United States Patent 10,760,088 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 2

SEQ ID NO: 1436 - DNA, 5400 bp, Amsonia hubrichtii
agcagctcccgcccaccctctcgctctggccatctccttccactcttactcgtacacagtaataaaaaactaagaggagtgctgggagaactcggagatgtccgtaaacacagtggcgggacaggtcccgcaactgctctactctaatgggcagttggcttcgagggacttggtgtttcttgattttgttggattgtgtagtaagtcttctaagagaactggccggagacttggagttgcgtcgtctactcggctgacacgtggtggtctgttgggaaagaattggtcttcgtcgtctattagagctgttcttgatcttgaacgcattggcactgtttctaagtcgtcttcctatgatttgaagccccaggttgcaaacttggaagatataatttctgaaagaggagcatgtggggttggatttattgccaatttggaaaataaagcatcgcatgaaattgttaaggatgctcttactgcccttggttgtatggaacaccgtgggggctgcggagcagataatgtttctggtgatggttctggagtaatgacatctattccttgggacctttttaatgattgggcagccaagcatgggattacagcctttgataaaatacacactggtgttggaatgatttttttccccaaagatgaagtactaatgaaagaagcgaaaacagcaattgtaaatatttttaaagaagagggtcttgaagtgcttggttggaggcctgttcctgttgatgcttccattgttggtttctatgccagagaaaccatacccaacatacaacaggtttttgtcaggattgtcaaagaagaaaatactgatgacattgaaagagaactatatatatgtcggaaattgattgaaaaagcagctaactgtgaaacatgggggagtgacctgtacttctgctcattgtccaaccaaactatagtttacaagggaatgctacgatcagaagttcttggcacattttatccggacctacaaaatgatctctataaatccccatttgctatttaccacaggagatacagtacaaataccagccctagatggcctctggctcaacccatgaggtttcttggccataatggagagatcaacactatacagggaaacttgaattggatgcaatctagggaaacttctctgaagtctcctgtttggcgtggtcgtgaaaatgaaattcgcccttttgggaacccgaaggcatcagattctgctaatcttgacagtgcagcagaaatcttgataagaagtggtcgtactcctgaggaagctttgatgattctggtcccagaggcatataaaaaccatccaacactgtcaataaagtaccctgaggctgttgatttttatgattactacaagggtcaaatggaagcctgggatggacctgccttactattgttcagtgatggaaaaactgttggagctacccttgatcgtaatggacttcgccctgctagatattggcggacaaaagacaacattgtctatgtcgcatctgaggttggtgttctgccaatggatgaatcaaaagtcacaatgaaagggcggttaggtcctggaatgatgatagctgttgatctaacaagtggtcaggtttttgagaacactgaagtcaaaaaacgagttgcattatcaaatccttatggaaagtgggtaaatgaaaatttaaggtcattgaagcctgcaaacttcctttctacaacagtcatggacaatgaagcaatattaagaagccagcaggcatatggatattcgagtgaggatgttcaaatggttattgaatctatggctgcacaaggaaaggagcctactttttgtatgggagatgatatacccctggcagcattatctcggaagccacacatgctatttgattacttcaagcaacgctttgctcaggttacaaatccagctattgatcctcttagagaaggactagttatgtctcttgaagtcaatcttggcaaacgtggcaacatacttgaagttgggcctgaaaatgcctctcaggtgattttgtcaagtcctgtactcaatgaaggagagctcgaggctttgcttaaagatccaatcttgaaacctcaagtcttacgcaccttcttcagcataaggagagggctagaaggttcattagagaagatgctaaacaagctctgtgaagcagctgacgaagccgttagaaatggatcccagttgctcattctctctgacagatctgatgaactggaaccgactcagccggcaatcccaatacttcttgctgtaggtgccgttcaccagcatctgattcagaatggtctacgaatgtctgcttctattgttgctgatactgctcagtgcttcagtactcaccattttgcatgtttaattggatatggtgcaagtgctgtgtgtccacatctggcacttgagacatgccgacaatggcgcttgagcactaaaactgtgaacctgatgaggaatggaaaaatgcctacagttacaattgaacaggctcaaaagaactattgcaaggcagttaagtctggccttctaaaaattctctccaaaatgggcatctcattgctttcaagttattgtggtgctcagatatttgagatttatggactgggaaaagaagttgttgacattgctttctgtgggagtaaatcaagtattggtggattaaccctggatgagttagcaagggagagtttatcattctgggtaaaggctttctcagaggatacagctaaacgactcgagaattttggatttatacaattcagaccaggaggagagtatcatggaaacaacccggagatgtcaaaattgctccacaaagctgtccgacaaaaaagtgaaagcgcatattctgtttatcagcagcatttggctacccgacctgtgaatgttcttcgagatcttctcgagttcaagagtgaccgatccccaatccccgtaggaagggttgagcctgcttcatctattgtgcagcgcttttgtacaggtggaatgtcacttggagctatttctagggaaactcatgaggcaattgcaattgcaatgaacagaataggtggaaagtcaaattcaggagaaggtggtgaggatccaattcgctggaagccactgactgatgttgttgatgggtattctccaacactcccacacctcaaaggtcttcaaaatggggatactgctactagtgccatcaaacaggttgcttctggtcgctttggtgtcacaccaacttttttagcaaatgctgatcaattggaaattaaaattgcacaaggtgcaaaacctggtgaaggtggccaattgccagggaagaaagttagtgcttacattgcacgattaaggaattcaaaacccggagttcctcttatttctcccccaccacaccatgatatctattctatcgaagatcttgctcaattaatttttgaccttcatcaggtcaaccccaaggctaaagtatccgtaaagcttgtagcagaagctggcattggcacagttgcttctggggttgcgaagggtaatgctgatattatacagatatcaggacatgatggaggaactggagctagccctataagttccattaagcatgcaggtggtccttgggaacttggtcttaccgaaacacaccagacgcttattgaaaatgggctcagagaaagggtcatacttagagttgatggcggctttaaaagtggaatggatgttctaatggctgctgcaatgggtgctgatgagtatggatttggttctgttgcaatgattgccactggttgtgtcatggctcgtatctgccacacaaataattgtccagttggtgttgctagtcagagagaagaactaagagctcgttttcctggtgtgcctggtgatcttgttaactacttcttatatgtggccgaggaggtaagaggcatgttggcgcaactgggttatgagaaactggatgatgttattgggcgcacagatctatttagaccccgagatgtatcattaatgaagactcaacatcttgatcttagttatattctttcgaatgttgggttaccaaagtggagcagcactgctatcaggaaccaggaagttcacagcaatggtcctgttctggatgataccttgctgtcagatcctgagatatcagatgcaattgagaatgaaaaggtggtaaataaaactgtaccaatctacaatgtggaccgtgctgtttgtggccgtattgcaggcatagttgcaaaaaaatatggggacactggttttgctgggcagctcaatattacattcacggggagtgctgggcaatcatttgcttgttttctcacccctggaatgaacattcggcttgtaggggaagcaaatgactatgtcggaaagggtatggctggtggtgaattggttgtgactcctgttgagaatactggattttgccctgaggaggccacaatagtaggaaatacctgtttgtatggggcaacaggtggtcaagtctttgttcgaggaaaagctggggagcgttttgctgtgagaaactcgcttgctgaagcagttgtagaaggcaccggagatcattgttgtgaatacatgactgggggttgtgttgtagtgcttggaaaggtgggtagaaatgtagctgctggaatgactggaggcttggcctacattctagatgaggatgacactcttattcccaaggttaacaaggaaatcgtgaagatccagagagttcttgctccagttggccagatgcagcttaagagtctcattgaagcccatgttgagaaaactgggagtaccaagggcgccaccattctgaatgaatgggacaaatatttgccactcttctggcagctggttccacctagcgaagaggacacaccagaggcttgtgctgagtacgagcaaacagccgccgggcaagtgactttacaatctgcatagatgacatcccagtatagccaacgattgaatatttttcagcagctgcaatcagggttccttcaaaaggttggattgtatagaagattgtgcgttctggaaatgagattgccagagatgaaagattaagaaaaggaaggtcatcctcttctaaaggcagaggccatgatctttatccagcaaccgatctttccaatgggtgtacagtgatggcgggtattacttcagattcttcactgaagttgtacgttacatttaacagatgttcatcacttaaaaaatcttacaatatgaaagcatggactgtaaatatgacttggaaagcttccttcctcctctctctttctatcttttcatctccattaatctgaaagtctcatacgcaacaagtacaataagttgtaaatctcattgaacatgaaatatacatcccaattttc

SEQ ID NO: 1437 - DNA, 5417 bp, Populus trichocarpa
gaggagcagtgtgtggttactggtgagtagaaggcaggggagagaagtgaagagaagaggcgcgggtggtaccggtcctttttcttcttttatccacctcttaataaaaccttcctcttttcttctccacacaacacacacccactctccgtcctctctcgctactcactcactctctctcatggcttctcttcaatcaccattaatctctccggttccgcaactcgtcaatgcaacaacaccgaactcagttaataagaacttattatttgttgattttgttggactctactgtaaatcgaagagaactagaaggaaaatcggagtttcttcttctttttcctcgagtttctctcgatttgctaacaaaaagaagtcctcctgtccagtcaacgccactctcagtgttgaccgtcgtaatatctcaccgccgtcttctcctcctcatcctcctcctgatttgaaaccgcaggtagcaaacttggaagatatattatcagaaagaggagcatgtggagttggatttatcgcgaatttggaaaacaagccgtcccatgcgattgtcaaggatgcacttacagctcttggctgcatggaacatcgtggaggttgtggagcagataatgactctggtgatggttcaggactaatgacttcgattccgtgggagctattcgataagtgggctgagagtgaagggattggttcttttgataaattgcatactggtgtcggaatgatttttttccctaaagatgataaccttatgaaagaagcaaaagaagtgattgtaaatatttttaaacaagagggccttgaggtgctcggatggaggcctgttcctgtaaatacatctgtagttggtttttacgcaaaagaaaccatgcccaacatagaacaagtatttgttagagttattaacgaagaggatgttgatgacattgaacgagaactgtatatctgccggaagctgattgaaagagcggcaaactcagaaagttggggaaatgagctttatttctgttctttgtctaatcgaacaattgtttataagggaatgcttcgttctgaagttcttaggctgttttattctgaccttcagaatgatatctacaaatcaccttttgccatttatcatagaaggtatagcacaaatactagtcccagatggcctcttgctcaacccatgcggtttcttggtcataatggagagatcaacaccatacagggtaacttgaactggatgcaatcacgagaaacctcattgaaatcttctgtttggcatggtcgagaaaatgaaatccgtccttatgggaacccaaaggcatcagactcagctaatcttgacagtgcagcagaattgttaataagaagtgggcgcactcctgagcacgcgttgatggttctcgtaccagaggcatacaagaatcatccaactttgaccatcaaatatcctgaggttgtagatttttatgattattacaagggtcagatggaagcttgggatggacctgctctactcttattcagtgatggaaagacagttggggcttgtcttgatcggaatggccttcgccctgctagatattggcggacagtcgacaattttgtctatgttgcatctgaggttggggttgtaccaatggatgaatcaaaagtaacgatgaaaggccgtctaggtcccggaatgatgataactgtagatttgcctggtggccaggtttatgagaatactgaagttaaaaagcgagtagcactgtcaaatccgtatggaaaatgggttcatgaaaacctgcgatccttgaagtctacaaacttcctctcagcaacagttatggacaatgaatcaattttaagatgccaacaggcattcggctactccagtgaggatgtccaaatggttattgagaatatggcttctcaagggaaggagcctacattttgcatgggggatgatattcctttggcaatattgtctcaaaaaccacacatgctttatgattatttcaaacaacggtttgcacaggttacaaatccagctatagacccactcagagaaggattagttatgtcacttgaaatcaacatcggaaagcgaggaaacatcttggaagatggaccagaaaatgcttcacaggttatcttgtctagtcctgtactaaatgaaggggagcttgagttattactgaaggatccctacttaaaacctcaagttttaccaaccttttttgatatacgtaaaggggttgagggttctttggagaaaacactgattaagctttgtgcggcagctgatgaagctgttagaaatggttcccaattgcttgttctctctgaccgatctgatgatctggaacccactcgacctgcaatcccaattcttcttgctgttggtgctgttcatcagcatcttattcagaatggcctgcgaatgtcaacttcaattgtagcagacactgctcagtgcttcagcactcatcattttgcctgtttgattggatatggtgccagtgctatatgcccgtacttggcactggaaacttgccggcaatggcgcttgagtaaaagaactgtgaatctgatgatgaatggaaagatgcctactgtaacaatcgaacaagctcaaaagaacttttgcaaggcagttaaatctggtcttctcaaaattctttctaagatgggcatctcattgctttcaagttattgtggtgcacagatatttgagatttatggattggggaaggaggttgttgatctagcattttgtggcagtgtttcaaatattggtggagtgacttttgatgagttggcgagggagactttgtccttctgggtgaaagctttctctgaggctacggccaaaagactggaaaattatggatttatacaattcagacctggaggggaatatcatggaaacaatccagagatgtcgaaattgcttcacaaagctgttcgccaaaagagtgaaaatgcattttctatttatcagcaacatttggctaaccggcctgtgaatgttcttcgtgatcttcttgaatttaaaagtgatcgtgctccaattcctgtgggaaaggttgaacctgccatatccatagttcaaaggttttgcactggggggatgtcacttggagccatttcaagagaaactcatgaagcaattgccattgctatgaacagattaggtggaaaatctaattcaggggaaggtggtgaggatccaattcgctggaccccactttctgatgttgttgatgggtactcccctacattgccgcatcttaaaggtcttcaaaatggtgatactgctaccagcgctatcaagcaggttgcttcaggacgttttggtgtcactccaacattcttggtcaatgctgttcagttagaaatcaaaatcgcacagggtgccaagcctggtgaaggtggccaattgcctgggaagaaagttagtgcatatattgcgaggctgagaaattctaaacctggggttccacttatatctccaccccctcaccatgacatttattccattgaagatcttgcccaattgatctatgaccttcatcaggtcaatcctaaggctaaggtatctgtaaagcttgtggcagaagcaggtattggcacagttgcatccggtgtagcgaagggtaatgctgatgttatacagatatcagggcatgatggtggaactggagctagccccataagttccattaagcatgccggtggtccttgggaacttggacttacagaaacccatcagactctcgttgcaaatgggcttagagaaagagtgatccttagggttgatgggggcttcaaaagcggagttgatgtcctgatggctgcggcaatgggtgctgacgagtatggatttggttctgtcgcaatgattgctacgggatgtgtaatggcccgcatttgtcacactaataattgccctgttggtgttgctagtcagagagaagaactacgcgcccggtttcctggtgtgcctggtgatcttgttaatttctttttatatgttgctgaggaggtaagaggcatgctggcacaactgggttatcagaagttggatgatatcattgggcatacagatttgttaagacaacgagatatttcccttgtcaaaactcagcatcttgatctcagttatattatgtcgagtgtaggattaccaaaactgagcagtactgatatcaggaaccaagatgtacactctaatggtcctgttttagatgatgttgttctagcagatccagagattctagatgctattgagaatgaaaaagttgtcaataaaaccataaaaatatacaatgtggaccgtgctgtttgtgggcgtatagcaggtgtggttgcaaagaaatatggtgacactggttttgctgggcagctgaacatcacgtttactgggagtgctgggcagtcgtttgcatgttttttgacacctggaatgaatattcgcctaataggagaggccaatgattacgtgggaaagggtatggctggaggagagttggtcgtaactcccgtggagaacactgggtttgttccggaggacgccaccattgtcgggaatacttgcttgtatggggctacgggcggtcaagtatttgtcagagggaaagctggggagcggtttgctgtgagaaactcacttgctgaagctgtagttgaaggcactggagaccattgttgtgagtacatgactggtggttgtgtggtggtacttggaaaagtgggtagaaatgtagctgctgggatgaccggaggtttggcgtacatgcttgatgaggatgacactttgatgcccaaggtaaataaagaaatagtgaaggtccaaagagtgactgctcctgttggccagatgcagctaaagagccttattgaagctcatgttgaaaaaaccggaagcggcaaaggcgctgctatcctgaaggagtgggacacatatctaccgctcttttggcagctagtaccacccagtgaagaagacaccccagaggcttgtgcatcattcgaggcaaccagtgctgggcaagtgacatcattccaatctgcataagctagcgatgctagaaaaccctcgaggccagccggaaaaacccgaattcgcaacctcaacctgtacatgtcaaatataagatgatgaattcttggcttggaattctccacaaatttatcggggaaacagaatgctttggtatccttggcgatgaagtttttgcgattgaagaaaggttatcatcacccaattgtatctgcaacccagacatccatcatccccattgttagagaaattctatagtgatttgtggcagaaaatgtaaaatcaagttcaaaatcttccactattgtcaagattctgatgttcaataataataataataataaaattgatttcatttccatga

SEQ ID NO: 1438 - DNA, 5643 bp, Vitis vinifera
agaagtagacgcgagagaggcgggtggttccgagcccctcgctcttttatcttcacatccattttcttccttctccacacgatcctcttattctatttctctctccgggttgttctctctccagaatcagccatgtctctccactctttctctcccacttctcagcttcttcactccaatgtctttcccgccgctcaatctccgccgccaacttcagtttttgccacgaacaagggcatcattctcgctgattttgttgggctgtactgtaaatcgcggcgtgcgcgcccgagaataggagtctccggccaccggagatttcacaaattctcggccggtaagtttggtacgatcaacgcggttctggatcttgatcgtatcaagaacgcggcggagcaatcgagttcacgctccgattcaaaacccaaggttgcaaacttggatgacataatatcagagagaggagcttgtggagttggattcattgctaatttggataacaaagcatcccatgaggttgtcaaggatgcccttgctgcccttagctgcatggaacatcgtgggggctgtggagctgataacgactctggagatggttcaggattgatgacttcaattccatgggatctatttaacaattgggccaaagagcaaaggattggttcctttgataggttgcatactggtgttggaatggtttttctccccaaagatgatgaccttatgaaagaagccaaaacagttattgataatagtttcaaacaagagggccttgaggtgctcggatggaggcctgttcctgtagatatttctatagttggttactatgctaaagaaaccatgccaaacatacagcaggtatttgttagagttgttaaggaagagaacatcgatgatattgaaagagaactatacatctgtaggaaattgattgaaagagcagtgaagtcagaaacttggggaaatgagctttatttctgttcgttatccaatcaaacaatagtttacaaaggaatgcttcgctcggaagttcttggaaacttttatttggaccttaagagtgatatttataaatcaccttttgccatttatcatcggaggtacagcacaaatactagtccaaggtggcctcttgcacaaccgatgaggttacttggtcataatggagagatcaataccatacaggggaatttgaactggatgcaatctcgagaggcctcattgaagtcgcctgtttggcgtggtcgagaaaatgaaattcgtccttttggtaacccaaaggcatctgactcggcaaatcttgatagcaccgcagaattgttgataagaagtggccgttctgctgaggagtctctaatgattctggtcccggaggcctacaaaaatcatccaactttgatgattaaatatcctgaggttgttgatttttataactattacaagggtcaaatggaagcttgggatggacctgccttgcttttattcagtgatggaaaaacagtcggagcttgtcttgatcggaatggtcttcgcccggctaggtattggcggacaatagacaatgttgtctatgttgcatctgaggttggtgttctaccgatggatgagtcaaaagttgtaatgaaaggccgtttgggtccaggaatgatgatatctgttgatctgacaagtggacaggtgtacgagaatacggaagtcaaaaaacaagtggccctgtcaaatccatatggaaagtgggtgaatgagaacatgcggtctctgagacctgtgaacttcctttcagctacagttatggacaatgaaggaattttaagacaccaacaggcatatggctactcaagtgaggatgtccaaatggttattgaaactatggctgcccaagcgaaggagcctacattttgtatgggagatgatattccattggcagtaatatctcagaggtctcacatgctttatgattattttaagcaacgctttgcacaggttacaaatccagctattgaccctctcagagagggattagttatgtctcttgaagtaaatattgggaagcgtgggaacatattggaggttggaccagagaatgcttctcaggttaatttgtctagtcctgtactgaatgaaggggagcttgagtcattgttgaaggatcctcacttaaaaccccgagtattaccaacattttttgacataagaaagggggttgagggttccctgcaaaagagactaaataagctttgtgaagctgctgatgaagctgttcgtaatggttcccaactccttgttctctctgaccgctctgatgaactggaaccaacccggcctggaattcctattcttcttgctgttggtgctgttcatcaacatcttattcaaaatgggttgcgaatgtcagcttcaattgtggccgacactgcccagtgcttcagtactcatcactttgcttgtttgattggatatggtgcaagtgctgtatgtccgtacttggcattggaaacatgccggcaatggcgtctgagtaataaaactgtgaatttgatgcggaatggaaaaatgcctactgttacaattgagcaggctcagaagaacttttgcaaggcagttcagtctggtcttctcaaaattctttcaaaaatgggtatctcattactttctagttattgtggggcccagatatttgagatttatggattaggaagggaggttgtcgatcttgcattttgtggaagtgtatctagtattggtggattgacccttgacgagcttgcaagggagactctatccttttgggtgaaggctttctctgaggatacagctaaaagactagaaaattttgggtttatacagttcagaccaggaggggaatatcatggaaacaaccctgaaatgtcgaagctgcttcacaaagctgttcgccagaaaagtgaaagtgcattttcggtttatcagcagcatttggctaatcggcctgtgaatgttcttcgtgatcttcttgagtttaaaagtgaccgttccccaattccattgggaaaagttgaacctgctgcttccattgttcaacggttctgcactggtgggatgtcacttggagctatttcaagagaaacccatgaagcaattgccattgcaatgaatagattaggtggaaaatctaactcaggagaaggtggtgaggatcctattcgctggagcccacttacagatgttgttgatgggtactctccaacactgccacatctcaaaggtcttcaaaatggggatactgctacaagtgctatcaagcaggttgcttctggtcgttttggtgtcacccccacattcttggccaatgctgaccagttagaaatcaaaattgcacaaggtgcaaagcctggcgaaggtggtcaattgcctgggaagaaagtcagtgcatacattgcaagattgagaaattcgaaacctggtgttccacttatatctccgcctccacaccatgatatttattctattgaggatcttgctcaattgatttttgatcttcatcaggtcaatccaaaggctaaggtatctgtaaagcttgttgcagaagctggaattggcacggttgcttctggggtcgctaagggtaatgctgatatcatacagatatcggggcatgatggtggaactggagccagtcccataagttccatcaagcatgctggtggtccttgggaacttggactttcagaatcacatcagacgctcattgaaaatggactcagagagagggtcattctcagagttgatggcggttttaaaagtggagttgatgtcatgatggctgcaacaatgggtgctgatgagtacgggtttgggtctgtggcaatgattgctactggatgtgttatggcccgcatttgccacactaacaattgcccagttggtgttgccagtcagagagaagaactccgtgcccgttttcctggtgtgcctggtgatcttgtgaacttctttttatatgtagctgaggaggttagaggcatattggcacaactgggctttgagaaacttgatgatgtaattggacgaacggatctattaagaccacgagatatctcattagtgaaaactcaacatcttgatctaagttacattctctcaaatgttggcttgccaaagtggagcagtactgagatcaggaatcaagatgtacattctaatggtcctgttttggatgatattatacttgcagatcctgagacatctgatgcaattgagaatgaaaaagtagtcaataaaagcataaagatatacaatgtggaccgtgctgtttgcgggcgtatagcaggtgtggttgcaaagaaatatggtgatactggttttgccgggcagctgaacataacattcacagggagtgctgggcagtcatttgcatgttttctgacacctggaatgaacattcgacttataggggaggctaatgactatgtgggaaagggtatggctggaggtgaattggttgtgactcctgttgaggatactgggtttctccccgaggatgcaactatagtaggaaatacttgcctatatggagcaacaggtggtcaaatctttgtcagagggaaaggtggggaacgatttgcagttagaaactcacttgctgaagcagtagtagaaggcactggagaccactgttgtgagtacatgaccgggggttgtgtggttgtacttggaaaggtgggtagaaatgtagctgctggaatgactggaggtctggcatacattcttgatgaggacgatactctcatccccaaggtaaataaggagattgtgaagatccagagagtgactgcccctgtggggcagatgcagctaaagagcctgattgaagcccatgttgaaaaaactggaagcagcaaaggctcagctattttgaaggagtgggatacatacctgcctctcttctggcaactggttcctcccagtgaggaagacaccccagaagctagcgcagagtttgagagaaccgatgctagccaggtgacgttgcagtcagcttaatacgataataagacaataccctgcagccagtgacatgatttcaaaagttgcactgcatggaaacatgtgagaactgggaagatggatattcttcagctggaaaatacaggttaaataatggggatatggcgaaatggctcaaatcacagggttacaaaaattgttaaagataattttcattgccttcagttggagaccctgatttgttcatatggaaaagcatttgcattcccactccagttgtgtatagaacagctgctagaaactgtaaatcttttaggaactttcatggaaattcctcactgttccattcgttaaagtaaaaaaaaaaaaaaaaaaattgctggatggccatttgaactattgttcttccattgattgctgtattcagggagaagtttgatcaatgaatcccttcaaatatgggatttggaatcaaataatggcatattttgcatggtaactcttttcatgcccaggtgtacgtacccgatacagtggcattcttgttattttatgaggagacaatacctaaatgtaaattaccaatgaatgcttaaatgtcccaaatttttattcagacgttattgtatttggagagaacaaagagctgcatagtta

SEQ ID NO: 1439 - DNA, 5025 bp, Prunus persica
cttcttcttcgttttcaataatggctttgcagtcattggctccgattcctcagctggttcactgctccaataatggccgctcgcccgccaagcctcttcggaacgggctcttcgtcgtcgatttcgtcgggctctactgtaaatcgaagcggacccgcaggaaattcggaacgtccgagcatcggtccttccctcaattcgtttccaggagctacccggtcaaagctgttcttgaccttggacgtagcgatgctgctttggatcaatcagctgcttctccttcttcggatttgaagccaaaggttgcagacttgcatgatattatagcagaaaggggagcttgtggagttggattcattgccaatttggaaaacaaagcatcccatgggattattgaagatgctctaacagctcttggctgcatggaacatcgagggggctgtggagcagataatgactctggtgatggttcaggattgatgagttcaatcccatgggatctatttgacaattgggctaacaagcaagggatttcttcctttgacaagttgcacactggtgttggaatggttttcctcccaaaagatgacgaccttatgaaagaagccaaaaaagttgttgtgaatatttttagacaagagggtcttgaagtgctcggatggagacctgttcctgtgaatgcttctgtagttggttactatgcaaaagaaacaatgcccaacatacaacaggtattcgtcaaagttgttaaagaggaaaatgttgaggacattgaacgagaactgtacatatgccggaagttaattgagaaagcagcaagctcagaaagttggggaaatgagctttatttctgttctttgtccaatcaaacaatagtttacaagggaatgctccgctcagaaattcttggtttattttattctgacctccaaagtgacctgtataaatccccttttgccatctatcatcggaggtatagcacaaataccactcccagatggccccttgcacaaccaatgaggttacttggtcacaatggagagattaataccatacagggaaacttgaactggatgcaatctcgtgaagcctcattgaaatcacctgtatggaatggtcgtgaaaatgaaattcggccatacggcaatccgaaggcatctgactctgcaaatcttgatagtgcagctgaattcttactgagaagtggccgcagtgctgaggaggctctaatgattcttgtcccagagggatacaaaaatcacccaactttgtcgataaaatatcctgaggtggttgatttttatgactattacaagggtcagatggagccttgggatggacctgctttactgttattcagtgatggaaaaacagttggggcctgtcttgatcgcaatggacttcgcccggctaggtattggcggacatctgataatgttgtatatgttgcctctgaggttggtgttctacctgtggatgattcaaaaattacaatgaaaggccgtctaggtcctggaatgatgatagctgctgatttaataagtggtcaggtttatgagaacacagaagttaaaaagcgagtggccttgtcacatccatatggaaagtgggtccaggaaaacatgcgatccttgaaagctgtgaacttcctttcaggcactgttgcagaaaatgatgcaatcctaaggcggcaacaggcatttggctactccagtgaggatgtccaaatggttattgagactatggcttcacaagggaaggagccaacattttgcatgggagatgatatcccattggcaatattatctcagaggccacatatgctttatgactatttcaagcaacggtttgcacaggttacaaatccagccattgatcctcttagagaaggtttggttatgtctcttgaagtcaacattggaaaaagacaaaatattttggaggttggacctgaaaatgcatcgcaggttatcttgtccagtcctgtgctgaatgaaggggaacttgacttgctgctaaaggatgctcagttgaaaccccaagttttacctacattttttgatatccataaaggggttgatggttccttggaaaagacactatataggctttgtgaagctgctgatgaagctgttcaaaatggatgccaattgcttgtgctctctgatcggtctgatgagctggaagcaactcgccctgcaattccaatccttctcgctgttggtgctgttcatcagcatcttattcaaaatggcttgcgaatgtcagcttctatcatagtggatactgctcagtgctttagcacgcatcagtttgcctgcttgattggatatggtgcaagtgctgtgtgcccatacttggcattggagacgtgtcggcaatggcgtctgagtactaaaacagtaaatttaatgcggaatgggaagatgcccactgtaacgattgaacaagctcaaaagaatttctgcaaggctgttaaggctggtcttcttaaaattctttccaaaatgggcatctcgttgctttcaagttattgcggtgcacagatatttgagatttatggattagggaaggaggttgttgatcttgcattttgtgggagtatatcaagtgttggtggattaacttttgatgagcttgcaagggagactttgtctttctgggtgaaggctttctctgaggatacggctaaaagacttgaaaattttggatttatacaattcagaccaggaggtgagtatcatggaaacaacccagagatgtcaaaactgctccacaaagctattcgccaaaaaaatgaaaatgctttttcagtttatcagcagcatttagctaaccggcctgtgaatgtgcttcgcgatctcgttgagttcaaaagtgatcgtgctccaattcctgtgggaaaggttgaacctgctgtatccattgttcaacggttctgcactggtgggatgtcacttggagctatttcaagagaaactcacgaggctatagccattgcaatgaatagaataggtggaaagtcaaattctggagaaggtggcgaggatcctattcgttggaaaccacttacagatgtcgttgatgggtactctccgacccttccacatctcaaaggtcttcaaaatggagatactgctacaagtgccatcaagcaggtggcttcaggacgttttggtgtcactccaaccttcttggtcaatgccgatcagctggaaatcaaaattgcacaaggtgcgaagcctggggaaggtggccaattgcctggtaaaaaagttagtgcatatattgcaaggttgagaaattctaaacctggggttccactcatatctccacctccacaccatgacatttattccatagaggatcttgcacaattgatctatgatcttcaccaggtgaacccaaaagctaaggtgtcagtaaagcttgtggcagaagctggaattggcactgttgcttctggtgttgcaaagggtaacgctgatgtcatacagatatcaggccatgatggtggaactggagccagtcctataagttccatcaagcatgctggtggtccctgggaactaggactcacagaaacacaccagacactcctttcaaatggacttagagaacgagtcattttaagagttgacggcggctttaaaagtggagttgatgtcctaatggctgcagcaatgggggccgatgaatatggatttggttctgtggcaatgattgctacgggatgtgttatggcacgcatttgccatacaaataattgtccagttggcgtagccagtcagagagaagaactgcgtgctcgatttcctggagttcctggtgatcttgtcaactttttcttatatgttgctgaggaggtaagaggtatgttggcacagttgggatatgagaagttagacgatataattgggaggacagatttacttaggccgcgagatatatctctagtgaaaacacaacatcttgatctcagttatcttctctcaaacgttggattaccaaaatggagcagtaccatgatcaggaatcaagatgttcacactaatggacctgttctagatgatattttactggcagatccagagatatcagatgcaattgagaatgaaaaggtggtctataagaccataaagatatacaatgttgaccgtgcagtttgtgggcgtatagcgggagtggttgccaaaaagtatggtgacactggttttgctgggcagctgaacataacctttacagggagtgctggacagtcatttgggtgcttcttgacacctgggatgaacattcggcttgttggagaggcaaacgattatgtcggaaagagtatttccggcggcgagttggttgtgactccagttgagaatactgggttttgccctgaggatgcaactattgtagggaatacctgcttgtatggagccactgggggtcaaatcttcattagagggaaagctggggaacgatttgctgtaagaaactcacttgcgcaagcagtggttgaaggcactggagaccactgttgtgaatacatgactggcggttgtgtagttatacttggaaaagtgggtagaaatgttgctgctggaatgactggaggtttggcatacattcttgatgaggacgatactttcatcccgaaggtaaatagggagattgtgaaaatccaaagagtgaatgctcctgtggggcagatgcagctgaagagccttattgaagcccatgttgaaaaaactggaagcagcaagggctcttcgatcctgaaggagtgggacaaatatttaccactgttttaccagctggttccacctagtgaagaagacactccagaggcatgtgcagactatgaacaaacagctgctgtcgatgtgactttacagtccactgcatagactaatattggcactgtacaatgaaacccaacataaaagacccagaagtttccaacctaccttgtatagatcgtagagaaacgtgactgttatactggaaaactcagtactaatatatgggattttg

SEQ ID NO: 1440 - DNA, 5297 bp, Vinca minor
aagtcgaacttgaaatcctctacaatctctcgtcttttatctccaaatccctctgttttctccacacattctccacacccaacccatcatctcctttcattctctagcagtaaaataatctaagaagagggactgtggtgggagagagagagagaaagacgatacagagaagaagaagaagatgtctgtaaacactgtggcgggacagttcgtcccgcaacttctctattcaaatgggcagttgggttcaagagatatgctttttcttgattttgttgggctttgtactaagtcttctaagtgctttactcgccggaaacttcgcctgacacgtggcggcttgctacctaaacattgttcgtctaataataatgttagagctgttctcgattttcaacgtattggctctgtttcgaagtcgtcttcttctattgatcttaaaccccaggttgcaaacttggaagacataattgctgaaaaaggagaatgtggagttggatttattgcaaatttggaaaacaaagcatcccatggaattgtcaaggatgctcttattgcccttggttgtatggaacatcgcgggggttgtggggcagataatgattctggtgatggttctggagttatgacatctattccttgggacctctttaatgattgggctgccctgaatgggattgctgcctttgataaattacacactggtgttggaatggtttttttccctaaagatgaagcactgatggaacaagcaaaaacagcaattgtgaatatttttaaagaagagggtcttgaagtgcttggttggaggcctgttcccgtggatacttctgttgttggttattatgccagagaaaccatgcccaatatagagcaggtctttgtccggattgtcaaagaagaaaatgttgatgacattgaaagagaattatacatttgccgaaaattgattgaaaggttggctagctctgaaacatgggggagtgagctgtacttttgctcattgtccaaccaaaccatagtttacaagggaatgttgcgatcagaagttcttggtagattttatttggacctacaaaatgatctctatcaatcgccattcgctatttaccacaggagattcagtacaaataccagccctaaatggcctctagctcaacccatgaggtttcttggtcataatggagaaatcaacactatacagggaaatttgaattggatgcaatctagagaagcctccctgaaatctcctgtttggcgaggtcgggaaaatgagattcgcccttttgggaactcgaaggcatcagactctgctaatcttgacagtgcagcagaattattgataagaagtggccgtgctcctgaggaagccttgatgattttggtcccagaggcatataagaaccatccaacattgtcgataaagtaccctgaggttgttgatttttatgattactacaaggggcaaatggaagcctgggatggacctgccttattattgttcagtgatggaaaaactgttggagctacccttgatcgtaatggactgcgccctgctagatattggcggactaaggacaacattgtctatgttgcatctgaggttggtgttctgccaatggatgagtcaaaagtcacaatgaaaggccggttgggtcctggaatgatgatagctgttgatctaactagtggtcaggtctttgaaaacactgaagttaaaaaacgcgttgcattatcatatccttatggaaagtgggtaaatgaaaatttacggtcattgaagcctgcaaactttctttctaccccggtcatggataacgaagtaattttacgacgccagcaggcatatggatattcgagtgaggatgttcaaatgattattgaatctatggcttcacaaggaaaggagcctactttttgtatgggagatgatatacctctggcagcattgtcccagaagccgcacatgctatttgattacttcaagcaacggtttgctcaggttactaatccagctatcgatcctctcagagaaggactagttatgtctcttgaagtcaatattggcaagcggcgcaatatacttgaagttggacctgaaaatgcctctcaggtgtttttgtcaagtcctgtactcaatgaaggagagctcgagtccttgctcaaagatccaatcttgaaacctaaagtattacgaaccttttttgacataaagaaaggggttgaaggttccttagagaagacactaaacaaactctgtgaagcagctgatgaagctgttagagctggatcgcagttgcttattctctctgacagatctgatgagccggagcctactcagccagcaatcccaatacttcttgccgtaggtgctgttcaccagcatctgattcagaatggtctacgaatgtcagcttctattgttgctgatactgctcagtgcttcagtactcaccattttgcttgtttaattggatatggtgcaagtgccgtgtgcccatatttggcactggagacatcccgacaatggcgcttgagcaataaaactgtgaacctgatgaggaatggaaaaatgcctaccgttacaattgaacaagctcaaaagaactattgcaaggcagttaaatctggccttctgaaaatcctttccaaaatgggcatctcattgctctcaagttactgtggtgctcagatatttgaaatttatggtctgggaaaagatgttgttgacatcgcattctgtgggagtaaatcaagtattggtggtttaacgctggacgagttagcaagggagactttgtcattctgggtaaaggctttctctgaggatacagctaaaagactcgaaaattttggatttatacaattcagaccaggaggggagtatcatagcaacaatccggagatgtcgaaattgctccacaaagctgtccgagaaaaaagtgaaaatgcgtattctgtttatcagcagcatttggctacccggcctgtgaatgttctccgtgatcttcttgagttcaaaagtgaccgatccccgatcccagtaggaagggtcgagcctgcttcatctattgtgaagcgtttttgtaccggtgggatgtcccttggagctatttctagggaaactcatgaggcaattgcaattgcaatgaatagaattggtgggaaatcaaattcaggagaaggtggtgaggacccaatacgttggaagccactaactgatgttgttgatgggtattctccaacactgccacaccttaaaggtctccaaaatggggatactgctacaagcgccatcaagcaggttgcttctggtcgctttggagtcacaccaacgtttttagcaaatgctgatcaattggaaattaaaatcgcacaaggtgcaaaacctggtgaagggggccaattgcccgggaagaaagttagtgcttacattgcacgactgaggaattcaaaacctggagttcctcttatttctccccctccacatcacgatatctattctattgaagatcttgcgcagttgatttttgaccttcatcaggtcaatcccaaggcaaaagtttctgtcaaacttgtcgcagaagctggcattggcactgtggcttctggggttgctaaggctaatgctgatattatacagatatcaggacatgatggaggaactggagccagccctgtaagttccattaagcatgcaggtggcccttgggaactggggcttactgaaactcatcagacgctaattgaaaatgggctcagagaaagggtcatactcagagttgatggcggcttcaaaagtggaatggatgttctgatagctgcagctatgggcggtgatgagtatggattcggttcgattgcaatgattgccactggttgtgtcatggctcgtatctgccacacaaacaattgtccagttggtgttgccagtcagagagaagaactaagagctcgtttccctggtgttcctggtgatcttgttaactacttcttatatgttgctgaggaggtaagaggcatgttggcgcaactgggttttgagaaactggatgatattattgggcgcacagatctgttaagaccccgggacatatcattggtgaagacacagcatcttgatcttagttatattctttcgaatgttggtttaccaaagtggagcagcaccactatcaggcaccaggaggtccacagcaatggtcctgttctggatgatacattgctgtcagatccagagatatcagatgcaattgagaatgagaaggtggtaaacaaaactgtaccaatctacaatgtcgatcgtgctgtttgtggccgtgtcgctggtgtaattgctaagaaatatggggacagtgggtttgctgggcagctcaatataacattcactgggagtgctgggcagtcatttgcgtgttttctcacccctggaatgaacatcaggcttgtaggagaagcaaatgactatgtggggaagggtatggctggtggtgaagtggttgtgactcctgttgacaatactggattttgcccggaggacgccacaatagtaggaaatacctgcttgtatggggcgacaggtggtcagatatttgttcgaggaaaagctggggaacgttttgctgtaagaaactcgctcgctgaagctgttgtagaaggcactggagatcattgttgtgaatacatgactgggggttgtgtggtggtgcttggaaaggttggtagaaatgtagctgccggaatgaccggaggtttagcctacattctagatgaggatgatagttttattcccaaggtgaacaaggaaatcgtgaaaatccagagagttcttgctccggttggccagatgcagcttaagaatctcattcaggcccatgttgagaaaaccgggagtaacaagggcgctaccattctaaacgattgggataaatatttgccactcttctggcaattggttcccccgagcgaagaggacacaccagaggcttgtgccgagtatgaagaaacagccgctggacaagtgacgacgactctacaatctgcataaaagaggacatcccggcttaagctcagtgatcgtcccttgaaaggtagaattgtatagaagattctttgtatgttccgcaaatgacattgccacaggcgatatagataggttgcgaaaaaatggaagatcatcccagagaggctcgtgatcgtttttttcgtgccataaatctatcaaaaaatgcgtacattttgggtgtacagttagtgctggtggtgtgtgtacttgagattctggatgatggtttttt

SEQ ID NO: 1441 - DNA, 5285 bp, Ricinus communis
atggctctgcaaacgacggcgtcttcgtcggcgtcgtcctctcagcttcttctaaactcagctagtagtagttccattgcaaaggcaccgtgttcggttcttgcttatactaataaatttaacagtaacaatcacttctttgttgatttcgttggattatactgtcaatccaaacgaagaagtaggagaattggagtctcatcctcgtcttgtgattctaattcatcgattcagcggaacagtttctctcgatttgttaactccactgttcgttctcagtcgcttcctctacctgatctcaaaccaaaggttgctaacttggatgacataatatcagaaagaggtgcttgtggagttggatttattgctaatttggaaaacaaagcatcacacgaggttgtgaaggatgcccttacagctcttggctgcatggaacatcgtggtggttgtggagcagacaatgattctggtgatggatcaggactgatgacttcaattccatgggatctatttaataattgggctgacaagcaagggattgcttcctttgataagttgcataccggtgttgggatggttttccttccgaaggatgataatcttatgaaagaagctaagcaagttgttgaaaatgtttttaaacaagagggccttgaggtgcttggatggaggcctgttcctgtaaataaatcgatagtaggtttttatgcaaaagagacaatgcccaacatacagcaggtctttgttagaattgtgaaggacgaaagtgttgatgacattgaacgggaattctacatatgtcggaagctgattgaaagggcagcaacttcggaaagatggggcaatgagctttacatatgttctttgtctaatcaaacaattgtttataagggaatgcttcgctcagaagttcttggtttattttattctgaccttcagagtgatctttataaatcaccttttgccatttatcatcgaagatatagtacaaatactagtccaaggtggcctctcgctcagccaatgcggcttcttggtcataatggagaaatcaataccatacagggtaacttgaactggatgcaatctcgagaaagctcattaaaatctcctgtctggcgtggccgtgaaaatgaaattcgtccttttggtaacccaaaagcatcagattctgcaaatcttgatagtgcagcagaattgttaataagaagtggtcgcaatcctgaggaggctctgatgattcttgtcccagaggcatacaagaatcatccaaccctaacaataaaatatcctgaggttgttgacttttacgactattacaaaggtcaaatggaaacttgggatgggcctgctttactcttattcagtgatgggaagacagttggcgcttgtcttgatcgtaatggacttcgtccggctaggtattggcggacagtagacaattttgtctatgttgcatctgaggttggtgttttaccaatggatgaatccaaagtaacgatgaaaggccgcctaggcccaggaatgatgatagctgtggatttgcttggtggtcaggtttatgagaatactgaagttaaaaagcgagtagctttatcaaatccatacgggaaatgggtcagtgaaaatctacgatccttaaagcctgcaaacttcctctcgactacagatttggacaatgaagcaattttacggcgccagcagtcttttggctactccagcgaggatgtccaaatggttattgaatctatggctgcacaaggaaaggagcctacattttgcatgggagatgacattccattggcaatattgtctcaaaggccgcatatgctttatgattattttaaacaacgattcgcacaggttacaaatccagctatagaccctcttagggaaggattagtcatgtctcttgaagtcaacattgggaagcgaggaaacatattggaagttggacctgaaaatgctatgcaggttaacttatctagtcctgtattgaatgaaggagagctggagtcattgcttaaggatcctcatttaaaacctcaagttctgccaaccttttttgatatacgtaaaggggttgagggtactttagagaaaacactactcaggctttgtgaaaaggctgatgaagctgttcgaaatggctcccaactgcttgttctttctgatcggtctgatgatctggagcccactcggcctgcaattccaatacttcttgcggttggtgctgttcatcagcatcttattcagaatggcttgagaatgtctacttcaatcatagcagacactgctcagtgcttcagcactcatcactttgcctgtttaattggatatggtgcaagtgctgtatgtccatacttggcattggaaacttgtcggcagtggcgtctgagcaataaaactgtgaatttgatgcggaatggaaagatgcctactgtaacaattgaacaagctcagaagaacttctgtaaggcagttaaagccggtctcctaaaaatcctttcaaagatgggcatctcattgctttcaagttattgtggtgcccagatctttgagatttatggattgggaaaggaggttgttgatctagcattctgtgggagcaagtcaactattggtggagcaactcttgatgagttggcaagggagactctgtctttctgggtgaaagctttctctgaggatacagctaaaagacttgaaaattttgggtttatacaattccgacctggaggggagtatcatggaaataacccagagatgtcaaaactgcttcacaaggctgttcggcaaaagaatgaaagtgcattttctatttatcagcaacatttagctaaccggcctgtgaatgttctgcgtgatcttgttgaattcaagagtgatcgtgctccaatttctgtgggaaaggttgaacctgcatcatctattgttgaacgattttgtactggtggaatgtcacttggggctatttcaagagaaactcatgaggcaattgccattgcaatgaacagattaggtggaaaatctaattcaggagaaggtggcgaggatccaattcgttggagcccactttcagatgtcactgatgggtattctcctacattaccacatctcaaaggccttcaaaatggtgatactgctaccagtgctattaagcaggttgcttcaggacgttttggtgtcaccccaacgttcttggtcaatgcagatcagttagaaattaagattgcgcaaggtgccaagcctggcgaaggtggccaattgcctgggaagaaagttagtgcatatattgctaggttgagaaactctaaacctggggttccacttatatctccacccccacaccatgacatttactccattgaagatcttgcacaactaatatatgaccttcatcaggtcaaccctaaggctaaggtatctgtaaagctagtggcagaagctggtattgggacagttgcttctggggttgcaaagggtaatgctgatatcatacagatatcagggcatgatggtggaacaggtgcaagccctataagctccattaagcatgctggtggtccttgggaacttggacttacagaatctcatcagactcttatcgaaaatggactcagagagagggtaattcttagagttgatggtggcttcaaaagtggggttgatgtcatgatggctgcagcaatgggtgctgatgaatatgggtttggttctgttgcgatgattgctactggatgcgttatggctcgcatttgtcacacaaacaattgtcctgttggtgttgccagtcagagagaagaactacgcgcacggtttcctggtgtgcctggagatcttgtgaattactttctgtatgttgccgaggaggtaagaggcatgcttgcacaattgggttaccagaagttggatgatattattggaagaacagatttgttgagagcacgagatatttctctaatgaaaactcagcaccttgatctcagttatattctttcaaatgttgggttaccaaaatggagcagcactgagatcaggaatcaagatgtacatagcaacggtcctgttttggatgatgttatactagcagatccacagatcttggatgccattgagaatgaaaaaattgtcaataaaactataaagatatacaatgtggaccgtgctgtttgtgggcgtatagcaggtgtggttgctaaaaaatatgggtacactggttttgccggacagctgaacataacatttactggaagtgcagggcagtcttttgcatgctttttgacacctggaatgaacattcggctggtcggagaggctaatgattatgtgggaaagggtatggctggaggtgaggtggttgtaatgccggtggagaaccctgggttttgccctgaggatgcaactatagttggcaatacttgcttgtatggagcaacaggtggccaagtatttgttagagggaaagctggggagcgctttgccgtcagaaactcacttgcggaagctgtagttgaaggcactggggaccattgttgtgaatatatgactggtggttgtgtggttgtgcttggaaaagttggtagaaatgttgctgctggaatgactggaggcttggcttacattcttgatgaggatgatactctgatgcccaaggtgaataaagaaatagtgagggcccaacgagtaactgcccctgttggtcagatgcagctaaagagtctcattcaagctcatgttgaaaaaactgggagcggtaaaggtgctgctattctgaaggagtgggacaactatctgccgcgcttctggcagttggttccacctagtgaagaagacaccccagaggcttgtgcagattatcaggccacggttgctggggaagtactgcagtctgcttagcatagcaatgcaaggctcccccacagccaggtgcgattggctaccacaacctgtacatgtcaaatagatgatgatggattcttaaacgggaatacatcggtagttgatcggaatccagaatgctttaatctccagttcaagggtctcgaaattaaaagatcagcatccacccccctccagagtcggacacccagatccatcattccacaaggatccaacttcccaggtgttgcatgaatttgtatagtgatttgtggcggaaaatgtgaagtcaatttcgttccagatttttccatcgtatgaaattttaaacatcgctgtttaattaaaataaaaaaccccttctgtggctggttaagtttttctaatctaatttattttaatgg

SEQ ID NO: 1442 - DNA, 5287 bp, Ricinus communis
tcatggctctgcaaacgacggcgtcttcgtcggcgtcgtcctctcagcttcttctaaactcagctagtagtagttccattgcaaaggcaccgtgttcggttcttgcttatactaataaatttaacagtaacaatcacttctttgttgatttcgttggattatactgtcaatccaaacgaagaagtaggagaattggagtctcatcctcgtcttgtgattctaattcatcgattcagcggaacagtttctctcgatttgttaactccactgttcgttctcagtcgcttcctctacctgatctcaaaccaaaggttgctaacttggatgacataatatcagaaagaggtgcttgtggagttggatttattgctaatttggaaaacaaagcatcacacgaggttgtgaaggatgcccttacagctcttggctgcatggaacatcgtggtggttgtggagcagacaatgattctggtgatggatcaggactgatgacttcaattccatgggatctatttaataattgggctgacaagcaagggattgcttcctttgataagttgcataccggtgttgggatggttttccttccgaaggatgataatcttatgaaagaagctaagcaagttgttgaaaatgtttttaaacaagagggccttgaggtgcttggatggaggcctgttcctgtaaataaatcgatagtaggtttttatgcaaaagagacaatgcccaacatacagcaggtctttgttagaattgtgaaggacgaaagtgttgatgacattgaacgggaattctacatatgtcggaagctgattgaaagggcagcaacttcggaaagatggggcaatgagctttacatatgttctttgtctaatcaaacaattgtttataagggaatgcttcgctcagaagttcttggtttattttattctgaccttcagagtgatctttataaatcaccttttgccatttatcatcgaagatatagtacaaatactagtccaaggtggcctctcgctcagccaatgcggcttcttggtcataatggagaaatcaataccatacagggtaacttgaactggatgcaatctcgagaaagctcattaaaatctcctgtctggcgtggccgtgaaaatgaaattcgtccttttggtaacccaaaagcatcagattctgcaaatcttgatagtgcagcagaattgttaataagaagtggtcgcaatcctgaggaggctctgatgattcttgtcccagaggcatacaagaatcatccaaccctaacaataaaatatcctgaggttgttgacttttacgactattacaaaggtcaaatggaaacttgggatgggcctgctttactcttattcagtgatgggaagacagttggcgcttgtcttgatcgtaatggacttcgtccggctaggtattggcggacagtagacaattttgtctatgttgcatctgaggttggtgttttaccaatggatgaatccaaagtaacgatgaaaggccgcctaggcccaggaatgatgatagctgtggatttgcttggtggtcaggtttatgagaatactgaagttaaaaagcgagtagctttatcaaatccatacgggaaatgggtcagtgaaaatctacgatccttaaagcctgcaaacttcctctcgactacagatttggacaatgaagcaattttacggcgccagcagtcttttggctactccagcgaggatgtccaaatggttattgaatctatggctgcacaaggaaaggagcctacattttgcatgggagatgacattccattggcaatattgtctcaaaggccgcatatgctttatgattattttaaacaacgattcgcacaggttacaaatccagctatagaccctcttagggaaggattagtcatgtctcttgaagtcaacattgggaagcgaggaaacatattggaagttggacctgaaaatgctatgcaggttaacttatctagtcctgtattgaatgaaggagagctggagtcattgcttaaggatcctcatttaaaacctcaagttctgccaaccttttttgatatacgtaaaggggttgagggtactttagagaaaacactactcaggctttgtgaaaaggctgatgaagctgttcgaaatggctcccaactgcttgttctttctgatcggtctgatgatctggagcccactcggcctgcaattccaatacttcttgcggttggtgctgttcatcagcatcttattcagaatggcttgagaatgtctacttcaatcatagcagacactgctcagtgcttcagcactcatcactttgcctgtttaattggatatggtgcaagtgctgtatgtccatacttggcattggaaacttgtcggcagtggcgtctgagcaataaaactgtgaatttgatgcggaatggaaagatgcctactgtaacaattgaacaagctcagaagaacttctgtaaggcagttaaagccggtctcctaaaaatcctttcaaagatgggcatctcattgctttcaagttattgtggtgcccagatctttgagatttatggattgggaaaggaggttgttgatctagcattctgtgggagcaagtcaactattggtggagcaactcttgatgagttggcaagggagactctgtctttctgggtgaaagctttctctgaggatacagctaaaagacttgaaaattttgggtttatacaattccgacctggaggggagtatcatggaaataacccagagatgtcaaaactgcttcacaaggctgttcggcaaaagaatgaaagtgcattttctatttatcagcaacatttagctaaccggcctgtgaatgttctgcgtgatcttgttgaattcaagagtgatcgtgctccaatttctgtgggaaaggttgaacctgcatcatctattgttgaacgattttgtactggtggaatgtcacttggggctatttcaagagaaactcatgaggcaattgccattgcaatgaacagattaggtggaaaatctaattcaggagaaggtggcgaggatccaattcgttggagcccactttcagatgtcactgatgggtattctcctacattaccacatctcaaaggccttcaaaatggtgatactgctaccagtgctattaagcaggttgcttcaggacgttttggtgtcaccccaacgttcttggtcaatgcagatcagttagaaattaagattgcgcaaggtgccaagcctggcgaaggtggccaattgcctgggaagaaagttagtgcatatattgctaggttgagaaactctaaacctggggttccacttatatctccacccccacaccatgacatttactccattgaagatcttgcacaactaatatatgaccttcatcaggtcaaccctaaggctaaggtatctgtaaagctagtggcagaagctggtattgggacagttgcttctggggttgcaaagggtaatgctgatatcatacagatatcagggcatgatggtggaacaggtgcaagccctataagctccattaagcatgctggtggtccttgggaacttggacttacagaatctcatcagactcttatcgaaaatggactcagagagagggtaattcttagagttgatggtggcttcaaaagtggggttgatgtcatgatggctgcagcaatgggtgctgatgaatatgggtttggttctgttgcgatgattgctactggatgcgttatggctcgcatttgtcacacaaacaattgtcctgttggtgttgccagtcagagagaagaactacgcgcacggtttcctggtgtgcctggagatcttgtgaattactttctgtatgttgccgaggaggtaagaggcatgcttgcacaattgggttaccagaagttggatgatattattggaagaacagatttgttgagagcacgagatatttctctaatgaaaactcagcaccttgatctcagttatattctttcaaatgttgggttaccaaaatggagcagcactgagatcaggaatcaagatgtacatagcaacggtcctgttttggatgatgttatactagcagatccacagatcttggatgccattgagaatgaaaaaattgtcaataaaactataaagatatacaatgtggaccgtgctgtttgtgggcgtatagcaggtgtggttgctaaaaaatatgggtacactggttttgccggacagctgaacataacatttactggaagtgcagggcagtcttttgcatgctttttgacacctggaatgaacattcggctggtcggagaggctaatgattatgtgggaaagggtatggctggaggtgaggtggttgtaatgccggtggagaaccctgggttttgccctgaggatgcaactatagttggcaatacttgcttgtatggagcaacaggtggccaagtatttgttagagggaaagctggggagcgctttgccgtcagaaactcacttgcggaagctgtagttgaaggcactggggaccattgttgtgaatatatgactggtggttgtgtggttgtgcttggaaaagttggtagaaatgttgctgctggaatgactggaggcttggcttacattcttgatgaggatgatactctgatgcccaaggtgaataaagaaatagtgagggcccaacgagtaactgcccctgttggtcagatgcagctaaagagtctcattcaagctcatgttgaaaaaactgggagcggtaaaggtgctgctattctgaaggagtgggacaactatctgccgcgcttctggcagttggttccacctagtgaagaagacaccccagaggcttgtgcagattatcaggccacggttgctggggaagtactgcagtctgcttagcatagcaatgcaaggctcccccacagccaggtgcgattggctaccacaacctgtacatgtcaaatagatgatgatggattcttaaacgggaatacatcggtagttgatcggaatccagaatgctttaatctccagttcaagggtctcgaaattaaaagatcagcatccacccccctccagagtcggacacccagatccatcattccacaaggatccaacttcccaggtgttgcatgaatttgtatagtgatttgtggcggaaaatgtgaagtcaatttcgttccagatttttccatcgtatgaaattttaaacatcgctgtttaattaaaataaaaaaccccttctgtggctggttaagtttttctaatctaatttattttaatgg

SEQ ID NO: 1443 - DNA, 5228 bp, Fragaria vesca
ctctctctctctctcagcaccaatggcggcgttgcagtcctcgtcactcggtcctcccattcctcctcagctgcttcactactccaatggctttcgctcctccccttttctcgtcgatttcgtcggctactgcaaatcaaagaggacccgccgtaaacatttcggaggagctctacggtcaaccttcccccattctgtttccaaagccgttcttcatcttcctccacccgatcactcatctccttctcctacctccaagccccaggttgcggacttgaaagaaataatatcagaaagaggagcctgtggagtcggattcattgccaatttggacaacaaggcatctcatgacattgttaaggatgctcttacagctcttggctgcatggaacatcgtggtggctgtggagcagataatgagtctggtgatggtgcaggattgatgagttcaatcccatgggatctgtttaacaattgggctgacaagcaagggattgcatcatttgacaagttacacactggtgtcggaatggttttcctccccaaagaggacaaccttatgaaagaagccaaaaaagctattgtaaatattttcaaacaagaaggtcttgaagtgcttggatggagacctgttcccgtgaatacagctatagttggtttcaatgcaaaagaaacaatgcccagcattcaacaggtattcgtcaaagttgttaaagaggaaaaagttgaggacattgagcgagaactgtacatctgccggaagttgatcgaaagagcagcaatctcagaaagttggggcagtgatctttatttctgttctttgtccaatcaaacaatagtttacaaaggaatgctacgctcagaagctcttggtttattttattctgacctccaaagtgatctctataaatcttctttcgccatctatcatcgaaggtatagcacaaataccactcccagatggccccttgcacaaccaatgaggttacttggtcacaacggagagatcaataccatacaggggaacttgaactggatgcaatcacgtgaatcctcactgaagtcgcctgtatggcatggtcgtgaaaatgaaattcgtccatatggaaatccaaagggttcagactctgcgaatcttgacagtgcagcagaattcttactaagaagtggccgcactgctgaggaggctctgatgattcttgtccctgagggatacaaaaatcacccaactttgatgattaactatccggaggtggttgatttttatgattattacaagggtcagatggaggcttgggatggacctgctttattgttattcagtgatggaaaaacagttggggcatgtcttgatcgtaatggacttcggcctgctagatattggcggacatctgataatgttgtttatgtagcatctgaggttggggttcttcctgtggatgattcaaaagttacaatgaaaggtcgtctaggtcctggaatgatgatatctgttgacttactaagtggtcaggtttatgagaatacagaagttaagaagcgagtagctttgtcaaatccatatggaacatgggtgcaggaaaacatgcggaccttgaaggctgtgaacttcctttcatccacaattgcggacaatgatgcaatactgagacggcaacaggcatttggctactcgagtgaggatgtccaaatggttattgagacaatggcttcacaagggaaggagcctacattttgcatgggtgatgacattccattggcaattttatcccagagaccacatatgctatatgactatttcaagcaacgatttgcacaggttacgaatccagccattgatcctctaagagaagggttagttatgtctcttgaagtcaacattggaaagcgtcgaaatattttggaggttggacctgaaaatgcattgcaggttatcctgtccagtcctgtgctcaatgaaggagaacttgagtcattgcttaatgatgctcaactaaaaccccatgttttacctacattttttgatattcataaaggggttgatggttctttggaaaaagccctgtataggctttgtgaagctgctgatgatgctgttcaaaatggttgccaattgcttgttctgtctgatcgatctgatgagttggaagctactcatcctgcaattccgatccttcttgccgttggtgctgttcatcagcatcttattcaaaatgggttgagaatgtcagcttctataatagtggatactgctcagtgctttagcactcatcaatttgcctgcttgattggatacggtgcaagtggcgtgtgtccatacttggcactggagacatgtcggcagtggcgtttgagtaataaaacggttaatctaatgcggaacggaaagatgcctagtgtaacgattgaacaggctcaaaagaacttctgcaaggctgttagggctggtcttctcaaaattctttccaaaatgggtatctcattgctttcaagttattgcggtgcacagatttttgagatttatggattgggaaagggggttgttgatcttgcattttgtgggagtatatcaagtatcggtggattaacttttgatgagctggcaagggagactttgtccttctgggtgaaggctttctctgaggatacagctaaacgactggaaaattttggatttatacaattcagaccaggaggggagtatcatggaaacaacccagagatgtcaaagctgctacacaaagctgtccgccagaagaatgaaagtgccttttctgtttatcagcagcatttagctaaccggcctgtgaatgttcttcgtgatctcattgagttcaaaagcgaccgtgctcctattcctgttggaaaggttgaacctgctgtatccattgttcaacgattctgcactggtgggatgtcacttggagctatttccagagaaactcatgaggctatagccattgcaatgaacagaataggtggaaagtccaattctggagaaggtggtgaggatccaattcgctggaaaccactagcagatgttgttgatgggtactcaccaacccttccacatctgaaaggtcttcaaaatggagatactgctacaagtgctatcaagcaggttgcttcaggacgttttggagtcactccaacattcttggtcaatgctgatcagctggaaatcaaaattgcacaaggggcaaagcctggtgaaggtggacaactgcctggtaaaaaagttagtgcatacattgcgaggttgagaaactcaaaacctggggttccacttatatctccacctccacaccatgacatttattctatagaggatcttgcccaattgatctatgaccttcatcaggtgaaccctaaagctaaggtatcagtgaaacttgtggctgaagctggaataggcactgttgcttctggggtcgcaaagggtaatgctgatgtcatacagatatcagggcatgatggtggaactggtgccagtcctataagttccattaagcatgctggtggaccctgggaacttggactcacagagacgcaccagacactcatagaaaatggacttagagaacgagtcattcttagagttgatggtggctttaaaagcggagttgatgtcctaatggctgcaactatgggtgctgatgagtacgggtttggttctgtggcaatgattgctacaggttgtgttatggcccgcatttgccatacgaataactgccctgttggtgtagccagccagagagaggaacttcgtgctcgatttcctggggtgcctggtgatcttgtcaacttttttttatatgttgccgaggaggttagaggcatgttggcacagttaggatatgagaagttagatgatataattggacggacagatttgtttagaccacgagatatatctctagtgaaaacgcagcatcttgatctcggttatattctatcaaatgtcgggttaccaaaatggaccagtaccatgatcaggaatcaggatgttcacactaatggtcctgttctggatgatatattgctagcagatccagagatatcagaagcaattgagaatgaaaaaatggttcagaagaccataaagatatacaatgtggatcgtgctgtttgtgggcgtatagcaggggtggttgcaaaaaagtacggtgacactggttttgccgggcagctgaacataacctttacagggagcgctgggcaatcatttgggtgtttcttgactcctgggatgaacattcgacttgttggagaggcaaatgattatgtgggaaagagtatttctgggggagaattggttgtcactccagcagagaatacaggattttgccccgaggatgcaactattgtagggaatacctgcttgtatggtgccactgggggccaaatctttgttagagggaaagctggagagcgatttgctgtaagaaactctcttgcgcaagcagtggtggaaggcactggagaccactgttgtgaatacatgactggtggctgtgtagttgtacttggaaaagtgggtagaaatgttgctgctggaatgactggaggtctggcatactttcttgatgaggacgattctttcatccccaaggtaaatagagagatcgtgaagatccaaagagtgaatgctcctgtggggcagatgcagctaaagagccttattgaagcccatgttgaaaaaactggtagcggcaagggctatgttattctggaagagtgggacaagtacttgccactcttctggcagctggttcccccgagtgaagaagacactcctgaggcgtgtgcagactatgagaaatcagctgctgatgaagtgactctgcagtctgcttagagtaatgtcggtacagtgatttgagttggataggaaatctgaaaactccaactcaccatgtatatatcatgaaagaaacataatcgttacattggaagaccctgtgctaattactgggatatgggagagggcctcagcagagttggtcacctttgtagaagaggaacactatgccccccgaagactagtgcatctgtataggtgagtgattgtggcctaaattgcaaattcaagcttgttcatcatgtccattccaaagaaagcttgatgttgaaaattcaggcatggtgtaattattatcaaccttggttaatttctagtaacggaaggaaattgacaaatttagtgaaaaattacctaattcaaagtt

SEQ ID NO: 1444 - DNA, 5296 bp, Glycine max
cacacactctcatcttctctctctctctctctcgatgatggcgctgcactccgtgccttccgtttcgcacgtgctgcgcctcgccgagccattcccttccctccacaacgctcacgtgcttctcgacctcgcgcctctccgccgcaaacctaagcgccgcactcgcagactcacggcgtttccctcgccgtcgtcttcgccgctccgtcattccgccgtcaaagccgttctccacctcgaccgctccaccgacaacaaccgcctccataattcctctgcttcgtcttcttccgattccaaaccgcaggttgcaaacttggaggacatattatcagagagaggagcctgtggggttggattcattgccaatttggagaataagggatcacatgagattgtcaaggatgctttaaatgctttaagttgtatggaacatcgtggtggctgtggagcagataatgactctggcgatggttcagggctgatgactggagttccatgggaactatttgacaattgggccaacacgcaagggattgcttcctttgataagtcgcacactggtgttggaatggttttcttacccaaagatgcacaatttctcaatgaggcgaagaaagttattgtaaatatttttcggcaagaaggtcttgaggttcttggttggaggcctgttcctgtaaatacttctgtagtaggttactatgcaaaggagaccatgcccaatatacagcaggtatttgttaagattgtgaaagaagaaaacgttgatgacattgaacgagaactgtacatctgtcggaaattgattgaaaaagcagtaagctcagaaagttggggaaatgagctttatttctgttctttatccaatcaaaccataatttacaaggggatgcttcgctcagaagtgcttgggttattttattctgaccttcaaaataatctttataagtccccttttgccatttatcatcgaaggtacagcacaaatactagtcccagatggcctcttgcacaaccgatgaggcttcttggtcataatggagagatcaacaccatacagggtaacttgaattggatgcaatcacgagaaccgtcattgaagtcacctgtatggcgaggtcgtgaaaatgaaattcgtccatttggaaatccaaaggcatcagactcagcaaatcttgacagtgctgcagaattattgataagaagtggtcgaagtcctgaggaagctatgatgattcttgttccagaggcttataaaaatcatccaactctgtcaatcaaatatcctgaggtggttgatttctatgactattacaagggtcagatggaagcttgggatggaccagccttgcttttgttcagtgatgggaaaactgttggtgcatgccttgatcgtaatggacttcgacctgctaggtattggcgaacatcagacaatatggtctatgttgcctctgaggtgggtgttgtgccagtggatgagtcaaaggttgtcttgaaaggccgtttaggtccaggcatgatgataacggttgatttacctggcggtcaggtctatgagaatacagaggttaaaaaacgagtagccttatcaagcccatatgggaactggatcaaggaaaatttgcggtctttgaagcctgggaacttcctttcagcctctgtgttggacaatgaggcagtattaagacaccaacaggcatttgggtactctagtgaagatgtccagatggtgatcgagagtatggctgctcaaggaaaggagcccacgttttgcatgggagatgatattccattggcagcattgtctcagaaacctcacatgctttttgattatttcaagcaacggtttgcacaggttacaaatcctgcaattgatcctcttcgagaaggattggttatgtctcttgaagtgaatattgggaagagaaggaatatattggaaactgggccagagaatgcttcacaggttatgttatctagtccagtattgaatgaaggggagcttgagtcattactaaaagactcatacttgaaaccacaagtattacctacattttttgatataagtaagggcattgaaggttccttggagaaagcattaaataagctttgtgaggctgcagatgaagctgtcagaaatggttcccagctgcttattctatcagaccattcagaagcactggaaccaactcatcctgcaattcccatactccttgctgttggtactgttcatcagcatctaatccagaatggcctgcgaatgtcagcttcaattgtagcagatactgctcagtgctttagcactcaccagtttgcctgtttaataggatatggtgcaagtgctgtgtgtccgtacttggcattggagacatgtcggcaatggcgtttgagtaataaaactgtaaatctgatgaggaatggaaagatgcctactgtatcgattgaacaggcacagaagaactattgcaaggctgtaaaagcaggtcttcttaaaattctttccaaaatgggcatctcattgctatcaagttactgtggtgcacaaatatttgaagtctatggattagggaaggaagttgttgatcttgcattcagaggaagtgtgtcgaaaattggtggattaacttttgatgaggtggcaagagagactttgtctttctgggtgaaggcattctctgaagatacagctaaaaggttggaaaattttggatttatacagttcagaccaggaggggagtatcatgcaaataacccagaaatgtcaaagttgctccacaaagctgttcgtcagaaaagtcaaagtgccttttctgtttatcagcaatatttggctaatcgacctgtgaatgttctccgtgatcttcttgaattcaaaagtgatcgtgctccaatacctgtggggaaggttgaacctgcttcatctattgtgcaacggttttgcacagggggcatgtcacttggagctatttccagagaaactcatgaagcaattgcaattgccatgaacagaataggtggaaaatcaaattcaggggaaggtggggaggatcctgttcgctggaaaccacttacagatgtcgtagatggttactctccaactcttcctcatcttaaaggtcttcaaaatggggatactgcaactagtgccatcaagcaggttgcttctggaaggtttggtgtcaccccaacattcttggcaaatgctgatcagttagaaatcaagattgcacaaggtgcaaaacctggtgaaggtggacaattgcctggaaaaaaagttagcatgtatattgctaggttgagaaattctaaaccaggagttcctcttatatctccacctcctcatcatgacatttattctatcgaggaccttgctcagttgatctttgatcttcatcaggtgaaccctaaggccaaggtgtctgtaaaactggtggctgaagctggaattggcactgttgcatctggggttgcaaagggcaatgctgacattatacagatttcaggacatgatgggggaacaggagcaagccctataagttccatcaagcatgcaggaggtccttgggaacttgggcttacagaatctcaccagacactcattgaaaatggacttagagaaagggttattctcagagttgatggtgggtttagaagtggagtagatgtcatgatggcagcaataatgggtgctgatgaatatgggtttggttcagtggcaatgattgctactggatgtgttatggcccgcatttgccacaccaataattgcccagttggtgttgccagtcagagggaagagttgcgtgcacgctttcctggtgttcctggggaccttgtcaactactttttgtatgtagctgaggaggtaagaggcatattggcacagctggggtatgagaagttggatgatgtgattggccggactgacttgtttcaaccacgagacatatctctagcaaaaactcagcatctagatctgaattatatcctctctaatgttgggttgcctaaatggagcagtaccgaaattaggaatcaggagcctcataccaatggtcctgttctggatgatgttttgctagcagacccagaggttgccgatgccattgaaaatgaaaaggtggttaataagaccataaaaatatacaacattgatcgtgctgtatgtggacgtatagctggtgtcattgcaaagaagtacggtgacactggttttgctggacagttgaatataacatttacaggaagtgctgggcagtcatttgcatgctttctgactcctggaatgaacattcgccttgttggagaggctaatgattatgttgggaagggcattgctggaggtgagttggttatcactccagtcgacaagaccgggtttgaacctgaggatgcagctattgtagggaacacttgcttgtatggtgcaactggtggacaggtcttcgttagagggagagctggtgaaagatttgctgtcagaaactcacttgctgaagcagtggtggaaggcgcaggagatcattgttgtgagtacatgactggtggctgtgtggttgtcttgggaaaagtgggtagaaatgtagctgctggtatgactggagggttggcttacattcttgatgaggacgatactttcatacccaaggtaaacagagaaattgtaaaaatccaacgggtgtcagcccctgttggacagatgcaactgaagagcctgattgaagctcacgttgaaaaaaccggtagtaccaaaggtgcggctattctgaaggactgggataagtatttatcactattttggcagctggttccacctagtgaagaagatacccccgaggcaaatgccaaatatgacacaactacggcagatcaggtcacttatcagtctgcttagggtaacaatctaaggttacattacattgattacgccaggctatggagccattgttgtgtccctgatttgtacaggaattggagaggctatcaattaggtggaaatgctagccaaaatatgggattaaactatcccttgaaaccatggtgctgcatgtattctcaagatcatttttgccagcagtatgaggaaccccgtatacatccatctgaagcattagcattctcttttgtatagccatgtgaaaggaaaaaagctgtatataaaatgcagttgattcgaatttgattgggacttttgtggacggtcaaaataaatagttggggcttgatatgcctgggtcccctttgctctcctgaattaatgaaaaattattgttttttccttgcacgatcg

SEQ ID NO: 1445 - DNA, 5265 bp, Medicago truncatula
tctctctctctctttgggcgatggcgctgaacacggtgtcatcggtttctctttctcaagtgctacgtctctccgatacaatcggtaaccgtcacttgttcgtagacttcgctccattccgccgtaataccaagcggtgcaaccgtagattgacgccggcgattctccgtcggagctccgttaaagctgttcttcaacttgataataatcatctcaatcctgctcctcctccttcttcgccgtcaacttccgattccaaacccaaggttgcaaacttggaggacatactatcagaaagaggggcctgtggtgttggattcattgccaatttggaaaataagggatcatttgagattgtcaaggatgctttaaatgctttaagctgtatggaacatcgtgggggctgtggtgcagataatgactcaggtgatggttctgggctgatgactgcagttccatgggatctatttgacaattgggcaaacgagcaagggcttgcttcctttgataagttgcacactggcgttggaatggttttcctacccaaagatgtagaacttatgaataaggccaagaaagttattgtaaatacttttcagcaagaaggtcttgaggtgcttgggtggaggccagtccctgtaaatacttctgttgtaggttattatgcaaaggagaccatgcccaatatacagcaggtatttgtcaagattgggaaggaagaaaatactgaagacattgaacgagaactgtacatctgtcgaaaacttattgaaaaagaagtaagctcggaaagttggggaaatgagctttatttctgttctttatccaatcgaacaatagtttacaaggggatgctccgctcagaagttttggggttattttattctgatcttcagaatgatctttataaatcctcctttgccatttatcatcgaaggtatagcacaaatactagtcctagatggcctcttgcacaaccaatgagacttcttggtcataatggagaaatcaacaccatacaggggaacttgaattggatgcagtcacgagagccgtcattaaagtcacctgtatggcgaggtcgtgaaaatgaaattcgtccatttggaaatccaaaggcatcagactcggcaaatcttgacagtgctgcagaattattaataagaagtggtcgaacccctgaggagtccatgatgattcttgttccagaggcttacaagaaccatccaacactgacaatcaaataccctgaggcgattgacttctatgactactacaaaggccagatggaagcttgggatggacctgccttgcttttattcagtgatggaaaaactgttggtgcgtgccttgatcgtaatggacttcgacctgccaggtattggcgaacatcagacaatatggtctatgttgcttctgaggttggtgttgtaccagtggacgagtcaaaggttatctcgaaaggccgattaggtccaggcatgatgataacagttgatttacttggtggccaggtctatgagaatatggaggttaaaaaacgagtagccttatcaaacccatatgggaactggatcaaggaaaatctgcggtctttgaagtctgagaatttcctttcatcctcggtgatggagaatgatgcagtattaagacaccaacaggcatttgggtactccagtgaagatgtccagatggtgatcgagtctatggcttctcaaggaaaggaacctacattttgtatgggagatgatattccattggctgcattatctcagaaacctcacatgctttttgattactttaagcaacggtttgcacaggttacaaatcctgcaattgatccactccgagaagggttagttatgtctcttgaagtaaatatagggaagagacggaatatattggaaattggacctgagaatgcttcacaggttatattatctagtccggtattgaatgaaggggaacttgagtcattgttaaaagactcccacttaaaaccacaagtgttgcacacattttttgacataactaaggggattgatggttccttggagaaagcattaaataagctttgcgacgctgccgatgaagctgttagaaatggttcccagctacttgttctttcagaccgttcagaagcactggaaccaactcatcccgcaattccaatacttcttgctgttggtactgttcatcagcatctaatccagaatggacttcggatgtcagcttcaattgtagcggatacttctcagtgctttagcactcatcagtttgcctgtttaataggatatggtgcaagtgctgtgtgcccatacttggcactggagacatgtcgtcaatggcgtttaagtaataaaacagtaaatctgatgaagaatggaaagatgcctactgtatcaattgaacaggcacagaaaaactactgcaaggctgtcaaagcaggtcttcttaaaattctttccaaaatgggcatctcattgctttcaagttactgtggtgcacagatatttgaaatctatggattagggaaggaagttgtggatcttgcattcagcggaagtgtatcgaaaattggtggtttaacttttgatgagctagctagagagactctgtctttctgggtgaaggcattctctgaagatacagctaaaagattggaaaattttggatttatagtgttcagaccaggaggtgagtatcatgcaaacaatccagagatgtcaaagttgcttcacaaagctgttcgtcagaaaagccaaaatgccttttcagtttatcaacaatatttggctaatcgacctgttaatgttatccgtgatcttcttgagttcaaaagtgatcgtgcccccatacctgtggggaaggtagaacctgctttatctattgtgaaacggttttgcaccggtgggatgtctcttggagctatatctagggaaactcatgaagcaattgcaattgcaatgaacagaataggtggaaagtcaaattcaggggaaggtggtgaggatcctattcgctggaaaccacttactgatgttgttgatggttactctccaactcttccacatcttaaaggtcttcaaaatggggatactgctactagtgctatcaaacaggttgcttcaggaaggtttggtgtcactccaacattcttggcaaatgctgatcaattagaaattaaaattgcacaaggtgcaaagcctggtgaaggtggacaattgcctgggaaaaaagttagcatgtatattgcaaggttgagaaattctaaaccaggggttcctcttatatctccacctcctcatcatgacatttactctattgaagatcttgcacaattgatctttgatcttcaccaggtgaaccctaaggccaaagtatctgtaaaactggtggctgaagctggaattggcactgttgcatccggggttgcaaagggcaatgctgacatcatacagatatcaggacatgatgggggaacaggagcaagccctataagttccatcaaacatgcaggaggtccttgggaactcggacttacagaatctcaccagacactagttgaaaatggactcagagaaagagttattctcagagttgatggtggatttagaagtggagttgatgtcatgatggcagcaataatgggtgctgatgaatatgggtttggttcagtggcaatgattgctactggatgtgttatggctcgcatttgccacaccaacaattgtccagttggtgttgccagtcagagggaagagttgcgtgcacgttttcctggtgttcctggtgatcttgttaacctcttcttgtacgtagctgaggaggtaagaggcactttggcacagttggggtatgagaagttagatgatataattggcagaacagaattattgagaccaagagacgtatctcttgtgaaaactcagcatctagatctgagctatatcctctctaatgttgggttacctaaattgagcagtacagaaatcagaaatcaggagccacataccaacggtcctgtcctggatgatgttttactagcagacccaaagattgcagatgccattgaaaatgaaaaagctgttagcaagaccataaagatatacaacgttgatcgttctgcctgtgggcgtatagctggtgttattgcaaagaaatacggtgacactggttttgctggacagttgaatattacatttacaggaagtgctggtcagtcatttgggtgctttctgacaccaggaatgaatattcgccttgtaggagaggcaaatgattatgttgggaagggcattgctggaggtgaattggttgtcactccagttgacaagatagggtttcaacctgaggatgcagctattgtggggaacacttgcttgtacggggccacaggagggcaggtctttgttagagggaaagctggggaaaggtttgctgtcagaaactcacttgctgaagctgtagttgaaggcgcaggagatcattgttgtgagtacatgactggtggctgtgtggttatcctgggaaatgtgggtagaaacgtagctgctggaatgacaggagggttggcttacattcttgacgaggacaacactctcattcccaagataaacagagaaattgttaaaattcagcgagtaacagcacctgtagggcagatccagctaaagaaactaattgaagcccatgttgaaaaaacgggtagcaacaaaggtgaggctattctgaaggactgggacaagtatttatcactattttggcagttggttccacctagtgaagaagatacccctgaggctaatgccaagtatgacataactgcaacggagcaggtcactttgcagtctgcttagggagagcaatgcaagctaatattgattgcgccaggctatgaagggaaccacatgtccctgtttttttatagggattaggaagctatcaacaagggtgaaaattactaaccagaatatgggattaaacttcccattaaaacaccgctgggcttcattcaatctcaagatcatgttttccattttgcagatgtaagaggccctccttgtacatccctgttaagcattagccttctctttcctcagacacatttgtatagtcatttgaaataaaaactgtaaataaaaatgcagtttattcaaatctgattggaggtttttgtggatgatgaaaataaattagttggtgcatgatccctgttcatcacgatatcatttgatgaaatggaagttattatttcacttgcat

SEQ ID NO: 1446 - DNA, 5371 bp, Citrullus lanatus
atggcgcttccttctgtttcctcttccatttcccatctccgcccttcctcttctccttctctctctcctcactcccctcttctctcccccaatcacgctctttctcttctcgatttcgttgctttctatggcaggtccagtagaaccagaaggaaatcatcactctcttattcatcttcttcctttcctaatcgctcctttcctcacttcccttctaccaagtcttcttcatccatcaaggcgcttctcgatcttccactccctgcttcttcttctcaacccctacctaaggttgcaaatttggatgacataatatcagaaagaggagcgtgtggagttggatttgttgccaacttggataacaaagcatcccataagattatccaggatgctcttacagcactaggctgtatggaacaccgtggtggatgtggagctgataatgattccggtgatggttcaggagtaatgacttccatcccatgggatctttttgataattgggccagtgggcaggggattccttcatttgataagttgcatgctggtgttggcatggtttttctccccaaagatgatggtcataataaagaggcaaaagaagttattgcaagtatctttagacaagaaggtcttgaggtgcttggttggaggcctgttcctgtgaaagcttctgtggttggtattaatgcaaagaagaccatgcctaacattgagcaggtattcgtccaagtagttaaagaagagaatgtggacgacattgaacgagaactttacatttgtaggaaattgattgaaagagaagcaaactctaagagttggggaagtgaactatatttctgttctttgtcaaatcaaactatagtttacaagggaatgcttcgctcagaggttcttggattattttatgatgaccttcagaatgaactctataaatccccctttgcaatttatcatcgaagatatagtacaaatactagtcctcgatggcctcttgcccaaccaatgaggttactgggtcacaatggagagatcaatacgatacaggggaacttaaattggatgcaatctcgagaagcctccttaaagtcatctgtatggcggggtcgcgaaaatgaaattcgtccatatggcaacccaagggcatcagattcagcaaatctcgatagtgcagctgaattgttaataagaagtggtcgtgctcctgaggaggctctcatgatccttgttcccgaggcttacaagaaccatcctacattgatgatcaaatatcctgaggttgttgacttttatgactattacaaaggtcaaatggaggcttgggatggacctgctttattgttgttcagtgatggaaaaacagttggtgcctgtcttgatcgtaatggattgcgcccagctcggtattggcgcacatcagataattttgtttatgttgcatctgaggttggcgtcttaccaatggatgagtctaaagttacaatgaaaggccgtcttggtccaggaatgatgattactgctgatctgcagaccggacaggtctttgagaatacagaagttaaaaaacgtgtagctttgtcatatccatatggaaagtggatcaaggaaaatatgcgctcattgaagcctgagaattttcttgcagcaacggtattggatactgataaattgctgagaagccagcaggcatttggctactccagtgaagatgtccaaatgattatagagagtatggctgctcaaggaaaggaacctacgttctgcatgggagatgatattccactggcaatattgtctcagaagccacacatgctctatgattattttaagcaacggtttgcacaggtgacgaatccagcaattgaccctctcagagaaggactagtcatgtctcttgaagtcaatattggaaagcgaagaaatatattagacataggacctgagaatgcttcacaggtaactttgtctagtcctgttttgaatgaaggagagcttgaatccttgctaaaggatccatacttgaaggcccaagtattgccaacattctttgacatacgtaagggtgttgatggttctctggaaaaaattctaaacagactttgtgatgctgctgacgaggctgttcgcaatggttctcaactgcttgttctatctgatcgttccgaagagcttgaagcaactcgcccagcaattccaattcttcttgctgttggtgctgttcatcagcatcttattcaaaatggcttgcgaatgtcagctactatagtagcagatactgctcagtgcttcagtactcatcagtttgcttgtttaattggatatggtgcaagtgctatatgcccatacttggctctggaaacctgtcggcattggcgtcttagtaacaagactgtaaatatgatgcggagtggaaagatgcctactgtaacaattgaacaggctcaaaagaatttttgcaaggcagtgaagtctggtcttctcaaaattctttccaaaatgggtatttctttactatcaagctattgcggtgcacaaatatttgagatctatggattaggaaatgagattgtagattttgctttccgtgggagcatatcaaaaattggtgggttgacgtttgatgagttggccagggagactttgtctttctgggtgaaggcattttctgaggatacagctaagagactagaaaattttggatttatacaattcagaccaggaggggagtatcatggaaacaaccctgagatgtcaaagttgctccataaagctgtgcgccagaaaaatgaaagtgcttatgcagtatatcagcagcatttggctaatcggcctgtgaatgttcttcgtgatcttctggagttcaaaagtgatcgtgctccaattcccgtgggaaaggtcgaaccagcagcatctatcgttcaacgcttttgcaccggtggaatgtcacttggagctatttcaagagaaactcatgaagcgattgctattgcaatgaacagaattggtggtaaatccaactcgggagaaggtggtgaggatcccattcgttggagacctctagcagatgttgttgatgggtattctccgacactgccacatcttaaaggccttcagaatggcgatactgctactagtgctattaagcaggttgcttctggacgttttggtgtcactccaacattcttggtcaatgctgatcaattagagatcaaaattgcacaaggtgcaaagcctggcgaaggtggccaattacctggaaagaaagttagtgcttacattgcaaggttgagaaattccaaacctggtgttccgcttatatctccacctccacatcatgacatttattctatagaggatcttgcacagttgatctttgaccttcatcaggtgaacccaaaggctaaggtatcagtgaagctggttgctgaagctggaattggcacggtggcttctggggttgctaagggtaatgctgatattatacagatatcagggcatgatggtggaacaggagctagtcctataagttccattaagcatgctggtggtccttgggaacttggactgacagaaacacatcagacccttattgaaaatggacttagagaaagggtcattcttagagttgatggtggcttcaaaagtggagttgatgtcttaatggctgcagcaatgggtgcggatgaatatggttttggttcagttgccatgattgctactggttgtgtgatggcccgcatatgccacactaacaactgcccagttggtgttgccagtcagagagaggagctacgtgcacgttttcctggtgtacctggcgatcttgtcaactatttcctttatgttgctgaggaggtaaggggtacattggcccagctgggatatgagaagttggatgatataattggaagaacagaattattaagacctcgagatatctctttgatgaagacacaacatctcgatctcgattatattctttcaaatgttggattaccaaaatggagcagtactgaaattcgtaatcaagatgttcacacaaatggtcctattctggatgatatcctactttcagacccccagatattagatgcaattgagaatgagaaagtagtacaaaagacagtgaagatatacaatgttgatcgtgctgtttgtgggcgtgtagcaggggcgattgcaaagaaatatggtgacactggttttgctggccaattaaatattacgttcacaggtagtgctggacaatcgtttgcatgctttcttacacctgggatgaatattcggcttataggagaggccaatgattatgtcggaaagggtatggcgggaggtgaattagttgtaactccaaccgaaaataccggatttgttcccgaggatgcagccatagtggggaatacatgtctgtatggtgcgactggcggtcaagtttttgttagaggaaaagctggggagaggtttgctgtcagaaattcacttgctcaggcagtggttgaaggaactggggaccattgctgtgagtacatgactggtggttgtgttgttgtacttggcaaagtgggaagaaatgttgctgctggaatgactggaggcttagcttatattctcgatgaggatgatactcttattccgaaggttaacaaagaaattgttaaaatccagagagtaactgctccagtggggcagatgcaactgaagagccttatcgaagcccatgttgaaaaaactggtagcagcaaagggtctacgatcctgagcgagtgggaaacttatttaccgctcttctggcaactggttccacctagtgaggaagataccccagaggctagtgctgagtatgtaagatcagctactggagaagtgacctttcaatccgcctaatggatcacaacaacaattgttgtgatcatgtgattaatttgcaaatgctgcaactctacgacttctgggttcggaatgggaattcttgatacaaaagacacttgcataactcggcggtgaaggctatatgacttggtggtgaaggaaccctgatctaccattaagcagtgtaagccttctcttgtattgatccctctgtaaatatcaatttgcagcataaaaataatatgtagatttcatgtagtttaggtttcccaattcttgttgaaacaaagcctatgttaatactgtcattaaaaataaatttagccttggctcattattattggccattgctttctttctactagctaatctgctttcttgcatttcaggtttcaaaattctctcattattttgtaatcacattctgaaaacatcaatgagcaatgtctattcttatagactactcttgaatgcttttattttcaaatgagattatttgttt

SEQ ID NO: 1447 - DNA, 5328 bp, Silene vulgaris
tttctctcctttccgtaacaatggcgctacactacgcgccgccgcctaaacttatctactcctcttccgccttctccgccgccgaaaaccgtctcgtctttgccgacttcgtcgcacttgctaaaaaccaccgctctcgccgccgtcgttccactaatttacgctctttctccgtaaaccggtccgtttctccggttttgaaggcgattcttcaacttgaccgcgcttctacttccgatgcttccggttcttctcgatcctcctctcctgccgttgaccagcaggctgtaaatttggcggatatacttgcagagagaggagcatgtggtgttggatttattgcaaacttggataataagggttctcatcagattgtcaaggatgctcttactgcacttggctgtatggagcatcgagggggatgtggatcagacaacgattcgggtgacggttctggagtaatgactgcgattccttgggatctgtttgacatttgggcgaaagaacaaggcattgataccttcgataggtcacatactggcgtcgggatggtttttcttcctaaagatgatgcacttgcggaagaagccaaaaaagttgttctagatatttttaatcaagagggtattgaggtgctcggttggaggtcagtccctacaactgtatctgtcgtcgggcggaatgccaaagaaactatgcccaatatacagcagctttttgtgagagttgtacgggaagagaacattgatgacattgaaagagagctatacatatgtcgcaagttgattgaaagagctgccagttctgaaacctgggcaaatgagctttatttttgctccttatctaatcagactatcatttacaaggggatgcttcggtccgaagtgctaggaatgttctacgatgatcttcggaatgaactttatacatctccatttgctatttaccatcgtaggtacagcacaaacactagccctcggtggccacttgctcaaccaatgagatttcttggtcataatggagaaatcaatactatacagggtaatttgaactggatgagatctcgcgagacatcattgaagtcccctgtttggcgtggtcgtgaaagtgaaattcggccttttggaaatccaagggcatccgattcagctaatcttgatagtgcagcagagctgttaattagaagtggacgtgctgctgaggaagcactgatgattcttgttccagaggcttataaaaaccatcctaccttgtcaatcaaatatcccgaggttctggacttttatgattactacaaggggcagatggaaacttgggatggacctgccttacttttattcagtgatggaaaaactgttggtgcttgtcttgatcgaaatggattacgtcctgctagatattggcgcacagttgacaatgtcgtttacgttgcatctgaggtgggagtcctgccaatggatgaatcaaaagtcataatgaagggccgactaggtccaggcatgatgatatcagtcgatctgactagtggtcaggttttcgagaatactgaggtaaagaaacgggtagcttcagcatatccttatgggaaatgggtgaaggaaaatttacgttcattaaaaccagtgaacttcctttcaggggcccttctggaaaatgacacaatcctgagacaccaacaggcatttggctactcgagtgaagatgtccaaatggtaattgaaagtatggcttcacaaggaaaggagcctacattttgcatgggagatgatattcccctagcagtgatgtcccagaagcctcatatgctttatgattatttcaaacaacgatttgctcaggttactaatccagctatcgatcctttgagagaaggattagtcatgtctcttgaagttaacattggtaggcgtgggaatatcctagaagttggacctgaaaatgcttcgcaggttatattatcgagtcctgtgcttaatgaaggagagttggaagctttgctgtccgatcccttgttaaaggcccaagtgctgcccaccttttttgacatacgtaaaggacttgacggctctctagagaaaacattgaataggctctgtgaagctgctgatgaagcagttagaaatggatcacaattgcttgttctatctgaccgttcggatgagccagaaccaaccaagccagctataccgatactcctagctgtaggtgctgttcatcagcatctgattcagaatggcttaagaatgtctgcctcaattgtggctgaaacagctcagtgtttcagtactcatcagtttgcgtgtttggtaggatatggtgcaagtgctgtgtgcccgtatttggcactggaaacatgtcgtcaatggcgattaagcaataaaaccgtgaacttgatgcgaacaggaaaaatgcctactgttacaattgagcaagctcaaaagaacttctgcaaggctgtgaaatctggtttactaaagatcctatcaaaaatgggtatctcacttctctcgagttactgtggggcacaaatttttgaaatctatggattgggaaaagacgtcgttgatttagctttttgtgggagtgtctccagcatcggtgggttgactcttgatgagcttgcaagggagaccctgtctttctgggtcaaggcgttctctgaggacacggcgaaaaggctagagaattttggatttatacaatttaggccaggaggggaatatcattcaaacaacccagagatgtcaaaactgcttcataaagctgttcgcaacaaaagtgaaagtgcctatgcagtttaccagcagcatttggctaatcggcctgttaatgtgattcgtgatcttattgagttcaaaagtgatcgtgctcctattcccgtgggtaaagttgaacccgctacatctatagtccaacgcttctgtactggtgggatgtcacttggagctatctctagagaaacccacgaagcaattgccattgctatgaatagattgggcggaaaatctaattcaggagaaggtggcgaggatccaatccgttggaaaccattgactgatgtggttgatgggtattcccctactcttcctcatctgaaaggtcttcaaaatggagacactgccacaagtgctatcaagcaggttgcatctgggcgttttggtgtcactccaacgtttttggttaatgctgatcaattggaaatcaaggttgctcagggtgcgaagcctggtgaaggagggcagttacctggaaagaaagtcagcgcctatattgcccgattgaggaactcaaagcctggggttcctcttatttctccaccgccacatcatgacatatattctattgaagatcttgcacagttaatatatgatcttcatcagataaaccctaaggctaaggtttcggtgaaactagtagcagaagctggcattggcactattgcgtccggtgtagcaaagggaaatgctgatattattcagatatcaggacatgatggtggaactggagctagcccaataagttccattaaacacgcaggtggtccttgggaacttggactaacagaaactcaccagaccttgattgtaaatggacttagagaaagggtcatcctcagagttgacggtggcttcaaaagtggggttgatgtcatgatggccgcagcaatgggtgcagatgaatacggttttggttctctagccatgatagctactggttgtgttatggctcgcatttgccatactaacaactgcccggttggtgttgctagccagagggaagaactccgtgctcgttttcctggtgtgcctggtgatctcgtgaactactttctgtatgttgctgaagaggtaagaggtatactagcacagttgggctatgcaaaattggatgatataattggaagaactgatcttcttaaaccaagagatatctccctgatgaaaacccaacatcttgatctgacctatattctctcaaatgtcggtttgcctaccatgagcagtactgccatcaggacccaagaagttcatactaatgggcctgtgctggatgatcgcatactctcagatccagagattacagatgccattgaaaatgaaaagattgtcagcaaaacattcgagatatataatgtggaccgtgctgtttgtggccgtatagcaggtgttgtcgccaagaaatatggtgacacaggctttgctggtcagctgaatataacctttacagggagcgctgggcaatcttttgcttgctttctgacccctggaatgtacattcgtcttattggagaagcgaatgactatgtcgggaagggtatggctggtggtgaattggttgttacaccagtagaaaatcctggattttgccccgaagatgccacaattgttgggaacacgtgtctatatggagctacaggaggtcaagtctttgttagaggaaaagctggggaacgttttgctgtaaggaattcgcttgcccaagcagtggtggagggcactggtgatcactgttgtgaatatatgactggtggctgtgttgttgtccttggaaaagtgggtagaaatgttgctgccggtatgactggaggtctggcatatctgctggatgaagatgatactctcattccaaaggtaaacaaggagattgtgaaaatccagagagtgactgctcccgttggccagatgctgctcaagagccttattgaagcacatgttgaaaaaaccgggagttccaaaggtgctgctattttgaaagactgggacaagtatctgcaactattttggcagttagtcccacctagtgaagaagacactccagaagcttccgcagactttgaacagacagctgttgagggtgagcaggttactctacaatctgcttagattgaacccagcagagaccactcaaggctgaaaacactgaaaatacgaaattctacctttaaagcatgtgtagtgcaactcccacgaaactccataaagggaaaggctgtgctgacgattttccattcattccaaagggattaaaagatttggaggcttaaactcgagtttgatggattttcaattggcatgagatgaaagtcaccatgggcctgatcatttcatatttgactaaagaagctaagcctcccgtatatattgattaccacttgtaaattccctccaactttcgctttggtctcttttccctgtgtgatttttctgacattcatccaagatgtagaaatttaaagctgttaattccccagctctttatcatcgttttgacacaatcggattagtggtgtaaattatataccaacttcatttgtctgatatttttttt

SEQ ID NO: 1448 - DNA, 5378 bp, Glycine max
acttggtggtgtgtgtgtgactcagacacttcctgacctctccctcttctcccttttatcttcattctcactcacccactccattctatttctattctccacacactctcatctctctctcgatgatggcgctgcactcagtgtcttccgtttcgcacgtgctgcgcctcgccgagccattcccttccctccacaacgctcacgtgctcctcgacctcgcacctctccgccgcaaacccaagcgccgcactcgcagactcacggcgtttcccttgtcgtcgccgctccgtcattccgccgtcaaatccgttctccacctcgaccgctccaccgacaaccgcctccataattcctctgcttcgtcttcttccgattccaaaccgcaggttgcaaacttggaggacataatatcagaaagaggagcctgtggggttggattcattgccaatttggagaataaggaatcacatgagattgtcaaggatgctttaaatgctttaagttgtatggaacatcgtggtggctgtggagcagataatgactctggtgatggttcagggctgatgaccggagttccgtgggaactatttgacaattgggccaacacgcaagggattgcttcctttgataagttgcacactggtgttggaatggttttcttacccaaagaggcacaacttctcaatgaggcgaagaaagttattgtaaatatttttcggcaagaaggtcttgaggttcttggttggaggcctgtccctgtaaatacttctgtagtaggtttttatgcgaaggagaccatgcccaatatacagcaggtatttgttaagattgtgaaagaagaaaatgttgatgacattgaacgagaactgtacatctgtcggaaattgattgaaaaagcagtaagctcagaaagttggggaaatgagctttatttctgttctttatccaatcaaaccataatttacaaggggatgcttcgctcagaagtgcttgggttattttattctgacctccaaaatgatctttataagtccccttttgccatttatcatcgaaggtatagcacaaatactagtcccagatggcctctagcacaaccgatgaggcttcttggtcataatggagagatcaacaccatacagggcaacttgaattggatgcaatcacgagaaccatcattgaagtcacctgtatggcgaggtcgtgaaaatgaaattcgtccatttggaaatcccaagggatcagactcagcaaatcttgacagtgctgcagaattattgataagaagtggtcgaagtcctgaggaagctatgatgattcttgttccagaggcttataaaaaccatccaactctgtcaatcaaatatcctgaggtggttgacttctatgactactacaagggtcagatggaagcttgggatggaccagctttgcttttgttcagtgatgggaaaactgttggtgcatgccttgatcgaaatggacttcgacctgctaggtattggcgaacatcagacaatatggtctatgttgcctctgaggttggtgttgtgccagtggatgagtcaaaggttgtcttgaaaggccgtttaggtccaggcatgatgataacggttgatttacttggcggtcaggtctatgagaatacagaagttaaaaaacgagtagccttatcaagcccatatgggaactggatcaaggaaaatttgcggactttgaagctcgggaacttcctttcagcctctgtgttggacaatgaggcagtattaagacaccaacaggcatttgggtactctagtgaagatgtccagatggtgatcgagagtatggctgctcaaggaaaggagcccacgttttgcatgggagatgatattccattggcagcattgtctcagaaacctcacatgctttttgattatttcaagcaacggtttgcacaggcaatacaggttacaaatcctgcaattgatcctcttcgagaaggattggttatgtctcttgaagtgaatattgggaagagaaggaatatattggaaattgggccagagaatgcttcacaggttatgttatctagtccagtattgaatgaaggggagcttgagtcattactaaaagactcctacttaaaaccacaagtattaccaacattttttgatataactaagggcattgaaggttccttggagaaagcattaaataagctttgtgaagctgcagatgaagctgttagaaatggttcccagctgcttattctatcagaccgttcagaagcattggaaccaactcatcctgcaattccaatacttcttgctgttggtactgttcatcagcatctaatccagaatggcctgcgaatgtcagcttcaattatagcagatactgctcagtgctttagcactcaccactttgcctgtttaataggatatggtgcaagtgctgtgtgtccgtacttggcattggagacttgtcggcagtggcgtttgagcaataaaaccgtaaatctgatgaggaatggaaagatgcctactgtatcaattgaacaggcacagaagaactattgcaaggctgtaaaagcaggccttcttaaaattctttccaaaatgggcatctcgttgctatcaagttactgtggtgcacaaatatttgaagtctatggattagggaaggaagttgttgatcttgcattcagaggaagtgtgtcgaaaattggtggattaacttttgatgaggtggcaagagagactttgtctttctgggtgaaggcattctctgaagatacagctaaaaggttggaaaattttggatttatacagttcagaccaggaggggagtatcatgcaaataacccagaaatgtcaaagttgctccacaaagctgttcgtcagaaaagtcaaagtgccttttcagtttatcagcaatatttggctaatcgacctgtgaatgttctccgtgatcttcttgaattcaaaagtgatcgtgctccaatacctgtggggaaggttgaacctgcttcatctattgtgcaacggttttgcacagggggcatgtcacttggagctatttccagagaaacccatgaagcaattgcaattgccatgaacagaataggtggaaaatcaaattcaggggaaggtggggaggatcctattcgctggaaaccacttacagatgtcgtagatggttactctccaactcttccacaccttaaaggtcttcaaaatggggatactgcaactagtgccatcaagcaggttgcttctggaaggtttggtgtcaccccaacattcttggcaaatgctgatcagttagaaattaagattgcacaaggcgcaaaacctggtgaaggtggacaattgcctggaaaaaaagttagcatgtatattgctaggttgagaaattctaaaccaggagttcctcttatatctccacctcctcatcatgacatttattctattgaggaccttgctcagttgatctttgatctccatcaggtgaaccctaaggccaaggtgtcagtaaaactggtggctgaagctggaattggcactgttgcatctggggttgcaaagggcaatgctgacattatacagatttcaggacatgatgggggaacaggagcaagccctataagttccatcaagcatgctggaggtccttgggaacttgggcttacagaatctcaccagacactcattgaaaatggacttagagaaagggttattctcagagttgatggtgggtttagaagtggagtagatgtcatgatggcagcaataatgggtgctgatgaatatgggtttggttcagtggcaatgattgctactggatgtgttatggcccgcatttgccacaccaataattgcccagttggtgttgccagtcagagggaagagttgcgtgcacgctttcctggtgttcctggggatcttgtcaactactttgtgtatgtagctgaagaggtaagaggcatattggcacagctggggtatgagaagttggatgatgtgattggccggactgatttgttccaaccaagagacatatctctagcaaaaactcagcatctagatctgagttatatcctctctaatgttgggttacctaaatggagcagcacagaaattaggaatcaggagcctcataccaatggtcctgttctggatgatgttttgctagcagacccagagattgcctatgccattgaaaatgaaaaggtggttaataagaccataaaaatatacaacattgatcgtgctgcatgtggacgtatagctggtgtcattgcaaagaagtacggtgacactggttttgctggacagttgaatataacatttacaggaagtgctgggcagtcatttgcatgctttctgacacctggaatgaacattcgccttgttggagaggctaatgattatgttgggaagggcattgctggaggtgagttggttatcactccagttgacaagaccggttttgaacctgaggatgcagctattgtagggaacacttgcttgtatggtgcaactggtggacaggtcttcgttagagggagagcaggggaaagatttgctgtgagaaactcgcttgctgaagctgtggttgaaggtgcaggagatcattgttgtgagtacatgactggaggctgtgtggttgtcttgggaaaagtgggtagaaatgtagctgctggaatgactggaggattggcttactttcttgatgaggacaatactttcatacccaaggtaaatggagaaattgtaaaaattcaacgggtgtcagcccctgttgggcagatgcaactgaagagcctgattgaagctcatgttgaaaaaaccggtagtacaaaaggtgcggctattctgaaggactgggagaagtatttatcactattttggcagctggttccacctagtgaagaggatacccctgaggcaaatgccaagtacgacacaactacggcagatcaggtcacttatcagtctgcttagggtgacgatgcaaggttacattacattgattacgccaggctatggagccattgttgtatccctgatttgtacaggaattggagaagctatcaataaggtggaaatgctagccaaaatatggggattaaactatcccttgaaaccatggtcgctgcattgattctcaagatcatttttgccagcagtacgatgcaccccgtatacatccatctaaagcattagcattctcttttgtatagccatgtgaaagcaaaactgtatataaaatgcagttgattcgaatctgattgggatttttgtggacggtgaaaataaattagttggggcttgatatgcctagtcatcttttctctcctctgattaatgaaaaaatattgttttctccttgca

SEQ ID NO: 1449 - DNA, 5397 bp, Capsicum annuum
atggcggtgaatccggtggcaaacgttccgcagttactctacgcgaacgggcagccaccgaagattctcacggggagtaaagacggtgtatttgttgatttcgttggtttgaactgtaaatccagcaagcggattcgtcgaaggattggttatgcggcagctaacaggagaagcttcataaacaacagatggaatgcaattaatgctgttcttgaccttgaacgtgttgccagtaatatatctcagcaatccgctagtatagtgcctaaggttgccgacttggatgatatattatctgaaagaggcgcatgtggggttggttttattgctaatttggacaataaagcatcacatgggatcgtcaaggatgctcttgtggctcttggctgcatggaacatcgtggaggttgtggagctgacaatgattctggtgatggttctggactgatgacttcgattccttgggatcttttcaatgattgggctgagaaagaaggaattgcagtctttgacaagcttcatactggcgttggaatgatttttcttcctaaggattgtaaccagatgaatgaagccaagaaagttatttccaatatctttaacaacgagggtcttgaggtgcttggatggaggtcggttccagtagattcttctgtagttggatattatgcaaaagaaactatgcccaacatacaacaggtttttgttcgaattgttaaagaggaaaatgttgatgatattgaaagagaactctatatatgtagaaaactcattgagagggctgtgaactcagagatttggggaaatgaactttatttctgttcattgtccaatcaaaccatagtttacaagggaatgcttcgttctgaagtccttggaaggttctattatgacttacaaagtgagctctatacatctccccttgctatttatcatcgtagatacagtacaaacaccagtcccaggtggcctcttgctcaaccaatgaggtttctgggtcataatggagagatcaacactatacagggaaacttgaattggatgcaatccagagaggcttcattgaagtcaactgtttggcgtgaccgtgaggatgaaatccgtccttttggcaacccaaaggcatctgattctgcaaatttagacagtgctgctgaattactcataagaagtggccgggctcccgaggaagcgctgatgattcttgtcccagaagcatatcaaaatcatccaacattgactattaaatatccagaggttcttgatttttataattattacaagggtcagatggaagcttgggatgggccagccttactcttattcagtgatgggaaaacagtcggtgcttgtcttgatcgtaatggacttcgtcctgcaagatattggcggaccgaagacaacattgtctatgttgcatctgaggttggtgtgatacccatggatgattcaaaggtaacaatgaaaggacgtttaggtcctggtatgatgataagtgttgatctatcaagtggtcaggtattcgagaatacagaagtcaaaaagcgagttgcattgtccaatccatatggggagtgggttaaagaaaatttgcgatctttgaagccgatgaactttctttcaacaacagtaatagatggtgaaaccatactaagacgccaacaggcatatggctattctagtgaggatgttcaaatggttattgaaagtatggctgcacaagggaaggagcctacattttgcatgggagatgatattcccttggctgtattatctcaaaagccacatatgctatatgattatttcaagcaacggtttgctcaggttacaaatccagctattgatcctctcagagaaggattagtcatgtcccttgaagtcaacctcggaaagcgtagaaatatactagaggttggacctgaaaatgcttctcagtttattttgcccagtcctgttcttaatgaaggagagcttgaatctcttttgaaagattcacacttgaaacctcatgttttgccaacattttttgatgttgggaaaggagttgatgggtccttgaaacggtcactctataaactatgtgaagcagctgatgaagctgtaagaaatggttctcaattgcttgttctctccgataggtttgatgaattggaggctactcggcctgcgattccaattcttcttgctgtaggtgctgttcaccagcatctgattcaaaatggccttagaatgtcagcttcaattattgctgatactgcccagtgcttcagtactcatcagtttgcttgcttgatcggatatggtgcaagtgctgtttgtccatacttggcatttgagacatgtcgacaatggcgcttgagcaccaaaactgtgaacttgatgcgaaatgggaaaatgcctagtgtcaccattgaacaagctcaaaagaacttctgcaaggcagttaaatccgggcttctcaaaattctttctaaaatggggatctccttgctctcgagttattgtggtgcacagatatttgaaatctatggattgggaaaggaggtcgtagatgttgcattctgtggcagtaaatcgagcattggtggattaacccttgatgagctggcaagagagactttatcattctgggtgaaggctttctctgaagatacagcaaaacgactagagaactatggtttcatacaattcagacaaggaggtgaataccatggaaacaacccagagatgtcaaaactgctccataaagcagtccgccaaaagagtgaaagtgcctattcagtttatcagcagcatttggctaatcgacctgtaaatgttcttagagatcttcttgaattcaaaagtgatcgttcgcctataccggttggaagggttgaacctgcttcagcaattgtgcagcggttttgcactggtggcatgtcacttggagctatttcaagggaaactcatgaagctattgcaattgcaatgaatagattgggtggaaaatcaaactcaggagaaggtggtgaggatccaattcgctggaaaccacttactgatgtcgttgatggatattctccaacacttccacatcttaaaggtctgcaaaatggagacactgcgacaagtgcaattaagcagattgcttccggacgctttggtgtcactcctacatttctagctaatgctgaccagttagaaattaaaattgctcaaggtgcaaagccaggtgaaggtggccaattgcctggtaaaaaagttagcgcttacattgcgagactaaggaattcaaaacctggagttcctcttatatctccaccgccacatcatgatatttattctatcgaggatcttgctcagttgatttatgaccttcatcaggtcaacccaaaagctaaggtatctgtaaagcttgtggctgaagctggtattggtactgtggcttctggggtggcaaagggaaatgctgatatcatacagatatcagggcatgatgggggaactggagcgagtccagtaagttcaattaagcatgctggtggtccctgggagcttggacttacggagacgcaccagacactcattgaaaatagattaagagaaagggttgttcttagagttgatggtggatttaaaagtggatttgatgtcatgatggctgcagcaatgggtgcagatgagtatggatttggctcggtagcaatgatagccacaggttgtgtaatggcccgcatatgccatacaaacaattgtcctgttggtgttgccagtcagagagaggaattacgagctcggttcccaggtgttccaggagaccttgttaactactttttgtatgttgccgaagaggtgagaggcatgttggctcaactaggctatgagaaactggatgacataattggacacacggatatacttagacctcgggatatatcattaatgaaaactcggcatcttgatcttagttacatcctctctaatgttggattgcctgaatggagcagcagtatgataaggaaccaggaagttcatagtaatggtcccgttctggatgatgttttgcttgcagatccaaagatatctgatgcaattgagaatgaaaaggtcgtcaacaagacagttgaaatatacaatattgaccgtgctgtatgtggtcgtattgcgggtgccgtcgctaagaaatatggtgatactggttttgctgggcagctgaacataatatttactgggagtgctgggcaatcatttgcttgttttctgacgcctggaatgaacatcagacttattggagaagctaatgactatgttggaaagggcatggctggaggagaattggttgtgactcccgtcgaaaatactggattttgtccagaggatgctaccatagtagggaacacctgcttatatggagcaactggtggtcaagtatttgtcaaaggtaaagcaggggagcgttttgctgtgaggaattctcttgcacaagctgttgtagaaggcactggggaccactgttgtgagtacatgacaggtggatgtgttgttgtgcttgggaaggttggtagaaatgtagctgctggtatgaccggaggtttggcatacattctagatgaggatgaaacacttatacgtaaggtaaataaggagatcgttaagatccaaagagtggttgctccggtgggtcaaatgcagctaaagaacctaattgaagcccatgtggaaaaaactggtagcacgaaaggctctcttatcctcaaggactgggacaaatatttgcctctcttttggcaattggttccacccagtgaagaagacacccctgaggccagtgctgaatatgagcaagcagctgtcgggcaggtcactttgcagtctgcagagataccattgaaataaatatgaggaccaatcatatgcacagccatgactatggtctaatcaacgaacagtttgtacaggaaattcattttaatttttagaatcagattgtcagtaaaagagaacagtgaagtctgagagatcgaaacacttgaaagattcaagcttacctttgtcaaacaaggggctaatcatttgtgatgcttggtagctgtacagtgatagtggagaaattgtaaattcttgataaattatggcataatagtgcctttccagtattgcttgccgaagaacttgaagttcagatacaatgttaatgcttttacttgctctggcccctaatttttttccgttccagggggaagtgttttttggtgggtagggggagaaaaccagcgttatcccttataagttgtaacttgtatgatgacttcaactctgatttgagaatatgtaaattagagtagccgagcaaagatttacttgtttggaacatcgataacttgcaatgaaaaatgcttactttgcccctcgtgc

SEQ ID NO: 1450 - DNA, 5333 bp, Plantago ovata
cctgccaactgtttgtataaattcctcacagacctatttctaccagtttcagtttcaggttcatgaacgatgtctgtgcaatcagctggtcaggttgtacagtctgtcaagctttttgctgcaaacaatattactaaaatgacttggttttcgccgaatttcttgccttgtgtggtaccaagaaatccaaaataatcgtcggagggttggtggtggaactaatgctcacaggaataagtttgctttaggagcagcctctaacagaaactgggcttcctccatcaaggctgttcttgatcttgaacgcgttgacaatgcctctaagtccgtaaaacactctgctgctgatgttgttgttaaaccaaaggtcgcaaacctgcaagatatattatctgaacgaggggcatgtggagttggatttattgcaaatttggacaacatagggtctcataaaattgtcaaggatgctcttatagctcttggatgtatggaacatcggggaggttgtggggcagataatgactctggggatggctctggaataatgacttcaatcccatgggatcttttcaacaaatgggctaatgaacaaggtattgatgcctttgacccattgcatacgggtgttggcatgctgtttcttccaaaggatgatagcctgatgaagcaagcccagacagctatactgaatatatttaaacaagagggtcttgaagtgcttggctggagggaagtacccgtcgatgcatctgtggttggttactatgcaaaagaaactatgccaagtatacagcaagtatttgtcaaaattgccaaagaagacgatatcgacgacattgaaagagaattgtatatctgtaggaagttgactgaaagagcagctagctcagaagcatggggaaatgaggtctacttttgctccttatccaatcgaaccattgtatacaagggaatgcttcggtcagaggttcttggcagtttttattttgatctacaaaatgatatatataagtcaccatttgctatatatcatcggagattcagtacaaacactagtcccagatggccacttgcacaaccaatgaggtttcttggtcataatggggagattaataccatacagggaaacttgaactggatgcagtctcgggaaacttcacttaagtctccagtttggcgtggtcgcgagaatgaacttcggccgtttggaaactcaaaagcatctgactctgctaatttagatagtgcagcagaactattgataagaagtggccgagctcccgaggaggctctgatgcttcttgtgccggaggcatacaagaatcatccaacgctatcgatcaaatatcctgagattcttgatttctatgattactacaaagggcaaatggaggcatgggatggacctgctttgctcttattcagtgatgggaaaacagtcggagcttgtcttgaccgcaatggacttcgccctgccagatattggaagacagcagacaatatagtctatgttgcatctgaggttggtgttttgccaatggatgattcaaaagttacaatgaaaggacgcttaggtcctggaatgatgataacagttgatctacagagtggacaggtatttgaaaatactgaggttaaaaagcgagttgcactatcgtacccctacggtaaatgggtcagtgaaaatctccgtgaattaaagccagtgaactttctttcatctactctgttggacaatgaaacaatattaaggcgacaacaggcatatggatattccagtgaagatgttcaaatggtaatagaatcaatggcctctcaagggaaggagcccactttttgcatgggggatgatattccattggcagtattatctacaaagccacatatgctctatgactacttcaagcaacggtttgctcaggtcacaaatccagctatagatcctctcagagaaggcctggtcatgtctcttgaagtcaaccttgggaaacgaggaaacatactagaagttggtccggataatgcatctcaggtgattttgtcgagccctgtgctgaatgaaggagagcttgagtccttattgaaggatccaaaattgaaaccccatgttttacacacatttttcaacataaggaaaggggttgaaggttcactagagaaaacattgtacaagctctgtgaagctgcagatgaagctgttagaaatggttctcagcttcttgtactatccgacaggtctgatgacttggaggcaactcgccctgcaattcctatacttcttgctgtgggagctgttcatcagcatctaattcagaatggactcagaatgcaagcttccattgttgctgatacagctcagtgcttcagtacacatcagtttgcttgtttgatcggatatggcgcaagtgctatatgcccctacttggcattggagacgtgtaggcaatggcggttgagcagtaaaactgtgaacctgatgcgcaatggaaaaatgcccactgtcacaattgagcaggcgcaaaagaatttttgcaaggcagttaaatctggtcttctgaaaattctctcgaaaatgggcatctctttgctctctagttactgtggtgcacagatatttgaaatttatggattggggaaagatatagttgacattgcattttgtgggagtgtgtcaagcatcggtggcttaacattggatgagttggcaagggagtcattgtcgttttgggtcaaggcgttctctgaggatacagctaaaaggctggaaaattttgggttcatacaaatgaggccaggaggtgaataccatggcaacaatccagagatgtcaaaattattgcacaaagctgttaggcaaaagagtgaatctgcatactcaatttaccagcagcatttggccaaccgaccagtgaatgttcttagggaccttgttgagtttaaaagtgaccgttcaccaatcccagttggaaaagttgagtctgcttcatctattgttcagcgattctgtactggtggcatgtcacttggagctatttctagggaaactcacgaagcaattgctattgcaatgaatcgaataggcgggaaatctaattctggagaagggggtgaggatcctatccggtggagtccacttaccgatgtggttgatgggtactccccaacgttaccacacctgaaagggcttcaaaatggtgacactgctacaagtgccattaaacaggtggcttcaggtcgctttggtgtgaccccgacattcttggctaatgccgaccaactagagattaaagttgcacaaggtgcaaaaccaggtgaaggtggtcaacttccagggaagaaagtcagtgcttatatcgcgaggttaaggaattcgaaacctggtgtgcctcttatatctccacctccccaccacgacatttattctatcgaggatcttgcacaattgatctatgaccttcatcaggtaaaccctagggctaaagtatcggtaaagcttgttgcagaagctggaattggcactgtggcttctggagttgccaagggcaatgctgatattatacagatatcgggacatgatggtgggactggagcaagccctgtaagttccatcaagcatgctggtggtccttgggaactagggcttacagaaacacaccagacactcatatcaaatgggctgagagaaagggtaattctccgtgttgatggaggattcaaaagtggttttgacgtcctcatggctgcagcaatgggcgcagatgagtacggatttggttctgttgctatgattgccactggatgtgttatggctcgtatttgccacacgaataattgtcctgttggtgttgctagtcagagggaagagctaagagctcgctttcctggtgtgcctggagaccttgtcaactacttcttatatgttgcagaagaggtaagaggcatgctggctcagttgggctatgagaaacttgacgatgtaattggtcacacagagctacttagacctcgggatatctcattagtgaagactcagcatcttgatcttggttatattctttctaatgttggattacccaaatggagcagcacgactatcaggaatcaggaagttcacagtaatggtcctgttctggatgatacggtgctggctgatgaagagatagccaaggcaattgacaatgaaacggttgtgagcaaaacatttcaaatatacaatgtggaccgcgcagcttgtggtcgtattgcaggcgtaattgcaaagagatatggagacactggctttgctgggcagctaaatatcacattcagaggaagtgcggggcagtcatttgcttgtttcttgacacctggaatgaacatacgattaataggagaagctaatgactacgtagggaagggcatggccggaggtgaattggttgtgatgcccgttgaaaacactggtttcattcctgaagaggcggccatagtgggaaacacatgcttgtatggagcaacaggtggccaagtctttgtaagaggaaaagcaggggagcgttttgctgttagaaactcattagctgaagcagtggtggaaggcacaggagatcactgttgtgagtacatgacaggaggttgtgttgttgtcctcggaaaggtgggtagaaatgtggctgcaggtatgacaggaggtttgggtactttcttgatgaagatgatactcttatcccaaaggtgaacaaagaaatagtaaagatccagagagtggttgctccggtaggccaaatgcaactaaagaacctgatcgaagcccatgttgaaaaaacgggtagcagcaaaggttctgaaatcctgaaagagtgggacaaatatttgccactattttggcagttagttcctccaagtgaagaagacactcctgaggcctgtgctgactatcaatcgacggaagctggccaggtgacattccagtctgcctagctacatatgcctatagtaatctgaacttgaatggggatacataccatacttgtcggttgtcacttactgtctcaatgacaaagttataaagaactccagggaggtatagttcctctgataacagattattggcaagtgctgatactgcagctgttggggaccatataagattgcttgtaagcgtttgaagatcgtgtgttacgctgctgaagtttgtacagttttgctgcatgcaattagatgttaataacttctgagaacacaggtcagattctgggcaaagagactacagtaataagatatagccattgtatgttggtgttctgacagactgatgggtagattgatgatgggtttctccaattcatgttggg

SEQ ID NO: 1451 - DNA, 5816 bp, Solanum lycopersicum
aaccgattacactgtaggagtagtagaaaaagaaaaaaataaaagttgtttgattgttggtcgtattcagttgtcactgcttctcactggttttatgtggttgaaaaaattagttgtcaatcttcgaaaacccgaaagaagagaacaattttggaatcaccattatcacatttactgcaaaaactgacctttgatctcagcctacagtcacctttcacacaaaaaatactcccactcaacatcaacttcaaagtgtggctccaaaactcccttctttttatctcccaatccttcccattctccacacattctctctttctctctaaaccattgactttttctctctctacctacaactatttcacactcactctgcgattctctgtgtaggggagggttctgattaggtttcatggcggtgaattccgtggcaaacgttccgcagttactctacggacagtcaccgaagattctaactggtaataaagacggcttgtttgctgatttccttggattctactgtaaatccagcaagcggattcgtagaaggattggttatgccgccactaataggagaagcttgattaataaaaagtgtaatgctgttcttgaccttcaacgtggtgccagtaatgcatctcgccagtcctctgatatagtgcctaaggttgctgacttggatgacatattatctgaaagaggcgcatgtggggttggttttattgcaaatttggacaataaagcgtcacatgggatcgtcaaggatgctcttgtagcccttggctgcatggaacatcgtggaggttgtggagctgacaatgattctggtgatggttctggattgatgacttcgattccttgggatcttttcaatgattgggctgagaaagaaggaattgctgtctttgacaagcttcatactggcgttgggatggtttttcttccgaatgattctaaccagatgaatgaagccaagaaagttatttccaatatctttaacaacgagggtcttgaggtgcttggatggaggtcggttccagtagattcttctgtagttggatattatgcaaaagtaacaatgcccaacatacaacaggtttttgttcgagttgttaaagaggaaaatgttgatgacattgaaagagaactctatatctgtagaaaactcattgagagggctgtgaactcagaaatttggggaaatgaactttatttctgttcattgtccaatcaaacaatagtttacaagggaatgctccgttctgaagtcctcgggaggttctattatgacttacaaaatgagctctatacatctcctcttgctatttatcatcgtagattcagtacaaacaccagtcccaggtggcctcttgctcaaccaatgaggtttctaggtcataatggagagatcaacactatacagggaaacttgaattggatgcaatccagagaggcctcattgaagtcagctgtttggcgtgaccgagaggatgaaatccgtccttttggcaacccaaaggcatctgattctgcaaatttagatagtactgctgaattactcataagaagtggtcgggctcctgaggaagcactgatgattctcgtcccagaagcatatcaaaatcatccaacattgtcaattaaatatccggaggttcttgatttttataattactacaaaggtcagatggaagcttgggatgggccagccttactcttattcagtgacgggaaaatagttggtgcttgtcttgatcgtaatggacttcgtcctgctagatattggcgaaccaaagacaacgttgtctatgttgcatctgaggttggtgtgatacccatggatgaatcaaatgtaacaatgaaagggcgtttaggtcctggtatgatgataagcgttgatctttcaagtggtcaggtattcgagaatacagaggtcaaaaggcgagttgcattgtccaatccatatggggagtggattaaagaaaatttgcgatctttgaagcctatgaactttttttcaacaacagtaatggatggtgaaacaattctaagacgccagcaggcgtatggctattctagtgaggatgttcaaatggttattgaaagtatggcagcacaagggaaggagcctacattttgcatgggagacgatattcccttggctgtattatctcaaaagccgcatatgctatatgattatttcaagcaacggtttgctcaggttacaaatccagctattgatcccctccgagaaggattagtcatgtcccttgaagtcaatcttggcaagcgtagaaatatactagaggctggacctgaaaatgcttctcaggttattttgcctagtcctgtacttaatgaaggagagcttgaatctcttttgaaagatttacacttgagacctcatgttttgccgacattttttgatgttgggaaaggagttgatgggtccttgaaaaggtcactggataaactatgtgaagcagctgatgaggctgtcagaaatggttctcaactgcttgttctctctgataggtctgacgaattggaagctactcgccctgcaattccaatacttcttgctgtaggtgccgttcaccagcatctgattcaaaatggccttagaatgtctgcttcaattgttgctgatactgcccaatgcttcagtactcatcagtttgcttgcttgatcggatttggcgcaagtgctgtatgtccatacttggcatttgagacatgtcgacaatggcgcttgagcactaaaactgtgaatttgatgcgaaatgggaaaatgcctagtgttaccattgaacaagctcaaaagaacttttgcaaggcaattaaatctgggcttctcaaaattctttcaaaaatggggatctcattgctcgccagttattgtggtgcacagatatttgaaatctatggattggggaaggaggtcatggatattgcattctgtggcagtaaatcaagcattggtggactaacccttgatgagctggcaagagagactttatcattctgggtgaaggccttttctgaagatacagcaaaacgactagagaattatgggttcttacaattcagacaaggaggtgaataccatggaaacaacccagagatgtcaaaactgctccataaagctgtccgccaaaagagtgaaagtgcatattcagtatatcagcagcatttggctaatcgacctgtaaacgttctcagagatcttcttgaattcaaaagtgatcggtcgcctatacccgttggaagagtggaacctgcttcagcaattgtgcagcggttttgcactggtggcatgtcacttggagctatttcaagggaaactcatgaagctattgcaattgcaatgaatagattgggtggaaagtcgaactcaggagaaggtggtgaggatccaattcgctggaagccgcttactgatgtcattgatggatattctccaacacttccccaccttaaaggtctgcaaaatggagatactgcaacaagtgcaattaagcaggttgcttctggacgctttggtgtcactcctacatttctagctaatgccgaccagttagaaattaaaattgctcaaggtgcaaagccaggtgaaggtggccaattgcctggtaaaaaagttagcgcttacattgctagactaaggaattcaaaacctggagttcctcttatatctccaccaccacaccatgatatttattctatcgaggatcttgctcagttgatttatgatcttcatcaggtcaacccaagagctaaggtatctgtaaagcttgtcgctgaagctggtattggtactgtggcttctggggtggcaaagggaaatgctgatatcatacagatatcagggcatgatgggggaactggagcaagcccagtaagttcaattaagcatgctggtggcccctgggagcttggacttacagagacacaccagacactcattgaaaatgggttaagagaaagggttgttcttagagttgatggtggatttaaaagtggttttgatgtcatgatggctgcagcaatgggtgcagatgagtatggatttggttcggtagcaatgatagccacgggttgtgtgatggctcgcatatgccatactaacaattgtccagttggtgttgccagtcagagagaggagttacgagctcggttcccaggtgttccaggagaccttgttaactactttttgtatgttgctgaagaggtgagaggcatgttggctcaactaggctatgagaaactggatgacataattgggcgcacagatatacttagacctcgagatatatcattaatgaaaactcggcatcttgatcttagttacatcctttctaatgttgggttgcctgaatggagcagcagtatgataaggaatcaggaagttcatagtaatggtcctgttcttgatgatgttttgcttgcagatccaaagatatctgatgcaattgagaatgaaaaggtggtcaacaagacagttgaaatatataatattgaccgtgctgtatgtggtcgcattgcgggtgccgtggctaagaaatatggtgatactggttttgccggacagctgaacataacatttaccgggagtgctggccaatcttttgcttgttttctgacacctggaatgaacatcagacttattggagaagctaatgactatgtaggaaagggcatggctggaggagagttggttgtaactcccgttgaaaatactggatttgttccagaggatgctaccatagtagggaacacctgcttatatggagcaacaggtggtcaagtatttgtcagaggtaaagcaggagagcgttttgctgtgaggaattctcttgctcaagctgttgtagaaggcactggggaccactgttgtgagtacatgacaggaggatgtgttgttgtgcttggaaaggttggtagaaatgtagctgctggtatgactggaggtttggcatacattctagatgaggacgaaacatttgtacctaaggtaaacaaggagattgttaagatccaaagagtggttgctccggtgggtcaaacacagctaaagaacctaattgaagctcatgtggaaaaaactggcagcacaaaaggctctgttatcctcaaagactgggacaaatatttgccactcttttggcaattggttccacccagtgaagaagacacccctgaggccagtgctgaatatgagcaactagcttctgggcaggaggtcactttgcaatctgcagaaatgccattaaaataaatttaaataccaattatatgcacacaggcacaaccatgaccacggtctaatgagaagacagtttgtacaggaaattcattttgaatttttagaatcagattgtctgcaaaagaaaacagtgaaatctgagagagaaatacttaaggatgcaagcttacctttatcaaagaagggacacatatctttcgtggtgcttcagcagttgtacagtgatgatggagaaattgtaaattcttgattaattatggcatagtcgtgcctttgccaagattgcttcactgaagaacttggaagttcacacaatgttaatgcttctactagtcctggccattaaatctcttttggtttttgcgttccagtgggctttcattctcatgtctaataagttgtagtaacttatattgtgactttgactctgattcaagaatgtgtaaattagaacagcaaagatttgcttgttcggaatatatcgatatatagcagtgcaaaatgcttctttgatttaagcgtgaaataataaaagtggaaatttcacaaa

SEQ ID NO: 1452 - DNA, 5831 bp, Solanum lycopersicum
aaccgattacactgtaggagtagtagaaaaagaaaaaaataaaagttgtttgattgttggtcgtattcagttgtcactgcttctcactggttttatgtggttgaaaaaattagttgtcaatcttcgaaaacccgaaagaagagaacaattttggaatcaccattatcacatttactgcaaaaactgacctttgatctcagcctacagtcacctttcacacaaaaaatactcccactcaacatcaacttcaaagtgtggctccaaaactcccttctttttatctcccaatccttcccattctccacacattctctctttctctctaaaccattgactttttctctctctacctacaactatttcacactcactctgcgattctctgtgtaggggagggttctgattaggtttcatggcggtgaattccgtggcaaacgttccgcagttactctacggacagtcaccgaagattctaactggtaataaagacggcttgtttgctgatttccttggattctactgtaaatccagcaagcggattcgtagaaggattggttatgccgccactaataggagaagcttgattaataaaaagtgtaatgctgttcttgaccttcaacgtggtgccagtaatgcatctcgccagtcctctgatatagtgcctaaggttgctgacttggatgacatattatctgaaagaggcgcatgtggggttggttttattgcaaatttggacaataaagcgtcacatgggatcgtcaaggatgctcttgtagcccttggctgcatggaacatcgtggaggttgtggagctgacaatgattctggtgatggttctggattgatgacttcgattccttgggatcttttcaatgattgggctgagaaagaaggaattgctgtctttgacaagcttcatactggcgttgggatggtttttcttccgaatgattctaaccagatgaatgaagccaagaaagttatttccaatatctttaacaacgagggtcttgaggtgcttggatggaggtcggttccagtagattcttctgtagttggatattatgcaaaagtaacaatgcccaacatacaacaggtttttgttcgagttgttaaagaggaaaatgttgatgacattgaaagagaactctatatctgtagaaaactcattgagagggctgtgaactcagaaatttggggaaatgaactttatttctgttcattgtccaatcaaacaatagtttacaagggaatgctccgttctgaagtcctcgggaggttctattatgacttacaaaatgagctctatacatctcctcttgctatttatcatcgtagattcagtacaaacaccagtcccaggtggcctcttgctcaaccaatgaggtttctaggtcataatggagagatcaacactatacagggaaacttgaattggatgcaatccagagaggcctcattgaagtcagctgtttggcgtgaccgagaggatgaaatccgtccttttggcaacccaaaggcatctgattctgcaaatttagatagtactgctgaattactcataagaagtggtcgggctcctgaggaagcactgatgattctcgtcccagaagcatatcaaaatcatccaacattgtcaattaaatatccggaggttcttgatttttataattactacaaaggtcagatggaagcttgggatgggccagccttactcttattcagtgacgggaaaatagttggtgcttgtcttgatcgtaatggacttcgtcctgctagatattggcgaaccaaagacaacgttgtctatgttgcatctgaggttggtgtgatacccatggatgaatcaaatgtaacaatgaaagggcgtttaggtcctggtatgatgataagcgttgatctttcaagtggtcaggtattcgagaatacagaggtcaaaaggcgagttgcattgtccaatccatatggggagtggattaaagaaaatttgcgatctttgaagcctatgaactttttttcaacaacagtaatggatggtgaaacaattctaagacgccagcaggcgtatggctattctagtgaggatgttcaaatggttattgaaagtatggcagcacaagggaaggagcctacattttgcatgggagacgatattcccttggctgtattatctcaaaagccgcatatgctatatgattatttcaagcaacggtttgctcaggttacaaatccagctattgatcccctccgagaaggattagtcatgtcccttgaagtcaatcttggcaagcgtagaaatatactagaggctggacctgaaaatgcttctcaggttattttgcctagtcctgtacttaatgaaggagagcttgaatctcttttgaaagatttacacttgagacctcatgttttgccgacattttttgatgttgggaaaggagttgatgggtccttgaaaaggtcactggataaactatgtgaagcagctgatgaggctgtcagaaatggttctcaactgcttgttctctctgataggtctgacgaattggaagctactcgccctgcaattccaatacttcttgctgtaggtgccgttcaccagcatctgattcaaaatggccttagaatgtctgcttcaattgttgctgatactgcccaatgcttcagtactcatcagtttgcttgcttgatcggatttggcgcaagtgctgtatgtccatacttggcatttgagacatgtcgacaatggcgcttgagcactaaaactgtgaatttgatgcgaaatgggaaaatgcctagtgttaccattgaacaagctcaaaagaacttttgcaaggcaattaaatctgggcttctcaaaattctttcaaaaatggggatctcattgctcgccagttattgtggtgcacagatatttgaaatctatggattggggaaggaggtcatggatattgcattctgtggcagtaaatcaagcattggtggactaacccttgatgagctggcaagagagactttatcattctgggtgaaggccttttctgaagatacagcaaaacgactagagaattatgggttcttacaattcagacaaggaggtgaataccatggaaacaacccagagatgtcaaaactgctccataaagctgtccgccaaaagagtgaaagtgcatattcagtatatcagcagcatttggctaatcgacctgtaaacgttctcagagatcttcttgaattcaaaagtgatcggtcgcctatacccgttggaagagtggaacctgcttcagcaattgtgcagcggttttgcactggtggcatgtcacttggagctatttcaagggaaactcatgaagctattgcaattgcaatgaatagattgggtggaaagtcgaactcaggagaaggtggtgaggatccaattcgctggaagccgcttactgatgtcattgatggatattctccaacacttccccaccttaaaggtctgcaaaatggagatactgcaacaagtgcaattaagcaggttgcttctggacgctttggtgtcactcctacatttctagctaatgccgaccagttagaaattaaaattgctcaaggtgcaaagccaggtgaaggtggccaattgcctggtaaaaaagttagcgcttacattgctagactaaggaattcaaaacctggagttcctcttatatctccaccaccacaccatgatatttattctatcgaggatcttgctcagttgatttatgatcttcatcaggtcaacccaagagctaaggtatctgtaaagcttgtcgctgaagctggtattggtactgtggcttctggggtggcaaagggaaatgctgatatcatacagatatcagggcatgatgggggaactggagcaagcccagtaagttcaattaagcatgctggtggcccctgggagcttggacttacagagacacaccagacactcattgaaaatgggttaagagaaagggttgttcttagagttgatggtggatttaaaagtggttttgatgtcatgatggctgcagcaatgggtgcagatgagtatggatttggttcggtagcaatgatagccacgggttgtgtgatggctcgcatatgccatactaacaattgtccagttggtgttgccagtcagagagaggagttacgagctcggttcccaggtgttccaggagaccttgttaactactttttgtatgttgctgaagaggtgagaggcatgttggctcaactaggctatgagaaactggatgacataattgggcgcacagatatacttagacctcgagatatatcattaatgaaaactcggcatcttgatcttagttacatcctttctaatgttgggttgcctgaatggagcagcagtatgataaggaatcaggaagttcatagtaatggtcctgttcttgatgatgttttgcttgcagatccaaagatatctgatgcaattgagaatgaaaaggtggtcaacaagacagttgaaatatataatattgaccgtgctgtatgtggtcgcattgcgggtgccgtggctaagaaatatggtgatactggttttgccggacagctgaacataacatttaccgggagtgctggccaatcttttgcttgttttctgacacctggaatgaacatcagacttattggagaagctaatgactatgtaggaaagggcatggctggaggagagttggttgtaactcccgttgaaaatactggatttgttccagaggatgctaccatagtagggaacacctgcttatatggagcaacaggtggtcaagtatttgtcagaggtaaagcaggagagcgttttgctgtgaggaattctcttgctcaagctgttgtagaaggcactggggaccactgttgtgagtacatgacaggaggatgtgttgttgtgcttggaaaggttggtagaaatgtagctgctggtatgactggaggtttggcatacattctagatgaggacgaaacatttgtacctaaggtaaacaaggagattgttaagatccaaagagtggttgctccggtgggtcaaacacagctaaagaacctaattgaagctcatgtggaaaaaactggcagcacaaaaggctctgttatcctcaaagactgggacaaatatttgccactcttttggcaattggttccacccagtgaagaagacacccctgaggccagtgctgaatatgagcaactagcttctgggcaggaggtcactttgcaatctgcagaaatgccattaaaataaatttaaataccaattatatgcacacaggcacaaccatgaccacggtctaatgagaagacagtttgtacaggaaattcattttgaatttttagaatcagattgtctgcaaaagaaaacagtgaaatctgagagagaaatacttaaggatgcaagcttacctttatcaaagaagggacacatatctttcgtggtgcttcagcagttgtacagtgatgatggagaaattgtaaattcttgattaattatggcatagtcgtgcctttgccaagattgcttcactgaagaacttggaagttcacacaatgttaatgcttctactagtcctggccattaaatctcttttggtttttgcgttccattgggctttcattctcatgtctaataagttgtagtaacttatattgtgactttgactctgattcaagaatgtgtaaattagaacagcaaagatttgcttgttcggaatatatcgatatatagcagtgcaaaatgcttctttgatttaagcgtgaaataataaaagtggaaatttcacaaaccaaggtaaactcaa

SEQ ID NO: 1453 - DNA, 5206 bp, Arnica chamissonis
agcatgtctcttcagtctgtagcccatgttaatggctactatctaaaacctacttccgttttcgcatccaaacgagacattttgttcacagattttgtaaatttgggggctaaacgaagtaatcggagattaatcggtgctggtgcggctgctctcaagggttttggaacgttccagaagaaaaggaactggtcgtcttcgatcaaatcggttcttgattttgatcatgttgattcgaaacaatctcccgattcgaaagtgcaggttgcaaatttggaagacatattagccgaaagaggggcatgtggggttgggtttattgctaatttggacaacaaggggtctcatgaaatagttcaagatgcacttacggctcttggttgtatggaacataggggtgggtgtggggctgataatgattcgggtgatgggtcgggtttgatgacttcaattccgtgggaatttttcaatgattgggctggaaaagaggggattgctccctttgatcaattgcatacaggggtaggaatggtatttcttccacaagatgaaaaacttatggaacaagccaaatctgttattgtaaacatcttcaatcaagagggtcttgaggtgcttgcatggaggtctgttcctgttaatacgcctattgttggttactatgcaagagaaacaatgccaaatatacaacaagtttttgttaaaatcatcaaagaagatgacattgatgatattgagcgggaattatatatatgtcgtaaattgattgaaaaaaaagctagttcagaagcatggggaaatgaactttatttctgttcattatcaaatcggaccatagtttataaaggcatgcttcggtctgaggttcttggtaaggttttactatgatctccaaaatgaagattataaatcgccttttgcaatttaccaccggagatacagtacaaacacgagtcctaggtggccacttgctcaaccaatgaggcttttgggtcataatggagagattaataccatacagggaaacttaaactggatgcaatctcgagaaaactcacttaagtcacctgtatggcggggtcgtgaaaatgaaattcgaccttttggaaatcccaaggcatccgactcagccaatcttgacagtgcagcagaattgtttatacgaagtgggcgtactcctgaggaagctatgatgattcttgtccccgaggcatacaaaaatcatccaactttgtcaatcaaatatcccgaggttgttgatttctacaactattacaaaggtcaaatggaggcttgggatggacctgctttactcctatttagcgatggtaagacagtaggtgcctgtcttgaccgaaatggacttcgccctgctagatactggcggactgttgacaatgttgtttatgttgcatcagaggtgggagttctaccaatagacgattcaaaagttataatgaaagggcgtttaggtccagggatgatgataactgttgatctaatcaatggtcaggtttatgagaatactgaggttaagaaaagagttgctttgtcaagtccttacggaaagtggatagctgaaaacatgagaattttggagcctgcaaatttcctgtcatccccaactatggaaaatgaaacaatattgcgtcatcaacaggcattcggttactctagtgaggatgtccaaatggttattgaaagcatggcttcagaagggaaggaacctacattttgcatgggagatgatactccattagccatattatctcaaaagtcacatatgctttatgattatttcaaacaacggtttgctcaggtcacaaatcctgcaatcgatccacttagggaaggattagtgatgtcacttgaagtcaatcttggtaagcgtgggaacatattagaagttggacctgagaatgcctctcaggtgactctatccagccctgtacttaatgaaagtgagcttgaatcattatttaaggatccaattttgaaaagccaaactataccaacatttttcgacatacgaaaggggcttgatggttcattggagaaaacactgaataagatctgtgaagctgccgatgaagctgttagaaatggttgccagctacttgttctgtctgacagagctgatgaactagaagccacacgtccagctgtcccaatacttcttgctgtaggtgcggttcaccagcatttaatacaaaatgggttgcgaatgtctgcttcaattgtcgctgacactgctcagtgcttcagtacacatcactttgcttgtttgattggatatggtgcaagtgcggtatgtccttacttggcatttgagacatgtcgacaatggcgtttgagcaagaaaactttaaaccttatgcggaatgggaaaatgcaaatggttacaattgaaaaggctcaaaacaacttcaaaaaggcagttaatgctggtttaatgaaaattttatccaaaatgggaatatcattgctctcaagttattgtggtgcacaaatatttgagatttacggtttgggaaaagaagttgttaattttgcatttactggaagcgtgtcaaatattggtggattgacttttgatgagcttgcaagggagagtttgtcattttgggttaaggctttttctgaggaaacagctaaaagacttgaaaattttggatttatacaaatgagaccaggaggggaatatcatggcaacaaccctgagatgtcaaaactgcttcataaagctgtacgtgaaaaacgtgaaagtgcatattcaatttaccagcagcatttggctaaccgacctatcaatgttatccgtgatctttttgaatttaagagtgagcgggctccgattccagtaggaaaggtggaatctgctgcatctattgttgagcgtttttgtacaggtggcatgtctctaggggctatttccagggaaacccatgaagcaattgccattgcaatgaataggattggcgggaaatctaattctggagaaggtggtgaggatcccattcgatggaccccactttctgatgttgtggatggatactctcccacactgccacatcttaaaggtcttcaaaatggagatactgctacaagtgccatcaagcaggttgcatcggggcggtttggtgtgactccaacatttttggtcaatgctgaccaaatagaaatcaaaattgctcaaggtgcaaaaccaggtgaaggtggtcaactgccaggaaaaaaagtcagcgcatatattgcaagattaaggaattcaaaacctggagtccctcttatttctccacctccacatcatgacatttactctattgaagatcttgctcaactaatattcgaccttcatcagatcaatcctaaggctaaagtatctgtcaagcttgtggcggaagctggaattggcactgtggcttctggagttgcaaagggtaatgctgacgtaatacagatatcagggcatgatggcgggactggggcaagtcccataagttcaatcaagcatgctggtggtccttgggaacttggtctcaccgaaactcaccagactctaattacaaatggtcttagagaacgagttattcttagagttgatggtggtttcaaaagtggatttgatgttcttatggctgctgcaatgggtgctgatgaatatggttttggttcaattgctatgattgctacaggatgtgtgatggcccgtatttgccacacaaataactgtccagttggtgtcgctagtcagcgagaagaactacgagctcgttttcctggtgtgcccggtgatcttgtgaactactttttgtatgtggctgaggaggttagaagcacgttggctcaactggggtatgaaaagcttgatgatatcattggacacacagaattattaagaccacgagatatttcattagtaaaaactcagcatcttgatcttagctatgttctttcgaatgttgggatcccaaaatggagcagcacaactattaggaagcaggaggttcatagtaacggtcctgttctggatgacattttgctttcggacatagagatatcagatgcgattgaaaatgagaaagtggtaaacaaaacattcaagatatacaatgtggatcgtgctgtttgtggccgggtagcaggtgctgttgcaaagaagtatggagataccggttttgctgggcagctaaacataacatttgaagggagtgcaggacaatcatttgcgtgcttccttacacctggaatgaacatacgactagtaggagaagccaatgattatgttggaaagggtatggctggtggtgaagtggttgtgaagcccgttgaaaataccggctttacccctgaggatgctgcaattgtcggaaatacttgtttatatggagcaacaggtggccagctttttgttagaggcaaaaccggggaacgttttgctgttagaaattcccttgctcaagcagtggtggaaggtaccggagatcattgctgtgaatacatgactggtggttgtgtggttgtccttggaaaggttggccggaatgtggcagctggtatgactggtggtttggcatatattcttgatgatgacgataccctcattcccaagataaataaggagattgtgaaaatccagagagtggttgcacctgtggggcagatgcagctgaagagcctcatcgaagcacatgttgaaaaaaccgggagcaccaaaggttcggctatcttgaaagaatgggacaaatatttacctctattttggcagttggtcccacccagtgaggaagacacacccgaggcttgtgccgaatatgaacaaacaatcgcggggcaagtgaccgcgcgatctgcataaaacccgcttttataaaaccaacattagatgaaaacgattcttttgacttcttgaccagatagattcattcaggtttgactcgagtgatggtcaaagctgtcggtgatgccatgagaagattatgatggaaaaagttatggtggtttggtttggtttggtctggtctggttggttgaaaaacctaccctttgaaggtgtgaatgtatacacagaacatagagatggtgcaagaaatgtaaattcttagggtacaatatttgaataaataaacttttgtatgtatgtgcatatgtgatgtagccacatcacatgctccattttatattttcacaacaatagtctctccct

SEQ ID NO: 1454 - DNA, 5214 bp, Mimulus guttatus
ggagggttgggagtgtaaatagtaggaggaatcattttcttggtttggcggcttcgaacaagaactgggcttcctccattcagtctgttcttgatcttgaacgtgttaccaatgcctcaaccaaacagtcttctgatctcaaaccaaaggctgcaaacttggcggatatactagcggaaaaaggcgaatgcggggttgggttcatagctaatttggacaacaaagcatcctatggaatcgttaaggatgcccttaaagcactcggctgcatggaacaccgtggaggttgtggagcagataacgattcgggagatggttccggaataatgacttcgatcccgtgggatcttttcaacaagtgggcccacgaacagggcatgagctccttcgaccagttgcacactggagttggaatggtctttcttccgaaagacgacgacttgatgaaacaagccaaacaagctattttggatatatttaaacaagagggtctcgaagtactcggctggagaccggtgccagtagacgcatccgtggttggtttctacgcaaaggaaacaatgccgaatatacaacaggtctttgtccaaatatccaaagaagaaaacatagacgacattgaaagagaactgtacatctgtcgaaagctgatcgaaagagctgccacctcagcggcatggggaaacgatgtctacttttgttcgttatcgaaccaaactattgtttacaagggaatgcttcggtcggagattcttggtcggttttatttcgatctgcaaaacgatgtttacaaaaccccgtttgctatatatcatcgtagatacagtacgaacactagtcctaggtggcctcttgctcaaccaatgaggttcctcggtcacaatggagagattaataccatacaggggaatttgaactggatgcaatcgagagagacttcattgaagtcccctgtttggcgtggccgtgaaaatgaaattcggccttttggaaactcgaaagcttccgattctgcaaatcttgatagtgctgcagaattgttaattagaagtggtcgaaatcccgaggaagccctcatgcttcttgttccagaggcatacaagaatcacccaacactaatgatcaaatatcccgaggttgttgatttttacgattactacaagggtcaaatggagccatgggatggacctgctttactcttattcagtgatgggaaaacagttggagcttgtcttgaccgtaatggacttcgtccagctagatattggcgtacagtagacaatgttgtctatgttgcatctgaggtgggggttctaccaatcgaagactcgaaagttgtaatgaaagggcgtttaggtccaggaatgatgataacagtcgacctatctagtggccaggtttttgaaaatacggaggttaaaaagcgagttgcacagttgaatccatacggaaaatgggtgagcgaaaatctccgctcgttaaaagctgtcaactttctgtcatcaaccgtcatggacaacgaaacaatattaaagcgtcaacaggcatacgggtattctagtgaagacgttcaaatggtaatcgaatcaatggcttctcaaggaaaggagcctactttttgcatgggggatgatattccattggcagtattatcgagaaggccgcatatgctgtacgattatttcaagcaacgattcgctcaggttacaaatcctgctatcgaccctcttagagaaggattagtcatgtctcttgaagtcaacctcgggaagcgagggaacattctagaagttggtcctgaaaacgtctcgcaggtgattttgtcgaaccctgttctgaatgaaggggagctcgagtcgttactgaaagatccgttcttgaaagcccaaattttacctactttctttagcataaggaaaggaatcgaaggctcacttgagaaaaggctttacaagctttgtgaagctgctgatgaagctgttagaaatggcgcccagcttcttgttctctctgataggtccgacgagctggatgcgaccaagccggcaattccgatacttctagctgtgggtgctgttcatcagcatctaattcagaatggactgagaatgcaaacttccattgttgctgatacagcacagtgcttcagtactcatcaatttgcttgtttgattggatatggtgcaagcgctatatgtccatacttggcattggaaacgtgtcgtcaatggcggttgagcactaaaaccgtgaacttgatgagaaacggaaaaatgcccactgttactattgaacaagctcagaagaatttctgcaagtcagttagatccggccttatgaaaattctttcgaagatgggaatctcgttgctatccagttattgcggagcacagatattcgaaatttatggactggggaaagatatagttgaccttgctttttgtgggagtgtgtcgagcattggtggattaaccttggacgagttggcaagggagactttatcgttttgggttaaggcattctccgaagacactgctaaaagactcgagaatttcgggttcatacaatttaggcctggaggtgagtaccatggaaacaatcccgagatgtctaaattgctccacaaagccgttcgacaaaagagcgaaaccgcatatttggtttaccagcagcatttggctaatcgacccgtaaatgttctgagggatcttatcgagttcacgagtgatcgtgctccaatcccagttggaagagtggagcccgctttgtctatcgttaagcgattctgtacaggtggcatgtcgctcggtgctatttcgagagaaacccacgaagcaattgccatagctatgaatcgattaggcggtaaatccaattcaggcgaaggtggtgaggatccaattcgatggagcccacttacagatgtcgttgatggttactctccgacactgccacatctcaaaggtcttcaaaacggcgataccgctacaagtgccataaagcaggtagcttcggggagatttggtgtcacgccgacatttttggctaatgccgaccaattagaaatcaagattgctcaaggtgctaaaccaggggaaggcggccaattaccagggaagaaagttagtgcttatattgcgagattgaggaattcgaagcctggcgtaccgcttatttctccgccgccacatcatgatatttattcgattgaggatcttgctcagttgatttacgaccttcatcaggtgaatccgagggctaaagtatcggtgaagttagttgcggaagctggcattggtacagtggcttctggagttgctaagggtaatgctgatattatacagatatcgggccatgatggtggaaccggagctagccccgtaagttctatcaagcatgctggtggtccatgggaactcggccttacagaatcacatcagacactcatttcgaacgggcttagagaaagggtcattctcagagtggacggaggattcaaaagtggattcgatgttctaatggctgcggctatgggtgccgacgaatacggattcggctcagttgcaatgattgccactggctgtgtcatggctcgtatttgccacactaataattgccctgttggtgttgctagtcagagagaagagctgagagctcgttttcctggtgtacccggtgaccttgtgaactactttttatatgttgctgaagaggtaagaggaatgctggctcaattgggatacgagaaactcgacgatgtgattggccacaccgaattattgaagccaagagatgtttctttgatgaagactcagcatcttgatcttagttacattctttctaatgttggattaccaaaatggagcagtactgtgataagaaatcaagaagttcacagtaacggtccggttttggacgatacattgctttcggacccagaggtggcgaatgctattgacaacgagacggttgtgaataaatcggtgaaaatatataacgtggacagggcagtttgcgggcgtattgctggcacaattgcaaagaaatacggagacactggatttgctggacaagtgaacctaacattcacgggaagcgctggccaatcgtttgcttgtttcttgacacctggcatgaacattcggttagtaggagaagccaatgactatgttgggaagggtatggcgggaggagaagtggtggtgactccggaggaaaatcccggatttgcccccgaggacgccacaatagtgggaaacacgtgcttgtacggagcaactggcggtcaactcttcgtcagggggaaagccggcgagcgttttgccgtcagaaactcactagcggaagcggtggtggaaggcgccggagatcactcgtgcgagtacatgaccggtggttgcgttgtagtcctcgggaaggtgggccgaaatgtggcagctggtatgaccggaggcttggcttatattctcgacgaggataatacgcttatccctaaggtgaacaaggaaattgtcaagatccagagagtcgttgctccagtcggacaaatgcagctcaaaaacctaatcgaagcccacgttgaaaaaaccggtagctccaaaggagcagaaattctgaaagagtgggacacatatttgccgctcttttggcaactcgtaccgccgagcgaagaagacacgccggaggcttgtgccgattacgaggagacgacttctggacaggtcactctgcagtctgcatagaaaaaaaaaaataatccggtatacgaagacggaaaaagaagacggacgaaattgtttccgagagacgagacgaatttcatcctcggcgttggattaaaaaagtccgaggttgtctcgaaagttgtatattgtgtttgcaagaattctgttagatgctgtgatagggtttctcagaatgagagtggtgtattttattttttttcaggattttcatttttaagtgcaagaattgatggagatgtgaaatatcaagaatttcaaattgacccccaagaaaaataaagggggttctccaatttatgttggggggcttgttgctataaatttatatttttatatattcattaatatataattgtatatgcagttaaacggtatccttgtatatttggaatttctgaaatttatttggtgtgtaaaattgcgctctggatttgaatgtaataactaatataactaatactcttgttct

SEQ ID NO: 1455 - DNA, 5122 bp, Triphysaria pusilla
gtgagctgaggttgatgagaaaatgtctttacactcagcgggtcaagtcgtgcagtctgtgaaactatttgcagggaacagtataactgataattgtaaaaaagatttcgtctttgttgattttgtgggattgtgtggtaccaagaaatccaagaaaagtggggctcgtcggagattaagcggcggtttgaacagtagtaatgttcagaggaaccattttcttggattgtcggtgtcaaagagaaactgggctccatctattaagtctgttcttgatcttgaccgtgttaatggtggccaccaccagcagcagcctgctgatctgaaaccaaaggttgcgaacttggaagatatattatctgaaagaggggaatgtggagtcgggtttattgcaaatttggacaacaaagcatcatatggtattgttaaggatgctcttacagctctaggctgcatggaacatcgtggaggatgtggggcagataatgactctggagacggttccggagtgatgacatcaatcccttgggaatatttcaacacttgggcccacgagcaagggatgagtgcctttgatcaggtgcataccggcgttggtatggttttccttccaaaggacgacgaactaatgcaacatgccaaaacagttattgtaaatatatttgaacaagagggtcttgaagtgctcggctggaggtcagtaccagtcgacacgtccgtggtcggttattacgcacgtgaaactttgccgaatatacagcaagtgttcgttcagattgctaaagaagagaatatcgacgacatcgaacgagagctttacatctgtcgaaagctgatcgagagagcagcgagctcggagccatggggcaacgacctttacttctgctcgttgtccaatcaaacaattgtttacaagggaatgcttcgagcagaggttcttggtcggttttatttcgatttgcaaaacgaactttataaatctccttttgctatataccaccgaagatacagtacaaatactagtcctaggtggcctctagctcagccgatgagatttcttggtcataatggagagatcaataccatacaggggaacttgaactggatgcagtctcgagaagcttcattgaaatcccctgtttggaatggtcgggaaaatgaaattcgcccttttggaaacccaaaggcatctgactctgcgaatcttgatatggccgccgagttgttaataagatcaggccgtgctcctgaggaatcccttatgctccttgtcccagaggcatataaaaatcatccaacactgtcgatcaaatatcccgaggttattgatttttacgactactacaagggtcaaatggaggcttgggatggacctgccttagtcttattcagtgatgggaaaacagttggagcttgccttgaccgaaacggacttcgccctgctagatactggcgcacttccgacaatgtcgtctatgttgcatccgaggtgggtgttgtaccaacagatgattcaaaagttgtagcgaaaggtcgattaggtcctggaatgatgattgcagtcgatttaactagtggacaggtgtttgagaataccgaggttaaaaagcgagttgcactgttgagtccctatggaaaatgggtgaacgaaaatctccgttctttaaagactgcaaactttctctcggcacctgagttggacaatgatacaatattaaagcgtcaacaagcatttggatattcaagtgaagatgttcaaatggtaattgaagcaatggctgctcaagcgaaggaacccacgttttgcatgggggatgatgcacctttggcagtattatctagaaggccgcatatgctatatgattatttcaagcaacggtttgctcaggttacaaatccagctatagatcctcttagagaaggattggtcatgtctcttgaagtcaaccttgggaagcgaggcaacatactagaagtgggtcccgagaatgcctctcaggtgattttgtcgaaccctgtgctgaatgaaagggagctcgagtcgttattccaagacccatatttgaagccgcaagtattaccgacatttttcgacatcaggtttggagttgaaggttcactggagaaaactctgtacaagctttgtgaagctgccgatgaagctgttagaaatggcgcccagcttcttattctctccgacaggtccgatgagctggaggcaactcggccagccattcctatactgctagctgttggggctgttcaccaacatctgattcagaacggactgcgtatgaaagcttctattattgccgatacggctcagtgcttcagtacacatcagtttgcttgtttgattggatatggggcgagtgccatatgcccgtacttggcattagagacatgtcgtcaatggcggttgagcaataaaactgtgaacctgatgcggaatggaaaaattcccactgttactattgaacaggctcagaagaacttttgcaaggcagttaggtctggccttatgaaaattctctcgaaaatgggcatctcattgctctcgagttattgtggcgcacagatatttgaaatttatggactcggcaaagacatagttgatcttgctttttgtgggagtatgtcgagcattggtggattaaccttggacgagttgtcgagggagactttatcattttggattaaggctttttctgaagataccgcaaaaagacttgaaaactttgggttcatacaatttagaccaggaggtgaatatcatgggaacaatccggagatgtcaaaattgctccacaaagctgttagacaaaagagtgaaactgcatattcggtttaccagctgcatttggctaaccgacctgtaaatgttttgagggatcttattgagtttaagagtggccgctcgccgatctcagttggaagggtcgaacccgctatttctattgttaagcgattttgtacaggtggcatgtcgctcggtgctatttccagggaaacccatgaaacaattgccatagcgatgaatagattaggtggaaaatctaattcaggagaagggggcgaggatccaattcggtggagcccactttccgatgttgttgatgggtactctccaacattgccacaccttaaaggtcttcaaaatggcgatactgctacaagtgccataaagcaggtagcatcaggacgttttggtgtcactccgactttcttggttaacaccgatcaattggaaatcaaaattgctcaaggtgcgaaaccaggcgaaggcggccaattgccggggcagaaagttagtgcttatatcgcgaggttgaggaactcaaagcctggggtcccacttatatcacctcctccacatcacgacatttattctatcgaggatcttgctcaattgatttatgaccttcatcaggtgaatcctagggctaaagtatcggtaaagctggtcgcagaagctggcattggtactgtggcttccggagttgctaagggcaatgctgatattatacagatatccgggcacgatgggggaactggagccagtccggtaagctctatcaagcatgccggtgggccttgggaacttgggctgacagaaactcatcagacactccttcaaaacgggcttagagaaagggtaattctcagagtcgacggtggcttcaaaagtggatatgatgttctcatggctgcaacaatgggagctgatgaatacggattcggttccgtcgcaatgattgccactggctgtgtcatggctcgtatatgccacactaataattgtcccgtcggtgttgccagtcagagagaagagctacgagctcgtttccctgctgtgccggatgaccttgtcaatttcttcttatatgtcgctgaagaggtaagaggtatgctggccaaactggggtatgagaaacttgacgacgtaattggccacaccgagcttctaaaagctcgagatgtttcattggtcaagactcagcatctcgatctgagtaatattctttccaacgtcggattaccaaaatggaccagcaccgagataaggaatcaagaagttcatagtaatggtcccgttcttgacgatacgttactttctgacccagagctggcaaatgctattgaaaatgaaacgatcgtgaataaatctgtagatatatacaacgtggacagggcagtttgtgggcgcatagctggcgtgattgctaaaaaatacggagacactgggttcgccggccagctgaatataacatttaatggaagtgcgggccagtcgtttgcttgttttttgacacctggcatgaatatccggttaatcggagaagctaatgactacgtaggaaagggtatggccggaggcgagctggtcgtgacacctgtcacacaaactggatttgtgcctgaggacgctactatcatcggaaacacgtgcttgtacggagcgacaggtggacaagtgtttgtcagagggaaagctggggagcgattcgccgtgcgcaactctctcgcacaagctgtagtcgagggaaccggggaccactgctgtgagtacatgacaggtggctgtgtcatcgtccttggaaaggtgggtagaaatgtggcggctggtatgactggcggcctggcgtatcttcttgatgaggacgatacacttatcccaaaggtgaacaaggaaattgtgaagatccagagagttattgctccagtcggccaaatgcagcttaagagccttatcgaagcccatgttgaaaaaacgggtagcggcaaaggctcggaaattcttaaagattgggacaaatatttgtcgctcttttggcagctcgtcccgcctagcgaagaggatactccagaggcgtgtgcggactatcagacgtcctctgggcaggtgacttttcagtcggcatcctaagtacctgtaaacgagcccgattctagtttattgtacttagtgcatcggcagttgtacagttgtggctgcagaaactatataattgtgtataacagatgaactcaggtttattttttgcttaaaaacaaatgtccgactcgtatatgcataagtgcacttttagtatctaaaataatggaaaatgcgtgattttga

SEQ ID NO: 1456 - DNA, 5394 bp, Eutrema parvulum
aacagcgacgggcgattcgagtcctgcgttgtcgtgctcactgatcacataccatttttctctttaagctcgtgcccatgagctgaaaaacatcagcggctagattttctctgcgtttccggtgcaccgtacacttcatcgcaggaaaataatctctgcttctattttgactttttgaaaataacggcaacagtcactcagagagagagagagtcagttggaaatccgatcgatcgctttctcgctcggcgttttcaagcttcgttccatggccctacaatctcccggcgccgccggagcttcatcctctgtctctcggcttctctcctccgggaaagtaagttctacgaagactctcttctctgttgacttcgtcggatcctactgtctttcgaagggaaccaaacggcgtaacgaactcgccgggtttcgcggctacagtccactgcttaagtcctcgctaaggtctccgttgtcggcaaaagcgatcctgaattttgaccggcccgccggtgatgcatcggcttccttttctgatctgaaacctaaggtggcctacttggaagacatagtttcagaaaggggagcatgtggagttgggttcatcgcacacttggagaacaaagctacacataaaattgtaaatgatgctctgatagcacttggttgtatggaacacaggggcggttgtggtgctgataatgcttctggtgatggttctggtttgatgacttccattccttgggatctatttaacgattgggctgagaagcaaggaatggcttcgtttgataagctgcatactggtgttggaatgctgttcctgccgagagacgaaaacattaggaaagaagccaagaaagtggttacaagtgttttcgagaaagagggcctggaggtgcttggatggagggaagttcctgtagagccgtccattgtcggtccttatgccaaaaagacaatgccaaacacgcaacaggtctttgttagaattgtcaaagaagataaagtagacgacgttgaacgagagctttacatttgcaggaagctgatagaaagagcagttgcttctgaaagttgggcctctgagctctacttcagctccttgtccaaccagaccattgtttacaagggaatgcttcgttcagaagttcttgggttattttactccgaccttcaaaatgatctttataaatctgcgtttgccatctatcatcgaagatttagcacaaatactagtcccagatggcctctagctcaaccaatgaggtttcttggacacaatggggagatcaataccatacaggggaacctaaactggatgacatctcgagaagcatctctaaaatcacctgtctggcatggacgtgaagatgatattcgcccaattagcaatccaaaggcttcggactcctctaaccttgatagtgcagcggaacttttgataagaagtggccggactccagaagaatctctaatgattcttgtcccagaggcatataaaaatcacccgaccttaatgattaaataccctgaggctgtagacttttatgattattacaagggccagatggagccctgggatggacctgcattggtattgttcagtgatggaaagactgttggagcttgcctcgaccgcaatggacttcggcctgcaagatattggcggacaagtgataatgttgtctatgtagcctctgaggtcggagttcttccaatggatgaatcgaaagtcaccatgaagggtcgtctaggacctggcatgatgatatctgttgacttagaaagtggacaggtatatgagaacacagaagtgaagaagcgggttgcatctaataacccatatggaaagtgggtaagtgaaaacctgcgaaccctgaagccttctaattttctttcgtcagcaatcatggagactgaagagactttaagacgccaacaggcgtttggctactcgagcgaagatgttcagatggtaattgagtcaatggctgcacagggaaaggagccgactttttgcatgggagatgatactccagtggcagtattgtctcagaagccacatatgctttatgattatttcaagcagcggtttgctcaggttacgaatccagctattgaccctcttcgagaaggattggtcatgtcacttgaagttaatattggaaagcgtgggaatatattggaggttgggcctcagaatgtttcacaggttgttttgtctggtcctttactaaatgaacgggagcttgaaggtttgctcagcgatccacatttgaaatctcaagtcttgcccacattttttgacatacatagaggaattgatggatctttgaagaaggctcttcttaaactctgcgaagctgcagatgaagctgttcgtaatggttcccaagtgcttgttctctcagacagatctgataatccggaaccaactcgaccagcaattccaatgttgttggcggtaggtgctgttcaccaacatctgatcgagaacggtcttcggatgtcagcttcaataattgcagatacagctcagtgctttagtacacatcactttgcctgtttgattggatatggagcaagtgctatatgcccgcacctggcactggagacatgcagacagtggcgtctgagcaacaagaccgtgaacatgatgagaaatggaaaaatgcctactgtaactatagaacaagctcaaaagaattatcgcaaggctgttaacactggtcttcttaaggttctctctaagatgggcatttcgttattctctagttattgtggagcacaaatatttgagatttatggattggggaaggaggtggttgaattttcgttccgtggtagtgcatctcgaattggtggattaactttggatgagctggctagggagacgttaactttttgggtgagggcattttctgaggatacagccaaacggctagaaaactttggtttcattcaatttaggcctggaggcgaatatcatggaaacaatccagagatgtctaaattacttcataaagccgtccgcgaaaagagtgagacagcctatgcagtctatcagcagcatttagccaaccgtcctattacggtttttcgtgatcttcttgaattcaaaagcgaccgtaagcctattcctgttggaaaggttgagcctgcctcttctatcgtggagcggttttgtactggtggaatgtctctcggagcaatctcgagagaaactcatgagacaattgctatagcgatgaacagattagggggaaagtccaattcaggggaaggaggcgaggatccaatccgctggaagccgctaacagatgttgttgatgggtactcttccacactgccacatcttaaaggtcttcgaaatggagataccgctacaagtgctataaagcaggttgcttcagggcgttttggtgttactccaacgtttttggttaatgcagaccagttggaaatcaaagttgctcaaggagcgaagccaggtgaaggtggccaacttcctgggaaaaaagttagcgcatatattgctagacttagatattctaaaccaggagttccgcttatctctccacctccacatcatgatatttattccatagaggatctggcgcagttgatctttgatcttcatcaggtgaaccccaaggcgaaagtatcagtcaaacttgtatcagaagctggaataggaacagttgcctcaggagtagcgaaggctaatgctgatatcatacagatatcagggtatgatggtggaactggagccagccctataagttccataaagcatgctggtggcccatgggaacttggactagctgaaactcagcagactctcattggaaatggactcagggaaagagtaataatcagggttgatggaggattcaagagtggtgttgatgtgttgattgctgcagctatgggcgccgatgagtatgggtttggtactctggcaatgattgccacaggatgtattatggctcgtatttgccacactaataactgccctgttggtgttgccagtcagagagaggagctgcgtgcacgtttccctggtctgcctggtgatcttgtcaatttcttcttgtatattgcagaggaggtgaggggcatattagctcagttgggatatgaaaaattggacgacataattgggcggagagatttgcttaagcctagggatatctcgctcgtgaaaactcatcttgacctcagttatcttttatcttccgttgggctgccaaaacgtagcagtacttccattaggaagcaggaggtgcactcaaatggtcctgtccttgatgatactctgcttcaggatccggagataatggatgcaattgagaatgaaaaaacggttcacaaaaccatgaatatatacaatgtggaccgtgctgtttgcggtaggattgcaggggtaattgcgaagaaatacggagacactggttttgctggacaactaaacctaacgttcaatggaagtgctggccaatcttttgcatgttttctaagtcctggaatgaatatacgtcttgtgggtgaagccaacgactatgtgggaaagggaatggccggaggtgaagttgtgatattaccagtggaatcgactgggtttcttcctgaagatgcaactattgtaggaaacacttgtctgtatggtgcaactggtggtttactatttgtcagaggcaaagcaggagagagatttgcagttaggaactctctagctcaagctgtcgttgaaggcactggagatcactgctgcgaatatatgactggtggttgtgtagttgtacttgggaaagtcggtagaaatgtagctgccgggatgacaggtggtttggcgtatattcttgatgaggacaacactctcctccctaaggtgaacaaagagatagtaaagatccaaagagtgacttcaccagtgggacaaacacagcttaagagcctgattcaagctcatgtggagaaaacaggaagcagtaaaggagcaacaattgtggaggaatgggacaagtatcttgcaatgttctggcaacttgtaccgccgagtgaagaagacacgccggaagctaactccgaccaccacctgaaaatgacgaccaccggagaagaagagcaagtatcaaacacgtttgcagtgtagttgcacaatgagaagaagtaaacgcttcagaagtgatggtagtttcttctttgtacagtcaaagtctctggtcgagataagtctctcagtttccgagttattacattacaaccaagttctccatttggttttttcttttctaattctgtctggattcggttattgttcagtttacttcgtccggtcgttaataataaaaggaaatccaccatgtttctactttatataccatgggg

SEQ ID NO: 1457 - DNA, 5555 bp, Eucalyptus grandis
atggctctgcagtcggcctcccccggcgcacagctcctccactccgccgccaagcccagctcggtcctcctccccaaccgaggaggcggaggaggaggaggaggaggaggaggactcggatggagcggcggtagcatcttctccgtcgatttcgtcggcctctactgtaaatccaagccggccaggcggcgcctcggcgtctccggctccccctccaggagcctctcccggctcctccccgcgtcgccgtcgtcggtgaaggccgtgctcgatctcgagcgcaccggtcgggcttcccgcgaatcgcctcgtcaggccggggacaagccgcaggttgcacaattggaggatataatagcagaaagaggagcttgcggagttgggtttattgccaatctcgagaataaagcatcatgtcagattgttaaggatgctcttactgctcttggttgtatggaacatcgtgggggatgtggagctgataatgactccggtgacggctctggagtgatgacatcgattccatggagtctatttgatgattgggccagcaagcaagggattgcgtcctttgataagtcgcacactggtgtggggatgtttttcttccccagagattctgaccttatcaatgaagccaagaaagttattgtaaatatcttcagacaagaaggtcttgaggtgcttggatggaggcctgtccctgtagactcatccatagttggtttctatgcaaaagaaactatgcctgacatacagcaggtatttgtaagagttgtgaaagaagacagtgttgacgacattgaacgagaactatacatttgccgaaaattgattgaaaaggtggcgagtactgaaaaatggggaaatgagctctatgtctgttctctctcgaatcaaacgctagtttacaagggaatgctgcggtcgcaagttcttggtaaattttacttagacctgcagaatgatctgtatgcatcatctttcgctatataccacagaaggtatagtacaaacactagccccaggtggcctcttgctcagccaatgaggtttcttggtcataatggagagatcaacaccatacagggcaacttgaattggatgcaatctcgtgaagcctcattaaagtcccctgtttggcgtggtcgtgagaatgaaattcgtccttttggtaatcccaaagcatcagactccgcaaaccttgatagtgcagcagaattgttgataagaagtggccgagctcctgaggagtctctaatgattcttgttccagaagcatacaaccatcatcctactttatcgatcaaataccctgaggtggttgacttttatgagtactacaagggtcagatggagacttgggatggaccagcattgcttttattcagtcatcctcaaacactatatgatcatattgttggtgttttgccaatggatgagtcaaaagttacaatgaagggcaggcttggaccaggaatgatgatatcggttgatttaacaagtggtcaggtttatgagaatactgacgtcaaaaagcgagtagcattatcaaatccatatggaaaatgggttgctgaaaacatgcgaaagttgaagcccgtgaacttccagtcaactactacaatggagaatgagtcaatcttaagacatcaacaggcttttggatactcaagcgaggatgtccagatgattattgaaacaatggctgcacagggaaaagagcctacattctgcatgggggatgacattccactggcagtactatctcaaaagccgcatatgctctatgattattttaagcaacgatttgcccaggttacaaatccagctattgaccctcttagagaaggcttagtcatgtctcttgaagtcaatattgggaagcgagggaacatattggaggtcggacctgaaaatgcttcccaggtgagtttatctagccctgtgttgaatgagggggagcttgaggagctgctacgagatccaaacttaaaaccctatgtattacgaacattttttgatatacggaaagggattgagggttcactggagaagacactgaacaggctgtgtgaagcagctgatgaggctgttcgaaatggctcacagttgcttgttctctctgacagattagatgaattggaacctacacgccctgcaataccaatccttcttgctgtcggtgctgttcatcaacatctcattgagaatggcctgcgaatgtcttgttcaattgtagcagacactgctcaatgcttcagcactcatcagtttgcttgcttaattggatatggggctagtgccgtatgtccctacttggcattggaaacatgccgacaatggcgcttgagtacaaaaacagtaaatttgatgcgaaatgggaagatgcctacagtgacaattgaacaggcacagaagaacttctgtaaggcagtcaagtcaggtctacttaagattctttccaaaatgggcatctcattgctttcaagttattgtggtgcacagatatttgagatctatggattagggagagatgttgttgatctgtcattccgcggaagtgtatctgtgattggcggactgacgctcaatgagcttgcaagggagacattgtctttttgggtgaaggctttttcagaggatacagcaaagaggctagagaattttggatttatacagttcagacctggaggggaatatcatggaaacaacccagaaatgtcaaaattgctgcataaggctgttcgtcagaagagtctaagtgcattttcaatttatcagcagcatttggctaatcgtcctgttaacgtactgcgtgatcttctagagtttacaagtgatcgggctccgataccagttggaagggttgaacccgcatcttccattgttgagcggttttgcactgggggaatgtcacttggagcaatttcaagagaaactcatgaagcaattgccatagcaatgaatagattaggaggaaaatcaaattctggagaaggtggtgaggatcctatccgctggagcccgttgacagatgttgttgatggttattctccaacactgcctcatctcaaaggactacaaaatggggatactgctaccagtgctatcaaacaggttgcttctgggcgatttggtgttactccaacattcttggtcaatgccgaccaactggagatcaaaattgcacagggtgctaagcctggtgaaggtggccaattacctgggaaaaaagtcagtgcgtacattgcaaggctgcgtaactctaagcctggggttccacttatatctccacctcctcaccatgatatatattctatcgaggaccttgcccagttgatttatgaccttcatcaggtcaatcctaaggctaaggtatctgtaaagcttgttgcagaagctggaattggtacagttgcttctggcgttgcaaaggggaatgctgatgttatacagatatcaggccatgatggtggaactggagctagtcctgtaagttcaatcaagcatgctggtggaccctgggaacttgggctgacagaatctcaccagactctgattgcaaatggacttcgagaaagggtaattctacgggttgatggtggctttaaaagtggatttgatgttctaatggctgctgcaatgggtgctgatgagtatgggtttggttcagtggccatgattgccactggatgtgttatggctcgcatttgccataccaacaattgtcctgttggtgttgcaagccagagggaagaattgcgtgccagatttcctggtgtgcctggtgatcttgtcaacttctttttatatgttgcggaggaggtgagaggcatgttggcacagctcggttatgagaagttggatgatgtgattggaaggacagagttgttaaagcctcgtgatatctcccttgtgaaaacacagcatcttgatctgagttacattctctcaagtgtagggttgccaaaatggagcagtactgaaattagaaatcaagaagttcatactaatggtcctgtgctggatgatgctgtgctggcagatccagagatatcagatgctattgaaaacgaaaaggtggtcagtaaaactttcagcatacacaatgtggatcgtgctgtttgtggacgtgtggcaggtgtggtggcaaagaagtatggggacagaggctttgcagggcagctgaacataacatttttagggagtgctgggcagtcatttgcttgttttctaactcctggaatgaacattcgacttgtgggggaggctaatgactatgttggcaagggtatggctggcggtgaattggttataactcctgtcgagaatattggttgttgccccgaggatgcaacaatagtaggcaatacttgcttgtatggagctactggtggccaagtttttgtaagagggaaagctggggagcgatttgctgtgaggaattctcttgctcaagcagtggtggaaggtacaggggatcattgttgtgaatacatgactggaggttgtgtggttgtgctgggaaaagttggtagaaatgtggctgctggaatgaccggaggtttagcatatattcttgatgaggacgacactctaatacctaaggtaaaccgagagattgtaaaaatccagagggtgaaggcaccagttggacagatgcagctgaagagccttattgaagcccatgttgagaaaactggcagcagcaaaggctcggcaattctcgaggagtgggacaagtacctaccactcttctggcagtttgttccgcctagtgaagaagacactccagaggcttgtgcagagtacgaggcaacagcctctggacaggtgacattgcagtctgcatgatttccttgcgagcaacaaagcatgtgagttagaggcagccaaccagcattgtacaggaaaaatgaatgtgaatacatagctgtggtatcgttattcaactaatgggtcaggaaacacctgctgctttgaggtggcattttcgagtttgagaagatcgaaattgccagaccaaagatcgtggtctatacctccaaagtcattcatgtccatgggacactcgagcagttgtacagatagtgggagaagttttcaggtttctgtcatgtcaaagcttctgggaatttgattaagaagcaatcacaagagtgcttcggctgggattaacatcagttcagccacagagaagcattcagtcagctctattattatctattgtttctcgtcaattactctctctcagatttattcgccgacggtcctcagtcaggaacttgtaacctgcatttcacattatattgggggtctttgtagtttcgccaagaattaacagaagggaaataaaatcaagtttttgagggttgcaaattgaatgtaattgggaaccaattagatatgtatgacctgcttaattgactcatgggtagcttatcatatgctctagtcgagcaataacaaagcctccttgctataaatttactctgtacaagtatgatttatttggctgcttgtccggcagctatttctcgtcccacgaaaca

SEQ ID NO: 1458 - DNA, 5197 bp, Gossypium hirsutum
tccgtttattctgcgtctgatcatcaatcatccgctcctcaacctaaggttgcaaatttagaggatataatatcagaaagaggtgcttgtggagttggattcattgccaatttggaaataaagcatcgcatggaattgttcaggatgcccttacagctcttggttgcatggagcatcgtgggggttgtggagcagataatgattctggtgatggttcaggattgatgacctcaatcccttgggatctgtttgacagctgggctgcaaatcaaggaatggcatcctttgataagatgcacactggtgttgggatggtttttcttcccaaagaagatagccttatagaagaagccaaaaaagttattgtaaatacttttagacaagagggtcttgaggtgcttggatggaggtctgttcctgtaaatacatcagtggttggtttttatgcaaaagaaaccatgcccaacatacagcagatatttgttagagttgtcaaggaagagaatgttgatgacattgaacgggaactatatatctgccggaaattgattgaaagagcagcagcctcagagacttggggaagtgagctttatttctgttctttgtccaatcaaaccattgtttacaagggcatgcttcgttcagaagttcttgggttattttattctgaccttcagaatgatctttataagtctccatttgccatttatcaccgaaggtatagcacaaatactagtcctagatggcctcttgctcaaccaatgaggtttcttggtcataatggagagatcaatactgtacaggggaacttgaattggatgcagtctcgtgaaacctcattgaagtcccctgtttggcgtggtagggaaaatgaaattcgcccttttggaacccaaaggcatctgactcggcaaatcttgatagtgcagctgaattactgatacgaagtggccgtaatcctgatgaaactctcatgattctgtcccagaggcatacaagaatcacccaacattgttagctaagtatcctgaggtggtagacttttatgactattacaagggtcagatggaagcttgggatggacctgccttgctcctatttagtgatggcaaaactgtcggggcatgtcttgatcggaatggacttcgccctgctaggtattggaggacaattgacaatgtcgtatatgttgcatctgaggttggtgttctaccggtggatgattcaaaagttattatgaagggccgtttaggtcccggaatgatgataactgctgatttattaagtggtcaggtttatgagaatacagaggtcaagaagcgagttgctgcaataaatgcgtatggaaaatgggttagtgaaaacatgagacccttgaaaccagtaaattttctctccacaacacttttggacagtgaaacgatcttaagacgccaacaggcttttggttattcaagtgaggatgttcaaatgattattgagactatggctgcacaaggaaaggagccaacattttgcatgggtgatgacattccattgtctatattgtctcaaaaggcacacatgctttatgattatttcaagcagcgttttgcacaggtcacaaatccggccattgaccctcttcgggaaggattagttatgtctcttgaagtcaatattggaaaacgaggaaatatattggaagttggacctgaaaatgcttctcaggtcaccttgtctagtcctgtactgaatgaaggggagcttgagtcattgcttaaggatccccagctaaaggcccaagtcttgcctacattttttgatatacgtaaagggattgaaggatcattggacaagacactttacaaactatgtgaagctgctgatgaagctgttcgtaatggttcccaactgcttgtgctctctgatcgtgctgatgagttggaagcaactcggcctgcaattccaatacttctagctgttgctgctgttcatcaacatcttattcaaaatggtctacggatgtcagcttccatagttgctgatactgctcagtgctttagtacacatcaatttgcctgtttaattggatatggggcaagtgctgtatgtccatacttggcattggagacttgtcggcagtggcgtttgagttctaaaactgtgaatttgatgcggaatggaaaaatgcctactgtgacaatcgagcaagcgcaaacaaacttttgtaaggcaatcaaagctggtctcctcaaaattctttctaagatgggcatctcattactttcaagttattgtggtgcgcaaatatttgagatttatggattggggaaggaaatagtggatcttgcattttctgggagtgtgtcaaagattggtggattaacttttgatgagttagcgagggagacattgtctttttgggtgaaggctttctctgaagatacagctaaaagattggaaaattttggatttatacaattcagatctggaggggagtatcatgcaaacaaccctgagatgtcaaaactacttcataaagctgtccgtgagaagagtgaaattgcattttcaatttatcagcagcacttggccagtcgtccagtcaatgttctccgtgatcttcttgaattcaaaagtaatcgtgcaccaattcctgttgggaaagttgaacctgccttatccattgttcaaagattttgcactggtggaatgtcacttggggctatttcaagggaaactcatgaggcaatagccattgctatgaacagattgggtggaaagtctaattcaggagaaggtggtgaggatccaattcgctggaggccacttactgatgttgttgatgggtattctcccacactgccacatctcaaaggtcttcaaaatggtgatactgctacgagtgccattaaacaggttgcttctggtcgatttggtgttactccaacattcttggccaatgctgatcaattggaaatcaaaattgcacaaggtgcaaagccaggtgaaggaggtcagttgccaggaaaaaaagttagtgcatatattgcaaagttaagaaattctaaaccaggtgttccacttatatctccacctccgcaccatgacatttattctattgaagatcttgcacaattgatctttgacctacatcaggtcaaccctaaggctaaggtatctgtaaagctagtggcagaagctggaatcggaacagttgcttctggggttgcaaaggctaatgctgatatcatacagatatctggtcatgatggtggtactggagctagtcccataagttccattaaacatgctggtggtccttgggagcttggacttactgagacccaccagactctcattgaaaatggactaagagaaagggtaattcttagagtcgatggtggtttcagaagtggagttgatgttctaatggctgcagcgatgggtgctgatgagtatggctttggctctttggcaatgattgccactggatgtgtaatggctcgcatttgtcacacaaacaattgcccagttggtgttgccagtcagcgagaagaacttcgtgcaagatttcctggcgtgcctggtgaccttgtcaatttctttttatatgttgcagaggaggtgcgtggcatgttagcacaactgggttatgaaaagttggatgatataattggacgaacagatttgctaaaaccacgagatatctcactagtgaaaacgcagcatcttgatctgaattatatcttgtcgaatgttggattaccaaaatggagcagtactgccatcaggactcaagaagttcactcaaatggttctgttctggatgctattttactttctgatcctgaggtatctcatgcaattgaaaatgagaaagaggtacataagactataaagatatacaatgtggaccgagctgtttgtggtcgtatagcaggtgtgattgcaaaaagatatggtgacactgggtttgctgggcagattaatataacatttactggtagtgctgggcagtcatttgcatgcttcctgactcctggaatgaatattcgacttattggagaagctaacgattatgtgggaaagggtatggctggaggtgagttggtagtaacccctgtagagaatcctgggttttgccctgaggatgcaactattgtaggaaatacatgtttgtatggagcaacaggtggacaaatctttgttagagggaaggctggagagcgctttgctgtgagaaactcacttgcccaagcagtggttgaaggcagtggtgaccattgctgcgagtacatgactggtggttgtgtggttgtacttggaaaagtggggagaaatgttgctgctggaatgactggaggtttagcatacgtgcttgatgaggatgatactctaatacccaaggtaaataaggaaattgtgaagatccaaagagtaactgcccctgttggacagatgcagcttaagagccttatcgaggcccatgttgaaaaaactgggagtgccaaaggctctatgattttgcttgaatgggacaagtacttaccactgttctggcagctggttccacctagtgaagaagataccccggaggcttgtgctgagtatcagagcacagcttcggagaaggtgacgttgcagtcagcctgagttaatgatcagaccatatgttcacttagagcattattcttgccccacactgtacagatcaaccaaaaggggattgttgtgggcgttgtgaatgaatgctatcttgcttgtgggagttcagtgcgggggaggaagaacttcggtagtatatggtgtcagcatttggtctttgtcaatccatccaaaagcattcaacctccaggtgttatagcagttatgtagtcatcatgcttgaaagttgtagattcagattagtttagtttagtttagttttcataatattgtccaaggtttatttgggtggcacgctactcgctgccctttttccatccaattaaacttggcttgttctaagctggtattgagtgccattacttatcgtacttcggatcaaagtgtattttttatctttactattctgtcagccaactgaatacaaagccttgctatgccaatttgtccgaatactagtttcacagagcccatatgtacgaggacatgactatcttgtatggcaattatcctactaccatgatatgctaattgtgcatccatctta

SEQ ID NO: 1459 - DNA, 5477 bp, Arabidopsis lyrata
aaatagcgacggcgattagagtcccgcgtggtcgtgctcactgatcactcttagctcgtgccgtgatctgagaaacgtcaccggttggattttctctgcgattccggtgcaccgtacacttcactataaatctctgcttccattttgactttttgaaattaaactacaacagtcgcagagagagagagtaaacttcgaaatccgatcgatcgctttctctctcggcgtttctctgcgattcttctcaggagcttcattccatggcgctacagtctcccggcgccgccggagcttcgtcttccgtttcccggcttctaacctccgcgaaattaagctctactaagactatcttctctgttgacttcgtcggatcctactgtatttctaaaggaactaaacggcgtaacgaactctccgggtttcgcggctacagtccactgctcaagtcctcgctgaggtctccgttttcggccaaagcgatcctgaattctgaccgggccgctggtgatgcatcggcttccttttctgatctgaaacctcaggtggcctacttggaagatataatttcagaaaggggagcatgtggtgttgggtttatcgcgaacttggagaataaggctacacataagattgtaaatgatgctctcatagcacttggttgtatggaacacaggggaggttgtggttctgataatacttctggtgatggttctggtttgatgacttccattccttgggatctatttaacgaatgggctgagaagcaaggaatggcttcttttgataagacgcatacgggtgttggaatgctcttcctaccgagagatgacaacattagggcagaagccaagaaagtgattacaagtatttttgagaaagagggcctggaggtgcttggatggagagatgttcctgtagaagcgtccattgtcggtcataatgcaaaacagacaatgccaaacacggaacaggtctttgttagaattgtcaaagacgataaagtagacgacgttgaacgagaactttacatttgcaggaagctgatcgaaagagcagttgcttctgaaagttgggcttctgagctctactttagctccttatccaatcagaccattgtttacaagggaatgcttcgttctgaagttcttgggttattttaccccgaccttcaaaatgatctttataaatctgcttttgccatctatcatcgaagatttagcacaaatactagtcccagatggcatcttgctcaacccatgaggtttcttggacacaatggggagatcaataccatacaggggaacctaaactggatgacttcacgagaagcatctctaagatcacctgtctggcatggacgtgaaaatgatattcgtccaattagcaatccaaaggcttcagactctgctaaccttgacagtgcagcggagctattgataagaagtggccggactccagaggaatctcttatgattcttgtcccagaggcgtataaaaatcacccgactttaatgattaaataccctgaggctgtagacttctatgattattacaagggccaaatggagccctgggatggacctgctttggtattgttcagtgatggaaagactgttggagcttgccttgaccgcaatggacttcgacctgctagatattggcggacaagtgataatgttgtctatgtagcctctgaggtcggagttcttccaatggatgaatcgaaagtcaccatgaagggtcggctaggacctggcatgatgatatctgttgacttagagagtggacaggtatatgagaacacagaagtaaagaggcgggttgcatcatataacccatatggaaagtgggtcagtaaaaacctgcgaaacctgaagccttctaattttctctcgtcagcaatcatggagactgatgagaccttaagacgccaacaggcgtttggctactcaagtgaagatgttcaaatggtaattgagtcgatggctgcacaaggaaaagaaccgacgttttgcatgggggatgatactccagtggcagtattgtctcaaaagccgcatatgctttatgattatttcaagcagcggtttgctcaggttacaaatccagctattgatcctcttcgagaaggattggtcatgtcgcttgaagttaatattggaaagcgtggaaatatattggaggttggacctcagaatgtttcacaggttgttttgtctggtcctgtactaaatgaacgtgagcttgagggtttgttcagtgatccacagttaaaatctcaagtcttgcccacattttttgacattcatagaggaattgaaggatctttgaagaagggtcttctaaaactctgtgaagctgcagatgaagctgttcgtagtggttcccaagtacttgttctctcagacagatctgataatccggaaccaactcgaccagcaattccaatgttgttggctgtgggtgctgttcaccaacatctgatccagaatggtcttcgaatgtcagcttcgataattgcagatacagctcagtgctttagtacacatcactttgcctgtttgattggatatggagcaagtgctatatgcccacacctagcattggagacatgtagacagtggcgtctgagcaacaagactgtgaacatgatgagaaacggaaaaatgcctactgtaactatggaacaggctcagaagaattaccgcaaggctgttaacactggtcttctaaaggttctctcgaagatgggcatctcgttattctctagttattgtggagcacaaatatttgaaatttatggattgggaaatgaggttgttgaattttcgttccgtggtagtgcatctcaaattggtggattaactttggatgagctggctagagagacattaactttctgggtgagggcattttctgaggatacagccaagcggctagagaacttcggtttcattcagtttaggcctggaggcgaatatcatgggaacaacccagaaatgtctaaattacttcataaagctgtccgcgaaaagagtgagacagcctatgcagtttatcagcagcatttggccaaccgtcctattacggttttccgcgatcttcttgagttcaaaagtgaccgtaaccctatccctgttgggaaggttgagcctgcgtcctctattgtggaacggttttgtacaggtggaatgtctcttggagcaatctcaagagaaactcatgagacaattgctattgcaatgaacagattaggaggaaaatccaattcaggggaaggaggcgaggatccgatccgctggaagccgctaacagatgttgttgatgggtattcttcaacactgccacatcttaaaggtcttcgaaatggggatacggctacaagtgctatcaagcaggttgcttcagggcgttttggtgtcactccgacgtttttggttaatgcggaccagttggaaatcaaagttgctcaaggggcaaagccaggtgaaggtggccaacttcctgggaaaaaagttagtgcatatattgctagacttcgaaattctaaaccaggagttccgcttatttctccacctccacatcatgatatttattccatagaggatctggcacagttgatctttgatctccatcaggtcaacccgaaggcaaaagtgtcagtcaagcttgtatcagaagctggaataggaacagttgcctcgggagtagcgaaggctaatgccgatatcatacagatatcaggatatgatggtggaactggagccagccctataagttccataaagcatgctggtggcccgtgggaactgggattagctgaaacccagaagactctcattggaaatggactcagggaaagagttattattagggttgatggcggattcaaaagtggtgttgatgtgttaatagctgcagctatgggcgctgatgagtatgggtttggtactctggcaatgattgccacaggatgtatcatggctcgcatttgccacactaataactgccctgttggtgttgccagtcagagagaggaactgcgtgcacgtttccctggtcttcctggtgatcttgtcaatttcttcttgtatattgcagaggaggtgaggggcatattagctcagttgggatatgaaaaactggatgatataattgggcggacagatttgctaaaggctagggatatctcgctcgtgaaaactcatcttgacctcagttatctcttatcttctgttgggctaccaaaacgaagcagtacttctattaggaagcaggaggttcactcaaatggtcctgttcttgatgatactctacttcaggatccagagataatggatgcaattgagaatgaaaaaacggttcacaaaaccatgagtatatacaatgtagatcgttctgtttgcggtcggattgctggggtgattgcgaagaaatacggagacactggttttgctggacaactgaacctaacgttcaccggaagtgctggccaatcttttgcatgtttcctaacccctggaatgaatatacgtcttgtgggtgaagccaacgactatgtgggaaagggaatggccggaggtgaagttgtgatattgccagtggaatcgactggttttcgtcccgaagacgcaactattgtaggaaacacttgtctgtatggtgcaactggtggtttattatttgtcagaggcaaagcaggagagagatttgcggttagaaactctctagctcaagctgttgttgaaggcactggagatcattgctgtgaatatatgactggtggttgtgtcgttgtacttgggaaagttggtagaaatgtagccgctgggatgacaggtggattggcatatatccttgacgaagacaacactctcctccctaagatgaacaaagagatagtgaagatccaaagagtgacttcaccagtgggacaaacacagcttaagagcctgatccaagctcatgtggagaaaacgggaagcagcaaaggagcaatgattgtggaagaatgggataagtatctagcaatgttctggcaacttgtaccgccaagtgaagaagacacacctgaggctaactcagaccacatcctgaaaacaaccaccggagatgaagaacaggtctcaaacatattagcggagaagtaaaccctacacatttgatcgtggtttcctcttttgtacagtcaaagtcgtggtggtggagataagtaagtctctcagtttctgagaacataacaatttacaagttctccacttgattttgatgtgattttgcttttcctaattcggtctgaattcggttatctgttggtttacttcgtcccattcgttagtaataaaacgaagtccagcatatttgtactttgtatggaaaaaatagtagccttccgatacccgattattaagaaaagggttttcgatttttatccactgtttttgactaggatgcttaatttggtttttcatggtttg

SEQ ID NO: 1460 - DNA, 5523 bp, Arabidopsis thaliana
acaaccaaataagcgacggcgattagagagtcctgcgtagtcgtgctcactgatcactcttagctcgtgccgtgatctgagactgagaaaacatcaccggttgggttttctctacgattccggtgcaccgtacacttcaccgcagtggataaatctctgcttccattttgactttttgaaaataaaactacaacagtcgcagagagattaaacttcgaaatccgatcgatcgctttctctctcggcgtttcttctcaggagcttcattccatggctctacagtctcccggagctaccggagcttcatcttccgtttcccggcttctctcttccgcgaaattaagctctactaagactatcttctctgttgacttcgtcagatcctactgtatttctaaaggaaccaaacggcgtaacgaactctccggctttcgcggctacagtccactgctcaagtcctcgctgaggtctccgttttcggtgaaagcgatccttaattctgaccgagccgctggtgatgcatcgtcttccttttctgatctgaaacctcaggtggcttatttggaagatataatatcggaaaggggagcatgtggtgttgggtttattgcaaacttggagaataaggctacacataagattgtaaatgatgctcttatagcacttggttgtatggaacacaggggaggttgtggttctgataatacttctggtgatggttctggtttgatgacttccattccttgggatctatttaacgaatgggctgagaagcaaggaatcgcttcttttgataggacgcatacgggtgttggaatgctgttcctaccgagagatgacaacattaggaaagaagccaagaaagtgattacaagtatttttgagaaagagggcctggaggtgcttggatggagagatgttcctgtggaagcgtccattgttggccataatgcaaaacagacgatgccaaacacggaacaggtctttgttagaattgtcaaagacgataaagtagacgacgttgaacgagaactttacatttgcaggaagctgatcgaaagagcagttgcttctgaaagttgggcctctgagctctactttagctccttgtccaatcagaccattgtttacaagggaatgcttcgttctgaagttcttgggttattttaccccgaccttcaaaatgatctttataaatctcctttcgccatctatcatcgaagatttagcacaaatactagtcccagatggcatcttgctcagcccatgaggtttcttgggcacaatggggagatcaataccatacaggggaacctaaactggatgacgtctcgagaagcatctctaagatcacctgtctggcatggacgtgaaaatgacattcgtccaattagcaatccaaaggcttcagactctgctaaccttgacagtgcggcggagctattgataagaagtggccggactccagaggaatctcttatgattcttgtcccagaggcgtataaaaatcacccgactttaatgattaaataccctgaggctgtagacttctatgactattacaaggggcagatggagccctgggatggacctgctttggtattgttcagtgatggaaagactgttggagcttgccttgaccgcaatggacttcgaccagctagatattggcggacaagtgataatgttgtctatgtagcctctgaggtcggagttcttccaatggatgaatcgaaagtcaccatgaagggtcgtctaggacctggtatgatgatatctgttgacttagagaatggacaggtatatgagaacacagaagtgaagaagcgggttgcatcatataacccatatggaaagtgggttagtgaaaacctgcgaaacctgaagccttctaattatctctcgtcagcgatcctggagactgatgagaccttaagacgccaacaggcgtttggctactcgagtgaagatgttcaaatggtaattgagtcgatggctgcacaaggaaaagaaccaacgttttgcatgggggatgatactccagtggcagtattgtctcaaaagccacatatgctttatgattatttcaagcagcggtttgctcaggttacaaatccagctattgaccctctccgggaaggattagtcatgtcccttgaagttaatattggaaagcgtggaaatatattggaggttgggcctcagaatgtttcacaggttgttttgtctggtcctgtgctaaatgaacgggagcttgagggtttgcttggtgatccactgttaaaatctcaaatcttgcccacattttttgacattcgtagaggaattgaaggatctttgaagaagggtcttctaaaactttgtgaagctgcagatgaagctgttcgtaatggttcccaagtacttgttctctcagacagatctgataatccggaaccaactcgacctgcaattccaatgttgttggctgtgggtgctgttcaccaacatctgatccagaacggtcttcggatgtcagcttcgataattgcagatacagctcagtgctttagtacacatcactttgcctgtttgattggatatggagcaagtgctatatgcccgcacctagcactggagacgtgtagacagtggcgtctgagcaacaagaccgtgaacatgatgagaaacggaaaaatgcctactgtaactatggaacaggctcagaagaattaccgcaaggctgttaacactggtcttcttaaggttctctctaagatgggcatctcgttattctctagttattgtggagcacaaatatttgaaatttatggattgggaaatgaggttgtggaattttcgttccgtggtagtgcatctcaaattggtggattaactttagatgagctggctagggagacgttaactttctgggtgagggcattttctgaggatacagccaaacggctagagaacttcggtttcattcagtttaggcctggaggtgaatatcatggaaacaacccagaaatgtctaaattacttcataaagccgtccgcgaaaagagtgagacagcctatgcagtctatcagcagcatttagccaaccgtcctattacggttttccgcgatcttcttgagttcaaaagtgaccgtaaccctatccctgttgggaaggttgagcctgcttcctctatcgtggaacggttttgtacaggtggaatgtctcttggagcaatctcaagagaaactcatgagacaattgctattgcaatgaacagattaggaggaaaatccaactcaggggaaggaggcgaggatccgatccgctggaagccgctaacagatgttgttgatgggtattcttcaactctgccacatcttaaaggtcttcgaaatggggatacggctacaagtgctattaagcaggttgcctcagggcgttttggtgtcactccgacgtttttggttaatgcggaccagttggaaattaaagttgctcaaggggcgaagccaggtgaaggtggccaacttcctgggaaaaaagtcagcgcatatattgctagacttagaaattctaaaccaggagttccgcttatttctccacctccacatcatgatatttattccatagaggatctggcacagttgatctttgatctccatcaggtcaaccccaaggcaaaagtgtcagtcaagcttgtatcagaaactggaataggaacagttgcctccggagtagcgaaggctaatgccgatatcatacagatatcaggatatgatggtggaactggagccagccctataagttccattaagcatgctggtggcccgtgggagctgggactagctgaaacccagaagactctcattggaaatggactaagggaaagagttattatcagggttgatggcggattcaaaagtggtgtggatgtgttgatagctgcagctatgggcgctgatgagtatggttttggtactctggcaatgattgccacaggatgtatcatggctcgcatttgccacactaataactgccccgttggtgttgccagtcagagagaggaactgcgtgcacgtttccccggtcttcctggtgatcttgtcaacttcttcttgtatattgcagaggaggtgaggggcatattagctcagctgggatatgaaaagttggatgatataattgggcggacagatttgctaaaggctagggatatctcgctcgtgaaaactcatctcgacctcagttatctcttatcttctgttgggctaccaaaacgaagcagtacttccattaggaagcaggaggttcattcaaatggtcctgttcttgatgatactctacttcaggatccagagataatggatgcaattgagaatgaaaagacggttcacaaaaccatgagtatatacaatgtagatcgttctgtttgcggtcggattgctggggtgattgcgaagaaatacggagacactggttttgctggacaactgaacctaacgttcactggaagtgctggccaatcttttgcatgtttcctaactcctggaatgaatatacgtcttgtgggtgaagccaacgactatgtgggaaagggaatggcgggaggtgaagttgtgatattaccagtggaatcgactggttttcgtcccgaagacgcaactattgtaggaaacacttgtctgtatggtgcaactggtggtttattatttgtcagaggcaaagcaggggagagatttgcggttagaaactctctagctcaagctgttgttgaaggcactggagatcattgctgtgaatatatgactggtggttgtgtcgttatacttgggaaagttggtagaaatgtagccgctgggatgacaggtggattggcatatatccttgacgaagacaacactctcctccctaagatgaacaaagagatagtgaagatccaaagagtgacttcaccagtgggacaaacacagcttaaaagcctgatccaggctcatgtggagaaaacgggaagcagcaaaggggcaatgattgtggaagagtgggataagtatctagcaatgttctggcaacttgtacctccgagtgaagaagacacacctgaggctaactcagaccacatcctgaaaacaaccacaggagatgaagaacaggtttcaagcacattagcagagaagtaaaacctacacatttgatcgtggtttcctctttgtacagtcaaagtcgtggtggaggagataagtaagtctctcagttgctgagaacataacaatttacaagttcaccacttgattttgatgtggttttaattcgttctggactcgcttatcttttggtttacttcgtcccagtcacgttagtaataaaacgaaatccagcatgcttgtactttgtatggaaacatcattagtcttccgattcccgattattaagaaagggttttcgatttttatccattgttttttttttactaggatgcttaatttggtttctcgtgagtttgtagttaattaatcggtatagaaaatttagtttacgggatt

SEQ ID NO: 1461 - DNA, 564 bp, Arabidopsis lyrata
agaaaacccttgagcttaagcaaattcaaagcaacactagaaaccctagcctctctctttatctctcacaacaaatctctttactatttgaaatggcgatctctaaggcttccattgttgttctcatgatggtgatcatctccgtcgttgcttcagctcaatctgaggcaccagcaccaagtcctacatctggatctagtgcgatctcagcttctttcgtctctgctggagttgcagcagtggcggctcttgtttttggctctgctcttcggatctaagttactgtgatggtgatttcgtacagagattgtttttgcagtcgtcgtctcgtgtgtattcctccgaagcttatagatctcagttctatgtggcctcttcttcttctatcttcaatcttcatatctgtatgaggatatcattattatttcttttagagagtatttgtggtttgtgattttctagacgatttattattattagttatgtgatatggtttttgatatgatatatggatcttattctatttattttatattgatgtctctcgagagttttcttttattc

SEQ ID NO: 1462 - DNA, 705 bp, Brassica napus
aaaaacctttctaagcttttagcattttcgaatcatcaaaaaaagctttcccttctctctaacacaaatggcgatctcaaaggcttccgtcgttgctctcgtcgcggtgattatctccgtcgtagctaccgtcgcttccgctcaggtcgaggctccagctccgagtcctacgtccggatctgctgctttctcgccgtcgatcgtttcagctggtgttgcagccgtcgcagctcttgttttcggctctgctcttcggatctaagtctttgcgatagagattcgtatttttgaaaaaaaataattgatcgggtatagcagtattattcatggtattcgtgtgtattccggagcgatagatctctttctatttttctattatctaataccttcatatctgtatgagggtactatatttatatctagagtattgtggttttgtgtgtttcttctagactctatggtttttgatatgactcttattctatttatttatggatctgatgtttctcagtttatatctttctcgttctttgcttaatcagtttatcaaacttcatctgcttaaaattacgatacgagcttgtttcacaattataacgttatactccaaatcgaatcactacagcccaaatttaactaaaatctaattctataggattgtcacttgaattcaatttatgtttttggtgaattttgaatcgagat

SEQ ID NO: 1463 - DNA, 571 bp, Brassica napus
ggaccaaaaaaccttcagagctttaaaacatttcgaatcaacaaaaaccctagcctcctccttttcttgctctctctctctctacaaatctctgaaatggcgatctcaaaggcctccgttgttgctctcgtcgcggtgatcatctccgtcgttgctaccgtcgcttcagctcagtctgagtctccggcgccaagccctacttctggatctggtgccttctcgccgtccatcgtctcagctggtgttgcagccgtcgcggctcttgtgttcggctctgctcttcggatctaagtctttgtgatggcgattcgtacagagatattgttttgaaaatttttatagcattattgatggtattggtgtgtattcaggagctatagatctctttctattgtgtctttgttaccattttgcgatattgtttttgattatgatatgattctattctatttatggatgtttctcagatgtttcttctccttcttcgcttacgagcttgttttacaaatcacatgatcgaaactttgctagaaatttgattataatctgtgaagataaaagtgattgtcag

SEQ ID NO: 1464 - DNA, 710 bp, Brassica napus
gaaaaaacctttctaagcttttagcattttcgaatcatcaaaaaaagctttcccttctctctaacacaaatggcgatctcaaaggcttccgtcgttgctctcgtcgcggtgattatctccgtcgtagctaccgtcgcttccgctcaggtcgaggctccagctccgagtcctacgtccggatctgctgctttctcgccgtcgatcgtttcagctggtgttgcagccgtcgcagctcttgttttcggctctgctcttcggatctaagtctttgcgatagagattcgtatttttgaaaaaaaataattgatcgggtatagcagtattattcatggtattcgtgtgtattccggagcgatagatctctttctatttttctattatctaataccttcatatctgtatgagggtactatatttatatctagagtattgtggttttgtgtgtttcttctagactctatggtttttgatatgactcttattctatttatttatggatctgatgtttctcagtttatatctttctcgttctttgcttaatcagtttatcaaacttcatctgcttaaaattacgatacgagcttgtttcacaattataacgttatactccaaatcgaatcactacagcccaaatttaactaaaatctaattctataggattgtcacttgaattcaatttatgtttttggtgaattttgaatcgagatcgt

SEQ ID NO: 1465 - DNA, 577 bp, Brassica napus
ttcggggtaccaaaaaaccttcagagctttaaaacatttcgaatcaacaaaaaccctagcctcctcctttttttgctctctctctctctacaaatctctgaaatggcgatctcaaaggcctccgttgttgctctcgtcgcggtgatcatctccgtcgttgctaccgtcgcttcagctcagtctgagtctccggcgccaagccctacttctggatctggtgccttctcgccgtccatcgtgtcagctggtgttgcagccgtcgcggctcttgttttcggctctgctcttcggatctaagtctttgtgatggcgattcgtacagagatattgttttgaaaatttttatagcattattgatggtattggtgtgtattcaggagctatagatctctttctattgtgtctttgttaccattttgcgatattgtttttgattatgatatgattctattctatttatggatgtttctcagatgtttcttctccttcttcgcttacgagcttgttttacaaatcacatgatcgaaactttgctagaaatttgattataatctgtgaagataaaagtgattgtcag

SEQ ID NO: 1466 - DNA, 1245 bp, Arabidopsis lyrata
tctctctctctctctccggcgatggcttccggtgaccagagcaagaagagaaaacagcattatcgcccgcaaaacagaccagtgaagaagaagggatcttaccctttgaagccaggcgttcaaggtttcttcatctcttgcgatggtggacgcgaataccaagcttctcaggaagctattaacgtcattgattcctttttcgaggagctaatacaggggaccgactcgaaagttaatcctggtttgtttgacaacccaataaacaaaaaagttacattttcgtatagcgaggatgaggatgatgaggaagatgagagtaattatggcgaggaagaggagaacaaaggggatggagataaggcagtagtgagtgaaggcggtaatgatcaagtgaatgagaaagaaatagctagtgaagggtcatgtgaagtcaaaaaattggcagaaaatgagactgaaaaagaggaagaagataaagggaatcagaagaacggtggagatgaacctccaagaaagaagacatgtacggaagaagcaaatcctttagcaaaagtaaatgaaaatgcggagaagtctattgataagttgattgaagctgaactaaaagaacttggggacaagagtaagagacggttcatgaagttagatccgggttgcaacggtctggtcttcatccaaatgaaaaggagagatggtgacccaagtcccaaagatattgcacagcatgcaatgacatctgctgctgccacaaaaaagcatatgtcaaggttcatcctaagacttctaccaattgaagtatcgtgttacccttcagaggaagaaatttcaagagccatcaagcctcttgtagaacaatacttccccattgagaccgaaaatccccggaaatttgctgtgttgtatggagcacgtgctaacacagggcttgataggatgaaaataataaacacgatcgccaaatctattcctgcccctcacaaagttgatttgagcaatccagagatgtcgatcgtggtggaagttgttaagacagtttgcttaattggagtggtagagaagtacaaggagctagcaaagtacaacctcaggcagctcacgtcgaccaattgacacaatctcctcttcttctatttttacctatgttttgtttgttaagactggagatgctctgtgtttactggaagtgttatagagttctggctcaacttattaaaatggctgaagttgccctttagatcaataaag

SEQ ID NO: 1467 - DNA, 1381 bp, Eutrema halophilum
tttgactgaaactcaaaaaatacttctctctccgtctccgacgatggcttccggtgaccagagcaagaagagaaagcagcgttatctccctcaaaatagaccagcgaagaagaagggtgcttatcctttgaagccaggggtacaaggttttttcatctcctgcgatggtggacgcgaattccaagcttctcaggaagctcttaacgtcatagattccttttttgaggagttagtgcatgggactggcttgaaagtaaattcttctgggtttcttgagaaaccaatcaacaaaaaggttacattttcctatagcgaggatgaggatgaggatgaagaggaaggtaataatggcgaggaagaggaaaacaaaggggatgggaatttgacggaagtgagtgaaagcggtaataatcaagtgaatgagaaagaattagcagcaagcgaagggtcatgtgaggtcaaacaattggcagaaaatgagactgaaaagaacgaagaaggaagaagatgaagggaaacagaagaacggtgtcgatgaacctccaagaaagaaggcttgtatggaagaagcaaatgcatcaacaaaagtaaacgagaatgcagagatgtcaattgataagctgattgatgctgaactaaaagagctcggagacaagagtaagagacgatttatgaagctagatccgggttgcaacggtattgccttcatccaaatgaaaaggagagatggtgacccaagtcccaaagatattgcacagcatgcaatgacttctgctgctgcaacaaaaaaacatatgtcaaggttcatcctaagacttgtaccaattgaagtgtcatgttatccttcagaggaagaaatttcaagagccattaagcctcttgtagaacagtattttcccattgagactgataatccccgcaagtttgctgtgttgtatggagcccgtgcaaacacagggcttgataggatgaaaataataaacacagtggcaaaatctattcctgctcctcacaaagttgatttgagcaatccggagatgtcaatcgtagtggaaattgtcaagactgtatgcttaattggggtggtagagaagtacaaggagctggcaaagtacaatctcaggcagctcacgtcaaccaagtgacacaatctcactttcttctatgttttttttcttctgaagactaagatgcgttgtctttactggttgttcaagatttctggcttaatgtattaaaatggtcgaagttggtctttagatcctattttcctgatcaataaagtttttttctttgatgaatggtgtcagtacaatgcaataactcagatttgattttgttgaatggtggcttaaccaaacgaaaccacaggttcaaggaa

SEQ ID NO: 1468 - DNA, 1358 bp, Eutrema parvulum
gactgaaactcaaaaaaagaccttccatctctctctttccgtctccgacaatggcttccagtgaccaaagcaagaagagaaagcagcgttatctccctcaaaatagaccagcgaagaagaagggggcttaccctttgaagccaggggtacaaggttttttcatctcctgcgacggcgggcgcgagtaccaagcttctcaggaagctattaacgtcatagattctttttttgaggagctagtgcatgggacgactggcttgaaagtaaattcttctgggttgcttgagaacccaataaacaaaaaggttacattttcctatagcgaggacgaagatgaggatgaggaggaagatgagggtgataatggtaaggaagaggaaaacaaaggagggttgaggataagacagaagtgactgaaggcgataataatcaagtggatgagaaagatatagcaaccgaaggttcatgtgaagtcaaacaattggcagaaactgagactgaaaaagacaaagaagatgaagggaaacaaaagaacggtgttgaggaacctccaagaaagaagacctgtacggaagaagcaaatgcgtcaacaaaagtaaacggaaatgcagacaagtctattgataggctgattgatgctgaactaaaagagctcggagacaagagtaagagacgatttatgaagttagatccgggttgcaacggtattgcctttatccaaatgaaaaggagagatggtgacccaagtcctaaagagattgtacagcatgcaatgacttctgctgcagcaacaaaaaagcatatgtcaaggttcatcctaagacttgtaccaattgaagtgtcgtgttatccttcagaggaagaaatttcaagagccatcaagcctcttgtagaacactattttcctattgagactgataacccccggaaatttgctgtgttgtatggagctcgtgcaaacacaggccttgataggatgaaaataataaacaccgtggcaaaatctattcctgcccctcacaaagttgatttgagcaatccagagatgtcgatcgtggttgaaattattaagacagtatgcttaattggggtggtagagaagtacaaggaactggcaaagtacaatctcaggcagctcacgtcgactaagtgacacaatctcgtttttgttttggctttcaagactatgatgctttctttttactgctagtgtcagagtgttctggctcaacttatttaaatgatagaagttggtctttagatcctacattgtctgatcaataaacttttttcttcgatgaagtttggcacactgtctacctaaaacatttcggtacaacgcaagaactcagatttga

SEQ ID NO: 1469 - DNA, 2298 bp, Arabidopsis lyrata
aaaccgagtaaaaaactttgatggacggtggccgagttctcatttcagtaattagtctctaaaattggttttcgtccgccgaggagatttcttccctagtagaccataagatcgacgagcataatatgtcgtggctgcgaacggccgtgagtaaggcggtggaggtcggaaaccgcaaaaacatcacacgaaccgtcaagaactatgctgactccgtcgtccagcaggctggccaagccgtcgctgaaggagccaaattgttccaagaccgcattggtgttggggcctataagagtgttaatcagacgattcagagattggaagaagctgcagtctcatatagaggtcatgaaagggcattgctgattactagatggctaaatgtgcttaaggagattgatagagctactgacagttctctaaaggataaacaattgagttcagaggaacaacttgcctctgatgaagcaaagaaacgtgaatgggttttgtattacgatccagatataggcggtgagccacttaacttccgtgatgtttttctgcaaagtcaagctctggaggggatcgttctgtccatgattattgaaccaccacatgacgaagaaattactctactcctggagatgtttgggctttgtctgaatggaggaaaggaagttcatgatgccatagttagcagtatgcaggatcttgctacagtcttttcgagttacaaggatgaagttttggttaagcaggacgaattgcttcagtttgcccaaaatgctatcacagggttgaagattaatgctgaaatgctgagaattgatgctgaagcttctgatctgaggaagaaactcgagaagatgaatgcctctccaattccacaggagactgaagacaaggaacttaaagaggctcctttaacaatagaggctttcaaagaaacgcttgcaaagattcgtctttgctctagattagaaggtcttctaattagaaagagacaactaagcaacggtgattcaccagatatacatgctcagaaagtcgacaagctcagggtgttattagaatctttagcaaattcaacttccaaagccgagaaacgaatatcagaaaacagacttcagaaagaggaggcactaaaagctcgtgtggtgaaagcaaatgaaaccggtgaaaaggaaaaggaattgggtgcagaaattgcacagcttgagaaacaaagagaagagctggaagccgaactgaagagggtaaatatatcattagctgctgctcaagctcggttccgtaatgcgacagaggagagggatcaatttggtgaagccaacaatcagataatcgctcacctgaaaacaaaggaggatgacctgtccaaatcagttgtagcttgtaagaatgaagcagaagttatcaagacgtggattaattttcttgaggatacatggcttcttcaatgctcatatatcgaaacgaaggataagcagactttggacgaattggagaagcatgaggattacttctcggatgtggcctttaatatactctctgtgtacaagaaggaggtggcacctttgataagtcgtatagaaaattatgtggaaaatctgaagaatctgggtcctgggtcggagaagccaccaaatgcagatcagggagacaatcaggtatcaaacccgaggaaaattctggagcaggagtatatagactatgagaccaagattattaccaccttcagcattgtggacaacatgaaagagcaattcgaggttctccaaagcaaactggataaaaaggacgaccggcgtgtgaaagagctgtttgatgacatggagaaaatgaggcagcaatttgaatcgatagcgaggccgatgttagagatagagattccatcacctaaaagcagtgttacatcacctaaaagcagtgctacatcacccaaatctcccaagcccagcagtagtagcatggatgattcaactgaatctactcagacccaaaagccggagctgagcaatcctcctcaggcacccaatcctacagctggttccagtcaggagtttaaccctgaagcagaactagccgagcttgaatctgaatttggtaaggtggctcgtgattactctgcagatgaggttgatggatgggaattcgatgaacttgagaaagaactgcagtagtaataatgacacacctgcctcacatacactaatatgttttacatttactttctttgtttggccataactccgaagttcctttgttaatctgtttggtaatttatggtaactgcctgttgacttttgaatgtct

SEQ ID NO: 1470 - DNA, 2329 bp, Eutrema halophilum
accgagtaaaacacattgaccgtgcccgagttcttttcattttcggtaattagtctctctgaaatcggttttttcttcccgaggagatttcttccgtagtggagaccagaaagatcgacgagaatatgtcgtggctgcgaacggccgtgagtaaggcggtggaggtcggtaaccggaaaaatatcacacgaaccgtcaggaactatgccgactccgtcgtccagcaggctggccaagccgtcgctgaaggagccaaattgttccaagaccgcattggtgttggtgcttataagagtgttagtcagacgattcagagattggaagaagctgcagtctcatacaggggtcatgaaagagcactgctgcttaccagatggctatctgtgcttaaggagatcgatagagctagtggaagtcccgtcaaggataaacaaatgagttcagaggaactacttgcttctgatgaagcaaagaaacgtgaatgggttttgtattacgatccagatataggaggtgcgccactaaactttcgtgatgtttttctgcaaagtcaagctctggagggcatcgttctgtccatgattattgaaccaccgcatgacgaagaaattactctactcctggagatgtttgggctttgtctgaatggaggaaaggaagttcatgatgccatagtcagcagtatgcaggatcttgctacagtcttttcgagttacaaggatgaagtattggttaagcaggacgaattgcttcagtttgcgcaaaatgctatcacagggttgaagattagtgctgaaatgctgagaattgatgctgaagcttctgatcttagaaaaaaactcgaaaagatgaacgcatctcaatttccacaggagagtgaggaaaaggaacttaaagagactcctctaacaatagaggctctcaaagaaacacttgcaaagattcgtctttgttccagattagaagagctgctgatcagaaagagacaactaagcaacggggattcaccagatatacatgctcagaaagtcgacaagctcaaggtgttattggaatctttagcaaattcaagttccaaagccgagaaacgaataaccgagaacagacttcagaaagaagaagcactaaaagctcgtgtggtgaaagcaaatgaaaccggtgaaaaagaaaaggaattgggtgcggaaattgcacaacttgagaaacaaagagatgagctggaagcggagctgaagagggttaatatatcactagctgctgctcaagctcggcttcataatgcgacggaggagagggatcaatttggtgaagctaacaatcagataatcgctcacctgaaaacaaaggaggatgacctgtccaaatcagttgtagcctgtaagaaagaggcagaagttatcaagacatgggttaattttcttgaggacacatggcttcttcaaagctcatatacagaaacgaaggataagcagactttggacgaattggagaagcatgaggattacttctcggatgtcgcttttagtatactctctacttacaagaaggaggtggcacctttaataagtcgtatagaaaattatgtggaaaatctgaagaatctgggccctgggtcggagaagccaccaaatgcagatcagggggacattcaggtttcaaacccgaggaaaagtctggagcaggagtatctagattatgagactaagatcattaccaccttcagcattgtggataacatgaaagagcatttccaggttctccagaacaaactggaaaaaaaggacgaccggcgcgtgaaagagctgtttgatgacatggagaaaatgaggcaggaatttgaatccatagcgaggccaacgttagagatagagattccatcacctaaaagcagtgcttcatcacccaaatctcccaaccccagaagtagcttggatgctccaaccgaaactacttcactgacccaaaagccagagttgagcaatcctgtcgaggcaccggctactagtgctggttccagtcgggaatttaaccctgaagccgagctagccgagcttgaatctgaatttggtaaggtggctcgtgattactccgcagatgaggttgatggatgggaattcgatgaacttgagaaagaactgcagtagcggtccagcaacgcagaataatatgatcgtcacacgcatgcttgctcacatcacatacactgatatgttaccttcttcgttggccgaaacttacaatttcctttctaatctgtatggtaatttatggtaactgcttgttgtgtgtctacttgaatcaaatgaaagcactaagtgacgtcaactgt

SEQ ID NO: 1471 - DNA, 2329 bp, Eutrema parvulum
accgagtaaaaacattgaccgtgcctgagcttctcatttcggtaattagagtctctgaaattggtttttcttcccgaggacatttcttcaaagagatcgacgagaacatgtcgtggctgcgaacggctgtgaataaggcggtggaggtcggaaaccggaaaaatatcacacgaaccgtcaagaactatgctgactccgtcgtccagcaggctggccaagccgtcgctgaaggagccaaattgttccaagaccgcgttggtgttggggcctataagagtgttaatcagacgattcagagactggaagaagctgcagtctcatacagaggtcatgaaagagcattgctgattacaagatggctaactgtgctcaaggagatcgatagagctagtgaagcttccgtcaaggataaagaactgagtgcagaggaacaacttgcttctgatgatgcaaaaagacgtgaatgggttttgtattacgatccagatataggaggtgagccactaaacttccgcgatgtttttctgcaaagtcaagctctggagggtatcgttctgtccatgattattgaaccaccacatgatgaagaaatcactctactcctggagatgtttgggctttgtctgaatggaggaaaggaagtccatgatgccatagtcagcagtatgctggatcttgccacagtcttttcgagttacaaggatgaagttttggttaagcaggacgaattgcttcagtttgcacaaaatgctatcacagggttgaagattagtgctgaaatgctgagaattgatgctgaagcttctgatcttagaaaaaaactcgaaaagatgaactcctcacaattatcacaggagagtgaagacaaggaacttaaagaggctcctttaacgatagaggctcttaaagaaacacttggaaagattcgtctttgctccagattagaagggattttaattagaaagaaacaattaagcaacggtgattcagcagatgtacatgctcagaaagtcgacaagctcaaggtgttattagaatctttagcaaattcaacttccaaagccgagaaacgaatttcagagaacagacttcagaaagaagaggcacttaaagctcgtgtggtgaaagcaaatgaaactggtgaaaaggaaaaggaattgggtgcggaaattgcacagcttgagaaagaaagaaatgagctggaagctgaactgaagagggttaatatatcattagctgctgctcaagctcggttccgtaatgcgacagaggagagggatcaatttggtgaagccaacaatcagataatcgctcacctgaaaacaaaggaggatgacctgtccaaatcagttgttgcttgtaagaaagaggcagaagttatcaagacttggattaattttctcgaggatacatggcttcttcagtgctcatataccgaaacgaaggataagcagactttggatgaattggagaagcatgaggattacttcacggatgtggcttttaatatgctttctacgtacaagaaggaggtggcacctttggtacgccgtatagaaaattatgtggaaaatctgaagaaccttggtcctgggttggagaagccaccaaatgtagatcagggggacattcaggtttcaaacccaaggaaaagtctggagcaggagtatctagactatgagaccaagatcattaccaccttcagcattgtggataacatgaaagagcatttccaggctcgccaaagtaaaccggaaaaaaaggatgaccggcgtgtgaaagaactgtttgatgacatggagaaattgaggcaggaatttgaatccatagccaggccaacgttagagatagagactccgtcacctaaaagcagtgcttcatcacccaaatcccccaagcccagcagtagtagcatggatgctccagttgaacctactagtctgacccaaaagccagagttgagcaatcctgcaaaggcatcgactactactgctggttccagtcaggaatttaaccctgaagccgaactagccgagcttgaatctgaatttggtaaggtggctcgtgattactctgcagatgaggttgatggatgggaatttgatgaacttgagaaagaactgcagtagtagtagtagcagtagcccagcaactcagaataatatgatcatcacacgcatgcatgctcacatacactgaaatgttttattcttaccttcttcttttgaccgtaactcgcaagttcctttgctaatctgtatggtaatttatggtacctgcgtgttgtatgtctacttggaacaaatgaaagcacttggtgacgtgatct

SEQ ID NO: 1472 - DNA, 2288 bp, Brassica napus
cgttagttagagaacgagaccatgtcgtggctgcgaacggctgttaacaaggcggtggaggtcggaaaccgcaaaaacatcacacgaaccgtcaagaactacgccgactccgtcgttcagcaggctggccaagccgtcgctgaaggagccaaattgttccaagaccgcattcgtgttggggcgtataagagtgttaatcagacgattcagagattggaggaagctgcggtctcgttcagaggtcatgagagagcgttgcttattaccagatggttatatgtgcttaaggagatcgataaagctactggaggagcttccgtcaaggataaaaatgtgacttctgaggaacaaattgcttatgacgaagctaagaggcgtgaatgggttttgtactacgatccagatataggaggtcagccactaaacttccgtgatgtttttctgcaaagtcaagctctggagggcatcgttctgtccatgattatggagccaccacatgatgaggaagttaccctacttctggagatgttcaggctttgtctgaatggaggaaaggaagttcatgatgccatagtcagcagtatgcaggatcttgctacagtcttttcgagttacaaagatgaagtgctggttaagcaggacgaattgattcaatttgcccaaaacgctatcacagggttgaagattaatgctgaaatgctgagaattgatgctgaagcttctgagcttagaaaaaaactcgaaaagatgaacgcctctcaaattccacaggagagtgaagacaaggaagttaaagccgctccattaacaatagaggctcttaaagaaacacttgcaaagattcgtctttgctccagattagaagcgttgttaaatagaaagaggcaactaagcaacggtgattcacctgatatacatgctcaaaaagtcgacaagctcaaggtgttattggaatctttagcaaattcgatttccaaagctgagaaacgaatatccgaaaacagacttcagaaagaagaggcactcaaagctcgcgtggtgaaagcagatgaaaccggtgaaaaggaaaaggaattgagtgcggagattgcacagcttgagaaacaaagagatgagttggaagctgaactgaagaaggttaatataacattagctgctgctcaagctcggttccgtaatgcaacagaggagagagatcaatttggtgaagccaacaatcagataatcgctcacctgaaaacaaaggaggatgacctttccaaatcagttgtagcttgtaagaaagagtcagaagttatcaagacttggattaattttctcgaggatacatggcttcttcaatgctcatacaccgaaacaaaggataagcagactttggacgaattggagaagcacgaggattacttctcggatgtggcttttaatatactcacaacgtacaagaaggaagtgacacctctagtacgccgtatagaaaactatgtggaaaatctgaagaatcttggtcctgggttggagaagccaccaaatgcagatcagggggacattcaggttgcaaacccgaggaagagtcttgagcaggagtatctagactatgagaccaagatcattgcgacgttcagcattgtggataacatgaaagagcatttccaagtcctccaaagcaaactggaaaagaaggacgaccggcgtgtgaaagagctatttgatgacatggagaaactgaggcaggagtttgaagccatagcgaggccaacgttagagatagagactccatctcctaaaagcgttgcgtcatcacccaaagcccctaagcccagcagtagtagcatggatgctccactcgaatctactaccactgtgacacaaaagccagtggtgagcgagacagcaccgactacaactactgctggttcgagtcgagagtttaaccatgaagctgagctagcggagcttgaatctgaatttggtaaagtggctcgtgattacactgcagatgaggttgatggatgggaattcgatgaactagagaaagaactgcagtagtagtagtagtagtaaaacctcagcaactcagaataatacaatgatcatcacatgcatgctcacatactacagtgatgtgttttactctttaccgtcttctttggacataactctcaaaagttcctttgcctatctttatggtaatttatggaaactgcgtgttgtatgtctacttggaacaaatgaaagtactttgtgacgtgaaacagtggttacgtatattatgcagtagtaacaaaatc

SEQ ID NO: 1473 - DNA, 2095 bp, Brassica napus
aattgttccaagaccgcattcgtgttggggcgtataagagtgttaatcagacgattcagagattggaggaagctgcggtctcgttcaggggtcatgaaagagcgttgcttattaccagatggttatctgtgcttaaggagatcgataaagctattggagcttcttccgttaaggataaagatgtgagttctgaggaacaacttgcttctgatgaggctaagagacgtgaatgggttttgtactacgatccagatataggaggccagccactaaacttccgtgatgtttttctacaaagtcaagctctggaggggatcgttctgtccatgattatggagccaccacatgatgaggaagttactctactcctggagatgttcaggctttgtctgaatggaggaaaggaagttcatgatgccatagtcagcagtatgcaggatcttgctacagtcttttcgagttacaaagatgaagtactggttaagcaggacgaattaattcaatttgctcaaaacgctatcacagggttgaagataaatgctgaaatgctgagaattgatgctgaagctgctgatcttagaaaaaaactcgaaaagatgaacgcctctcagtttcaacaggagagtgaagacaaggaaggtaaagcggctcctttaacaatagaggctcttaaagaaacacttgcaaagattcgtatttgctccagattggaagcgcttttagttaaaaagaggcaactaagcaacggtgattcaccagatatacatgctcagaaagttgacaagctcaaggtgttattggaatctttagcaaattcgatttccaaagccgagaaacgaatatccgaaaacagacttcagaaagaagaggcactcaaagttcgcgtggtgaaagcagatgaaaccggtgaaaaggaaaaggaattgagtgcggagattgcacagcttgagaaacaaagagatgagttggaagctgaactgaagaaggttaatataacattagctgctgctcaagctcggttccgtaatgcaacagaggagagggatcagtttggtgaagcaaacaatcagataatcgctcacctgaaaacaaaggaggacgacctttccaaatcagttgtagcttgtaagaaagagtcagaagttatcaagacttggattaattttctcgaggatacatggcttcttcaatgctcgtataccgaaactaaggataagcagactttggacgaattggagaagcacgaggattacttcacggatgtggcttttaatatactcacaacgtacaagaaggaagtgacacctctagtacgccgtatagaaaattatgtggaaaatctgaagaatcttggtcctgggttagagaagccaccaaatgcagatcagggggactctcaggtttcaaacccgaggaagagtctggagcaggagtatctagactatgagactaagatcattgcgaccttcagcattgtggataacatgaaagaacattttcaagtcctccaaagcaaactggaaaagaaggacgaccggcgagtgaaagagctatttgatgacatggagaaactgaggcaggagtttgaagccatagcgaggccaacgttagagatagagactccatctcctaaaagcgttgcgtcatcacccaaagcccctaagcccagcagtagtagcatggatgctccactcgagtcaacaactactgtgacacaaaagccagaggtgagcgagacagcaccaactactactactactactggttcgagtcaagagtttaaccatgaagcagagctagcggagcttgaatctgaatttggtaaagtggctcgtgattacactgcagatgaggttgatggatgggaattcgacgaactagagaaagaactgcagtagtagttgtagtagtacctcagcaactcagaataatactgatcatcacatgcatgctctcatacagtgatttgtttttttatcttttaccttggacataactctcaaaagttgcttttactgatctttatagtaatttatgaaaactgcttgttgtatgtctacttggaacaaatgaaagcgcttaaacgtgaactttt

SEQ ID NO: 1474 - DNA, 2530 bp, Eutrema parvulum
catattgtcgcttccgttccaatgaaacaccgtctcgtcgactcgccgctcaaaaacggcaacgatgttcctttccggcgtgaacgccgcgcgcttccgtccactagttgcttttcgcctcttctctgctgccgctcctctcctccaatactgcatggagaaaccgccgatcaaaccgtggccgaagaggctattccccaagcggctggtctccatgatcacccagcagcagaacatcgatcttgctctccagatattcctgtacgccggtaaatcacatcccggttttactcataattacgatacctaccactccattctcttcaaactatcccgtgctcgtgctttcgatcccgtcgagcctctcatggcagatcttcgctactcctacccgccgatcaaatgcggcgagaatcttttcatcgacttgcttcgaaactatgggctcgcgggtcgattcgagtcttctatgagaatcttccttcggatccctgattacggcgtgaaacgctccgttcgatcgctgaacacactcttaaacgttctaatccagaacaggagatttgatctggtgcatgccatgtttaagaacagcaaggagtctttcggcataacgccgaacatcttcacctgtaatctactcgtcaaagctctctgtaagaaaaacgatatagagagtgcatataaagtgctcgacgaaattcccgctatgggtctggtgccgaatttagtgacttacacaacgattttaggtggttacgttgcaagaggtgatatgaaagcggccaagagggttttgggagagatgttggatcgtgggtgggatccggatgcgaccacttacactgttctcatggatggttactgtaagttagggagattctgtgaggcggctaaggtgatggatgagatggaaaagaacgagattgagccaaatgaagtaacgtatggagttatgatcggagcgttatgcaaggagaagaaagccggtgaagcacgcaacatgttcgatgaaatgcttgacagaagttttatgccggattcttccctttgttgtaaagttattgacgcgttgtgtgaagaccacaaggtagatgaagcctgtagtctgtggaggaaaatgttgaagaacaactgtatgcctgataatgctcttctgagcactctcatccattggctttgtaaagaagggagagttgcagaggcgaggaaattgttcgacgagtttgagaaaggctcgatccccagcctcttgacgtacaacacgttgatctctggaatgtgcgagaagggcgagttgacagaggcgggtcgattatgggacgacatggttgagaggaaatgcaagccgaatgctttcacatataacgttctgatcgagggcttgtccaagaacgggaatgttaaggaaggagtcagggttcttgaagagatgttggagaatggttgttttcctaacaaaatgacgttcttgatattgttcgaggggttgcaggagttagggaaagaagaggatgcgataaaggttatatcaatggctgttatgagcaggaaagtcgataaagagtcgtgggaactttttttgaagaaatttgctggtgaactagataaaggggttgtggctcttaaagagctgttacatgaaaaatctgtctcttgaagaaccaagacttaatgctcaaaagactatcgatctcttgaagccgtcaacatgagcgaccccaacgatgcgggaatggatgctgttcagagacgactcatgtttgaggacgaatgcattctcgttgatgaaaatgatcgtgtcgtgggccatgacactaaatataaatgtcatcttatggaaaagattgaagctgagaatttgcttcacagggctttcagtgtgttcttattcaactccaaatatgagttgcttctccagcaaaggtcaaaaacaaaggttactttcccgcttgtgtggaccaacacatgttgcagtcatcctctttaccgtgaatctgagcttatcgaagagaatgtgcttggtgtaagaaatgctgcacaaagaaagcttctacatgagctcggtattgtagctgaagacgtgccagtcaatgagttcactgccttgggacgcatgctttacaaggcaccttctgatggaaaatgggcgagcacgaacttgactatctacttttcatcgtgcgggatgtgaagcttcaaccaaacccagatgaagtggctaatattaagtatgtgagcagagaagagcttaaggagctggtgaaaaaagcagatgctgttgatgaagctgtgaaactgtctccatggtttagattggtggtggacaatttcttaatgaagtggtgggatcatgttgagacaggaactctccttcaagctgcagacatgaaaaccattcacaagctctaagctttatataaaatgttttggatcttcttcttctcattttaatctttattataataaacgacgagactctattgattccagattaaaactggcgacaagatctcttcatggggttttt

SEQ ID NO: 1475 - DNA, 2583 bp, Eutrema halophilum
catatcgtcgccttcgtccccaatgaaatatcttctcgtagattcgccgccgctcaaaaaacggcaacgatgttccttccccgcgtgatctccacgcgcatccagccattagtcgcttctcgcctcttctccgccgctcatcttctggaatactacacggagaagccgccgatcaaaccctggccgcagaggctattcccgaagaggttggtctccatgatcacccaacagcagaacatcgatctcgctctccagatgtttctctacgccggtaaatcgcatcccggtttcactcataattacgatacttaccactccatcctcttcaaactatcacgtgctcgtgctttcgatcccgtggagcctctcttggcagatcttcggagctcctacccgccgatcaaatgcggcgagaatcttttcatcgacttgctccgaaactacggcctcgcgggtcgatacgaatcttctgtgaggatcttccttcggatccctgatttcggcgtgaaacgttcggttcgatcgctaaacacgctcttaaacgttctaatccagaacaagagattcgatttggttcatgccatgtttaagaactgcaaggagtctttcggcatcacgcccaacatcttcacttgtaatctactcgtcaaggctctctgcaagaagaatgatatagagagtgcatttaaagtgctcgacgaaattcccgccatgggtttggtgccaaatttggtgacttacactacgattctaggtggttacgttgccagaggcgatatggaagcggccaagcgggttttgagagagatgatggatcgtggctgggatccggatgcgaccacttacactgttctcatggatggttactgtaagttagggagattctctgaggcggctatggtgatggatgacatggaaaagaacgagattgagccaaatgaagtgacatatggagttatgatcggagctttatgcaaggagaagaaagctggggaagcacgaaacatgttggatgaaatgattgacagaagtttcgtgccagattcttcactttgctgtaaagttatcgacgcgctgtgtgaagaccataaggtagatgaagcgtgtagcctgtggagaaaaatgctgaagaacaactgtatgcctgataatgctcttctgagcactctcatacattggctctgcaaagatgggagagtttcagaggcgaggaaattgttcgacgagtttgagaaaggctcgatccccagtctcttgacgtacaacactttgatttctgggatgtgcgagaagggagagttgactgaggcgggtcggttatgggacgacatggttgagaggagatgcaagccgaatgctttcacttataacgttttgatcgaaggcttgtctaagaacgggaatgttaaagaaggagtcagggttcttgaagagatgctggagaagggttgctttcctaacaaaacaacgttcttgatattgttcgaggggttgcagaagttagggaaagaagaggatgcgatcaagattgtatcaatggctgttatgagcgggaaggtcgataaagaatcttgggaacttttcttgaagaaatttgctggtgaactagataaaggggttgtggttcttgaagagctgttgcgtgaaagttctgcctcttgaagaaccaagactctgatcattaactcaatgctgaaaaggctatcgatcgatctcctgaagccgtcaccatgactgatcccaacgatgccggaatggatgctgttcagagacgactcatgtttgaggacgaatgcattctcgttgatgaaaatgatcgtgtggtgggccatgacactaaatataactgtcatctgatggaaaagattgaagctgagaatttgcttcatagggctttcagtgtgtttttattcaactccaaatttgagttgcttctccagcaaaggtcaaaaacaaaggttactttcccacttgtgtggacaaacacttgttgcagccatcctctttaccgtgaatccgagcttattgaagagaatgtgcttggggtaagaaacgctgcacaaagaaagcttctcgatgagctcggtattgtagcccaagatgtacctgtcgatgagttcactgccttgggacgcatgctttacaaggcaccttccgatggaaaatggggcgagcacgaacttgattatctacttttcatcgtgcgggatgtgaaggttcaaccaaacccagatgaagtggctgatataaagtatgtgagcagggaagagctcaaggagctggtgaagaaagcagatgcaggtgatgaagctgtgaaactatctccatggtttagattggtggtggacaatttcttgatgaagtggtgggatcatgttgagaaaggaactctcattgaagctgcagacatgaaaaccattcacaagctctaaactttttttataaaaagttttggatctccctcttctcatttttgcatttataatttattgtaccctataattaaaggtgaaactccatttgattttgacaaaaccggcaagaagatctcttcctgggatttttcttttctttttttttttt

SEQ ID NO: 1476 - DNA, 1372 bp, Arabidopsis lyrata
ttttttcttaaataaataaaaaataccaaaagaagcggaaacagagaaaaagagagaaaaaatgctgagtagatcagttgcatctgctgtttcaccggtctcttcttcttctctcttaccaaactcaaaacctatcttctgtctcaaaaccctctccggttatcgttcttcttctttctgcggcggctcctttcgtaaaatcaaccataaacctcttcgaatgactagttctaatatgactccaagagctatggccacgcaacagcttgaaaacgctgatcagctcattgattctgtcgaaacttttatcttcgattgtgatggcgtaatctggaagggagataaattgattgagggagttcctgaaactcttgatatgcttcgtgccaagggaaagaggttggtttttgtcacaaacaactcaacaaaatctaggaaacagtatggaaaaaagtttgagactcttggtctgaatgttaacgaggaggagatatttgcttcatcttttgctgcagctgcatacttgcagtctattaatttcccaaaagataagaaggtctacgtgattggtgaggaaggtatcttgaaagagctcgagcttgctggttttcaataccttggaggtccggatgatggtaaaagacagattgaattaaagccaggatttctaatggagcatgaacatgatgtgggagctgttgtggttggatttgatcgctatttcaactactacaaaattcagtatggaacactatgtatccgagaaaacccagggtgtcttttcattgctacaaaccgagatgcagtcactcaccttaccgatgctcaagaatgggcaggtggtggttctatggttggtgctcttgttggatccactcaacgtgagcctcttgttgttggaaaaccctcaacttttatgatggactatttagcagacaaatttggaatccagaagtcacagatatgcatggtgggtgatagattggacactgacattttattcgggcagaatggcggatgtaaaactctgctcgtcctctcgggtgttacttcaatctcaatgttggaaagccctgagaacaagatacaaccagatttctacaccagcaagatctccgattttctgtccccgaaagcagcaactgtataatcaacttcttttatttgcagtgcctttgtgtgcatcgcaaattagcgagccaatgagtattgtttaggaagagtttacagaattgaaacaagctctaatctgtaagtgtaagagtctttattgactttaaattattcgtttgttgttatgtatataaacaagaactgtgcataacacattacataatcatggtaacagagttaataaacattctttcgcaat

SEQ ID NO: 1477 - DNA, 1464 bp, Eutrema halophilum
tacaacatccacccaatttaccacgtcagcaccattcacactcgtattaaccaaataaaaattaataaaaaaaaaaaattccaaaagaaacggaaacaaattaagaaagaagagaggaagaaaaaaaaatgctgaacagagcaattgcttctgctgtttcttcagtcacttcttcttcttcctccgtttctctcttacccaaatccaaacctttcttctctgtcaaaaccctctccggatcatctcgttctccatctttctgcggcggcttcactcgtagaatcgaccataagcctctccgtatgacgactcgagctatggctacgcagcagctcgagaacgccgatcagctcatcgattccgtcgaaacttttatcttcgattgtgacggagtgatttggaagggagataaattgattgagggagttcctgaaactcttgatatgctccgtgccaagggaaagaggttggtttttgtcacgaacaactctacaaagtcaaggaaacaatacggcaaaaagtttgagactcttggcctgaatgttaacgaggaggagatatttgcttcttcttttgctgcagctgcatacttacaatctattaatttcccaaaagataagaaggtctatgtaattggtgaggagggtatcttgaaagagcttgagcttgctggttttcagtaccttggaggtccagatgatggtaaaaggcagattgagttgaagccaggatttttaatggagcatgatcatgatgtgggagctgttgtggttggatttgatcgctatttcaactactacaaaatccagtatggaacactctgtatccgcgaaaacccgggttgtcttttcattgctacaaaccgagatgctgtcacacaccttaccgatgctcaagaatgggcaggtggtggctctatggttggtgctcttgttggatccactcaacgtgagcctcttgttgttggaaaaccttcaacttttatgatggactatttagcagataaatttggaatccaaaagtcacagatatgcatggtgggtgatagattagacactgacattttgttcgggcagaatggtggttgtaaaactctgcttgttctctcgggtgttacttcaatctcaatgttggaaagccctgagaacaagatacaaccagatttctacaccagcaagatttctgattttctttcccccaaaacagctaatgtataggcaagaaactgaatcgtttcatgggtttatacggttttctctaagtcttttctgtttcttgctttgttttggcgagcttattttagttgcactgccttctgtgtgcatagtgaattagcaagccaacgagtcatgttttaggaagagttttacagaattgaatgttaaaatgatgaaccagtgcactgatatgtaagagttaagactcttcatcgacctttaaatccatttgtttgtggttatttac

SEQ ID NO: 1478 - DNA, 1421 bp, Thellungiella halophila
ggtattaaccaaataaaaattaataaaaaaaaaaattccaaaagaaacggaaacaaattaagaaagaagagaggaagaaaaaaaaatgctgaacagagcaattgcttctgctgtttcttcagtcacttcttcttcttcctccgtttctctcttacccaaatccaaacctttcttctctgtcaaaaccctctccggatcatctcgttctccatctttctgcggcggcttcactcgtagaatcgaccataagcctctccgtatgacgactcgagctatggctacgcagcagctcgagaacgccgatcagctcatcgattccgtcgaaacttttatcttcgattgtgacggagtgatttggaagggagataaattgattgagggagttcctgaaactcttgatatgctccgtgccaagggaaagaggttggtttttgtcacgaacaactctacaaagtcaaggaaacaatacggcaaaaagtttgagactcttggcctgaatgttaacgaggaggagatatttgcttcttcttttgctgcagctgcatacttacaatctattaatttcccaaaagataagaaggtctatgtaattggtgaggagggtatcttgaaagagcttgagcttgctggttttcagtaccttggaggtccagatgatggtaaaaggcagattgagttgaagccaggatttttaatggagcatgatcatgatgtgggagctgttgtggttggatttgatcgctatttcaactactacaaaatccagtatggaacactctgtatccgcgaaaacccgggttgtcttttcattgctacaaaccgagatgctgtcacacaccttaccgatgctcaagaatgggcaggtggtggctctatggttggtgctcttgttggatccactcaacgtgagcctcttgttgttggaaaaccttcaacttttatgatggactatttagcagataaatttggaatccaaaagtcacagatatgcatggtgggtgatagattagacactgacattttgttcgggcagaatggtggttgtaaaactctgcttgttctctcgggtgttacttcaatctcaatgttggaaagccctgagaacaagatacaaccagatttctacaccagcaagatttctgattttctttcccccaaaacagctaatgtataggcaagaaactgaatcgtttcatgggtttatacggttttctctaagtcttttctgtttcttgctttgttttggcgagcttattttagttgcactgccttctgtgtgcatagtgaattagcaagccaacgagtcatgttttaggaagagttttacagaattgaatgttaaaatgatgaaccagtgcactgatatgtaagagttaagactcttcatcgacctttaaatccatttgtttgtggttatttac

SEQ ID NO: 1479 - DNA, 1313 bp, Eutrema parvulum
ctacaagatccacccaaattgccacgtcagcaccatccacaatcgtagtaaccaattataaaattaattatacaaaaaaaaacaaaatttccaaaagaagaacaaagaaaaaaaaatgctgaatagagcagttgttgcttcttcttcctccttttctctcttacccaactcaaaacctttcttctcctccgtcaaaagcctctctggatttcgatcttcctcgttctccggcggattcattcgtagaatcgaccataaacctcttcgaatgacgagtctcagttcgacaccgaaagctacggcgacgaagcagctcgagaacgccgatcagctcatcgattccgtcgaaacttttatcttcgattgtgatggagtaatttggaaaggagataaattgattgagggagttcctgaaactcttgatatgctacgtgccaagggaaagaggttggtttttgtcacgaacaactcaacaaagtctaggaaacaatatggcaaaaagtttgagactcttggactgaatgttaacgaggaggagatatttgcttcttcttttgctgcagctgcatacttgcagtctattaatttcccaaaagataagaagatctacgtgattggtgaggagggtatcttgatagagctcgagcttgctggttttcaataccttggtggtccggatgacggtaaaaggcagattgaattgaagccaggatttctaatggagcatgataatgatgtgggagctgtggtggttggatttgatcgctttttcaactactacaaagttcagtatggaacactctgtatccgcgaaaacccggggtgtcttttcattgctacaaaccgagatgctgtcacccaccttaccgatgctcaagaatgggcaggtggtggctctatggttggtgctcttgttggatccactcaacgtgaacctcttgtagttggaaaaccctcaacttttatgatggactatgtagcagacaaatttggaatccaaaagtcacagatatgcatggttggtgatagattggacactgacattttgttcggacagaatggcggttgtaaaactctgctcgtcctctcgggtgttacgtcaatctcgatgttggaaagccctgagaacaagatacaaccagacttctacaccagcaagatttctgattttctaaccccaaaagcagctactgtataagcaagtaagcgccacgacaagtaactctctgttgaactcagcaaatataagctgtttcttttgttaatttgtagcgccttctgtgtgtgcatagcgaattagcgagccaacgagt

SEQ ID NO: 1480 - DNA, 1307 bp, Brassica napus
acagaaaaaaggaagaagagaagaaaagatgctgaacagaacaacacttgtttcttcttcctcagtttctctcttaccaaactccaaacctttcttctccgtcaaggctttctcaggatttcgttcttcctccttctccggtggcatcattcgcagaatcgatcataagcctctccgcgtgatgactcccaatatgacaccgagagctatggcggcacagcagctcgagaacgccgatcagctcatcgattccgttgaaacttttatcttcgactgtgacggagtcatttggaagggagataaattgattgagggagttccagagactcttgatatgctccgtgccaagggaaagaggttggtttttgtgacaaacaactcaacaaaatctaggaaacaatatggcaaaaagtttgagactcttggcctgaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtatcttggaggtccggatgatggtaaaaaacagattgaactgaagccagggtttctaatggagcatgataatgatgtgggagctgtggtggttggatttgaccgctatttcaactactacaaaattcagtatggaactctctgtatccgcgaaaacccgggctgtctgttcattgctacaaaccgagatgctgtcacccaccttaccgatgctcaagaatgggcaggtggtggctctatggttggtgctcttgttggatcctgtcaacgtgaacctcttgtagttggaaaaccctcaacttttatgatggactatttggcagacaaatttggaatcgaaaagtcacagatatgcatggtgggtgatagattggacactgatattttgtttgggcagaatggtggttgtaaaactctgcttgtcctctcgggtgttacttcaatctcgatgttggaaagccctgagaacaagatacaaccagatttctacaccagcaagatttctgattttctttccctcaaagcagctaatgtatgaaagcacttgccgcgtcaatcgctctgtagaactcagcaaattcagagtcagtccacacgtttatctattgtataagctttttcttggcaagcttcatctatctgtagcctcttccttgagccaacgagtattgtgtatcaccgtctcatcctctctcgaagtgacactctaatcatgtttatctcacatacgctaaatt

SEQ ID NO: 1481 - DNA, 1272 bp, Brassica juncea
aacacttgtttcttcttcctcagtttctctcttaccaaactcaaaacctttcttctccgtcaaaaacctctccggatttcgttcttcctccttctctggcggcttcattcgcagaatcaaccataagcctctctgtgtgatgactcccaatttgacaccgagagctatggcggcacagcagctcgagaacgccgatcagctcatcgattccgttgaaacttttatcttcgattgtgacggagtcatttggaagggagataaattgattgagggagttcctgaaactcttgatatgctccgtgccaagggaaagaggttggtttttgtgacgaacaactcaacaaagtctaggaaacaatatggcaaaaagtttgagactcttggcctcaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtaccttggaggtccggatgatggtaaaaaacagattgaactgaagccaggatttctaatggagcatgataatgatgtgggagctgtggtggttggatttgaccgctatttcaactactacaaaattcagtatggaacactctgtatacgcgaaaaccctggctgtctgttcattgctacaaaccgagatgctgtcacccaccttaccgatgctcaagaatgggcaggtggtggctctatggttggtgctcttgttggatcctgtcaacgtgaacctcttgtagttggaaagccctcaacttttatgatggactatttggcagacaaattcggaatcgagaagtcacagatatgcatggtgggtgatagattggacaccgatattttgtttgggcagaatggtggttgtaaaactctgcttgtcctctcgggtgttacttcaatctcaatgttggaaagccctgagaacaagatacaaccagacttctacaccagcaagatttctgattttctttcccttaaagcagctaatgtatgaaagcacttgccgcctcaatccgctctgtagaactcagcaaattcagagtcaacccacacgtttatctattgcataagcttttgcttggcaagcttcatctatttgtagcctcttccttgagccaacgagtattgtgtatcaccgtctcatcctctctcgaagtgacactctaatcatgtttatctcccataacactaaatttgaaa

SEQ ID NO: 1482 - DNA, 1365 bp, Brassica napus
accggtccggaattccgggtcgacacacgcgtccggaaaccgagaaaaggaagaagagaagaaaagatgctgaacagaacaacacttgtttcttcttcctcagtttctctcttaccaaactccaaacctttcttctccgtcaaggctttctcaggatttcgttcttcctccttctccggcggcatcgttcgcagaatcgaccataagcctctgcgagtgatgactcccaatttgacaccgagagctatggcggcacagcagctcgagaacgccgatcagctcatcgattccgttgaaacttttatcttcgactgtgacggagtaatttggaagggagataaattgattgagggagttcctgaaactcttgatatgctccgtgccaagggaaagaggttggtttttgtgacgaacaactcaacaaagtctaggaaacaatatggcaaaaagtttgagactcttggcctcaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtaccttggaggtccggatgatggtaaaaaacagattgaactgaagccagggtttctaatggagcatgataatgatgtgggagctgtggtggttggatttgaccgctatttcaactactacaaaattcagtatggaacactctgtatacgcgaaaaccctggctgtctgttcattgctacaaaccgagatgctgtcacccaccttaccgatgctcaagaatgggcaggtggtggctctatggttggtgctcttgttggatcctgtcaacgtgaacctcttgtagttggaaagccctcaacttttatgatggactatttggcagacaaattcggaatcgagaagtcacagatatgcatggtgggtgatagattggacaccgatattttgtttgggcagaatggtggttgtaaaactctgcttgtcctctcgggtgttacttcaatctcaatgttggaaagccctgagaacaagatacaaccagacttctacaccagcaagatttctgattttctttcccttaaagcagctaatgtatgaaagcacttgccgcctcaatccgctctgtagaactcagcaaattcagagtcaacccacacgtttatctattgcataagcttttgcttggcaagcttcatctatttgtagcctcttccttgagccaacgagtattgtgtatcaccgtctcatcctctctcgaagtgacactctaatcatgtttatctcccataacactaaatttgaaagcaccatattatt

SEQ ID NO: 1483 - DNA, 1380 bp, Brassica napus
accggtccggaaatccgggtcgaaaacgcgtccggaaaccgataaaaggaagaagagaagaaaagatgctgaacagaacaacacttgtttcttcttcctcagtttctctcttaccaaactccaaacctttcttctccgtcaaggctttctcaggatttcgttcttcctccttctccggcggcatcgttcgcagaatcgaccataagcctctgcgagtgatgactcccaatttgacaccgagagctatggcggcacagcagctcgagaacgccgatcagctcatcgattccgttgaaacttttatcttcgactgtgacggagtaatttggaagggagataaattgattgagggagttcctgaaactcttgatatgctccgtgccaagggaaagaggttggtttttgtgacgaacaactcaacaaagtctaggaaacaatatggcaaaaagtttgagactcttggcctcaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtaccttggaggtccggatgatggtaaaaaacagattgaactgaagccagggtttctaatggagcatgataatgatgtgggagctgtggtggttggatttgaccgctatttcaactactacaaaattcagtatggaacactctgtatacgcgaaaaccctggctgtctgttcattgctacaaaccgagatgctgtcacccaccttaccgatgctcaagaatgggcaggtggtggctctatggttggtgctcttgttggatcctgtcaacgtgaacctcttgtagttggaaagccctcaacttttatgatggactatttggcagacaaattcggaatcgagaagtcacagatatgcatggtgggtgatagattggacaccgatattttgtttgggcagaatggtggttgtaaaactctgcttgtcctctcgggtgttacttcaatctcaatgttggaaagccctgagaacaagatacaaccagacttctacaccagcaagatttctgattttctttcccttaaagcagctaatgtatgaaagcacttgccgcctcaatccgctctgtagaactcagcaaattcagagtcaacccacacgtttatctattgcataagcttttgcttggcaagcttcatctatttgtagcctcttccttgagccaacgagtattgtgtatcaccgtctcatcctctctcgaagtgacactctaatcatgtttatctcccataacactaaatttgaaagcaccatattattgatatttaaataatgt

SEQ ID NO: 1484 - DNA, 1299 bp, Brassica napus
acagaacaacacttgtttcttcttcctcagtttctctcttaccaaactccaaacctttcttctccgtcaaggctttctcaggatttcgttcttcctccttctccggtggcatcattcgcagaatcgatcataagcctctccgcgtgatgactcccaatatgacaccgagagctatggcggcacagcagctcgagaacgccgatcagctcatcgattccgttgaaacttttatcttcgactgtgacggagtcatttggaagggagataaattgattgagggagttccagagactcttgatatgctccgtgccaagggaaagaggttggtttttgtgacaaacaactcaacaaaatctaggaaacaatatggcaaaaagtttgagactcttggcctgaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtatcttggaggtccggatgatggtaaaaaacagattgaactgaagccagggtttctaatggagcatgataatgatgtgggagctgtggtggttggatttgaccgctatttcaactactacaaaattcagtatggaactctctgtatccgcgaaaacccgggctgtctgttcattgctacaaaccgagatgctgtcacccaccttaccgatgctcaagaatgggcaggtggtggctctatggttggtgctcttgttggatcctgtcaacgtgaacctcttgtagttggaaaaccctcaacttttatgatggactatttggcagacaaatttggaatcgaaaagtcacagatatgcatggtgggtgatagattggacactgatattttgtttgggcagaatggtggttgtaaaactctgcttgtcctctcgggtgttacttcaatctcgatgttggaaagccctgagaacaagatacaaccagatttctacaccagcaagatttctgattttctttccctcaaagcagctaatgtatgaaagcacttgccgcgtcaatcgctctgtagaactcagcaaattcagagtcagtccacacgtttatctattgtataagctttttcttggcaagcttcatctatctgtagcctcctccttgagccaacgagtattgtgtatcaccgtctcatcctctctcgaagtgacactctaatcatgtttatctcacataacactaaatttgaaagaaccgtattattaaaggcaa

SEQ ID NO: 1485 - DNA, 1249 bp, Brassica napus
cttcctcagtttctctcttaccaaactccaaacctttcttctccgtcaaggctttctcaggatttcgttcttcctccttctccggtggcatcattcgcagaatcgatcataagcctctccgcgtgatgactcccaatatgacaccgagagctatggcggcacagcagctcgagaacgccgatcagctcatcgattccgttgaactttatcttcgactgtgacggagtcatttggaagggagataattgattgaggagttccagagactcttgatatgctccgtgccaagggaaagaggtgggtttttgtgacaaacaactcaacaaaatctaggaaacaatatggcaaaaagtttgagactcttggcctgaatgttaacgaggaggaaaatatttgcttcttcttttgctgcagctgcatacttgcagtctataatttccccaaagataagaaggtctatgtgattggtgaggagggtatcttgaaggagctcgaccttgctggtttccagtatcttggaggtccggatgatggtaaaaaacagattgaactgaagccagggtttctaatggagcatgataatgatgtgggagctgtggtggttggatttgaccgctatttcaactactacaaaattcagtatggaactctctgtatccgcgaaaacccgggctgtctgttcattgctacaaaccgagatgctgtcacccaccttaccgatgctcaagaatgggcaggtggtggctctatggttggtgctcttgttggatcctgtcaacgtgaacctcttgtagttggaaaaccctcaacttttatgatggactatttggcagacaaatttggaatcgaaaagtcacagatatgcatggtgggtgatagattggacactgatattttgtttgggcagaatggtggttgtaaaactctgcttgtcctctcgggtgttacttcaatctcgatgttggaaagccctgagaacaagatacaaccagatttctacaccagcaagatttctgattttctttccctcaaagcagctaatgtatgaaagcacttgccgcgtcaatcgctctgtagaactcagcaaattcagagtcagtccacacgtttatctattgtataagctttttcttggcaagcttcatctatctgtagcctcttccttgagccaacgagtattgtgtatcaccgtctcatcctctctcgaagtgacactctaatcatgtttatctcacataacactaaattt

SEQ ID NO: 1486 - DNA, 1384 bp, Raphanus sativus
  misc_feature (1367)..(1367): n is a, c, g, or t
ggatattccaaaagaaacggaaaccgaagaagaaaagatgatgctgaacagaacacttgtttcttcttcctcactttctctcttaccaaactcaaaacctttcgtctcctccggatttcgttcttcctccttctccggcggcttcattcgcagaatcgaccataagcctatccgtgtgatgactcccaatttgacaccgagagctatggcggcacagcagctcgagaacgccgatcagctcatcgattccgttgaaacttttatcttcgattgtgacggagtcatttggaagggagataaattgattgagggagttcctgaaactcttgatatgctccgtgccaagggaaagaggttggtttttgtgacgaacaactcaacaaaatctaggaaacaatatggtaaaaaatttgagactcttggcctgaatgttaacgaggaggaaatatttgcttcttcttttgctgcagctgcatacttgcagtctattaatttccccaaagataagaaggtctacgtgattggtgaggagggtattttgaaagagctcgaccttgctggttttcaataccttggaggtccggatgatggtaaaaaacaaattgaactgaagccaggatttctaatggagcatgataatgatgtgggagctgtggtggttggatttgaccgctatttcaactactacaaaattcagtatggaactctctgtatccgcgaaaacccgggctgtcttttcattgctacaaaccgggatgctgtcactcaccttaccgatgctcaagaatgggcaggtggtggctccatggttggtgctcttgttggatcctgtcaacgtgaacctcttgtagttggaaaaccctcaacttttatgatggactatttgtcagacaaatttggaatcgaaaagtcacagatatgcatggtgggtgatagattggacactgatattttgtttgggcagaatggtggttgtaaaactcttcttgtcctctctggtgttacttcaatctccatgttggaaagccctgagaacaagatacaaccagatttctacaccagcaagatttctgattttctttccctcaaagcagctaatgtgtgatgaacaagaaatcactttcacctctgtacaactcagcaactacagagtcaatccatacgtttatctatgtatagactttttcttgcttgttttggcaagcttcatttattcgaagcgtctttctcgtgcatggcgcgttagcgagcaccaatctcatcctccctaagtgacactctaatgtttatctcacataactttaaatttcaaatactattttattaatatttaaataaagttttcaataataaaaaattactggaanaaactgaatttattgca

SEQ ID NO: 1487 - DNA, 1347 bp, Brassica oleracea
gatattccaaaagaaacggaaacagaaaaaaggaagaagagaagaaaagatgctgaacagaacaacacttgtttcttcttcctcagtttctctcttaccaaactccaaacctttcttctccgtcaaggctttctcaggatttcgttcttcctccttctccggtggcatcattcgcagaatcgatcataagcctctccgcgtgatgactcccaatatgacaccgagagctatggcggcacagcagctcgagaacgccgatcagctcatcgattccgttgaaacttttatcttcgactgtgacggagtcatttggaagggagataaattgattgagggagttccagagactcttgatatgctccgtgccaagggaaagaggttggtttttgtgacaaacaactcaacaaaatctaggaaacaatatggcaaaaagtttgagactcttggcctgaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtatcttggaggtccggatgatggtaaaaaacagattgaactgaagccagggtttctaatggagcatgataatgatgtgggagctgtggtggttggatttgaccgctatttcaactactacaaaattcagtatggaactctctgtatccgcgaaaacccgggctgtctgttcattgctacaaaccgagatgctgtcacccaccttaccgatgctcaagaatgggcaggtggtggctctatggttggtgctcttgttggatcctgtcaacgtgaacctcttgtagttggaaaaccctcaacttttatgatggactatttggcagacaaatttggaatcgaaaagtcacagatatgcatggtgggtgatagattggacactgatattttgtttgggcagaatggtggttgtaaaactctgcttgtcctctcgggtgttacttcaatctcgatgttggaaagccctgagaacaagatacaaccagatttctacaccagcaagatttctgattttctttccctcaaagcagctaatgtatgaaagcacttgccgcgtcaatcgctctgtagaactcagcaaattcagagtcagtccacacgtttatctattgtataagctttttcttggcaagcttcatctatctgtagcctcctccttgagccaacgagtattgtgtatcaccgtctcatcctctctcgaagtgacactctaatcatgtttatctcacataacactaaatttgaaagaaccgtattatt

SEQ ID NO: 1488 - DNA, 1359 bp, Brassica rapa
attccaaaagaaacggaaacagaaaaaaaaggaagaagagaagaaaagatgctgaacagaacaacacttgtttcttcttcctcagtttctctcttaccaaactccaaacctttcttctccgtcaaggctttctcaggatttcgttcttcctccttctccggcggcttcattcgcagaatcgatcataagcctctgcgtgtgatgactcccaatttgacaccgagagctatggcggcacagcagctcgagaacgccgatcagctcatcgattccgttgaaacttttatctttgactgtgacggagtaatttggaaaggagataaactgattgagggagttcccgaaactcttgatatgctccgtgccaagggaaagaggttggtttttgtgacgaacaactcaacaaagtctaggaaacaatatggcaaaaagtttgagactcttggcctcaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtaccttggaggtccggatgatggtaaaaaacagattgaactgaagccaggatttctaatggagcatgataatgatgtgggagctgtggtggttggatttgaccgctatttcaactactacaaaattcagtatggaactctctgtatccgcgaaaatccgggctgtcttttcattgctacaaaccgagatgctgtcactcaccttaccgatgctcaagaatgggcaggtggtggctctatggttggtgctcttgttggatcctgtcaacgtgaacctcttgtcgttggaaagccctcaacttttatgatggactatttggcagacaaattcggaatcgagaagtcacagatatgcatggtgggtgatagattggacactgatattttgtttgggcagaatggcggttgtaaaactctgcttgtcctctcgggtgttacttcaatctcgatgttggaaagccctgagaacaagatacaaccagatttctacaccagcaagatttctgattttctttccctcaaagcagctaatgtatgatgaacaagaaagcactcgccgcgccaatcgctctgtagaactcagcaaatacagagtcagtccacacgtttacctattgtataagctttttcttggcaagcttcatctatttgtagcctcttcttgagccaacgagtattgtgtatcactctaatcatgtttatctcacataaccctaaatttgaaagcaccatattattaatatttaaatagtgatttcaagtatcgaaa

SEQ ID NO: 1489 - DNA, 1195 bp, Brassica napus
ctttctcaggatttcgttcttcctccttctccggcggcttcattcgcagaatcgaccataagcctctccgtgtgatgactcccaatttgacaccgagagctatggcggcacagcagctcgagaacgccgatcagctcatcgattccgttgaaacttttatcttcgactgtgacggagtaatttggaaaggagataaactgattgagggagttcccgaaactcttgatatgctccgtgccaagggaaagaggttggtttttgtgacgaacaactcaacaaaatctaggaaacaatatggcaaaaagtttgagactcttggcctgaatgttaacgaggaggaaatatttgcttcttcttttgctgcagctgcatacttgcagtctattaatttccccaaagataagaaggtctatgtgattggtgaggagggtatcttgaaggagctcgaccttgctggtttccagtaccttggaggtccggatgatggtaaaaacaaattgaactgaagccaggatttctaatggagcatgataatgatgtgggagctgtggtggttggatttgaccgctatttcaactactacaaaattcagtatggaactctctgtatccgcgaaaatccgggctgtcttttcattgctacaaaccgagatgctgtcactcaccttaccgatgctcaagaatgggcaggtggtggctctatggttggtgctcttgttggatcctgtcaacgtgaacctcttgtcgttggaaagccctcaacttttatgatggactatttggcagacaaattcggaatcgagaagtcacagatatgcatggtgggtgatagattggacactgatattttgtttgggcagaatggtggttgtaaaactctgcttgtcctctcgggtgttacttcaatctcgatgttggaaagccctgagaacaagattcaaccagatttctacaccagcaagatttctgattttctttccctcaaagcagctaatgtatgatgaacaagaaagcactcgccgcgccaatcgctctgtagaactcagcaaatacagagtcaatccacacgtttacctattgtataagctttttcttggcaagcttcatctatttgtagcctcttcttgagccaacgagtattgtgtatcactgtctcatcctctctcgaagcgacactttaatcatgtttatctcac

SEQ ID NO: 1490 - DNA, 1281 bp, Cleome spinosa
aaaagtttcaagcggaaacggaaaagggaggataggatgcttggcagagcagttgttgcttctgcagtttcaccagtctcttcctcttcttcttcatctgctttctgtctctcgccgaagctcaatttctccgccgtctggagcctctccggcgtccaatcttcgccgtttctcggttcctctctcctcagatgtaagagcgaccgcaagcctctccgcatgacgagctccagtgtcgcggtccgagcggcggctcagccgctggagaacgccgatgagctcattgactctgtcgagactttcatctttgactgtgacggagtgatatggaaaggagacaaactgatcgagggagttcctgaaactctggatatgctccgtgctaagggaaaaagattggtttttgtcacaaacaactcaacaaagtcaaggaaacaatatggcaaaaagtttgagactctcggccttactgttagcgaggaagagatatttgcttcatcttttgctgcagctgcctacttgcagtccatcaattttccaaaagataagaaggtttacgtggttggtgaggatggcatcttgaaagaacttgagctagctggcattcaatatattggagggccggaagacggtaaaaagcagattgaactaaagccaggatttttgatggagcatgataaggatgtaggagctgttgtggttggatttgatcgttatttcaactactacaaaatacagtatgcaacactctgtatccgtgaaaaccctgggtgtcttttcattgctacaaaccgagatgcagtcacccaccttactgacgctcaggaatgggcaggtggtggttccatgaatggagctattgctggatctactcaacgggagcctctggttgctggaaaaccctcaacttttatgatggattatttagcagacaaatttggaattcaaaagtcacagatatgcatggtgggtgatagattggacactgacattttgttcggacagaacggcggttgcaaaactctcctcgtcctctctggtgttacaacactctcaaagcttcaaagccctgaaaacaagatccaaccagatttctacacgagcaagatctcagattttctatccccaaagcctgccgctgctgtgtaaaatcaataactccagctacatacatatattatattatatatacatgagatatcatcacttatcggttagaaagaatgtaaaagcaccacttaaagacaagagaaggacccatctgtatgacttttttaaaaa

SEQ ID NO: 1491 - DNA, 1387 bp, Aristolochia fimbriata
aaaaatagcgagtgcgccacccgccaatggccccctccaaaagtaagaggcagacacagaggggacgtcggagtaaagaggaaacatgctgggtagagtctgccattcgcttttgcccgtctcttctccgcccctttttctccccagtattccaagttgtcggtttttggggcagagcaacgtgtctggcctgcggaactctttattttctcgtgcgagtagatcatggaactgtagaatggcgggttctaatgcgagttttagcgtcagagcgtcggctcagcagctcaagaacgctgacgagttgattgattccgtcgagacgtttattttcgattgtgatggagtcatatggaaaggggacagtcttattgatggggtacccgagactctggatatgcttcgtgcaaagggcaagcgactagtttttgttacgaacaattctacaaagtccagaaaacaatatggcaaaaagtttgaaacacttggtttaagtgtgaatgaggaagagatttttgcatcttcctttgctgctgccgcttatttgcagtcaattgattttcctaaagataagaaggtttatgtcattggggaggatggaattttgaaggagcttgaacttgctggatttcaataccttggtggcccagcagatggggataagaagattgaactgaagcctggatttttgatggagcatgatgagaatgtcggggcagttgttgttggatttgaccgttacttcaactactacaaaattcagtatggaacactttgtatacgtgaaaatccagggtgccttttcattgctacaaatcgtgatgctgttactcatcttaccgatgctcaagagtgggcaggtggtggttccatggttggtgctattcgtggatcaactcaacgggaacctctggtagtgggaaaaccatcgacattcatgatggactatcttgcaaagaaatttggcattctcaaatctcaaatatgcatggttggggacagactggatacagacatcttatttggccaaaacggtggatgcaaaacacttcttgttttatccggtgttacctcgctttccatgcttcaaagccctgataatgctatccaaccggacttctatactagcaaaatagctgattttctttccctcaaaaccacaaccgtttgagaatatcaaattttggtaatgccattaccgttccagtgcacattttccttgattactaggtgaaattgtatataagctctggtggaactccactttattgaggacggtaatcggaggacggtagcattcagaaatgaaacagccaattcttttgagtatgttacgaaaattcaatttctagataatgctttccttgaattctagtggaaatttacc

SEQ ID NO: 1492 - DNA, 1401 bp, Cleome gynandra
ttaaaacaaaaacgagttattccctagaaagcggaaagaagaaaataaacgagaggatgctgagcagagcaggggcttttgcagtttcaacagtctcgtcttcttcttcttcttctgctttttatctctcggcgaagcctagattcttcctcggcgggagccgctactgcgtccattcttcgctgtttctcggttctactgtcctcagatataagagccaccccaagcctctgcgaatgacgagttccagtttcgagctgcgagcggtggcggctgctgctcggccactggagaatgccgatgagctcattgattctgtcgagactttcctcttcgattgtgacggagtgatatggaagggagacaaattgatagaaggagttcctgaaactctggatatgcttcggtcgaaggggaaaagattggtttttgttacaaacaactcaacaaagtcaaggaaacaatacggtaaaaagtttgaaacactcggtcttactgttagcgaggaagagatatttgcttcatcgtttgctgcagctgcatacttgcagtccattaatttcccaaaagataagaaggtttacgtggttggtgaggatggcatcttgaaagagcttgagcttgcgggtattcagtaccttggagggccggaggacggtaaaaagcagattgaactgaagccaggattttttatggagcatgataaggatgtcggagctgtggtggttggatttgatcgttatttcaactactacaaaacacagtatgcaacactctgtatccgtgaaaacccagggtgtctgttcattgctacaaaccgagatgctgtcactcaccttacagacgctcaggaatgggcaggtggtggttccatgaatggagctattgctggatccactcaacgtgagcctctggttgttggaaaaccttcaacttttatgatggattacgtagccaacaaattcgggattcaaaagtcacagatatgtatggtgggtgatagattggatactgacattttgtttggccaaaacggtggttgcaagactctcctcgtcctctcaggcgttacctccctctcaaagcttcaaagccctgacaatacgattcaaccggatttctacaccgacaagatctcagatttcctctcctccaaagctgctgctgctgtataaccaataccttcaaccattcggagagatcatcaataaactgcgaattccttcttttggtggttatagctaatctttgtgatgaagcctttctactttggtgtattgagtgttcaagaacaacctattgtgttggaaacatgaggtataacatctgctcaaggtttatttctctttctataaatatttattcctgtatcaaataaaaattttaaatcaatagttttaa

SEQ ID NO: 1493 - DNA, 1389 bp, Arabidopsis lyrata
acatcatcctctttacccacatatataaaagcccttttagagatctcaactttgtttcatctcatttatcatcatccttcaagaacacaaagatagacagaaaaaaaatgtgttcctcaaaattaaagaacctgacccaagaaaacatttcccagatcaacggtcgtccggttcttcaaccgaaatcgaaccaagttccaacattagaccgacgtaactcactcaagaaatctcctcctaagcctttgaatccaatcgcatcatcaaagataccctcaccaagactaatttctctaaactctcctcctttgtctcccaactcaaaatccttaagacaaccgcccggttcttgcaaggagctacttaggtctagctctgtaaaatcaaagccagtgaaatcaccagagaatagtgatggtggctacaaagaagttatgtctatggtgattgttcagaagcagcctggaagtatagcagctgcaagaagagaagaggttgcaatgaaacaagaagagagaaagaagaaaatttctcattacggtagaatcaaatccgtaaaatcgaacgaaaagaacttaaatgttgagcatgagaagaaaaagaggtgcagtttcatcactataagttcagatccaatatatgtcgcttaccatgacaaagaatggggagttccagttcatgatgacaagctactatttgagcttctggtgttaaccggagctcaggtcggatcagattggacttcggttttgaagagaagaaacacttttagagaggctttctctggtttcgaagcagagttggtagcagacttcaacgagaagaagatacaatcaatagtcaacgactatggcattaaccttagccaagtccttgcaatcgttgacaactctaaacaaattctcaaggtgaaaagagattttgggtcattcaacaaatacatttgggggtttctgaaacacaaaccggtcaccacaaaatacacatcatgccaaaagatacccgttaagacatcgaaatcggagactataagcaaagatatggttcgtcgtgggtttagattcgttggtccgacggttatacattcgttaatgcaagccgccggtttaaccaacgaccacttgatcacatgtccgaggcatcttgagtgtacggccatggcggctttataggcaaaaagatcattgttgttgttcacattggctttagtttatatgtaaataaataatatttatgtgttattatttttagtactatatattttgtttttgtcaacattgtagtactatatccaccatgtgatatttaggtttgaggtcctaactttaggtattgatatttctacaaaagtttttgtgtgtgtgtgattctactttgaatttaatatat

SEQ ID NO: 1494 - DNA, 1703 bp, Eutrema parvulum
acattttatcatccttttgcccacgtataaaaaacccttttagagatctcacattcgtttcatcccattatcatcatccttcaagaacacaaagctagagagaaagaaaaaaatgtgttcctcaaaatcaaagaacatgaaccaagaagccatttcacaaatcaatggtcgtccggttcttcagccgaaatcgaaccaagttccgacattagaccgacgcaactcactcaagaaatcttctcctaagcctttgatccatcccattacatcaaagataccttcaccaagatcaatttctctaaactctcctcctttgtctcccaaatcaaaatccttaagaaaaccggccggttctgataagcctaaaccggtgactaaaccggtaaagttatcagagagcactgatggtggctgcaaagaggttctgtccacggtgactgttcagaagcagcctggaagtatagctgctgcaagaagagaagaggttgcgataaaacaagaagaaagaaagaagaaaatatctcattacggtaggatcaaatccgtaaaatcgaacgagaagaacttaaatgttgagcatgagaagaagaagagatgcagtttcatcactacaagttcagatccaatctatgtggcttaccatgacgaagaatggggagttcctgttcatgatgacaacctactgtttgagcttctggtcttaaccggagctcaggtcggatccgattggacttcggttttgaagagaagaaacacttatagagaggctttctctggtttcgaagcagagttggtcgcagagttcaacgagaagaagatacaatccataatcaacgactatggcattggccttagccaagtccttgcaattgttgacaactctaaacaaattctcaaggtgaaaagagatttcgggtcattcaacaaatacatttggggatttatgaaacacaaaccggttaccacaaaatacacatcttgccaaaagattccggttaagacatcaaaatcagaaaccataagcaaagacatggttcgtcgtgggtttagattcgttggtccgaccgttatacattcgttaatgcaagccgctggtttaaccaacgaccatttgatcacttgtccgagacatctcgagtgtacggctatggcgggtctataggcaaaaaagataaatcttgtttgtcatatttggctttatttattagttttacgtacttaaataatgttgttgcgttattattctatagtactatatctaccatgtgatatatagatttgaggtcctaactttaggtattgatttttgtacaaaagtctttttatgtgtgtgtgattctgctttgaagttaatatatctatatatgtgtgtgtgtgtttggtttatttttgtttataacttttttgtttgaggttaatagtttgtgggttatggggaataatgtaaagaagagagacagagcatgtgcaaaagttgggaggcagtgtcatgtgttaagattatcaatgaacatttttttttcttttttgaacattttatacttttttctcttttttttgttgatgacaaatgttctttctttagcttttgagttggacgaataaaatatgaaaagaagctttgttagacccatctagtacaaaaattgatgcaatttctccttaccgaaagccttatcatcttcaagttcgataatggaact

SEQ ID NO: 1495 - DNA, 1555 bp, Eutrema halophilum
gtttcatcccattatcttcatccttcaagagcacaaagctagagaagaaaatttaaaaaatgtgttcctcaaaatcaaagaacatgaaccaagaagctatttcccaaatcaacggtcgtccggttcttcaaccgaaatcaaaccaagttccgacattagaccgacgcaactcactcaagaaatctcctcctaagccttcaatccatcccattccatcaaagataccctcaccaagaccaacttttctaaactctcctccattgtctcccaaatcaaaatctttaagaaacccggccggttctgagaagcctaaaccggtgaaattatcagagagcacggatggtggctgcagagaggttatgtccatggtgattgctcagaagcagcctggaagtatagctgctgctagaagagaagaggttgcgatgaaacaagaagaaagaaagaagaaaatctctcattacggtaggataaaatccgtaaaatccgtaaaatcgaacgaaaagaacttaactgttgagcatgagaagaagaagagatgcagtttcataactacaagttcagatccaatctatgtggcttaccatgacacagaatggggagttcctgttcatgatgacaagctactgtttgagcttctggtgttaaccggagctcaggtcggttccgattggacttcggttttgaagagaagaaacacttttagagaggctttctctggttttgaggcagagttggtcgcagagttcaacgagaagaagatacactcaatagttaatgactatggcattggccttagccaagtccttgcaattgttgacaactctaaacaaattcttaaggtaaaaagagatttcgggtcattcaacaaatacatatggggatttttgaaacacaaaccggtcaccacaaaatacacatcttgtcaaaagattccggttaagacatcgaaatcggagaccataagcaaagacatggttcgtcgtgggtttagatttgttggtccgaccgttatacattcgttaatgcaagctgctggtttaaccaacgaccacttgatcacttgtcctaggcatctcgagtgtacggccatggcggctctataggcaaaaagatcattgctattgtctcattttggttgtgtaattaaataatatcgattattgtagtactatgtctagcatgtgatttatagatttgaggtcctaactttaggtattgatttttgtacaaaggcctttttgtatgtgtgtgtgtgattttgctttgaatttaatatatttatatatgtgtgtttatatttttattttagtttctttaatttgtttttgaggttgatagtttgtgggatatgggaataatgtaaagaagggagacagagcatgtgcaaaagttaagaaccaatgtcatgtgttagattattaatgaactttttatactttattctctcttttttttgttgataacaaattttccttagcttttgagttggaagaaaaaatataaaaagaagctttgttagaccccatttggtacaaaaattgatgcaattctt

SEQ ID NO: 1496 - DNA, 1480 bp, Brassica napus
ctcccgggaattttgaaccaccgtgtagttttgggagtctccacagacgattttaccaaaaccatcccattatcatcatccttcaagaacacaaagctagagagaaaaagaaaatgtgttcctcaaaatcaaagaacatgaaccaagaagccatttcccaaatcaatggtcgtccagttcttcagccaaaatcgaaccaagttcccactttagaccgacgcaactcactcaagaaatctcctcctaagtctttgatacatcccattgcatcaaagatagcctcaccaagaccaatatccctaaactctccacctttgtctcccaactcaaaacccataagaaaactggcctattatgagaagcctaaaccggctgctaaaccggtgaaattatcagagcgcactgatggtggctgcagagaggttaagtccacggtgactgttcagaagcaacctggaagtatagctgctgcaagaagagaagaggttgctatgaaacaagaagaaagaaagaagaagatctctcattatggtagggtaaaatccgtactatcaaacgaaaagagcttaaatgttgaacatgagaagaagaagagatgcagtttcatcactacaagttcagatccaatctatgtggcttaccatgatgaagaatggggagttcctgttcatgatgacaacctattgtttgagcttctggtgttaaccggagctcaggtcggatccgattggacttcggttttgaagagaagaaacacttttagagaggctttctctggtttcgaagcagagttggtcgcagagttcaacgagaagaagatacagtcgatagtcaacgactacggaattggccttagccaagtccttgcagttgttgacaactctaaacaaattctcaaggtgaaaagagatttcggatcattcaacaaatacatttggggatttatgaagcacaaaccggttaccacaaaatacacatcttgccaaaagattccggttaagacatcaaaatcagaaaccataagcaaagacatggttcgtcgcgggtttagattcgttggtccgacagttatacattcgttgatgcaagccgccgggttaaccaacgaccatttgatcacttgtccgagacatctcgagtgtatggccaaggctgctctataggcaaaaaaatatcattgttgttcacattggctttatttattagttttacgtaatcaaataatattgatgtgttattatccatgtgatatatagatttgagatcctaactttaggtattgatttttgtacaaaagtatgtgtgcgtgtgtgattgtgctttatattgaatatatgtgtgtatttggtttataattatttaatttggtttctgaggataatagtttgtgggatatgaggaatattgtaaagaagagagacagagcatgtgcactaaagttgggtagtgcattgttcatgtgttagattatcaatggtac

SEQ ID NO: 1497 - DNA, 1519 bp, Raphanus sativus
  misc_feature (590)..(590): n is a, c, g, or t
  misc_feature (751)..(751): n is a, c, g, or t
gggtttcatcccattatcatatcatccttcaaaacacaaagctagagagaaagaaaatgtgttcctcaaaatcaaagaacatgaaccaagaagccatttcccaaatcaatggtcgtccggttcttcagccaaaatcgaaccaagttcccactttagaccgacgcaattcactcaagaaatcccctcctaaacctttgatacatcccattgcatcaaagttagcgtcaccaagacaaatatccctaaactctccacctttgtctcccaacttaaaacccataagaaaactggccggtcatgagaaacctaaacaggctgctaaaccggtgaaattaccagagagcactgatggtggctgcagagaggttaagtccttgatgactgttcagaagcaacctggaagtatagctgctgcacgaagacaagaggttgctatgaaacaagacgaaagaaagaagaaaatctctcattatggtagagtaaaatctgtaaaatcaaacgaaaataacttaaatgttgaacatgagaagaagaagagatgcagtttcatcactacaagttcagatccaatctatgtggcttaccatgangaagaatggggagttcctgttcatgatgacaacctactgtttgagcttctggtgttaaccggagctcaagtaggatccgactggacttcggttttgaagagaagaaacacttttagagaggctttctctggtttcgaagcagagcttgtcgcagagttcancgagaagaagatacagtcgatagtcaacgactatggaattggccttagccaagtccttgcaattgttgacaactctaaacaaattctcaaggttaaaagagattttggatcattcaacaaatacatttgggaattcatgaagcacaaaccggttaccacagaatacacatcttgccaaaagattccggtgaagacatcaaaatcagaaaccataagcaaagacatggttcgtcgtgggtttagattcgttggcccgacagttatacattcgttaatgcaagccgccggtttgaccaacgaccatttgatcacttgcccgagacatctcgagtgtaaggccaaagctggtctataggcaaaagaagatcattgttttggtcacattggctttatttattagttttacgtaatcataataatattgatgtgttattattgtagcactatatataccatgtgatatatagatttgaggtcctaactttaggtgttgtttcttgtacaaaagtagttgtttgtgtgtgtgattgtgccttatctttaatatatatttgtgtatttggtttattttgtttaatctggtttttgaggataatagtttgtgggatatggggaatattgtaaagaagagagacagagcatgtgcattagttgggaggcagtgtcatctgttagattctcaatggactttttatactttattctctttttatgaaaatttctctttagcgttcgagttggaagataatatgaaaagaagctttgtta

SEQ ID NO: 1498 - DNA, 1390 bp, Brassica napus
atcaaagaacatgaaccaagaagccatttcccaaatcaatggtcgtccagttcttcagccaaaatcgaaccaagttcccacagtagaccgacgcaactcactcaagaaatttcctcctaagtctttgatacatcccattgcatcaaagatagcctcaccaagaccaaaatccctaaactctccacctttgtctcccaactcaaaacccataagaaaactggcctgttatgagaagcctaaaccagctgctaaaccggtgacattatcagagcgcactgatggtggctgcagagaggttaagtccacggtgactgttcagaagcaacctggaagtatagctgctgcaagaagagaagaggttgctatgaaacaagaagaaagaaagaagaagatctctcattatggtagggtaaaatccgtacaatcaaacgaaaagaacttaaatgttgaaaatgagaagaagaagaagaagaagagatgcagtttcatcactacaagttcagatccaatctatgtggcttaccatgatgaagaatggggagttcctgttcataatgacaacctattgtttgagcttctggtgttaaccgaagctcaggtcggatccgattggacttcggttttgaagagaagaaacacttttagagaggctttctctggtttcgaaccagagttggtcgcagagttcaacgagaagaagatacagtcgatagtcaacgactacggaattggccttagccaagtccttgcaattgttgacaactctaaacaaattctcaaggtgaaaagagatttcggatcattcaacaaatacatttggggatttatgaagcacaaaccggttaccacaaaatacacatcttgccaaaagattccggttaagacatcaaaatcagaaaccataagcaaagacatggttcgtcgcgggtttagattcgttggtccgacagttatacattcgttgatgcaagccgccgggttaaccaacgaccatttgatcacttgtccgagacatctcgagtgtatggccaaggctgctctataggcaaaaaaatatcattgttgttcacattggctttatttattaggtttaggtaatcaaataatattgatgtgttattatctatgtgaatatgtgatatatagatttgagatcctaactttaggtattgatttttgtacaaaagtatgtgtgcgtgtgtgattgtgctttatatttaatatatgtgtgtatttggtttataattatttaatttggtttctgaggataatagtttgtgggatatgaggaatattgtaaagaagagagacagagcatgtgcactaagttgggatgcattgtcatgtgttagattatcaatggtactttttatactacgaaaaaaaaaaa

SEQ ID NO: 1499 - DNA, 1656 bp, Arabidopsis lyrata
aatttacaaattcaaaaacaaaatcttagatcaggtgaatctacctgagaccacgcgattctagatcgatccaccggtgagagacgccggagtttttatccccgccgcgaagagaggaaaccctttcttcttcccgatgtattggtgaagtaatcgagaggggacaatgatggaagtggaaggatcgatgaatcgtgctcctgatcaatcatccttcttacgatcgagacgatccaaagctctgtatcagtttaagcagcagaagctcccagcttgtaagccagtcttaacaccaatatcggttataacagtgtttatgttaatgggttttgttttcattcccattggcctcattactcttcgtgcttctcgtgatgctattgaaattatagaccggtatgatgttgagtgcattcctgaagaatatagaaccaacaaattgtcgtacataacggattcatctatcccaaagaattgtactcgttacttgaaggtacaaaagtatatgaaagctcccatttttatctactaccagctcgataactactatcaaaaccaccgccggtatgtaaagagtagaagtgatcagcaacttttacatggactggagtatagccacacaagttcttgtgaacccgaggagtcatctaatggtctcccaattgttccttgtgggttaatcgcttggagtatgttcaatgatacatttacgttttctcgtgaaagaacgaaactgaaggtgagccggaataacattgcgtggaagagtgaccgcgagcaaaagtttggaaagaatgtgtatcctgtcaatttccagaatggaactttgattggtggagcaaagttggatccaaaaattccactaagtgaccaagaggactttatagtgtggatgcgagcagctgctttgctaagcttccggaaattatatggaagaatcgaagaggacttggagccaggaagtgttgttgaagtaaatttgatgaacaattacaacacttatagctttagtgggcagaagaagcttattctttccacatcgaattggttaggaggaagaaatgatttcctgggcatcacctaccttgtcgttggttcctcttccatagtcatatccatcatcttcatgttgctccatttgaaaaatccaaggccttatggcgacaattcgtggaacaagaaaagccttgcaagttgagaagctgttacattctttctctaacagattcatattccagaaaactgggtgtaagaaaaaaaaatggccaaggaaatgaggtttgttcaaacatggggagaggtagcaccaaggcttattgcatctcaccagaaacaacaacagcaattctcagacttgccaaagcttgagacgatttttgaagaaggatgctgcgtcgatagtcttactgttagggcgccgaagcggattgtaatctttcttcctcttgcactctcaatgattttgtacatggtgttgcacaaaagtatcataggttattgatttgactgtctattggttttgagacttttttaaatatgtgatgatgagaagaagagaatgttctgaacgataaaagagagagattggaaatgttgttaatggtggaaagttgatgacaaatctcaatatgaatttaggtcaagagagagttgaaa

SEQ ID NO: 1500 - DNA, 1624 bp, Eutrema parvulum
tcgatccaccgtgcgagtcgccgtagttttgcctccccgatttgtgttcgagccgcgaggggagtaatttcttcttccgatgtatagttgaaaagtcgagagggataatgatggaagtggaaggatccagctctccgatgaatcgtgctcctgatcaatcatccttcttacgttccaggcgatctaaagctctgtatcagtttaagcagcagaaactcccagcttgtaagccagtcttaacaccaacatcggtcataacagtgtttatgttaatgggttttgttttcattcccattggcttagttactcttcgtgcttctcgtgatgctattgaaattatagaccggtatgatgttgagtgcatacctgaagaatataaaagcaacaaactgtcatatatatcagattcattgatcccaaagaattgtacgcgttacttgaaggtacaaaagcatatgaaagctcccatttttatctactaccagcttgataactactatcaaaaccaccggcggtatgtaaagagtagaagtgatcaacagctgttacatggacgggagtatagccacacaagtgcttgtgaacccgaggagtcatcgaatggtctccccattgtcccttgtgggttaatagcttggagtatgttcaatgatacctttacgtttgctcgtgaaaaatcgaaattgaaggtgagccggaataatattgcatggaagagtgaccgtgagcgcaagtttggaaagaatgtatatcctttcaacttccagaacggaactttgattggtggagcaaatttggatccaaaaattccattaagtgaccaagaggacttcattgtgtggatgcgagcagctgctctactaagcttccggaaattatacggaagaatagaagaggatctagaaccaggaaacgttgttgtggtaaatttgatgaacaattacaatacttacagctttagtgggcaaaagaagcttattctctccacgtcaagttggttaggaggaagaaacgatttcctcggcatcacatatcttgtcgttggttcctcttccataatcatatccatcatcttcatgttgctccatttgaaaaatccgaggccttatggggacaattcttggaacaagaaaagcctttcgggttaagaagctgttacattcttctctgacacattcccattccagaaaactgcgggtgaaagaaagaaaaaaatggccaaggaaatgaggtttggtgaaacatggggagaggtcgcaccaaggcttattgtatctcaccagaaacaacaacaacaattctcaaacttgccaaagcttgagacgattgttgaagaaggatgctgcgtcgataattttgctgttagggcgccgaagcggattgtgatctttcttcctcttgtactctcaatgattttgtacatggtgttgcacaaaagtatcaaagattcttgatttcacttgtcttttggtttttttttgttttttttttggtttacgagactttttaatgtgtgatggtgagaagaagagaatgttctcatatgataaagagtttggaaatgttattaatggtggaaacttgatgacaaaatctctatattaatttaggtagaaagagagag

SEQ ID NO: 1501 - DNA, 1494 bp, Eutrema halophilum
gataatgatggaagtggaaggatcgagcacttcgatgaatcgtgctcctgatcaatcatctttcttacgatccaggcgatcgaaagctttgtatcagtttaagcagcagaaactcccagcttgtaagccagtcttaacaccaacatcggttataacagtgtttctacttatgggttttgttttcatccccattggcttccttactcttcgtgcttctcgtgatgctattgagattatggatcggtacgatgttgaatgcattcctgaagagtataaaagcaacaaactttcatacataacagatgcatcaatcccaaagaattgtactcgttacttgaaggtacaaaagtatatgaaagctcccatttatatctactaccagcttgacaactactatcaaaaccaccgacggtatgtaaagagtagaagtgatcagcaactgttacatggactggaatatagacacacaagtgcttgtgaacccgaggagtcatctaatggtctcccgattgttccttgtgggttaatagcttggagtatgttcaatgatacatttacttttgctcgtgaaagtacgaaactgaaggtgagccggaaaaacattgcgtggaagagtgaccgtgagcacaagttcggaaagaatgtgtatccttacaatttccagaacggaactttgattggtggagcaaagttggattccaaaattccactaagtgaccaagaggactttattgtgtggatgcgagcagctgctctactaagcttccggaaactatacggacgaatcgaagaggacttggaaccaagaaacgttgttgtggtaaatgtgatgaacaattacaacacttatagctttagtgggcagaagaagttgattctctcaacatcaagttggttaggaggaagaaacgatttcctcggcatcacatatctcgtcgttggttcctcttccataatcatatccatcatcttcatgttgctccatttgaaaaatccgaggccttatggggacaattcttggaacaaaaaaagcctttcgggttgagaagctgttacattctttctttgacacattctgattccagaaatccgttggtgaaagaaagaaaaaaaaacatggctaaggaaatgaggtatgttcaaacatggggagaggtatcaccaaggcttattgtatctcaccagaaacaacaacagcaattctcaaacttgccaaagcttgagaccattgttgaagaaggatgctgcgtcgatagtttttctgttagggccccgaagaggatcgtgatctttcttcctcttgtactctcaatgattttgtacatggtgttgcacaagagtatcaaagattcttgatttaaaacttgtcttttggttactttttttttgggtttatgagaacttttaaatgtgtgatggtgagatgaagagaatgttctcagataagtaagagagagattggaaatttctatagtgaatttaggtcgagagaga

SEQ ID NO: 1502 - DNA, 1464 bp, Brassica napus
gtggagatcaatcaggtgaatctactctctacgcccagagagaccagaccacgcgattctcgatcgaccgtgcgagccggagccgccgccgatttgaattggaatcgcgaagggagtaattgctatgtatagttgaagtggagagaagataaatgatggaagtggaaggatccaacacttggatgaatcgttctcctcaatcatccttcgtacgatccaaagctttgtatcagttcaagcagcagaagctcccagcttgtaagccagtcttaacaccaacgtcggttataacagtgtttatgttgatgggttttgttttcattcccattggcttcgttaccctccgtgcttctcgtgatgctattgaaattgtagaccggtatgatgttgagtgcattcctgaagaatatagaaccaacaaactctcttacattacagattcatccatccttaagaactgtactcgctacttaaaggtacaaaagtttatgaaagctcctatttttatctactaccagcttgataactactatcaaaaccaccgccggtatgtaaagagtagaagtgatcaacaactgttacatggacaggagtatagccacacaagtgcctgtgaacccgaggagtcatctaatggtctccccattgtcccttgtgggttaatagcttggagtatgttcaatgatacatttacctttactcgtgaaagcgcaaaactgaaggttagccggagtaacattgcctggaagagtgaccgtgagcacaagtttggaaaggatgtctatcctttcaatttccagaacggatctttgattggtggagctaagttggatccaaaagttccactaagtgaccaagaggactttattgtgtggatgcgagcagctgctctactaagcttcaggaaactatacggaagaatcgaagaggacttagaaccagggaacgttgttgtggtgaatttgatgaacaattacaacacttatagctttagtgggcagaagaagcttattctctccacgtcaagttggttaggaggaagaaacgattttctcggcctcacatatctcgtcgttggtgcctcttccatcgtcatatccatcatcttcatgttgctccatttgaaaaatccgaggccttatggagacaattcttggaacaagaaaagcctttcgagttgagaaactgttacattctttctctaacatattccgattccaggttcatatatacattactcaagagcctgtatatgtgatcatatagatatagggagagtatagaaccattctatgagcctctgttttctctttcgacgttcggtttttgggctctaaggataattgtttgaccctttttaagtcatgtgatgggtttatttgggtactatctgtttttagagtttctaaagttagcaaatgtaacaaaagtatgttagagaatgcatcgttggcgatctgcaaa

SEQ ID NO: 1503 - DNA, 1410 bp, Brassica rapa
  misc_feature (12)..(12): n is a, c, g, or t
  misc_feature (84)..(84): n is a, c, g, or t
  misc_feature (152)..(152): n is a, c, g, or t
  misc_feature (184)..(184): n is a, c, g, or t
  misc_feature (186)..(186): n is a, c, g, or t
  misc_feature (209)..(209): n is a, c, g, or t
  misc_feature (615)..(615): n is a, c, g, or t
attttagttcanaaattcaaaagaggcgaaaacaaaaagtggagatcaatcaggtgaatctactactctctctctacgcccagngagagcagaccacgcgatcctcgatccaccgtgcgagcccgagccgccgccgatttgtaattggaatngcgaagggagtaattgctatgtatagttgaantngagagaagataaatgatggaagnggaaggatccaacacttcgatgaatcgttctcctcaatcatccttcgtacgatccaaagctttgtatcagttcaagcagcagaagctcccagcttgtaagccagtcttaacaccaacgtcggttataaccgtgtttatgttgatgggttttgttttcattcccattggcttcgttaccctccgtgcttctcgtgatgctattgaaattgtagaccggtatgatgttgagtgcattcctgaagaatatagaaccaacaaactctcttacattacagattcatccatccttaagaactgtactcgctacttaaaggtacaaaagtttatgaaagctcctatttttatctactaccagcttgataactactatcaaaaccaccgccggtatgtaaagagtagaagcgancaacaactgttacatggacaggagtatagccacacaagtgcctgtgaacccgaggagtcatctaatggtctccccattgtcccttgtgggttaatagcttggagtatgttcaatgatacatttacctttgctcgtgaaagcgcaaaactgaaggttagccggagtaacattgcctggaagagtgaccgtgagcacaagtttggaaaggatgtctatcctttcaatttccagaacggatctttgattggtggagcgaagctggatccgaaagtgccactaagtgaccaagaggactttattgtgtggatgcgagcagctgctctactaagcttcaggaaactatacggaagaatcgaagaggacttggaaccagggaacgttgttgtgttgaatttgatgaacaactacaacacttatagctttagtgggcagaagaagcttattctctccacgtcaagttggttaggaggaagaaacgattttctcggcatcacatatctcgtcgttggtgcctcttccataatcatatccatcatcttcatgttgctccatttgaaaaatccgaggccttatggagacaattcttggaacaagaaaagcctttcgagttgagaaactgttacattctttctctaacatattccgattccaggttcatatatacattactcaagagcctgtatatgtgatcatatagatgtagggagagtatagaaccattctatgagcctctgttttctctttggacgttcggttttttggctctaaggataattgttcgaccctttttaagtc

SEQ ID NO: 1504 - DNA, 1466 bp, Raphanus sativus
  misc_feature (57)..(57): n is a, c, g, or t
  misc_feature (59)..(59): n is a, c, g, or t
agtttacaaaaaaaaatcaaaagacgcgaaaaaaagaaagtggagatcaggtgaatnantctctctctacgcgtattgaacgccgacgcggattctctatcgacctttcgatccaccgtactgagccgccgccgccgatttgtatttcaaatcgcggaagggagtataattgatatgtattagttgaagtggagaggagagaagataaaaatgatggaagtggatggatccaacacttcgatgaatcgtgctcctcctcctcctcctcctcaatcatccttcttacgttccagccgatccaaagtattgtatcagtttaagcagcagaaactaccagcttgtaagccagtcttaactccaacctcggttataacagtgtttatgttgatgggttttgttttcattcccattggctttgttactctccgtgcttctcgtcatgctattgaaattgttgaccggtatgatgttgagtgtattcctgaagaatatagaaccaacaaactctcttacattacagactcatccatctctaagaactgtactcgttacttaaaggtacaaaagcatatgaaagctcccatttttatctactaccagcttgataactactatcagaaccaccgccggtatgtaaagagtagaagtgatcagcaactgttacacggacgtgagtatagccacacgagtgcttgtgaacccgaggagtcatctaatgatggtctccccattgtcccctgcgggttaatcgcttggagtatgttcaatgatacgtttacctttgctcagctgaaggtgagccggaacaacattgcctggaagagtgaccgtgagcacaagtttggaaaggatgtttatcctttcaatttccagaacggttctttggttggtggagctaagttggatcctaaagttcctctaagtgaccaagaggactttattgtgtggatgcgagcagctgctctactaagcttcaggaaactatacggaagaatcgaagaggacttggaaccagggagcgttgttgtggtgaatttgttcaacaactacaacacttatagctttagtgggcagaagaagcttattctctccacgtcaagttggttaggaggaagaaacgacttcctcggcatcacatatatcgtcgttggtgcctcttccatagtcatatccatcatcttcatattgctccatttaaaaaatccgaggccttatggagacaattcttggaacaagaaaagcctttcgagttaagaaactgttgttaccattctttctctaacatattccgattccaggttcatatatacattactcaagagcctgtatatgtgattcatatagatatagtgagagtatagaccattctatgaagcctgtagttgtagaaaaaaaaactgataaggttcctctgttttctctatgacaattcggttttttgggttctaaagataaagtgtttgagc

SEQ ID NO: 1505 - DNA, 2344 bp, Arabidopsis lyrata
ctgcttcttcttcttcttcttcggtagaggaagattctctcgcgagagattgctcaacatctctcgacatgggcttatcaacgaatctccatagcctcgacctccgttcaactttcttcaccggtctccgtccttgtccatctccaatcccttccaatttcatcaaaatctcttccatttccaaccctagacgcggaatctccaccatcagagcccaagtttccactatcagcctcgagacctccgttaaagagcgtcaagacgaaatcgaatcgcttttctcgaaaccaacctccgaacaagactccgaccggagacgaaacggtaagaattccaaaaacggagcttctgggatttcttcaggtgtgaagctagagaacataaggaagagctacaaaggcgtgactgtgcttaaagatgtgacctgggaagtgaaaaggggtgagaaagtagggttagtgggagtgaacggagctgggaagacgactcagctcaggattatcactggtcaggaagagcctgattcaggtaacgtaatcaaggccaaacccaatatgaaaatagctttcttgagccaggaatttgaggtttcgatgagtaagacggtgagggaagagttcatgagtgcttttaaggaagagatggagatcactgagaagcttgagaaagttcagaaggctattgaaggatctgttgatgatttggaccttatgggaaggttattagatgaatttgatttgttgcagagacgagctcaggctgtgaatttagattccgttgatgctaagattagtaagctgatgccggaattagggtttgcctcagaggatgctgataggcttgtggcttcctttagtggtggatggcaaatgagaatgtcacttggaaagattttgcttcaggatccagatttgctgctacttgatgagccgaccaaccatttggatcttgatactattgagtggcttgaaggttatttgcagaagcaagatgtgcctatggttataatttcacatgacagagccttccttgatcagttatgtactaaaattgtggaaactgagatgggtgtgtcgaggacatttgagggtaattattctcagtatgtgatctcaaaggcagagtggatcgaaactcagaatgcagcttgggaaaagcaacagaaagagatcgattcaactaaggacttgatcgccaggcttggtgctggtgccaattctggtcgtgcttctactgcagaaaagaaactagagaagcttcaagaacaggagctaatagaaaaaccatttcagcggaaacagatgaagattaggtttccagagcgtggaacaagtggaagatcggtagtcaatgttaaaaacattgattttggtttcgaggataagatgctatttaagaaggctaatctagcaatagaaagaggagagaaaatcgccattattggcccgaatgggtgtgggaaaagtacgttattgaagctaattatgggtttagagaagcctatgaaaggtgaagttattcttggagagcacaatgttctgccaaactactttgagcagaatcaggccgaggtccttgatttggataaaacagtgcttgaaacagtttgtgaagctgcagaagactggagaagtgatgatataaaaggtcttcttggacgctgcaacttcaaagcagacatgcttgatcgaaaggtctctcttttaagcggtggtgagaaagcgcgtcttgctttctgcaaattcatggtgacgccatcaactttactcgttctggacgaaccaactaatcacttagacattccttcaaaagaaatgctcgaggaagccataaacgagtaccaaggtacagtcatcgcggtctcccacgatcgatactttatcaaacaaatcgttaacagagtgatagaagtagaagatggttgtttagaagattatgcaggcgactacaattattacttggagaagaatctggatgctagagcaaaggagctagagagagaagcagagctagaagagaaagcaccaaaagtgaaggcaaagtcaaagatgtcgaaagctgagaaagaagcgaggaagaagcagaagatgcaagcgtttcaacaagctaaacagaaatcaaaggctagcaagaactccaagagatggaactgaacaaacactgataactgaaaggagtcaagatttataaaaaatgtggaatgtatatagatatacttttagaaatgcagagagagtattaatgtttccacaacgcttgagccccattgggttacattaagaaactttattgtctcaaaaatggatgaatcgaatcgaaccattgaatttcagtgcaaaaccta

SEQ ID NO: 1506 - DNA, 2388 bp, Eutrema halophilum
aagcactctcgagagagactttcttcctctgcttcttctccagtagagcgagattctctcgcgagagactgctattcttctgataaatccacacccgattattcaaatcgctacaaggttccgtttttaaatcatgggtttatcgacgaatctccatagcctcgacctccgatctactttcttcaccggtctccgtccttgcccatccccagtcacatctaatttcatcaaaatctcttccatttccaaccctagacgcgaaatccccaccatcagagcccaagtctccacaatcagcctcgagacctcggtgaaagagcgccaagacgacatcgaatcgcttttctccaagcaaaccaccgagcaagactccgaccggaagcgaaacgggaagaattcgaaaaacggagcttctgggatttcttcaggtgtgaagctagagaacataaggaagagctacaaaggcgtgacggtgctcaaggatgtgagctgggaggtgaaaagaggggaaaaagtcgggttagtgggcgtgaacggagctgggaagacgactcagctcaggataatcactgggcaagaagaaccagattcaggtaacgttatcaaggccaaacccaatatgaaaatcgccttcttgagccaggagttcgaggtttcgatgagcaggacggtgaaagaagagttcatgagcgctttcaaggaagagatggagataactgagaagctggagaaagtgcagaaggcgatcgaaggatctgtcgatgatttggaccttatgggaaggttattagacgagtttgatttgttacagagacgagctcaggccgtgaatttagacaccgtcgatgctaaggtcagtaagctgatgccggagttagggtttgctccagaggatgcagataggcttgtggcttcgtttagcggtggatggcaaatgagaatgtcacttggaaagattttgcttcaggatccagatttgctgctacttgatgagcctacaaaccacttggatcttgatactattgagtggcttgaaggttatttgcaaaagcaagaggtgcctatggttataatctcacatgacagagcttttcttgatcagttgtgtactaaaattgtggaaaccgagatgggtgtgtcgaggacattcgagggtaactactctcagtatgtgatctcaaaggcagagtggatcgaaactcagcatgcagcttgggaaaaacaacagaaagagattgaatcaacaaggggcttgatcgctaggcttggtgccggtgcaaattctggtcgtgcttctactgcagaaaagaaactggagaggatccaagaacaggagcaaatagagaagccatttcagcggaagcaaatgaaaattaggtttccggagcgtggaacaagtggaagatcggtagtcgcggttaaaaacattgattttggtttcgaggataagatgctatttaagaaggctaatctagcaattgaaagaggagagaaaatcgccattatcggcccgaacgggtgcgggaaaagtactttattgaagctaattatgggtttagaaaagcctacgaaaggtgaagttattcttggagagcacaatgtactgccaaactactttgaacagaatcaggccgaggttcttgatttggataaaacagtgcttgaaacagtttgtgaagctgcagaagactggagaagtgatgatataaaaggccttcttggacgttgcaacttcaaagctgacatgcttgatcgaaaggtctctcttttaagcggtggtgagaaagcacgccttgctttctgcaagtttatggttacgccatctactcttctcgttttggatgaaccaaccaatcatttagatattccttcaaaagaaatgctcgaggaagcgataaacgagtaccaaggtacagtcatcgcagtctcccacgatagatacttcatcaaacaaatcgttaacagagtcatagaagtcgaagatggttgtttagaagattacgcaggcgactacaattattacttggagaagaatctggacgctagagcaaaggagctagagagagaagcagagcttgaagagaaagctccaaaagtgaaggcaaagtcaaagatgtcaaaagctgagaaagaagcaaggaagaagcagaagatgcaagcgttccaacaggctaaacagaaatcaaaggccagcaagaattccaagagatggaattgaaaaaacgaaaactgaaaggagtcagatttataaagtcttcttacagtcagtcacaagatcttttactgtggaatgtatatagatacttttagaaaatgcagagtattaatgtttctaaacacttgagccccattgggtaaattaagaaactttattgtctcaaaaattgg

SEQ ID NO: 1507 - DNA, 2397 bp, Eutrema parvulum
gccctctcgacctcgagagagtttcttcctctgcttcttcttcttcgtcttcctcagcagggcgagattgctctttctttttctgagaaatatccactctttctatctatatcgctacacattccgtccaacaaaaaacaaaatcatgggcttttcaacgaatctccatagtctcgacctccgttccactttcttcaccggtctccgtccttgcccatctccagtcacatctaatttcatcaaaatctcttccatttctagccctagacgcgaaatccctaccatcagagcccaagtttccacaatcagcctcgagacctcggttaaagagcgacaagacgacatcgaatcgcttttctcgaagcagaccacgcaacaagattctgatcggaaacgaaacgggaagaactcgaaaaacggagcttctgggatttcgtcaggtgtgaagctagaaaacataatgaagagctacaaaggcgtgacggtgctcaaggatgtgagctgggaagtgaaaagaggggagaaagtaggattagtgggagtgaacggagcggggaagacgacccagctcaggataatcacgggtcaagaagaacccgattcaggcaacgtaatcaaggccaaatccgatatgaaaatcgccttcttgagccaggaattcgaggtttcgatgagcaggacggtgaaggaagagttcctgagcgctttcaaggaagagatggagataaccgagaagctggagaaagtgcagaaggcgattgaaggatctgtcgatgatttggaccttatgggaaggttattagacgagtttgatttgttacagaggcgagctcaagccgtgaatttagataccgtcgatgctaaggttagtaagctgatgccggaattagggtttgctccagaggatgcagataggcttgtggcttcgtttagtggtggatggcaaatgagaatgtcacttggaaagatcttacttcaggatccagatttgctgctacttgatgagcctacaaaccatttggatcttgatactattgagtggcttgaaggttatttgcaaaagcaagaggtgcccatggttataatttcacatgacagggcttttcttgatcagttgtgtaccaaaattgtggaaactgagatgggtgtttcaaggacattcgagggtaactactctcagtatgtgatctctaaggcagagtggatcgaagctcagaatgcagcttgggaaaagcaacagaaagagattgaatcaacaaaggacttaatcgctaggcttggtgcgggtgcaaattctggccgtgcttctactgcagaaaagaaacttgaaaagctgcaagaacaggagctaatagagaagccatttcagcgaaagcagatgaaaatcaggtttccagagcgtggaacaagtggaagatcagtagtcgcggtgaaaaacattgattttggtttcgaggataagatgctatttaagaaggctaatctagcaatagaaagaggagagaaaatagctattattggcccgaacgggtgtgggaaaagtacgttattgaagctaattatgggtttagagaaacctacgaaaggtgaagttattcttggagagcacaatgtactgccaaactactttgaacagaatcaggccgaggttcttgatttggataaaacagtgcttgaaacagtttgtgaagctgcagaagactggagaagtgatgatataaaaggtcttcttggaaaatgcaacttcaaagctgacatgcttgatcgaaaggtctcacttttgagcggtggtgagaaagcacgccttgctttctgcaaattcatggtgacgccatcaactctactcgtgttggacgaaccaaccaatcacttagacattccgtcaaaagagatgctcgaggaagcgataaacgagtaccaaggtacagtcattgcagtctcacacgatcgatacttcatcaaacaaatcgttaacagagtcatagaagtcgaggatggttgtttggaagattacgcaggcggctacaattattacttggagaagaacctcgaagctagagcgaaggagctagagagagaagcagagcttgaagagaaagctccaaaagtgaaggccaaatcaaagatgtcgaaagctgagaaagaagcaaggaagaagcagaagatgcaagcgtttcaacaggctaaacagaaatcaaaggccagcaagaattcgaagagatggaactgaatactgaaaggagtcggagatttataagaaaagtcttctttcagttgcaagatctttattgtggattgtatatagatatacttttagaaatggagagaatatcaaagtttctttaacatttgatccccattgggtaaattaagaaactttactgtttcagaaatgga

SEQ ID NO: 1508 - DNA, 2394 bp, Brassica napus
cacgcgtccgcgcccagagagtttcttcctctgctccatctcgattcagtagagcaagattctctccggagactttcaatcatgggtttatccacgaacctccacaccatcaacctccgctccactctcttccccggcggcctccgcccatctccaatcgcatcaaacttcatcaaagtctcctcctttcccatccctaaacaccacaccaccgccacaatcagatcatcccaactctccacaatcacccccgaaacctccctcaaagaagacatcgaatccctcttctcctccccaacgtcccaacaacactccgaccgcaaacgaaactcctcctcctcctcctccggcgtctcctccggcgtcaagctcgagaacattagcaaaacctacaaaggcctaaccgtcctcaaagacgtctcctgggaggtgaagcgcggcgagaaagtaggcttagtcggcgtcaacggcgcgggcaaaacgacgcagcttcgaatcataacgggccaagaagagcccgactcgggacacgtgataaaggcccggcccaatatgaaagtggcctttttgagccaggagttcgaggtgtcgatgagcaggacggttaaggaggagttcatgagcgccttcaaggaggagatggaggttgctgataagctcgagagagttcagaaggctattgaagggtctgttgatgatttggagctcatggggaggttgcttgatgagtttgatttgctgcagaggagggctcaggctgtgagtttggatagtgttgatgcgaagattagtaagctgatgccggagctggggtttgcggcggaggatgctgataggcttgtggcttcgtttagtggtgggtggcagatgaggatgtcgcttgggaagattctgcttcaggatcctgatttgctactactcgatgaacctacaaaccatttggatcttgacaccatcgaatggctcgaaggctatttgcaaaagcaagaggttcccatggtcatcatctcacacgacagagccttcctcgaccagctctgcaccaaaatcgtcgaaaccgagatgggtgtctccaggacattcgaaggcaactactcgcagtacgtcatctccaaagcagagtggatagaaactcagaacgcagcttgggagaagcagcagaaagagatcgaatcaactaaggacttaatcgctaggctcggtgctggtgcaaactctggccgtgcttccactgcagaaaagaaactagagaagctgcaagagcaggagcttatagagaagcctttccagaggaagcagatgaagatcaggtttcctgagcgtgggactagtggaagatctgtagtcacggttaagaacgttgattttggttttgaggataagatgctgttcaagaaggcgaatctagcgatagagagaggagagaagattgctatcattggccccaacgggtgtggcaaaagcacgttgctgaagcttataatgggtttagagaagccaaccaaaggtgaagttatacttggagagcacaatgtattaccaaactactttgaacagaaccaggctgaggttcttgatttggataagacagttcttgaaacggtttgtgaagctgcggaagactggagaagtgatgatgtaaaaggtcttttaggacggtgcaacttcaaagcagacatgcttgatcggaaagtctctcttttgagcggtggcgagaaagcgcgtcttgctttctgtaaattcatggtgacgccttcgaatgtgcttgttttggacgaaccgaccaatcacttggcattccttctaaggagatgctcgaggaagcgataaacgagtaccaaggcacagtgattgcagtctcacacgaccggtacttcatcaaacagattgttaacagagtgatagaagttgaagatggttgtttggaagattacgcaggagactacaattattacttggagaagaacctggaagctagagcaaaggcggtggagagagaagcggagctagaagagaaagcaccgaaagtgaaggcgaagtcaaagatgtcaaaagcagagaaagaagcgaggaagaagcagaagatgcaggcgtttcagcaggcgaaacagaagtcaaaggccagcaagaactccaagagatggaactgaaacactgaaaggagtctgagagagagagatattcttataagaaacagtcttctttacatgtttattttgtggattcagtttgtatagttagttatactttttcagtttaaggaacgattaagaaacttaactgtctcagattttggattagaggacacattatccggaaggaagaactctgccaaaccgaaaaaagctgaaacgattagtctttttatgtaatgtttaaactaattaaaccgtc

SEQ ID NO: 1509 - DNA, 2293 bp, Brassica rapa
cactctctctctctcgctcgcccagagagtttcttcctctgctccatctcgattcagtagagcaagattctctcccgagatccaaactttcaatcatgggtttatccacgaacctccacaccatcaacctccgctccactctcttccccggcggcctccgcccatctccaaacttcatcaaagtctcctcctttccaacccctaggcgcgaaacctccgccacaatcagatcatcccaactctccacaatcgcccccgtaaaagagcaacaaaacgacgtcgaatcactcttctccaccccaacgtcccaacaagactccgaccgcaaacgaaacaacggaaaaaactcctcctccggcgtctcctccggcgtcaagctcgagaacataagcaaaacctacaaaggcctcaccgtcctcaaagacgtctcctgggaggtgaagcgcggcgagaaagtaggcttagtcggcgtcaacggcgcgggcaaaacgacgcagcttcgaatcataacgggccaagaagagccagactcgggccacgtgatcaaggcccggcccaacatgaaagtggcctttttgagccaggagttcgaggtgtcgatgagcaggacggttaaggaggagttcatgagcgccttcaaggaggagatggaggttgctgataagctcgagagagttcagaaggctattgagggttcggttgatgatttggagctcatggggaggttgcttgatgagtttgatttgctgcagaggagggctcaggctgtgagtttggatagtgttgatgcgaagattagtaggctgatgccggagctggggtttgcggcggaggatgctgataggcttgtggcttcgtttagtggtgggtggcagatgaggatgtcgcttgggaagattctgcttcaggatcctgatttgctgctactcgatgaacctacaaaccatttggatctcgacaccatcgaatggctcgaaggctatttgcaaaagcaagaggttcccatggtcatcatctcacacgacagagccttcctcgaccagctctgcaccaaaatcgtcgaaaccgagatgggtgtctccaggacattcgaaggcaactactcgcagtacgtcatctccaaagcagagtggatagaaactcagaacgcagcttgggagaagcagcagaaagagatcgaatcaactaaggacttaatcgctaggctcggtgctggtgcaaactctggccgtgcttccactgcagaaaagaaactagagaagctgcaagagcaggagcttatagagaagcctttccagaggaagcagatgaagatcaggtttccggagcgtgggactagtgggagatctgtagtcacggttaagaacgttgattttggttttgaggataagatgctgttcaagaaggcgaatctagcgatagagagaggagagaagattgctatcattggccccaacgggtgtggcaaaagcacgttgctgaagcttataatgggtttagagaagccaaccaaaggtgaagttatacttggagagcacaatgtattaccaaactactttgaacagaaccaggctgaggttcttgatttggataagacagttcttgaaacggtttgtgaagctgcggaagactggagaagtgatgatgtaaaaggtcttctaggacggtgcaacttcaaagcagacatgcttgatcggaaagtctctcttttgagcggtggcgagaaagcgcgtcttgctttctgcaaattcatggtgacgccttcgaatgtgcttgttttggatgaaccgaccaatcacttggacattccttctaaagagatgctcgaggaagcgataaacgagtaccaaggcacagttattgcagtctcacacgaccggtacttcatcaaacagattgttaacagagtgatagaagttgaagatggttgtttggaagattacgccggagactacaattattacttggagaagaacctggaagctagagcaaaggcggtggagagagaagcggagctagaagagaaagcaccgaaagtgaaggcgaagtcaaagatgtcaaaagcagagaaagaagcgaggaagaagcagaagatgcaggcgtttcaacaggcgaaacagaagtcaaaggccagcaagaactccaagagatggaactgaaacactgaaaggagtctgagagagatatatattcttataagaaacagtcttctttacatgtttattttgtggattcagtttgtatagttagttatactttttttcagtttaaggaacgattaagaaacttaaaa

SEQ ID NO: 1510 - DNA, 2353 bp, Cleome gynandra
tcggggcagacgcttgaaactcttatcggagctggagagttcttcctctgcttactcggtggagagagaatctctcgaaagtctgcgtttttctttctcattagtccattttccggctatacaaacatgggattgacgacgaatctccatcgcctcgacctccgttccacctttttcactggactgcgtccatgcccgacaccggtaacctcgaatcttctcaaaatttcttctgtttcttaccctagacgcgaaatccctagcatcagagctcaagtatccactgtcagcattgagtcgtccgtgaaacaagaggaagacgacgttgaatcgctcttctcgaccgaacccactgaagatttcgataggaaacgtaacaacaagcaatccaacaatggggcgtcagggatttcgtcgggtgtgaagctggagaacataagcaagagttataaaggcgtgacagtgctcaaagatgtaagctgggaggtgaagaaaggggaaaaggtcggattagtcggcgttaatggcgccggtaaaacgacccaactgagaattatcacgggtcaggaagaacccgattcgggaaacgtgataaaggcgaaatccaacatgaaaatcgccttcctgagtcaggaattcgaggtttcgatgagcaaaacggtgaaggaagagtttatgagtgcgttcaaggagcaaatggagattgctgagaagttggaaaaagtgcagaaggcgatagagagatctgtggataatttagagctgatgggaagattgctggatgaatttgatttgttgcagaggcgagcacaggccgttgaccttgacactgtcgatgccaagatcagtaaactgatgccggagttagggtttgcaccggaggacgccgataggctggtggcatcatttagtggcggatggcagatgaggatgtctcttgggaaaatattgcttcaggatccggatttactgctgctggatgagccaacgaaccatcttgatcttgatactatagaatggctcgaaggttatttgaacaagcaagacgttcctatggtcataatatcccatgacagagcttttcttgatcagttgtgtacaaaaattgttgaaactgaaatgggtgtgtcaagaacattcgagggtaattattctcaatacgtaatctcaaaggcggagtggattgaagctcaatatgctgcgtgggagaagcagcagaaggaaattgaagcgacaaaggacttgatcagtaggcttggtgccggggcaaattctggtcgtgcttcaacagcagaaaagaaactggaaagactgcaagaggaagagcaaatagagaagccgttccaacggaaacagatgaaaatcagatttccagagcgtggaagaagcggaagaatggtagtcaatattaagaagctcgagtttggattcgaggataagatgctatttaacaaggcggaccttacgatagaaagaggagagaaaatcgcaattcttggaccgaatggatgtggaaaaagtacattattgaaactgattatggctttagagaagcctatgggaggtgaagtgattcttggggagcacaatgtattgccaaactactttgagcagaatcaggcagaggctcttgagttggataaaacagtgcttgaaacagttgaagaagctgcggaagattggagaagtgatgatataaagggtcttctcgggcgttgtaacttcaaagctgacatgcttgatcgaaaggtctctcttcttagtggcggtgagaaggctcgtcttgctttctgcaaattcatggtgaaaccctctactttactcgttttggatgaacccaccaatcacttagacattccctcgaaagaaatgctcgaggaggcgatcaatgagtacgaagggacggtgatcacagtctcccacgatagatacttcattaaacaaattgttaacagagtaatcgaagtcagagacagaggattacaggattatgcaggcgactacaactattacctggagaagaatttggaagcaagagagaaggaggtggagagggaagcagagttagaggagaaagctccaaaagtgaaagcaaagtcgaagatgtcaaaggcggagaaagaagcgcggaagaagcagaaaatgcaagcttttcaggccgccaaacagaaatcgaaggccagcaagaatgctaagagatggaagtgaagatgatcttcaagaggaatcttacagaatgaatcatgtagtggagaaagaagctttcatagttcatcatggatgctgtttttttttaagaaaaatgcagcttctgttgttgattgccattggtaaatatcagatcctgttttga

SEQ ID NO: 1511 - DNA, 2515 bp, Cleome spinosa
tacgcgggatagaaaatattaccaaattttggaaataataacatatattggattaatcgttcggacgctgtggtcggagctcgagagatcttcctctgcttactcggtggagaaagactctctcggtggtcgtgaatcttggcgttcgtcttcaatcccgcatttttctatctcgtctcttccattttctcgttatctaaacatgggtttaacgacgaatctccatcgcctcgacctccgttcgaccttcttcactggtctccgtccatgcccgtcgccgatacactcgaattccatgaaaatctcttcggtttctaaccctagacgcggaatctcttgcatcagagcccaagtgtccaccatcagcgttgagtcgtcggtgaaacaagaggaatacgacgtcgaatcgctcttctcgaccggaaccaccgatgatttcgatcggaatcgcaacaacaggcaatccaacagtggggcgtctggggtttcgtcgggtgtgaagctggagaacataagcaagagctataaaggcgtgacggtgctcaaggacgtgagctgggaggtgaagaaaggggagaaggtcggactggtcggcgtgaatggcgccggcaagacgacccaactgagaattatcacaggtcaggaagaacccgactcgggaaacgtgataaaggcgaagcccaacattaaaatcgccttcttgagtcaggaattcgaggtttccatgagcaagacggtgaaggaagagttcatgagcgcgttcaaggagcagatggagattgctgagaagttggagaaagtgcaaaaggcgatagaaaaatccgtggatgatttggagctgatgggaagattgctggatgaatttgatttgttgcagaggcgagcacaggccgttgatttggacgccgtcgatgcgaagatcagtaagctgatgccggagttagggtttgcgccagaggacgcagataggctcgtggcatcgtttagtggtggatggcagatgaggatgtcacttgggaagatcttacttcaggaaccggatttactgttgctggatgagcccacgaaccatctcgatcttggtactatagaatggctggaagattatttgaacaagcaagacgttcctatggtgataatatcccacgacagagctttccttgatcagctctgtactaaaatcgttgaaactgagatgggtgtgtcaaggacattcgagggcaattattctcaatacgtaatatcaaaggccgagtgggttgaagctcagaatactgcatgggagaagcagcagaaagagattgaagcaacaaaggacttgatcagcaggctgggtgccggggcaaattctggccgtgcttctactgcagaaaagaaactggagaggctgcaagaggaggaacaaatagagaagccgtttcagaggaaacagatgaaaatcaggtttccagagcgtggaagaagtggaagaatggtagtaaatatgaagaatctcgagtttggtttcgaggataagatgctatttaagaaggcaaatctttcaatagaaagaggagagaaaattgcaattcttggcccgaatggctgtggcaagagtacattactgaaactgattatgggttcggagaagcctgtgggaggtgaagttattcttggggagcacaatgtattgccaaactacttcgagcagaatcaggcagaggcccttgagctggataaaacggtgcttgaaacagttgtagaagctgcagaagactggagaattgacgatataaagggacttcttgggcgttgcaatttcaaagctgacatgctcgatagaaaggtctctcttcttagcggtggcgagaaggctcggcttgctttctgcaaattcatggtgaaaccatccactctactcgttttggatgaacccaccaatcacttagacattccctcgaaagaaatgctcgaggaggcgataaacgagtacgagggcacggtcatcgcagtctcccatgacagatacttcattaaacaaatcgttaacagagtcatagaagtcagagatggagggttacaagactatgcaggcgactacaactattatctggagaagaacatggaagcaagagcaatggagctggagagggaggcggagttagaggagaaggctccaaaagtgaaagcaaagtcgaaaatgtcaaaggccgagaaagaagcgaggaagaagcagaagatgcaggcttttcaggctgctaagcagaaatctaagtcccttaagaactccaagagatggaagtgaacttcttcttcctttcaccagaagagagaggagagcagaatgctttgtagtgaagagaagtaaatggtctatttgtatatagtcctttctcatagcaaaaatgcaggttgtgtccattgctattggtagaaatgagatactgcattccatatttggacacattatcaaaacaccaaattccactgtaaatggcttctttgagcaaagcccttcttcagagtttgttcttgc

SEQ ID NO: 1512 - DNA, 2692 bp, Raphanus sativus
  misc_feature (252)..(252): n is a, c, g, or t
  misc_feature (285)..(285): n is a, c, g, or t
  misc_feature (300)..(300): n is a, c, g, or t
  misc_feature (699)..(699): n is a, c, g, or t
  misc_feature (745)..(745): n is a, c, g, or t
  misc_feature (798)..(798): n is a, c, g, or t
  misc_feature (804)..(804): n is a, c, g, or t
  misc_feature (1176)..(1176): n is a, c, g, or t
  misc_feature (1596)..(1596): n is a, c, g, or t
  misc_feature (1714)..(1714): n is a, c, g, or t
  misc_feature (2025)..(2025): n is a, c, g, or t
  misc_feature (2060)..(2060): n is a, c, g, or t
ctcttctcaaccccaacgacccaacaagactccaatcctaaacgaaagaactcaaagaacaactcttcctcgggagtctcctccggggtgaagctagagaacataaggaaaagctacaaaggcgtgacagtcctcaaagacgtctcctgggaagtgaaacgaggcgagaaagtaggcttagccggcgtcaacggcgcaggcaaaacgacgcagctccgtatcatcacaggccaagaggagccggactcgggngacgtgatcaaggccaaacccaacatgaaagtngccttcttgagccangagttcgaggtgtcgatgagcaggacggttaaagaagagttcatgagcgctttcggggaggagatggagatcactgagaggctggagagagttcagaaggcgatcgaagggtcggttgatgatctggagctgatggggaggttgcttgatgagtttgatctgttgcagaggagagctcaggctgtgagtttggatagtgttgatgctaagattagtaagctgatgccggagctggggtttgctcccgaggatgctgataggcttgtggcttcgtttagtggtgggtggcagatgaggatgtcgcttgggaagattctgcttcaggatccagatttgctgctactcgatgaacctacaaaccatttggatcttgataccatcgagtggcttgaaggctanttgcaaaagcaagaagtgcctatggttatcatctcacacgacaganccttccttgaccagctctgcaccaaaatcgtcgaaaccgagatgggtgtttcnaggacnttcgaaggtaactactctcagtacgtgatctcaaaggcagagtggatcgaaactcagaacgcagcttgggagaagcagcagaaagagattgaatcaaccaaagacttgatcgctaggcttggtgctggtgcaaactctggccgtgcttctactgcagaaaagaaactagagaagctgcaagaacaggagctaatagagaagcctttccagaggaagcagatgaaaattaggtttccagagcgtggaacgagtggaagatctgtagtcacggttaaaaacgttgattttggttttgaggataagatgctattcaagaaggcgaatctagcaatagaaagaggagaaaagattgctattattggccccaacggntgcgggaaaagcacgttgctgaagcttataatgggattagagaagccaacgaaaggtgaagttattctaggagagcacaatgtattaccaaactactttgaacagaaccaggctgaggttcttgatttggataaaacagttcttgaaacggtttgtgaagctgcggaagactggagaagtgatgatataaaaggtcttttgggacggtgcaacttcaaagcagacatgcttgatagaaaagtctctcttttgagcggtggtgagaaagcgcgtcttgctttctgcaagttcatggtgacgccttcgaatgtgcttgttttggacgaaccgaccaatcacttggacattccttcaaaagagatgcttgaggaagcgataaacgagtaccaaggtacagtcattgcagtctcgcacgaccgntacttcatcaaacagattgttaacagagtcatagaagttgaagatggttgtttggaagattacgctggcgactacaattattatttggagaagaacctggaagctagagcaaaggcgntagagagagaagcagagctagaagagaaagcaccaaaagtgaaggcgaagtcaaagatgtcaaaagcagagaaagaagcgaggaagaagcagaagatgcaggcgtttcaacaggctaaacagaagtcaaaggccagcaagaattcaaagagatggaactgagtactgaaaggagtcttagagatttataaaaagtcttcttagagttgcaacatctttattgtggaatcagtttgtatagatatactttttcagttaaggtactattaagaaacttaactgtcttagaaattggattagaggctggtgaangtgtagttagttagctggacacatttatccagaancaagaaattaaagcaaaagacaaaaccgaatcaaattttataaatatctgagcggattgaaccggatgaatacctaaaatatcaaaaaaaaaattatatatctaaaaatactaattacatctaggttctaaataacaaaatattatttataaaccagattatcaaaaaaattgaatatgtgttatctgaaatatctatattattaaagttgaagtacaaaatcgaagtgtttggaaacatgaattgcagtttaaaaatgaggtttgtttggaaacatggataacaatattaaatgagaattgtttggaaacatggatagcggtatatttactttcttttatttacacatttagtcattgcatttataaaaaattaggtatttcctttttgtaatttttttatttacagattttaccactacatttaaaattaatttaaattaattaattataattccaaacttatctaaacaaattgatgtctccatatattgatcattattaatatgtaaaattactattaaaaaaatatttcatctattttggccaatcacataaaaatatatatattttttttttacaaaatcagttaggcataaacatccggatacccatttaggtacgagtcgtttc

SEQ ID NO: 1513 - DNA, 2221 bp, Eutrema parvulum
aactaacatttttaacaatcagaattgttcgtttaatcttttgatgtttacaatagactgatttacccaagaaatgggtttaacgacgaatctccatagcctaaaccttcgttctactttcttcaccaatccccttccttgtcctacaccattcaccctcaaactctcctctgtttctaactctagacaagaaatttccaatagcagagcccaagttccctccatcggctccaattcgtcggcgagtgagctcgaatcgctcttctcgagcgaagatcacgatcgaaagtggatcgttaagcaatcaaacgatggcgcgtctgcgatttcatcgggagtgagacttgaaaacataagcaagagctatgaaggcatgacggtgctcaaagatgtgaactgggaagtgaagaaatgtgaaaaagtagggttgatcggcgtaaacggtgcgggtaagacgacacagctcaggataatcacgggtcaagaggaacctgattcaggaaacgttgttagagccaaacccaatttgaaagttgctttcttgagtcaggaattcgaggtttcgatgagtaagactgtgaaggaagagttcatgagtgtgtttacggaagagatggaaattgcgaggaaactcgagaagttgcaaaaggcgatagaaggaactgttgatgatttagacttaatgggaaggttactcgacgaattcgattcgttgcagagacgagctcaagagcttgatttggattctgtcgatgcgaaaatcagcaagctgatgccggaattggggtttgcgtcgaaggacggagataggcttgtggcttcgtttagcagtggatggcaaatgagaatgtcacttgggaagattttgcttcagaacccagatttgctgcttttggatgagccaacgaatcatttggatcttgataccattgagtggcttgaaagttacttgaataagaaagatgtgccaatggttataatatcacacgacagagcatttcttgatcagttatgttccaaaattgtggaaaccgaaatgggcgtatcgaggactttcgagggtaactactctcagtatgtaatttcaaaggcagagtgggttgaagcacagtatgctgcttgggagaagcaacagaaagagattgaagcaacaaagaacttgatcagtaggctaagtgctggagcaaattctggtcgagcttcatcagcagaaaagaagctggagaagctacaacaagaagagcaaatagagaagccatttcagcggaaacaaatgaagattacgtttccagaatgtggagtaagcggaagatctgtaatcactgttaagaatcttgaatttggttttggagataagatgctatttaataaggcaaatttagcaatagaaagaggagagaaaattgctattattggtccgaacgggtgtggtaaaagtacattattgaaactgattatgggtttggagaagcctatgagaggcgaagtgattctcggggagcacaatatattgccaaactacttcgagcagaaccaggcagaggctctagatttggataaaactgtgattgagactgttgttgaagctgctgtagattggagaattgatgatataaaaggtcttcttggtcgctgcaacttcaaagctgacatgttggataggaaggtctctcttttgagtggtggcgagaaggcacgccttgctttctgcaaattcatggtgaaaccatccactctactcgtgttggacgaacccaccaatcacttggacataccttcaaaagaaatgcttgaggaggcgataaacgaatacaaaggtacagtcatcgcagtctctcacgatcgatacttcattaaacagatcgtcaacagagttattgaagtcagagacggttgtttaaaggactatgcaggagactacaattattacctggagaggaatatggaagctagagcaaaggagctggagagagaagcagaattggaggaaaaagctccaaaggtgaaagcaaagtcaaagatgtcaaaggctgagaaagaagcacgaaagaagcaaaagatgagggcgtttcaagcttccaaacaaaagtcaaagtccagcaaaaacgccaagagatggaattaaagcttcacacatagctttaggtggttagtgttatcctctactcgattcagtgaaaagataatatggtctatttcactgaaatcattgacttgacct

SEQ ID NO: 1514 - DNA, 2674 bp, Theobroma cacao
gatttccatttcctttttggatggactacaaacaactagaaaaggtccctccttcaccagtctctctctctgccctgggctgagagtttctcttctattctctctcactgagaagctctccattgcctgctttcagaaatcctccatctctttttcctttcattttcccacactttccttcactttcccactacccagacatgggcctctccacaaaactccaccgtatagaccttcgttccacattcttcacctctcttcgcccctctttcaccccgaattcctcctctctaatctcccccaagacccttaaatttagacccactaaaataactgcccaggtttccactctcagcgttgaaacctccgttaaagaccctcaaaacgacatcgagtcattgttttccaccaacacagtcgaagaagttgatcgaaaacgcgccaacaagcggtccaacaccggctcttcgggtatttcctccggtgtaaagctcgaaaacataagcaagagctataaaggagtaacggttttgaaaaatgtgagttgggaagtgaaaaaaggcgagaaagttggattggttggagtaaacggagcagggaaaacgactcagatgagaattataacggggctagaagaacctgattcggggaatgttataaaggcgaaaccaaacatgaaagttgcgtttttgaaccaagaatttgaggtttcgatgagtaggacggtgagggaggagtttatgagtgcttttaaagaggaaatggagattgcagacaggttagagagggttcaaaaggcgattgaaggggctaccgaggatttggagttgatgggaaggcttttggatgagtttgatttgttgcagaggagagctcaggctgtggatttggatgaggttgatgctaaggttagtaagttgatgccagagctcgggttttcccctgaggattcggataggttggtcgcgagttttagtagcgggtggcagatgaggatgtcacttgggaagattttattgcaggagcctgatttgttgcttttggatgagcctacaaatcaccttgaccttgatacaattgagtggcttgaaggatatctcgacaagcaagaagtgccgatggtcattatatctcatgatagagcttttctagatcagttgtgtacaaagatagtggagactgatatgggcgtttccaggacgtttgagggtaattattctcagtatgttgaagcaaaggcagcatgggttgaaaaccagtgtgctgcatgggagaagcagcagaaggaaattgagcagacaaaagacttgataaacagattaggtgcaggagcaaattctggccgtgcttcttctgctgaaaagaagctggagagacttcaagaagagggtcaattagagaagccatttcagcggaaacaaatgaagataaggttccctgagcgtggaagaagcggcagatctgttattactgttaagaatctggaatttggttatgaggatgacttgctatttaacagggcgaatcttacaattgaaaggggagagaaaattgccattattggtccaaacggttgcggaaagagtactttactgaaactgataatgggtttggagaagccaagaggaggtgaagtggtacttggggaacataacgttctaccaaattattttgagcagaatcaggctgaggctcttgatttggataaaacagtgcttcagacagtggaagaagtggcagaagactggagaattgatgatattaagggactcctaggtcgttgcaacttcaaagctgatatgctcgaaagaaaggtttcccttttgagtggtggtgagaaggcacgtcttgctttttgcaaatttatggtaaaaccatcaacattactagttttggatgaaccaactaatcacctcgatataccttcgaaagaaatgctggaggaggcaatcagagagtacagcggcactgtcattactgtttcacatgaccgatactttattaggcaaattgttaacagagtagtggaagtaaaagatggacatttgcaggactacatgggtgattacaattattatctagagaaaaaccttgaggcaagggctaaggagctggagcgtgaggcagaccttgaagagaaagctcccaaagtgaaagccaaatccaagatgtcaaaggctgagaaggaagctcgaaagaaacagaaaatgcaggcctttcaagctgctaaacaaaagtcgaaagggctgaagaattccaagagatggaaatgaaatattccatctatacatgaaattgattaagaatgaccaattgttaaaccaattttacagtgtaaagtgcctaggatgtggatgaccaccagcaccatctgtatataatgttgatagaaatacagttctaaattgaagctcttacacgagttatggtagagttgagttcttcttatttcctggccatagcaattcatacttccttaaaaatgtaatgcagggtgaaattgaactgagaagtgaaaactgaatccggcagcctctctttgatgcgtaaaaagaaaataaagaaaaaatccatggccatgcatgccgcaaacaaatactagtatttcttcatctttctctccaaaattcaagttttttatatttaatttttccaaaaaattttagttttatct

SEQ ID NO: 1515 - DNA, 1927 bp, Brassica napus
gcgtctcctccggcgtcaagctcgagaacattagcaaaacctacaaaggcctaaccgtcctcaaagacgtctcctgggaggtgaagcgcggcgagaaagtaggcttagtcggcgtcaacggcgcgggcaaaacgacgcagcttcgaatcataacgggccaagaagagcccgactcgggccacgtgatcaaggcccggcccaatatgaaagtggcctttttgagccaggagttcgaggtgtcgatgagcaggacggttaaggaggagttcatgagcgccttcaaggaggagatggaggttgctgataagctcgagagagttcagaaggctattgaagggtctgttgatgatttggagctcatggggaggttgcttgatgagtttgatttgctgcagaggagggctcaggctgtgagtttggatagtgttgatgcgaagattagtaggctgatgccggagctggggtttgcggcggaggatgctgataggcttgtggcttcgtttagtggtgggtggcagatgaggatgtcgcttgggaagattctgcttcaggatcctgatttgctactactcgatgaacctacaaaccatttggatcttgacactattgagtggcttgaaggctatttgcaaaagcaagaggttcccatggtcatcatctcacacgacagagccttcctcgaccagctctgcaccaaaatcgtcgaaaccgagatgggtgtctccaggacattcgaaggcaactactcgcagtacgtcatctccaaagcagagtggatagaaactcagaacgcagcttgggagaagcagcagaaagagatcgaatcaactaaggacttaatcgctaggctcggtgctggtgcaaactctggccgtgcttccactgcagaaaagaaactagagaagctgcaagagcaggagcttatagagaagcctttccagaggaagcagatgaagatcaggtttcctgagcgtgggactagtggaagatctgtagtcacggttaagaacgttgattttggttttgaggataagatgctgttcaagaaggcgaatctagcgatagagagaggagagaagattgctatcattggccccaacgggtgtggcaaaagcacgttgctgaagcttataatgggtttagagaagccaaccaaaggtgaagttatacttggagagcacaatgtattaccaaactactttgaacagaaccaggctgaggttcttgatttggataagacagttcttgaaacggtttgtgaagctgcggaagactggagaagtgatgatgtaaaaggtcttttaggacggtgcaacttcaaagcagacatgcttgatcggaaagtctctcttttgagcggtggcgagaaagcgcgtcttgctttctgtaaattcatggtgacgccttcgaatgtgcttgttttggacgaaccgaccaatcacttggacattccttctaaggagatgctcgaggaagcgataaacgagtaccaaggcacagtgattgcagtctcacacgaccggtacttcatcaaacagattgttaacagagtgatagaagttgaagatggttgtttggaagattacgcaggagactacaattattacttggagaagaacctggaagctagagcaaaggcggtggagagagaagcggagctagaagagaaagcaccgaaagtgaaggcgaagtcaaagatgtcaaaagcagagaaagaagcgaggaagaagcagaagatgcaggcgtttcagcaggcgaaacagaagtcaaaggccagcaagaactccaagagatggaactgaaacactgaaaggagtctgagagagagagatattcttataagaaacagtcttctttacatgtttattttgtggattcagtttgtatagttagttatactttttcagtttaaggaacgattaagaaa

SEQ ID NO: 1516 - DNA, 2483 bp, Gossypium hirsutum
ttccattgtttcacctctaatttgtgggctgagaatttggttttcttccacaaattttctcagtggagcttcccatttcccttcatttagatatttatcattcttcctttcctttccttcattttcccaccaatcaaacatggacctatccacgaaattccatcgcttagaccttcgttcaacattcttcacctctatgcgaccctctttaacccggaattcctcatcgttcgtttctccccaaacccttaaatttagacccactaaagtaaatgcccaagtttccactctcagtgttgaaacctccgttaaagaacctcaaaacgacattgagtcattgttttcaaccaacacagtcgaagagattgatcgaaagcgtggcgacaaacaatccaacaccggcgcttctggtatttcctccggtgtaaagctcgaaaacattagcaaaagctataaaggagtgacggttttgaaaaacgtgaattgggaagtgaaaaaaggcgagaaagttggattggttggagtaaacggggcagggaaaaccacccaaatgagaattataacggggcaagaagaacccgattcggggaacgttataaaagccaagcccaatatgaaagttgcgtttttgaaccaagaattccaagtttcaatgagtaggacggtgagggaggagtttatgagtgcctttaaagaggaaatggagatttctgagaggttagagagggttcaaaaggcgatagaaggatctacagaggatttggagttgatgggaaggcttttggatgagtttgatttgttgcaaaggagagctcaggctgtggatttggatgaggttgatgctaaggttagcaagttaatgccagagctagggttttcccctgaggattcagataggttggttgccagttttagtagcgggtggcagatgaggatgtcacttggaaagattttgctgcaggagcctgatttattgcttttggatgagcctacaaatcaccttgaccttgatacaattgagtggcttgaaggatatctgaaaaagcaagatgtgccaatggtcattatatctcatgatagagcttttctagatcagttgtgtacgaagattgtggagaccgatatgggtgtttccaggacgtttgagggtaattattctcagtatgttgaagcgaaggcagcatggattgaaactcagtatgctgcgtgggagaagcagcagaaggagattgagcagacaagagacttgataagccgattaggtgctggggcaaattctggccgagcttcttctgccgaaaagaagctggagaggcttcaggaagagggtcaaatagagaagccatttcaacgaaaacaaatgaagatcaggttccctgagcgtggaagaagtggtagatctgttgttactattaagaatctggaattcggttacgaggatgagctgctatttaacagggcaaatcttgcaattgaaagaggagagaaaattgccattattggtccaaatggttgtggaaagagtactttactgagactgataatgcgtttagagaaaccgagaggcggtgaagtgatccttggggagcataatgttctaccaaattattttgagcagaatcaggccgaggctcttgatttggataaaacggtgcttcagacagtggaagaggttgcagaggactggagaattgatgatattaagggactccttggtcgttgcaacttcaaagccgatatgcttgacaggaaggtttcccttttgagtggtggtgagaaggcgcgtcttgctttctgcaaattcatggtaaaaccatcaaccctactgattttggatgaaccaactaatcatctggatataccctcaaaagagatgctagaggaggcaattagggaatacagtggcactgtcattactgtttcgcatgaccgatacttcattcggcagatagtcaacagagtagtggaagtaaaagatggccatttgcaggactatgcaggcgactacaattattatctggagaagaacctcgaggcaagggtaaaggagcttgagcgtgaggcggatcttgaagagaaagctcccagactgaaagccaaatcaaagatgtcaaaggcggagaaggaagctcgaaagaaacaaaagatgcaggcttttcaagctgctaaacaaaagtcaaaagggctgaagaattccaagagatggaaatgaagtattaaatctatataccacacatagattaaagaatgaactgttagttgagagtaggaattgagtgaccaccagcaccatctgtatataatatttgatagaaataaagtcctgaaagttgaagctctttgtaatccttatttagaagcgaaattcattcattaaggtggcaagtaaaggatgtgatccacattcatgcctaaatctaatgttaaaaactcaaaaactggctttcttaaattcttgatgcttgaaaggggaaaaagaaaaa

SEQ ID NO: 1517 - DNA, 2091 bp, Eutrema halophilum
tttactcaaaatgagcttaacgacgaatctccatagcctaaaccttggttctaccttcttcactagtccccttccttgcccaacaccaccatttaccctaaaactgtcctctgtttctaaccttagacgagaaatccccaatatcagagcccaagtgccttccttgagctccaattcctcggtgaatgagctcgaatcactcttctcgtccgaagatcacaatcggaagctgaacggtaagcaatcaaacaacggtgcgtctgcgatttcgtcgggagtgaggcttgaaaacataagcaagagctaccaaggcgtgacggtgctcaaggatgtgaactgggaagtgaagaaaggtgagaaagtagggctaatcggcgtcaacggtgcgggcaagacgacacagctgaggataatcacgggtcaagaggaacccgattcgggcaacgtgattagagccaaacccaatttgaaaaccgcattcttgagtcaggaattcgaggtttcgatgagcaagaccgtgaaggaagagttcatgagtgtgcttaaggaagagatggagatagcgaggaagctggataatttgcaggaggcgatacaaggagctgttgatgatttagaactaatgggaaggctactcgacgaattcgattcgttgcagagacgagctcaagaggctgatttggattctgtcgatgcgaagatcagtaagctgatgtcggaattagggtttgtgtcggaggatgcagataggcttgtggcttcttttagcagtggatggcaaatgagaatgtcacttgggaagattttgcttcagaatccggatttactgcttttggatgagccaacgaatcatttggatcttgatactattgagtggcttgaaggttacttgaataaacaagaagtgccaatggttataatatcccatgacagagcatttcttgatcagctatgtaccaaaatcgttgaaactgaaatgggcgtgtcgaggactttcgagggtaattactctcagtatgtaatttcaaaggcagagtggttcgaagctcagtatactgcctgggagaagcaacagaaagagattgaagcaacaaaggatttgatcagtagactaagttctggaggaaactccggtcgggcttcttcagcagaaaagaaacttgagaggctccaagaagaggaacaaatagagaagccgtttcagcggaaacaaatgaaaattaggtttccagaatgtggattaagcggaagatctgtagtcactgtcaagaatcttgaatttggttttgaggataagaagctatttaacaaggcaaatctagcgatagaaagaggagagaaaatcgttattattggtccaaacgggtgcggtaaaagtacattactgaaactgattatgggtttggagaagcctatgagaggtgaagtgattctcggggagcacaatgtattgccaaactacttcgagcagaatcaggcagaggctttagatttggataaaactgtgattgagacggttgttgaagctgctgtagattggagaatcgatgatataaaaggtcttcttggtcgctgcaacttcaaagctgacatgttggatagaaaggtctctcttttgagtggtggcgagaaggcacgccttgctttctgcaaattcatggtgaaaccatccactctactcgtgttagacgaacccaccaatcacttagatataccttcaaaagaaatgcttgaggaagcaataaacgagtacaaaggcacggtcatcgcagtctcacacgatcgatacttcattaaacaaatagttaatagagttattgaagtcagagatggtggtttaaaggactatgcaggagactacaattattacctggagaagaatgtggaagctagagaaagggagctacagagagaagcagagttggaggaaaaagctccaaaagcgaaagcaaagtcaaagatgtcaaaggctgagagagaagcacggaagaagcaaaagatgagagcgtttcaagcttccaaaaagaagtcaaaatccagcaaaaatgccaagagatggaactaaagccgcgcacataggtttaagtgtat

SEQ ID NO: 1518 - DNA, 2037 bp, Arabidopsis thaliana
atggtattaacgacgaatctctatagcttaaaccttcgttcgaccttcttcttcactaatactattacttgccctacacttttcaccttcaaactctcctctgtttctaaccctagacgagtattccccaatattagagctcacgtttccgcagccagctccaattcagagctcgaatctctcttatctaccgatcggaagctgatcagtaagcaatcaaacaatggtgcgtcttcgatttcgtcgggagtgagacttgagaacattagtaagagctatgaaggcattacggtgctaaaggatgtgacttgggaagtgaagaaaggagaaaaagtagggttaatcggcgtcaacggtgcagggaagacgacacagctcaggatcataacgggtcaagaagaacctgattcaggaaacgtgatttgggccaaacccaatttgaaagttgctttcttgagtcaagagttcgaggtttcaatggggaagacagtgaaggaagagttcatgtgtacgtttaaggaagagatggaaatagcgaggaagcttgagaacttgcagaaggcgattgaagaagctgttgatgatttagaactaatgggaaagttactagacgaattcgatttgttgcagagacgagctcaagaggttgatttggattctatccatgctaaaatcagtaagctgatgtcggaattagggtttgtgtcggaggatgctgataggcttgtggcttcttttagcagtggatggcaaatgagaatgtcacttgggaagattttgcttcagaatccagatttactgcttttggatgagccaacgaatcatttggatcttgatactattgagtggcttgaaggttacttgattaagcaagatgtgcctatggtcataatatcacatgacagggcgtttcttgatcagttgtgtactaaaattgtggaaaccgaaatgggagtttcgaggactttcgatggtaattactctcagtatgtaatttcaaaggcagagttggttgaagctcagtatgctgcttgggagaagcaacagaaagagattgaagcaacaaaggatttgattagtaggctaagtgctggagcaaattctggtcgagcttcttcagcagaaaagaaactggagaagcttcaggaagaggagctaatagagaagccatttcagcggaaacaaatgaaaatccggtttccggaatgtggattaagtggaagatctgtagtcactgttaagaatcttgtatttggttttgatgataagatgttatttaacaaggcgaatctagctatagaaagaggagagaaagtcgctataattggtccaaacgggtgcggaaagagtacattgctgaaacttattatgggtttggagaagcctatgagaggtgaggtgatacttggggagcacaatgtattgccaaactacttcgagcagaatcaggcagaggctcaagatttggataaaacggtgattgagacagttgttgaagctgctgtagattggagaattgatgatataaaagctcttcttggtcggtgcaacttcaaagctgacatgttggatagaaaggtctctcttttgagtggtggtgagaaggcacgccttgctttctgcaaattcatggtgaaaccatccactctacttgtgttggacgaacccaccaatcacttagacataccttcaaaagaaatgcttgaggaagctataaatgagtacaaaggcacggtcatcacagtctcacacgatagatacttcattaaacagattgttaacagagttattgaagtcagagatggtggtttaatggactatgcaggagactacaattatttcctggagaagaatgttgaagctagagcaagggagctggagagggaagcagaattggaagaaaaagctccaaaagtgaaagcaaagtcaaagatgtcaaaggctgagagagaagcacggaagaagcaaaagatgaaagcgtttcaagcttccaaaaagaagtcaaagtccagcaaaaatgccaagagatggaattaa

SEQ ID NO: 1519 - DNA, 2039 bp, Arabidopsis lyrata
atgggattaacgacgaatctccatagcttaaaccttcgttctgccttcttcttcactaatcctcttccttgccatacactattcaccttcaaactctcctctgtttctaaccctagacgagaattccccaatattatagcccaagcttccgcaaccagctccaattcagagctcgattctctcttctctacggatcggaagctgatcggtaagcaatcaaacaatggtgcgtcttcgatttcgtctggagtgagacttgagaacattagtaagagctatgaaggcgttacagtgctaaaggatgtgacttgggaagtgaagaaaggagaaaaagtaggtttaatcggcgtcaacggtgcggggaagacgacgcagctcaggatcataacgggtcaagaagaacctgattcaggaaacgtgatttgggccaaacccaatttgaaagttgctttcttgagtcaagaattcgaggtttcgatggggaagacagtgaaggaagagttcatgagtgcgtttaaggaagagatggaagtagccaggaagcttgagaggttgcagaaggcgattgaagaagctgttgatgatttagaattaatgggaaagttactagacgaattcgatttgttgcagagacgagctcaagaggttgatttggattctatcgatgctaagatcagtaagctgatgtcggaattagggtttgtgtcggaggatgcagataggcttgtggcttcttttagtagtggatggcaaatgagaatgtcacttggaaagattttgctgcagaatccagatttactgctattggatgagccaacgaatcatttggatcttgatactattgagtggcttgaaggttacttgaataagcaagatgtgcctatggttataatatcacatgacagagcgtttcttgatcagttgtgtactaaaattgtggaaaccgaaatgggagtttcgaggactttcgagggtaattactctcagtatgtaatttcaaaggcagagtgggttgaagctcagtatgcttcttgggagaagcaacagaaagagattgaagcaacaaaggatttgattagtagacttagtggtggagcaaattctggtcgagcttcttcagcagaaaagaaactggagaagctccaagaagaggagcaaatagagaagccatttcagcggaaacaaatgaaaatcaggtttctggaatgtggattaagcggaagatctgtagtcactgttaagaatcttggatttggttttgaggataagatattattcaacaaggcaaatctagcgatagaaagaggagagaaagtcgctataattggtccaaacgggtgcggtaaaagtacattgttaaaactgattatgggtttggagaagcctatgagaggtgaagtgattcttggggagcacaatgtattgccaaactacttcgagcagaatcaggcagaggctctagatttggataagactgtgattgagacagttgttgaagctgctgtagattggagaattgatgatattaaagctcttcttggtcgctgcaacttcaaagctgacatgttggatagaagggtctctcttttgagtggtggtgagaaggcacgccttgcattctgcaaattcatggtgaaaccatccactctacttgtgttggacgaacccaccaatcacttagacataccttcaaaagaaatgcttgaggaagcgattaatgagtacaaaggcacggtcatcacagtctcacacgacagatacttcattaaacagattgttaacagagtaattgaagtcagagatggtggtttaatggactatgcaggagactacaattattacttagagaagaatgtggaagctagagcaagggagctggagaaggaagcagaattggaggaaaaaggtccaaaagtgaaagcaaagtcaaagatgtcaaaggctgaaagagaagcacggaagaagcaaaagatgaaagcatttcaagcttccaaaaagaagtctaagtccagcaaaaatgccaagagatggaattaaag

SEQ ID NO: 1520 - DNA, 2395 bp, Populus trichocarpa
agcctctccaacacacaacagtatctctttcttcatgggctgagtgtttctctcccctcccctccacagattctcactgccctgagaaacactctcccgcccgaacccatcattatttcccctccctgttctcactaaccagtcatggacttgtccaccaaactccactctaccttcttcaccggctcaacctttttcaatcctcgacaaaaatccactctttttaaaccgaacccatctctcttatccactaaatacaacactaatcccttcaaattccctaccagaagatcgaattataaaaccaaagcacgcttatcaactgccacggtggaaacatctggtgctgactccaaaactgacattgaatcattgttttcgagcaattcggatgttgagttcgacaggaaacgctcaaacaagcagtcaaacggtggggcttcagggatatcttcaggtattaagctagaaaacataagcaagagttataaaggagttactgttttgaaagacgtgacttgggaggtgaaaaaaggtgagaaagttggattagttggtgtaaatggagcggggaaaacgacccagttgagaattataactggacaagaggagcccgattcagggaatgtgattaaagccaaagcgaatatgaagattgcgtttttaagtcaagagttcgaggtttctatgagtaggaccgtgaaggaggagtttatgagtgcttttaaagaggaaatggagattgctgagaggctggaaaaggtgcaaaaggctatagagggagctgtggaggatttggacttaatggggaggttattggatgagtttgatttgttgcagagaagagcacaagctgtggacttggatgaagttgatgcaaagattagtaagttgatgcctgagctcgggttttcgcctgaggactcagataggttggtggcttcttttagtggtgggtggcagatgaggatgtcgcttgggaagattttgcttcaggacccagatttgttgcttttggatgaacccacaaaccaccttgaccttgacacgattgagtggcttgaaggctatctccagaagcaagatgtgccaatggtcatcatatctcatgacagagcctttcttgatcaattatgtacgaaaattgtggagactgatatgggcgtgtcaaggacatttgaggggaattattctcaatacatcatatcaaaagcagaatgggttgaagctcagcttgctgcttgggagaagcaacaaaaggaaattgagcacacaagagaattaataagtaggttaggtgcaggagcaaactctggccgtgcttcttctgctgagaagaaactggagagacttcaagaagaggatcaaatagagaagccatttcaacataaacagatgaagatcaggttcccagagcgcgggagaagtggaagatctgttgttgccatcaataatttggaatttggttttgaggataaggtgctttttaataagacaaatcttatgatagaaagaggcgagaaaattgctattattggtccaaatggatgtggtaagagtactttactgaaactgatcatgggcttagagaagccaacaggaggccaaattatggttggggaacataatgtactaccaaactattttgagcagaaccaggctgaggcacttgatttagataaaacagtaattcaaacagtggaagaagttgcggaggactggagacttgatgatataaagggactccttggtcgttgtaacttcaaagctgatatgcttgatagaaaagtttcacttttgagtggtggtgagaaggcacgtttagcattttgcaaattcatggtaaaaccttcaactttactagttttggacgaaccaactaatcacttggatataccttcaaaagagatgcttgaggaggccatatcagaatacagtggcacagtcattacagtttctcatgaccggtacttcataaagcaaatagttaatagagtagtggaagtcaaagacgacaagttacaggattatgcaggcgattacaattattatctagagaaaaatctggacgcaagggagaaagagcttgaacgtgaggcagagcttgaggacaaggctcccaaagtaaaggccaaatccaagatgtcaaaggctgagaaggaagctcgaaagaaacaaaaaatgaaggcctttcaagctgccaaacaaaagtcaaaagggtcgaagaatgctaagagatggaattgacagctttacactaaaagattgaacatcacacttcgttaaactaattttatcttgtaaagatcctaggaagtgaggtggcctgttttgtgccaggaactcgacctttgtatataagatcaatagaaaggcaggtcttggttcaaaattg

SEQ ID NO: 1521 - DNA, 2234 bp, Gossypium hirsutum
cgcccaaacatggtgctctgcacaaaactccaccgtttagaccttcgttcaacattcttcacctctcttcgcccctcgtttactcccaatccctcctcttcagtctcccccaaaacctttaaatttagaccaactaaaataactgcccaagtttccactctcagcgttgaaacctccgttaaggaccctgaaagcgacattgaatcactgttttcctccaatacagaagaaattgatcggaaacgttccaacaagcaatccaataccggtgcttcgggtatttcctccggtgtaaagcttgaaaacattagcaagagctataaaggagtaacggttttgaaagatgtgagttgggaagtgaaaaaaggcgagaaagttggactggttggagtaaatggagcagggaaaacgacccagatgagaattataacgggacaagaagaacccgattcggggaacgttataaaggccaaatcaaacatgaaaattgcgtttttgaaccaagaatttgaggtttcgatgagcaggacggtgagggaggagtttatgagtgcttttaaagaagaaatggatatttctgacaggttagagagggtacagaaggcgatagaaggggctaccgaggatttggagttgatgggaaggcttttggatgagtttgatttgttgcagaggagggctcaggctgtggatttggatgaggttgatgctaaggttagtaagttgatgccagagcttgggttttcccccgaggattccgataggttggtcgcaagttttagtagcggatggcagatgaggatgtcacttgggaagattttgttgcaggagcctgatttattgcttttggacgagcctacaaatcacctcgaccttgatacaatcgagtggcttgaaggatatctcaacaagcaagatgtgccaatggtcatcatatctcatgatagagcttttctagatcagttgtgtacaaagattgtggagactgacatgggtgtttcgaggacatttgagggtaattattctcagtttgttgaggcgaaggcagcatgggttgaaagtcaatatgctgcgtgggagaagcagcagcaggaaattgagcagacaaaagacctgataaacagattaggagcaggggcaaattctggccgtgcttcttctgctgaaaagaagctggagagacttcaagaagagggccaaatagagaagccatttcaacggaaacaaatgaagatcaggttccctgagcgtggaagaagtgggagatctgttgttactattaagaatctggaatttggttatgaggatgagctgctagttaacagggcaaatctttcaattgaaaggggagagaaaattgccattattggtccaaatggttgtggaaagagtactttactgaagctgataatgggcctagagaatccaagtggaggtgaagtgttgcttggggagcataatgttttaccaaattattttgagcagaatcaggctgaggctcttgatttagataaaacagtgcttcagacagtggaagaggttgcagaggactggagaattgatgatattaagggacttcttggtcgttgcaacttcaaagctgatatgcttgacagaaaggtttcccttttgagtggtggtgagaaggcacggcttgcattttgtaaattcatggtaaaaccgtcaaccctgctagttttggatgaaccaacaaatcacctggatataccctcaaaggaaatgctagaggaggcaattagagagtacagtggcacagtcattactgtttctcatgaccgattctttataaagcaaattgtgaacagagtagtggaagtgaaagatgggcatttgcaggactatgtaggcgattacaattattttctggagaagaaccttgaggcaagggaaaaggagctcgagcgtgaggcggagcttgatgagaaagctccaaaagtgaaagccaaatccaagatgtcaaaggctgagaaagaagctcagaagaaacaaaaacggcaggcgtttcaagctgcgaaacagaagtcgaaagggcagaagaatgccaagagatggaattgaaatgaaacatgaatttttagggtgtaaaatggctagaatgtggaattgagcaccttctgtatataatagtgttgatagaaatacagttccaacttccaagttgaagctcttgtataattaatttatttaaatatcaagttaataaattttctcta

SEQ ID NO: 1522 - DNA, 2425 bp, Manihot esculenta
agagcttcaacaattatctcgtcgatgggctgaggttcctctctgtgctcactttgttcacttcgcttgagagaatctcaacccctttgcgcaatttcccatttgccaaacatggatttatccaccaagttccaccgcctagacctccactcttctttcttcactagttcgcctctgtttgggacccgtaaatctcctcttaggcttccccgttttaagcatagctcaaaacccattaaaaacaatcccagttcgattaaagttgttgcttcttctgtctccagaagagggacttctaaaatcactgctcagttatccaccgccactgtcgagacatcggttgctgaacccgagacagatattgagtccttgttttcaagcaattcctctgatgaattcggcaggaaaggtgcacataagcaatcgaattcaggggcttcgggaatttcatcgggtatcaagctagaaaacataagcaagagttacaaaggagtcacagtgttgaaagacgtgacttgggaagtgaaaaaaggtgagaaagtaggacttgtaggtgtgaatggggcagggaaaacgacccagttgagaattattactggacaggaggaacctgattctgggaacgtaatcaaagcgaagcccaatatgaaaatcgcgtttttgagtcaagaattcgaggtttctttgagtaggactgttaaagaggagttcatgagtgcgtttgaagaagaaatggagatttctgggagattggagaaggtacaaaaggcgatagaggggtctgtggacgacttagagctgatggggagattattggatgagtttgatttgttgcagaggagagcacaggctgtggacttggatgaagttgatgccaagatcagtaagttgatgcccgaacttgggtttgcccctgaggattcggataggttggtggcctccttcagcagtgggtggcagatgaggatgtcgcttgggaagattttgctgcaggacccagatttattgcttttggatgaacccacaaatcaccttgaccttgacacaattgagtggctcgaaggttatctccagaagcaagatgtgcctatggtcatcatatctcatgacagagcatttcttgatcaactttgtaccaaaattgttgagactgaaatgggcgttgctaggacgtacgaggggaattattctcagttccttttgtccaaggcagcatggattgaagctcagcatgctgcctgggagaagcagcagaaagaaattgagcacaccaaggacttaataagccggttgggtgcaggagcaaattctggccgcgcttcttctgctgagaagaaattggagagacttcaagaagaggatcaagtagagaagccatttcaacgcaaacaaatgaagatcaggttcccggagcgtggaagaagtggaagaaatgttgtatccattaagaatttggaattcagttatgaggataaggtgctgtttaataggacgaatcttacaatagaaagaggtgagaaaattgccattattggcccaaatggatgtgggaagagtactttactgaagctgatcatgggcttagagaagccgaaagctggcgatattatacttggggagcataatgtactgcccaactattttgagcagaaccaggcggaggcacttgatttagacaaaacagtgattcaaactgtggaagaagttgcagaggactggagaattgatgatataaagggactgctaggccgttgtaatttcaaagctgatatgcttgatagaaaggtttcccttttgagtggtggtgagaaggcgcgactagcattttgcaaattcatggtgaaaccttcaactttgctagttctggatgaacctactaatcatttggatataccttcaaaagagatgcttgaggaggcaataacagaataccagggtacagtcatcacagtttctcatgatcgatacttcataaagcaaatagttaatcgagtaattgaagttaaagatggccagctacaagattatgcaggcgattacaattattatctggagaaaaacctggatgcaagggctagagaacttgaacgcgaggcagagcttgaggaaagggctcccaaagtgaaggccaaatcaaagatgtcaaaggctgagaaggaagctcggaagaaacaaaaaatgcaggcctttcaggctgcaaaacaaaaatctaaaggactgaagaactccaaaagatggaactgaagaggggtacacaaaattgattcaatttcatacttggttgaactaattttgccatgtaaagagggtaggaggtgatatagtccattttcaccaaggtactccaccattgtaaataatatttgatagaaatgcaggtctcatttaaaaaggtgccatatgaatattgctatgacgtttgagc

SEQ ID NO: 1523 - DNA, 2248 bp, Euphorbia peplus
atcaaaaaaacctcctcctctgaactcttaccactccaaaaaccatggagttatccgctaagttccactgtctagacctccattctcctttccttactggttcttcttccagaccatctattttcaaacctagtacaaacaatcccatctcccttcattttcgaaaaccaactcaaaaaatctctgcccgaatatctactgccaccgttgagacatccgtagccgacccagataccgatatcgagtccttgttctcttccactgatgaattcaacaagaggggcgctaaaaagcaattcaccggggcttctggtattacatcaggtatcaagcttgaaaacattactaagacttataaaggtctcactgttttaaaaaacgttacttgggaagtcaagaaaggtgaaaaagttggtcttgttggtgttaacggcgccggaaaaactacccagttgagaattattactggtcaggaagtgcctgattctggtaatgttattaaagcgaaatctaatatgaaagtttcatttttgagtcaagaatttgaggtttcgttgagtaggactgttaaggaggagtttatgagtgcttttcatgaagaaatggagattgctgggaggttggagagggttcagaaggctattgaggggtctgttgatgatttggaacttatgggtcggttgttggatgagtttgatttgttgcagagaagagcacaagctgttgacttggatatggttgattcgaagatcagtaagttgatgcctgagctcgggttttcccccgaggattctgataggttggttgcttcctttagcggtggctggcagatgagaatgtcacttggcaagattttgctgcaggatccagatttgttgcttctagatgaacctacaaatcaccttgatcttgacacaattgagtggcttgaaggatatctccagaagcaagatgtgccaatggtggtcatatcccacgacagagcctttcttgatcaactctgcacaaaaattgtggagactgaaatgggtgtggctaggacgtatgtgggaaactattctcagttcattttatctaaggcagcgtggattgaagcccagaatgctgcttttgagaaacagcaaaaggaaattgagcatacaaaggacttaataactaggttgggtgcaggagccaattctggtcgtgcttcttctgctgagaagaaactggagaaacttttggaagaggatcaaatagaaaaaccatttcaacggaaacaaatgaagatcaggtttccagagaggggaagtagtggaagaattgttgcagaggttaagaatctggaattcagttatgaggataaggtgctgtttaataagtcaaatcttacaatagaaagaggtgagaagatcgccattattggcccaaatggatgtgggaagagtactttactgaaacttatcatgggattacagaagccaagtgcaggtgaaattgtacttggcgagcataatgtattacccaactattttgagcaaaaccaggctgaggcgcttgatctggataaaacagtgcttcaaacagtggaagaagttgcagaggattggagagttgatgatataaaaggactccttggacgctgcaatttcaaagccgatatgcttgatagaaaagtttcccttttaagtggtggtgaaaaggcacgcctagcattctgcaagttcatggttaaaccttcaactttgcttgttttggacgaaccgactaatcatttggatataccttcaaaagaaatgctcgaggaagccatatcagaatatgaaggcacagtaattgcagtttcgcatgatcggtacttcataaagcaaatagttaatagagtaattgaagttgaagatggccaactacgggattatgcaggggattacaattattatctggagaaaaaccttgatgccagagagagagcgctcgagagggaggcagagcttgaagaaaaagcgccaaaaactaaggccaaatcgaagttgtcaaaggctgagaaggaagctaggaagaaacaaaaaatgaaggcattccaagctgcaaaacaaaaatctaaaggaactaaaaattccaagagatggaactgaaaattcgaagagatggaattgcgagaaatacaccgttacaaattaagtgatgattgaattagcatcgctatgtaaagagcctaaactaggaggtatttatcctgtttaaggtactcgaaaccggagaccaacca

SEQ ID NO: 1524 - DNA, 1225 bp, Brassica rapa
  misc_feature (5)..(5): n is a, c, g, or t
aaacnacatcacattcacaccagcactcaactcagccatggcttctattaactcttctcttcttcttgtcctagccgtcgcttgtttcatctcaccggcgatttcacagacgtgctctacgcagaacgtctccaccagcttcgacagttgcatggacctccccgtactcgattcctacctccactacacttacgacgcagccaactcatccctctccgtcgcattcgtcgctactccgcctcgttccggcgactgggtcgcttggggtatcaaccccacagggactagaatgatcggttctcaggccttcctcgcttacagtcctcgagccggcgcgcgtcccatggtggacacgtacaacatcagcagctacaacctcaccccagggagacttaccttcgacttctggaacgtacgcgccgaatccatgcccggtaatctgatcgtgatttacgcctcggttaaggttccgatgggagccaacagcgtgaaccaagtgtggcagatcggcgggaatgtgactaacggtcgtccgggagtgcatcctatgactccggcgaacatggcctctacacgggtgttgagattgaccggttctgatgctccgagctctgctccgggctctgctccgggctctgctccaggctctgttccagggtctgctcaagggccgaccactcctggtgcctcgaccactccaggacaggcgggaggtccagagaacgcgggttcgatgtcgaccagcgtaaatttcggggttaattttggaattttggttatgttggctactattttcatcttttgagtatgatttcatcatctttacattacttttttttttgctcaataatggagacatatactgttgtttatctttttagtctttagagtcatttactcttttttgttttccacctatctcccctctcacccacattattattctgagttattattggatttgaggagaagaggatacgaagaagagagtggtagtcgaatcgctgggatggataacggaatcttccatcatgccgaagaagcatcgcgccatcgaaggcgtgggtccttcctcgatcatggagctcaaggctcagctttataagtctcaggaagaagctaagctgacgaaggatttcacgggctccgatgctcagtaccaccgcgccaaggagaggatcgccgctaaagactctttcgccgcgaaaaactccggcgtcgaggg

SEQ ID NO: 1525 - DNA, 714 bp, Brassica napus
cagacgtgctctacgcagaacgtctccaccagattcgacagttgcatggacctccccgtactcgattcctacctccactacacttacgacgcagccaactcatccctctccgtcgcattcgtcgctactccgcctcgttccggcgactgggtcgcttgggctatcaaccccacagggactagaatgctcggttctcaggccttcctcgcctacagtcctcgagccggcgcgcgtcccatggtggacacgtacaacatcagcagctacaacctcaccccagggagacttaccttcgacttctggaacctgcgcgccgaatccatgcccggcaacaggatcgtgatttacgcgtcggttaaggttccgatgggagccaacagcgtgaaccaagtgtggcagatcggcgggaatgtgactaacggtcgtccgggaaggcatcctatgaatccggcgaacatggcctctacaggggtgttgagattgaccggttctaacgctccgagctctgctccgggctctgctccaggctctgttccagggtctgctcaagggccgaccactcctggtgcgtcgaccactccaggacaggcgggaggtccagggaacgcggggtcgatgtcgaccagcgtaatttcggggttaatttggaatttggttatgttggctactattttcatcttttgagtatgatttcatcatctttacattactttt

SEQ ID NO: 1526 - DNA, 918 bp, Brassica oleracea
  misc_feature (80)..(80): n is a, c, g, or t
  misc_feature (691)..(691): n is a, c, g, or t
  misc_feature (700)..(700): n is a, c, g, or t
  misc_feature (702)..(702): n is a, c, g, or t
  misc_feature (704)..(704): n is a, c, g, or t
tcttcttcttgtcctagccgtcgcttgtttcatctcaccggcgatttcacagacgtgctctacgcagaacgtctccaccngattcgacagttgcatggacctccccgtactcgattcctacctccactacacttacgacgcagccaactcatccctctccatcgcattcgtcgctactccgcctcgttccggcgactgggtcgcttgggctatcaaccccacagggactagaatgctcggttctcaggccttcctcgcctacagtcctcgagccggcgcgcgtcccatggtggacacgtacaacatcaacagctacaacctcaccccaggaagacttaccttcgacttctggaacctgcgcgccgaatccatgcccggcaacaggatcgtaatttacgcttcggttaaggttccgatgggagccaacagcgtgaaccaagtgtggcagaccggcgggaatgtgactaacggtcgtccgggaaggcatcctatgaatccggcgaacatggcctctacaggggtgttgagattgaccggttctaacgctccgagctctgctccgggctctgctccgggctctgctccaggctctgttccagggtctgctcaagggccgaccactcctggtgcctcgaccactccaggacaggcgggaggtccagggaacgcggggtcgatgtcgaccagcgtnaatttcgtngnanttttggaattttggttatgttggctactattttcatcttttgagtatgatttcatcatctttacattacttttttttttttttgcataataatggagacatatactgtttgtttatctttttagtcttagagtcatttactcttttttgtattccacctatctcccctctcacccacattattttgagttattattggatttgtatggaccatt

SEQ ID NO: 1527 - DNA, 1497 bp, Brassica oleracea
ttctagatcgcgagcggccgctcgcgcccacgcgtccgaaaaaaaaaataaaatactctctcttcttcttcttcgtcttctccgagtagtggttccacaaaaatatcgacaggaagtagcgaagtgataaaatctccttcctttgagctcggatctactgagagaatatggcgatgcgaagagtcattagagcctcctgcgtttcctcttcttctactggttatctcgccagaaaatttcatgcttcttctggagatagcaaaaagattgttggagttttctacaaggccaacgaatacgcttcaaagaatcctaacttccttggctgcgtcgagaacgctttaggaatccgcaactggcttgaatcacaaggtcatcactacatcgtcactgacgacaaagaaggtccagactgcgagctcgagaagcatatccctgaccttcacgtcctaatatccacccccttccacccagcttacgtcaccgccgagagaatcaagaaggccaagaaccttcagcttctcctcacagccgggattggatccgaccacatcgatctgcaggcagctgcggctgctggactgaccgtggctgaagtcacgggaagcaacgttgtctccgtggctgaggacgagctcatgaggatcctgatcctcatgcgcaacttcgttccggggtacaaccaagtcgtcaatggagagtggaacgtggctgggattgcttatagagcgtacgatctggaaggcaagacggtgggaacggtaggagctggtagaatcgggaagctactgctacagcggttgaagccgttcgggtgcaacttgttgtaccatgacaggcttcagatgggaccggagatggagaaggaaactggtgctaagtatgttgagagtcttgatgagatgcttcctaaatgcgatgttgtagtcgtcaacactcctctcactgagaagacaagagggatgttcaataaagagatgatagggaaaatgaagaaaggcgttttgattgtaaacaacgcgagaggagccatcatggataggcaagcggtggtggaggcggtggagagcggacacatcggaggatacagcggagacgtgtgggacccgcagccagctcctaaggatcatccatggcgttacatgccgaaccaagcgatgactcctcacatctctggcaccaccattgatgcacagctacgatatgcggcggggacaaaagacatgttggagaagtatttcaagggagaggacttccctgctcagaactacatcgtcaaggatggtgagcttgctcctcaatacaggtaagcttgtttcaactttcagcactatcaagtctcgtctccaaagggcaaagcagacggttaaattaaataaattatcaacgttttgtgctttgttcatttgaaaacgttgtaataaaccaacaagacatgtatgtaacgttgctatttcgtgacatttatcttttgagtctatcaatgattcatatggg

SEQ ID NO: 1528 - DNA, 1565 bp, Arabidopsis thaliana
atttcgtcctatataaatcctctcatctccaattactgatttcacacaaaacaaaaatcgaccaaagagtaaccaaattgatatttatctcttctcaaccatggcgatgagacaagccgctaaggcaacgatcagggcctgttcttcctcttcttcttcgggttacttcgctcgacgtcagtttaatgcatcttctggtgatagcaaaaagattgtaggagttttctacaaggccaacgaatacgctaccaagaaccctaacttccttggctgcgtcgagaatgccttaggaatccgtgactggcttgaatcccaaggacatcagtacatcgtcactgatgacaaggaaggccctgattgcgaacttgagaaacatatcccggatcttcacgtcctaatctccactcccttccacccggcgtatgtaactgctgaaagaatcaagaaagccaaaaacttgaagcttctcctcacagctggtattggctcggatcatattgatctccaggcagctgcagctgctggcctgacggttgctgaagtcacgggaagcaacgtggtctcagtggcagaagatgagctcatgagaatcttaatcctcatgcgcaacttcgtaccagggtacaaccaggtcgtcaaaggcgagtggaacgtcgcgggcattgcgtacagagcttatgatcttgaagggaagacgataggaaccgtgggagctggaagaatcggaaagcttttgctgcagcggttgaaaccattcgggtgtaacttgttgtaccatgacaggcttcagatggcaccagagctggagaaagagactggagctaagttcgttgaggatctgaatgaaatgctccctaaatgtgacgttatagtcatcaacatgcctctcacggagaagacaagaggaatgttcaacaaagagttgatagggaaattgaagaaaggcgttttgatagtgaacaacgcaagaggagccatcatggagaggcaagcagtggtggatgcggtggagagtggacacattggagggtacagcggagacgtttgggacccacagccagctcctaaggaccatccatggcgttacatgcctaaccaggctatgacccctcatacctccggcaccaccattgacgctcagctacggtatgcggcggggacgaaagacatgttggagagatacttcaagggagaagacttccctactgagaattacatcgtcaaggacggtgaacttgctcctcagtaccggtaagcttttgaggaggtgacattgggaagatgatgagaaacgaccccaacgttcaagaaaacaaataaagaagtatttggactttgctaagtcgaatgacttgagtcatcttttggtttagtttttgttattatataagcacaataataataggagggcacttcccctgttctgagagtttgtgaacatattactcagtggtttaaatcacacatatgtatttgtttccccaatcgtaggaactcaatggtttcaaatctcattatataaacataaaaatgaataaaggcatattaaatttgtctaaagaaaa

SEQ ID NO: 1529 - DNA, 1357 bp, Cleome gynandra
ttggctaaacagcaaaacccacgagaaagagaaagagcagccaaactcaaattgttctctaccatttccagcttcgatctcctgaaatggcgatgcgagcactgatcaaatcctttacttcttcttcttcttcttcttcgacggcgtacctcgcgcgtcggtttcatgcttcttctgctgacagcaaaaagattgttggagtgttctacaaggccaacgaatatgcttcgaaaaatccaaactttcttggttgtgttgagaatgcattaggaatccgtgaatggttggaatccaaagggcatcaatacattgtcaccgatgacaaagaaggtcccgattgcgaacttgaaaaacatatccctgatcttcatgttctcatatccacccctttccaccctgcctacatgacagccgaaagaatcaaaaaagctaagaacttgaagcttctcctcacagctggaatcggctctgaccacatagacctaaatgcagctgcagctgctggtctaacagtggctgaagtcaccggaagcaatgtggtttcagttgcagaagatgaactcatgaggatccttatcctcatgcgtaacttcttacctgggtatcatcaggtcatcaatggagaatggaatgttgcaggcattgcatataaagcttatgatcttgaaggaaagaccataggaaccgttggggcaggaagaatcggaaggcttctgcttcaaaggctgaagccctttggctgtaaccttttgtaccatgaccggcttaagatggaacaagagatggaaagccttttaggggcaaagtatgaagaaaatctcaatgatatgctaccaaagtgtgacgtcatagtcatcaacactcctctcactgaaaagacaagagggatgttcaacaaagagatgataaagaaaatgaagaaaggggtactgatagtgaacaatgctcgaggagccatcatggacagacacgcggtggtggaggcggtggacaacggtcacatcggaggctacagcggagacgtgtgggacccacaaccagctccaaaggaccatccatggaggtacatggcaaatcaggcaatgactcctcacatctccggtaccaccattgatgctcagatacggtatgcggaggggacaaaggatatgttagagaggtacttcaagggagaagattttcctgctcagaattacattgttaaagatggtgaattggctcctcagtaccgttgaattaagaagaacaaacattatatattatctccccttttcttgtaataaacttaaacatgttatgttttaaataatccatcgttaatattgcgctttatgtgcattatatttagctttaaccc

SEQ ID NO: 1530 - DNA, 1525 bp, Tropaeolum majus
gtagacgataagattgtcatcaaatcctttcttgccaaatgcaaaaccattattacaccaaaaactgctaaaaccagaaaacgctttttctatttttctttcttaaaaaaccagcaaacaagaaaccagttggagatcaaatatggcgatgaagcgagttgctacctctacaatcaaagcttttgctagctcagctccttcatttacgatcaccaggcagctccatgcttctcctgggagcaaaaagattgttggagtgttttataaggcgaatgagtatgcttccaaaaatcctaactttctaggctgtgcggagaacgcgttgggtatccatgactggctggaatcacaaggccataagtacattgtcactgatgacaaagaaggaccagattgtgaactcgagaagcacattcctgatcttcatgtcctcatatctacacccttccacccagcttatgttacagcagaaaggatcaagaaggccaaaaatctgcaactgcttctcactgctgggatcggctcggatcacattgatctgaatgcagcagctgctgccggattaactgttgctgaagtcacgggaagtaatgtggtctcggttgctgaagatgaactgatgagaattctcattcttatgagaaactttgtacctggatacaaacaagtaattaacggcgagtgggatgttgctagtattgcttatagagcttatgatcttgaagggaagactgtcggaactgttggagctggacgcataggcaagctcttacttcaaaggttgaagccattcaattgtaatctcctctatcatgaccggttgaagatggatcaggaaatggaggctcaaaccggggcgaagtacgaagagaatcttgaaaagttgctcccacaatgtgatgttattgtggtcaatactcctcttacagagaagacgagggggttgtttaacaaagatatgattgcaaagatgaagaaaggagttctgattgttaacaatgctcgaggagcaatcatggatacgcaagcagttgttgatgctattaacagtggacacatcggaggttatagtggggatgtttggaatccacaaccagcgccaaaagaccatccatggcgttacatgccaaaccatgcgatgactccacatatttccggcaccacaattgatgcacagatccgatatgctgctggagtcaaggatatgctcgagaagtacttcaagggagaagacttccctgcacaaaactacattgttaaggatggtgaaatcgcaagtcagtaccgatgattttgagctccccgggggcatgagaagtttttttgcttcttatggccaatgctgtttggtttaatcagcttgctttttgcttgtaagttaatgttgtaattctgtttcatcttgggcttcgctaacacggatatgataataaaactgtgttgtatggaaccaaataatactcgagaaatgtaacgtttttacaacctcgtttaaaagttggtagtttggattcaaaaaaaaaaa

SEQ ID NO: 1531 - DNA, 1422 bp, Carica papaya
gagcttcatttcattcataccgaacttcctcccacagatggcaatgaagcgtgctgctacttctgcaattaaagcttttgcttcttctcagacttccttttcaggtttatcaacgaatttcgcccgtaacctccatgcgtctccagggagcaaaaagattgttggggtgttttacaaggccaacgaatatgctacagaaaatcccaatttcgtaggctgtgtggagaatgcattgggcatacgcaactggctggaatcacaaggccatcagtatattgttacggatgacaaagaaggacccaattgtgaacttgagaagcacattcctgatcttcatgtgctcatatcgacacccttccatccagcctatgtgacagcagaaaggatcaagaaggccaaaaatttgcaactgcttcttacagctggaatagggtcagatcacattgacctgaaggcagcagcagctgctgggctaactgttgcagaagtcaccggaagtaatgtggtttcagttgcggaagacgaagtcatgagagtactcattcttatgaggaactttgtgcctggataccagcaagtagttaatggagaatggaatgttgctgctattgcttgcagatcttatgatcttgaggggaagactgtgggaactgttggtgcagggagaattggcagacttttactccaaagattgaaacctttcaattgcaatcttctctatcatgatcgggtcaagatggatccggaactggagagtcagataggggcaaagtttgaggaggatctcgataaaatgcttcccaaatgcgatgtcatagttgtcaatactcctcttacagagaagacaagggggatgtttaacaaagaaagaattgcaaagatgaagaaaggagtccgtattgtcaacaatgcccgaggagcaattatggatacacaagcagttgtcgatgcttgcaatagcggacaaattggaggttacagtggggatgtttggaacccacaaccagcgccaaaagatcatccatggcgttacatgccaaaccaggctatgactcctcatatttctggtactaccattgacgcacagttgcggtatgctgctggagttaaggatatgcttgacaggtacttcaaaggagaagacttccctgcagaaaactatattgttaaagatggtcaactagcaagtcagtatcggtgattttgtgcttccaaagcctgcagagtcttggtaaaactttgtccaggtctttaagttccatttccaagtttaaaaaaaaataataataataacaataaagttgtaatgactgaagtcacaacagtagtatcatcttcatgtgtgtgtgtgtgtgtgtcagttttaaaattttaagtctgtaaatggatgagtttcaataattgactgttttttgctgggta

SEQ ID NO: 1532 - DNA, 1557 bp, Olea europaea
aacggataagaccgacacggattaatcgcttctctcccatgggagaaagcttttgattcgtctataaagtggacaaatctacaaaggattgcacacagagtgagagagtcctttcatttcactgtcgtttttatagaaatctgtcaagcgatataatggcgatgaagcgtgtagctacttctgcaattcgtgcttttaattcttcaggaattccatctagttcttcaattttcaccagagaactccatgcaacacctgggagcaagaagattgttggggtcttttacaaggcaaacgaatatgcatccatgaacccaaattttctgggatgcgttgagaatgcattgggtatacgtgattggttggaatcacaaggtcaccagtacatagttactcctgacaaagaagggccagattgtgagcttgagaaacatattcctgatctccatgtgctgataacgacccccttccacccagcttatgttacggctgaaaggattaagaaggcaaaaaatctgcaactgttgctcacagctggtattggctcagatcatattgatctgaaagctgcagctgatgctggtttaactgtggcagaagtcaccggaagcaatactgtatcagttgcagaggatgaacttatgcggattctcattcttgttcggaatttccttcccggataccatcaggttattactggcgattggaatgttgcagctattgctcaccgagcttatgatcttgaaggcaagaccgttggaacggttggagctggacgtattggcaaacttttactgcagagattgaaaccttttaactgtaatctactctaccatgatcgccttaaaatggatccagagttggagagtcaattaggagctaagtttgaggaagatcttgatgcaatgcttccaaaatgtgacataattgtcatcaacacccctcttactgagaaaacaaaagggatgtttaacaaagaaaagatagctaagctgaagaagggagttctaatagtaaacaatgctagaggggctatcatggacacacaagcagtcgctgatgcgtgctccagtgggcacattgcaggttacagtggggatgtttggtacccgcaaccagctccaaaggatcacccctggcgttacatgccaaaccaagctatgacccctcacatatctggaacaaccatcgacgcacagttgcggtatgcagccggcaccaaggacatgctcgagaggtacttcaagggagaggattttcctccacagaactacattgtcaaggacggagaactagccagccagtaccgttaagatgcctcagcttgtcaagtttgatctctgtaggtcgtgtcatatgtagcagtttgctacttcaataaatcgaccttgtcagtaataatttccatcgcagaaagtagttgcgagaattgttttgtatggatcataaatttgaagtatgactgtgttgcttaaataaatttcaaagaagattaaagtgagtgggtgaagtagagagctcgggctcaccaaatttgatcagttgatcaaacacagg

SEQ ID NO: 1533 - DNA, 1489 bp, Momordica charantia
caccatcattcacaataaagctttttcagagagaatcagaaggcgacaatggcgatgaagcaggcagctaccacggcagttcgagctctttcttcctctgcaacctcgcaatcatcgtctctggtccgccatctccatgcttctccagggagcaagaagatcgtcggagtgttttacaaggcgaatgagtatgctgctctgaaccctaatttcgtgggatgtgtggagggagccttgggcattcgcgagtggttggaatcgcaaggtcatcagtatattgttaccgatgacaaggaaggactcgattctgagcttgaaaagcatattccagatctccatgttctcataagcacccccttccatcctgcctatgtaactgctgaaaggatcaaaaaggccaaaaacttgcagttgcttctcactgctggaattggatctgatcatgttgacctcaatgctgctgctgctgctggactaacagttgcagaggttactggaagcaatgtggtttcagttgcagaggacgagctaatgagaattctcattcttgtcaggaatttcctaccaggacaccaccaggttattaatggcgaatggaatgtcgctggaattgctcatagggcttacgatctcgaggggaagacagttgggaccgtaggcgctgggcgaatcggcaaactcttacttcaaaggttgaaacctttcaactgcaatctcctctaccacgaccgactcaagatcgatcctgaacttgagaagcagataggagcgcagtttgaagaggacctggatgcaatgctaccaaaatgtgatgtacttgtcatcaacactcctctaactgacaagacaaggggactatttaacaaagagagaattgccaagtgcaagaagggagtgctgattgtcaacaatgctcgaggagcaatcatggacacccaagcagttgttgacgcttgtaacagcggacatattggaggttacagtggtgatgtgtggaacccacaaccagctccaaaagaccatccatggcgttacatgccaaaccaagctatgacacctcatatttctggtaccaccattgatgctcagttgcgatatgctgcgggagtgaaggacatgcttgagaggtatttcaaaggagaagaatttcccgctcagaactacatcgtgaaggaaggagaactcgcacctcagtaccgataaatagttctctctctgatgcttctctggctttggcttggaatttggatttagctccctccccttttgccattttagtcaaaaataaaatagttccaaaataaaagttggcttccatgggatcggagttgcttaacttgtttccttaaatcagtttcttgtgagtctttgttggtaatcagacgtaatgtaatgtaattccatgtaaaatggaatgtatgaggatgaatgagagcttcttacttttccatccaaaagttgtattcatcgaattgaatgaattcccaat

SEQ ID NO: 1534 - DNA, 1528 bp, Nicotiana tabacum
cggggacaagccaagtggagcttcttcttcttcttcttcttcttctctctttctagtaagtacaactctttgctgcaaatacaaaaaattccgatggcgatgagacgtgtggcttctacagcagctcgtgcttttgcttcctcttcaccatcaccgtcctccttagtttttactagagaacttcaggcttcccctggtagcaaaaagattgttggtgttttctataaagcaaacgaatatgctgaaatgaaccccaactttgtgggctgtgccgaaaatgccttggggatacgcgaatggttagaatctaaaggtcatcagtacatagtcactcctgacaaagaaggaccagattgtgagcttgagaaacacattcctgatctccacgtgttgattactactccttttcatcctgcctatgtcacggctgaaaggatcaagaaggcgaaaaatttacaacttctgctgacagctggaattggatcagatcatgttgatctgaaagctgctgctgctgcagggttgacagtagcagaggtcaccgggagcaatgttgtctcagttgcggaagatgaactgatgcgaatcttaattcttgtccgaaatttcctgcctggacatcatcaggttattaatggggagtggaatgttgctggcattgcgtacagagcttatgatttggaaggcaagactgttggaaccgtgggtgcaggacgcattggtagacttttacttcaacgattgaagccatttaactgtaatctactttaccatgatcgtgttaagatggattcggagctagagaatcaaatcggggcaaagtttgaggaagatcttgataagatgctttcaaaatgtgacatagtggtcgtcaatacgcctcttacagagaaaacaaaagggatgtttgacaaggaaagaattgcaaaaatgaagaagggagttctaattgtaaacaatgctcgaggagcaatcatggacactcaagcagttgttgatgcttgtaatagtggtcatattgcaggatacagtggagatgtttggtacccacaaccagctcccaaggaccatccgtggcgctacatgccaaaccaagctatgaccccccacatttcagggactaccattgatgcacagttgcggtatgctgctgggacgaaggatatgctggacaggtacttcaagggcgaggatttcccagcacaaaattacattgtcaaggatggggaactggctcctcagtatcgctaaatcacttatgtaccttagggttgtggtctaggcttctctgtcaaataaactggcaagccccgtctgtaataagctgataaaatcggctacttatcatcctttagaacatttgtagtgcagtttctccatttggctctagcgtcacatttgtgatgtaaacatgtccccttttgttttggaggtctatgtataatccttcattatcgttcttgagtaatcctattatgatggaaatgttcttgctatggtggctgtacttgtgttctgggcaatttgt

SEQ ID NO: 1535 - DNA, 1413 bp, Fraxinus spp
agagaatcccttcatcttactgtcgttaatataaaaaactctccagcgagatcatggcgatgaagcgtgtagctacttctgcaattcgtgctattacttcttcggaagtttcatctccttcttcaattctcaccagagaactccatgcaacacccgggagcaagaagattgttggggtattttacaaggcaaacgaatagtgcatccatgaacccaaattttctgggatgcgtcgagaatgcattgggtatacgtgattggttggaatcacaaggtcaccagtacatagttacgtctgacaaagaagggccagattgtgaacttgagaaacatattcctgatctccatgtgctgataacgacccccttccacccagcttatgttacggctgaaaggattaaaaaggcaaaaaacctgcaactgttgctcacagctggaattggctcagatcatattgatctgaaagctgcagctgatgctggtttgactgtggcagaagtcactggaagcaatgtcgtctcagttgcagaggatgaactcatgaggattctcattcttgttcggaatttcctgcctggacaccatcaggttattactggggattggaatgttgcagctattgctcaccgagcttatgatcttgaaggcaagactgttggaacgtttggagctggacgtattggcaagcttttgctacagagattgaaaccttttaactgtaatctactctaccatgatcgccttaaaatggatccagagttggagagtcagttaggagctaagtttgaggaagatcttgatgtaatgcttcccaaatgtgacatacttgtcattaacacccctcttactgagaaaacaaaagggatgtttaacaaagaaaggatagctaagctgaagaagggagttctaatagtaaacaatgctagaggtgcaatcatggacacacaggcagtagctgatgcgtgctccagtgggcacattgcaggttacagtggggatgtttggaacccgcaaccagctccaaaggatcacccctggcgttacatgccaaaccaagctatgacccctcacatatctggaacaaccattgacgcccagttgcggtatgcagccggaaccaaggacatgctcgagaggtatttcaagggagaggatttccctccacagaactacattgtcaaggacggagaactagccagccagtaccgttagatgcctcaacttgtcgagtcatgtaatatgtagttgtttgctactttaaaaaatcaacgtcgtgggtaataatttccatcccggaaaatagttacaagatttgtttcgtatggatcataattttgaagtatgactgttctgcttgtcgaatttcgtctctgtacgtcatgtaatatgtagctgtttgctactttaataaat

SEQ ID NO: 1536 - DNA, 1413 bp, Platanus occidentalis
gagagtaagagaaacatagagagttagaaaaatggcgatgaagagggctgctgcgtctacaattcgaagcgtctgtgcttccagggtttcaaactcatctcctctagcaagaaacctccatgcatctccgggaagcaagaagatcgttggggtgttctacaaggctaacgagtatgcagcaatgaatcccaactttgtaggttgtgtggagggagccttgggcatacgggagtggctggaatcacaaggtcatcagtatattgtcactgacgacaaagaaggccccaattgcgaacttgaaaaacatattcctgatctccatgtactaatatcgacccccttccatccggcctatgttacggcagaaaggattaaaaaagccaaaaatttacaacttcttcttactgctggcattggctctgatcatgttgatctgaaagctgcagcagctgctggactaactgttgctgaggttactggaagcaatgtggtctcagttgcagaagatgagcttatgagaatcctcatccttgtacggaattttgtacccgctcaccatcaggtgattaatggggaatggaatgttgctgccatttcccatagagcatatgatcttgaggggaagacagttgggacggtcggtgctgggcgcattggcaagcttttgctccaacggctgaagcccttcaactgtaatctcctttatcatgatcggatcaagatggatccagagatggagaaacaaacaggggccaaatttgaggaggatttggatgtgatgcttccaaagtgtgacatcattgttgtcaacatgcctcttactgagaaaactagagggatgttcaataaagaaaggattgcaaaattgaagaagggagttctaattgtgaataatgcccggggggcaatcatggatacccaagcagttgttgatgcgtgctccagtggacatattgcaggttatagtggggatgtgtggaatccacaaccagcaccaaaggatcatccatggcgctacatgccgaaccaggctatgacaccccatatttctggcactaccattgatgctcagttgcgatatgcagctggagttaaggacatgctggagaggtatttcaaaggagaagattttcccccacaacattacattgttaaggaggggaaattggcgagccaatatctctgattccatgcttcttttggtatctagatggccctttggtcgtggaggttattttgtcatgcaaataaaagtagttcccgagatgctgtttcagaactatggagttaataagttatatgtagctttctatttcctttttcttatttgaaacattttcagatcagttaagatttaacagtaatattgggcttgtttggatgtggagttcttatgccctatgagtataatcg

SEQ ID NO: 1537 - DNA, 1461 bp, Vinca minor
aaaagtgagattccggcggaaatggcgatgaagcgggttgctgtttctactattcgtgcttttgcttcttcagccacctcaagttcttcgtttttcacccgacaccttcatgcttctcctgggagcaaaaagattgtcggcgtcttctacaatgcaaatgaatacgcttcaatgaatcctaattttgttggctgcacagagaatgcgttaggcattcgtgactggttggagtcacaaggtcatcaatatgttgtcactgcagacaaagaaggacctgattgtgaactcgagaaacacattcctgacctccatgttttgataaccactcccttccatcctgcctatgtcacggctgaaaggatcaagaaggcaaagaacctgcaactgttgctgacagctggaattggttctgatcatattgatctcaaagctgcagcagatgccggattaacggttgcagaggtcactgggagtaatactgtgtccgttgctgaagatgaacttatgaggatcctcattcttgttaggaatttcctgcctgggtaccaacaagttatcactggagactggaatgttgcaggtattgcttacagagcttatgatcttgaaggtaagactgttggcactgttggggcaggacgtattggccggctcttgttacagaggttgaaacctttcaactgtaatctactatatcatgatcgtcttcagatggactccaagttggagaatgagataggagcaaaatatgaggaagatcttgataaaatgcttccgaaatgtgatataattgtcatcaacatgcctcttaccgaaaaaaccaaagggatgttcaacaaagaaaggattgctctgctaaaaaagggagttctgattgtgaataatgctcggggtgctataatggatacacaagcagttgctgatgcttgtgctagcggacacatagcaggatacagtggagatgtatggtatccacaaccggctccaaaggaccatccttggcgttacatgccaaaccatgccatgacccctcatatttctggcactaccattgatgcacagctgaggtatgctgctgggactaaggacatgctggacaagtacttcaaaggagaggatttccctgctcaaaattacattgtcaaggacggtgaactagcaagccaatacaaatagatcatgattctgcccttacatatatgttgtctgcaggtcattgaagcatatttaggggcatatatgttgaataaagtggcaactattagttcttcctttccaaataaaaaatgtatgactcttaaaatattagcttagttgtagcctgtaggacccaagtacctctcagaggttaattggtcctagaacttgatttctcgactttcattctgctaatatattagttctgttggaaatcctccaatagaaaagagtctctataaataaaatgaagttgaaaaagat

SEQ ID NO: 1538 - DNA, 1550 bp, Citrullus lanatus
gcaaagagcggcttcgcttccaatcccatttcgccaactataaatactccactccacacactcaacccatcatcatcgttttcatctgcatcgttcacgagtctctcattaactttctcagagattcaatagacgacgatcatggcgatgaagcaggctgctacagcagcgattcgagctctttcctcctctgtaacctctaagtcatcacctctcgtcaggcatcttcatgcttctgcagggagcaagaagatcgtcggtgtgttttataaggctaatgagtatgctgcaatgaaccctaattttgtgggatgtgtggagggagccttgggcatacgcgactggttggaatctcaagggcatcagtatatagtcaccgatgacaaggaaggactcaattctgaacttgaaaagcacattccagatctccatgttctcataacaacccccttccatcctgcctatgtaactgctgaaaggatcaaaaaggccaaaagcttgcagttgcttctcacggctggaattggatccgatcatgttgacctcaatgctgctgctgctgctggactgacagttgcagaggttactggaagcaatgtggtttcagttgcagaggatgagctaatgagaattctcattctcgtcaggaatttcctaccaggataccaccaggttattaatggtgaatggaatgtcgctggaatagctcacagagcttatgatcttgagggcaaaacagttggaacggtaggagctggacgaattggcaaacttttacttcagaggctgaaacctttcaattgcaatctcctttaccacgaccgactcaagattgatcctgaacttgagaagcagatcggagcacaatttgaggaagatctggaggcaatgttaccaaaatgtgatgtacttgtcatcaacactcctctaactgacaagacaaggggactatttaacaaagagagaattgccaagtgcaagaaaggagtactgatcgttaacaatgctcgtggagcaatcatggatactcaagcagttgttgacgcttgtaacagtggacacattggaggttacagtggtgatgtgtggaacccacaaccagctccaaaggaccatccatggcgttacatgccaaaccaagctatgacacctcatatttctggcactaccattgatgcacagttgcgatatgctgcgggagtgaaggacatgcttgaaagatacttcaaaggagaagaatttcctgctcaaaactacatcgtcaaggaaggagaacttgcacctcagtaccggtaagttgtttaggtctagtttttatttcccatggtatcctctctagagggctttgatttcctctcttctcttccccttagtcaaccattcgttcccaaaataaattggctctgtgggagagttccgttgtgcctttaaaatcagtgtctgtgagtcttttttccctttaaaatcataatgtaattccacaaaaaatggataatgtatgaggatgaatcagagcttttctttctttcctttctctctaattcagctgg

SEQ ID NO: 1539 - DNA, 1620 bp, Cucumis melo
atcacctccttcatcgttcacgagtctctcatttacccacaaaactttctcagagattcaacaaacgtcgatcatggcgatgaagcaggctgctacaacagcgattcgagctctttcttcgtctctaatctctcactcatcacctctcgtcaggcagcttcatgcttctgcagagagcaagaagatcgtcggtgtgttttacaaggctaatgagtatgctgctatgaaccctaattttgtgggatgtgtggagggagccttgggcatacgtgaatggttggagtcccaagggcatgagtatatagtcacagatgacaaggaaggacttgattctgaacttgaaaagcacattccagatctccatgttctcataacaacccccttccatcctgcctacgtaactgctgaaaggatcaaaaaggccaagaacttgcagttgcttctcacggcaggaattggatccgatcatgttgacctcaatgctgctgctgctgctggactaacggttgcagaggttaccggaagcaatgtggtttcagtggcggaggatgaactaatgagaattctcattcttgtcaggaatttcctaccaggataccaccaggttgttaatggtgaatggaatgttgctggaatagctcacagagcttatgatctcgagggcaagactattggaacagtaggggctggacgaattggcaaactcttacttcaaaggctgaaacctttcaattgcaatctcctataccacgaccgactcaagatcgatcctgaacttgagaagcagattggagcacagtttgaggaggatctggatgcaatgctaccaaaatgtgatgtacttgtcatcaacactcctctaactgacaagacaaggggactatttaacaaagagagaattgccaagtgcaagaaaggagtactgattgttaacaatgctcgaggagcaattatggatactcaagcagttgttgacgcttgtaacagtggacacattggaggttacagtggtgatgtgtggaacccacaaccagctcccaaggaccatccatggcgttacatgcctaaccaagctatgacacctcatatttcgggcactaccatcgatgcacagttgcgatatgctgccggaattaaggacatgcttgaaaggtacttcaaaggagaggaattccctgctcaaaactacatcgtcaaggaaggacaacttgcacctcaataccggtaagtcctttaggttttgttttatctcccatggtgtcctctcactctctcccacttagtcaacaattagttcccaaaataaattggcttctgtgggagttcacttgtgccttcaaaatcagtgtctttgtgagtctttttttctgtatgtatctcatcataatgtaattccatctaaaatggatatctatgaggatgaatcaaagttttttttcctcccttgcctaaaaggaattgaattgattgaaccaattgctcaactaaacggatcaaaaccaacaaaatggatcaaaatcgaactgagttatgagacaccattaaaccagattggtttctcttttctttagtttaacaaatacaagtatatatgatcaaatctagtcgaattctaaaaaa

SEQ ID NO: 1540 - DNA, 1645 bp, Eucalyptus grandis
ccctccgcgactcctcctcgcctatatttattatataacacgaaacgtccctctctttctgtcagagtacttcacgagtgttttctcgcgccttctctttcgtcttccggtgccgaatctctctttggaccgcgagtgtcgctcggctcggagatggcgatgaagcgagctggtgtctccgccatcagagctctgtgctcgtctgcgaatttcgctagacatgcccattctactgctggaagcaaaaagattgtgggtgtgttctacaaggccaatgaatatgctgagttgaatccgaatttcttgggctgtgttgagagaggtttgggcatacacgactggctggaatcgcaagggcatcagtacatagtcacggatgacaaggagggaccagactgtgaacttgaaaagcatattcccgatcttcatgtcctcataacaaccccctttcaccctgcctatgttactgcggaaagaatcaaaaaggcgaagaatctgcagcttcttctcactgctggcattggttctgatcacattgatttaaaggctgcagctgacgcagggttgacagttgcagaagtcactggtagcaatgttgttttggttgcagaggatgagctcatgagaatcctcattcttgtaaggaactttttgcctggatatcaccaggtcattagtggggactggaatgtggctggtatagcatacagagcttatgatcttgaaggaaaaactgttgggactgttggtgctggacgaattggcaagcttttgctacagagattgaagcctttcaattgcaatctcctctatcatgaccgcctgaaaatggatccagaactggagaagcagactggtgcaaaatttgaggaggaccttgatgtgatgcttcagaaatgtgacatagttgtggtcaacacccctctaactgagaaaacgagaggaatgtttgataaagagaggatttccaagatgaagaagggtgtccttatcgtcaacaatgctagaggagcaatcatggatacacaagcagttgctgatgcttgctccagcggacacatcggaggttatagtggggatgtttggttcccacaaccagcacccaaggaccatccctggcggtacatgccgaaccaggccatgacacctcatatttccggcacaactatagatgcgcagttgcgatacgcagcgggaacaaaagacatgctggataggtacttcaggggagaggaattccctctccagaattacattgtcagggagggtgaactggccccgcagtaccggtgatttccctgctcctcggctcctgcagtttccatgttcaagctttcacatagtcgggcttgtaggatcttgaattggtgtaacgatgctgctgctcgtacaacgtgcgtcttaaactgtgcgtcttcagcttgtgctgtactaaaagacgatgcaggatcttcaataagtgtaataatgcccgctcttacaatgtacatcttgaactctctgtctttagcttgtgctgcatcgaagatccatgaggtcttgtttgagacccttagtgcaaatcatctcctctgatttttttctactcaaacaattcatgtccttatgtactgattacagtcgacattgtctactctggagaaaa

SEQ ID NO: 1541 - DNA, 1601 bp, Solanum lycopersicum
attggagttgaagcaggtcgcttctaagtactgggccttcgccctttcctataaaaagccgttacgtctctccagtaagtcatctcagccaactggagtttattcttctctctgtttttagtaagtacaaaccctttgctgtaaatccgaaaaaaattccgatggcgatgaggcgtgtagcttctacagcagctcgtgctattgcttcaccttcatccttagtttttaccagagaacttcaggcttcccctggccccaaaaagattgtgggtgttttctacaaagcaaatgaatatgctgaaatgaaccccaactttttgggctgtgcagaaaatgccttggggatacgtgaatggttagagtctaaaggtcatcagtacatagtcactcctgacaaagaaggaccagattgtgagcttgagaaacacatccctgatctccatgtgttgatttcgaccccttttcatcctgcctatgtcacggctgaaaggatcaagaaggcaaaaaatctacaacttctgctgacagctggaattggatcagatcatgttgatctgaaagctgctgctgctgctggattgacagtagcagaggtcactggaagcaatactgtctcagttgcggaagatgaactgatgcgaatcttaattcttgtccgaaatttcttacctggacatcatcaggttatcaatggggagtggaatgttgctggaattgcgcacagagcttatgatttggaaggcaagactgttggaactgttggtgcaggacgtattggcagacttttactccaaagattgaagccatttaactgtaatctactttaccatgaccgtcttaagatggattctgagctagagaatcaaattggagcaaagtttgaggaagatctcgataagatgctctcgaaatgtgacatagtggtcatcaatacgcctcttacagagaaaacaaaaggaatgtttgacaaggaaagaattgcaaagttgaagaagggagttctaattgtaaacaatgctcgaggagcaattatggacactcaagcagttgttgatgcttgtaacagcggtcatattgcaggatacagtggagatgtttggtacccacaaccagctcccaaggaccatccatggcgctacatgccaaaccaagctatgactcctcacatttctgggactaccattgatgcacagttgaggtatgcagctggaacaaaggatatgttggacaggtacttcaagggtgaggatttccctgctgaaaattacattgtcaaggatggggaattggcacctcagtatcgctaaattattaatgtatagagttgtgtctagatttctgtgttaaataaactggcaagccgtgtcttcaataagctgataaaattggctactttatgttcttttagaactctaatgcagtttttctccgggttggctgtaacttttgtgatggaaacatatgtcctcttctgtgatggaggtctatgtatgatcctccagtgtctttcttgagtctataactgaacttccttgctatggtagttgtactggtgttgtcctggacattttatgttttaaaaaaaattatcttcttctttg

SEQ ID NO: 1542 - DNA, 1197 bp, Vinca minor
cagaaatggcgatgaagcgagtcgctttttccacaattcgtgccttttcttcttcaagctcatcatttctcacccgtcaccttcatgcttcttctgggagcaaaaagattgttggagtcttctacaatgcaaatgaatatgcttcgatgaatcctaattttgttggctgcacagaaaatgcattaggcattcgtgactggttggagtcacaaggtcatcagtatgttgtcactgcagacaaagaaggacctcattgtgaactcgagaaacatattcctgacctccatgtcttgataaccactccctttcatcctgcctatgtcacggctgaaaggatcaagaaggcaaagaatctgcaactattgctgacagctggaattgggtctgatcatattgatctcaaagctgcagcagaagccgggttaacagttgcagaggtcactgggagtaatactgtatctgttgctgaagatgaacttatgaggatcctcattcttgttaggaatttcgtgcctgggtaccagcaagttatcactggagactggaatgttgcaggtatttcttacagagcttatgatcttgaaggtaagaccgttggcactgttggggcaggacgtattggcaggctcttgttacagaggttgaaacctttcaactgtaatctgctatatcatgatcgtcttaagatggactccgcgttggagaatgagataggagcaaaatatgaggaagatcttgacaaaatgcttcccaaatgtgatataattgtcatcaacatgcctcttacagagaaaaccatagggatgttcaacaaagagaagattgctctgctaaagaagggagttctgattgtgaataatgctcggggtgctataatggatactcaagcagttgctgatgcttgtgctagcggacacatagcaggatacagtggagatgtatggtacccacaaccagctccaaaggaccatccttggcgttacatgccaaaccatgctatgacccctcatgtttctggcactaccattgatgcacagctgaggtatgctgctgggactaaggagatgctggacaagtacttcaaaggagaggatttccctgctcaaaattacattgtcaaagacggagaactagcaagccaatacaaatgattcatgattccgcgcttataaatatgttgtctgaaggtcattgagc

SEQ ID NO: 1543 - DNA, 1505 bp, Citrus sinensis
ccacgcgtccgcaaaagcaaaaacgttatcaaatttcatgttttcaccatctcgtttaaataaattaaaataaaaaggcaaagcagaagtcaaagcctgccgttaaaacttgaaaaggtttcccctataaaagcgctgtgcttttgtgagaactcagcagtgtgagtgacaaattatataattgggagatggccatgaagagagtagctagctctgcaattaacgcttttgcttcgtcgggatatcttcgttcatcgtcgaggttttctcgacactatgcttcttctggaagtaagaagattgttggggtgttctacaagggcaatgaatacgcttcaatgaatcccaactttcttggttgtgtggagggaggctgtggcctgcgtgaatggctggaatcgaaaggtcaccaatatattgtcactgatgacaaagagggaccagactgtgaactagagaaacatattcctgatctccacgtcctcatatctacccccttccaccctgcctatgttacggcggaaaggattaagaaggccaaaaatttgcaactgcttctcactgctggagttggctctgatcatattgatctaaaagctgctgctgctgctggtttaactgttgctgaagttactggaagcaatgtggtttcagttgctgaggacgagcttatgagaatccttattcttgtccgtaatttcttacctggacaccatcaagttatcagtggggaatggaatgttgccggtgttgcttatagagcttatgatcttgaaggaaagacagtgggaactgttggttgtggacgcattggcaagctgttgctccaacgacttaaacctttcaattgtaatctcctttatcatgaccgggtgaagatggatccgcaattggagaaagagacaggagcaaaatttgaggaggatctagatacaatgcttcccaaatgtgacatagttgttgtcaacacccctctaacagaaaagacgagagggatgtttgacaaagataggattgcaaagatgaagaagggcgtcttgattgtcaacaatgctcgaggagcaatcatggacacacaagctgttgttgatgcttgctcaagtggacacattgcaggttatagtggtgatgtttggaatccacaaccagctccaaaggaccatccctggcgttacatgccaaatcaagcaatgacccctcatgtttctgggaccactattgatgcacagctacgctatgctgcgggagtcaaggatatgcttgacagatacttcaagggagaagattttcctgttcaaaattacatagtgaaggcgggggagctggcacctcaatatcgataatttcacgtgtgaagagactgatcgtttgagtttattctctgttgaacaggaccttctggaataatgttcctatgtttgtatctgcttctggaataatgttcctatgtttgtaaactctacatttaacaatggaataataaacagctggaatgagtaacttca

SEQ ID NO: 1544 - DNA, 1505 bp, Citrus sinensis
gcaaaagcaaaaacgttatcaaatttcatgttttcaccatctcgtttaaataaattaaaataaaaaggcaaagcagaagtcaaagcctgccgttaaaacttgaaaaggtttcccctataaaagcgctgtgcttttgtgagaactcagcagtgtgagtgacaaattatataattgggagatggccatgaagagagtagctagctctgcaattaacgcttttgcttcgtcgggatttcttcgttcatcgtcgagattttctcgacactatgcttcttctggaagtaagaagattgttggggtgttctacaagggcaatgaatacgcttcaatgaatcccaactttcttggttgtgtggagggaggctgtggcctgcgtgaatggctggaatcgaaaggtcaccaatatattgtcactgatgacaaagagggaccagactgtgaactagagaaacatattcctgatctccatgtcctcatatctacccccttccaccctgcctatgttacggcggaaaggattaagaaggccaaaaatttgcaactgcttctcactgctggagttggctctgatcatattgatctaaagctgctgctgctgctggtttaactgttgctgaagttactggaagcaatgtggtttcagttgctgaggacgagcttatgagaatccttattcttgtccgtaatttcttacctggacaccatcaagttatcagtggggaatggaatgttgccggtgttgcttatagagcttatgatcttgaaggaaagacagtgggaactgttggttgtggacgcattggcaagctgttgctccaacgacttaaacctttcaattgtaatctcctttatcatgaccgggtgaagatggatcctcaattggagaaagagactggagcaaaatttgaggaggatctagatactatgcttcccaaatgtgacatagttgttgtcaacacccctctaacagaaaagacgagagggatgtttgacaaagataggattgcaaagatgaagaagggcgtcttgattgtcaacaatgctcgaggagcaatcatggacacacaagctgttgttgacgcttgctctagtggacacattgcaggttatagtggtgatgtttggaatccacaaccagctccaaaggaccatccctggcgttacatgccaaatcaagcaatgacccctcatgtttctgggaccactattgatgcacagctacgctatgctgcgggagtcaaggatatgcttgacagatacttcaagggagaagattttcctgttcaaaattacatagtgaaggcgggggagctggcacctcaatatcgataatttcacgtgtgaagagactgatcgtttgagtttattctctgttgaacaggaccttctggaataatcctatgtttgtaccttctggaataatgttcctatgtttgtaaactctacatttaacaatggaataataaacagctggaatgagtaacttcattttgtgtttttttttt

SEQ ID NO: 1545 - DNA, 1477 bp, Capsicum annuum
cacgaggggcatttcttcttctctcactcttctctctttttagtaagtaataagtacagctttttgctgcaaatccactcagatggcgatgaggcgtgtggcatctacagcagctcgtgcttttgcttcaccttcatccttagtttttaccagacaacttcaggcttcccctggccccaaaaagattgttggtgttttctacaaagcaaacgaatatgctgaaatgaaccccaactttttgggctgcgcagaaaatgccttggggatacgtgaatggttagaatctaaaggtcatgagtacatagtcactcctgacaaagacggaccagattctgagcttgagaaacacattcctgatctccatgtgttgatttcgaccccctttcatcctgcctatgtcacggctgaaagaatcaagaaggcaaaaaatttacaacttctgctgacagctggaattgggtcagatcatgttgatctgaaagccgctgctgctgcggggttgacagtagcagaggtcactggaagcaatactgtctcagttgcggaagatgaactgatgcgaatcttaattcttgttcgaaattttctgcctggacatcatcaggttatcaatggggactggaatgttgctggcattgcttacagagcttatgatttggaaggcaagactgtcggaactgttggtgcaggacgtattggaagacttttactccaacggttgaagccatttaactgtaatctactttaccatgatcgtcttaagatggatccggagctggaaagtcaaatcggagcaaagtttgaggaagatctcgataagatgctctcgaaatgtgacatagtggtcatcaatacgcctcttacagagaaaacaaaagggatgtttgacaaggaaaaaattgcaaagttgaagaagggagttctaattgtaaacaatgctcgaggagcaatcatggacactcaagcagttgtcgatgcttgtaacagtggtcatattgcaggatacagtggagatgtttggtacccacaaccagctcccaaggaccatccgtggcgctacatgccaaaccaagctatgaccccgcacatttctgggactaccattgatgctcagttgcggtacgcagctggaacgaaggatatgctggacaggtacttcaagggtgaggatttccctgctgaaaattacattgtcaaggatggggaactggcaccccagtatcgctaaatcatcaatgtacctagggctatgtctagatttctctgtcaaataaactggcaagctgtgtcttcaataagctgataaatttggctacgtatcttcttttagaatatctggaatggagtttttcttcggttggttgtaacgtaacatttggatggaaacatgtccgcttttgtgatggaggtctatgtataatcctccattgtctttcttgagtactataattgggaaacaattttatgatgttgctaa

SEQ ID NO: 1546 - DNA, 1425 bp, Citrus clementina
aaagcaaaagtcaaaggctgccgttaaaacttgaaaaggtttcgcctataaaaacgctgtgctttagtgaggactcggcagtgtgagtgacaaattatataattgggagatggccatgaagagagtagctagctctgcaattaacgcttttgcttcgtcgggatatcttcgttcatcgtcgaggttttctcgacactatgcttcttctggaagtaagaagattgttggggtgttctacaagggcaatgaatacgcttcaatgaatcccaactttcttggttgtgtggagggaggctgtggtctgcgtgaatggctggaatcgaaaggtcaccaatatattgtcactgatgacaaagagggaccagactgtgaactagagaaacatattcctgatctccacgtcctcatatctacccccttccaccctgcctatgttacggcggaaaggattaagaaggccaaaaatttgcaactgcttctcactgctggagttggctctgatcatattgatctaaatgctgctgctgctgctggtttaactgttgctgaagttactggaagcaatgtggtttcagttgctgaggacgagcttatgagaatccttattcttgtccgtaatttcttacctggacaccatcaagttatcagtggggaatggaatgttgccggtgttgcttatagagctcatgatcttgaaggaaagacagtgggaactgttggttgtggacgcattggcaagctgttgctccaacgacttaaacctttcaattgtaacctcctttatcatgaccgggtgaagatggatcctcaattggagaaagagactggagcaaaatttgaggaggatctagatactatgcttcccaaatgtgacatagttgttgtcaacacccctctaacagaaaagacgagagggatgtttgacaaagataggattgcaaagatgaagaagggcgtcttgattgtcaacaatgctcgaggagcaatcatggacacacaagctgttgttgacgcttgctctagtggacacattgcaggttatagtggtgatgtttggaatccacaaccagctccaaaggaccatccctggcgttacatgccaaatcaggcaatgacccctcatgtttctgggaccactattgatgcacagctacgctatgctgcgggagtcaaggatatgcttgacagatacttcaagggagaagattttcctgttcaaaattacatagtgaaggcgggggagctggcacctcaatatcgataatttcacgtgtgaagagactgatcgtttgagtttattctctgttgaacaggaccttctggaataatgttcctatgtttgtaaactctacatttaacaatggaataataaacacctggaatgagtaacttcattttatgtttttttttttggtaggcttcatt

SEQ ID NO: 1547 - DNA, 1464 bp, Cucumis sativus
atcaccttcatcatcatcatcatcacctccttcatcgttcacgagtctttcatttacgcataaaactttgtcagagattcaacaaacgtcgatcatggcgatgaagcaggctgctacaacagcgattcgagctctttcctcttctctaacctctcactcatcacctctcctcaggcatcttcatgcttctgcagagagcaagaagatcgtcggtgtgttttacaaggctaatgagtatgctgctatgaaccctaattttgtgggatgtgtggagggagccttgggcatacgcgaatggttggagtctcaaggacatgagtatatagtcactgatgacaaggaaggacttgattctgaacttgaaaagcacattccagatctccatgttctcataacaacccccttccatcctgcctacgtaactgctgaaaggataaaaaaggccaagaacttgaagttgcttctcacggcaggaattggatccgatcatgttgacctcaatgctgctgctgctgctggactaacggttgcagaggttaccggaagcaatgtggtttcagttgcggaggatgagctaatgagaattctcattcttgtcaggaatttcctaccaggataccaccaggttgttaatggtgaatggaatgttgctggaatagctcacagagcttatgatctcgagggcaagactgttggaaccgtaggggctggacgaattggcaaactcttacttcaaaggctgaaacctttcaattgcaatctcctctaccacgatcgactcaagatcgatcctgaacttgagaagcagattggagcacagtttgaggaggatctggatgcaatgctaccaaaatgtgatgtacttgtcatcaacactcctctaactgacaagacaaggggactatttaacaaagaaagaattgccaagtgcaagaaaggagtactgattgttaacaatgctcgaggagcaattatggatactcaagctgttgttgacgcttgtaacagtggacacgttggaggttacagtggtgatgtgtggaacccacaaccagctcccaaggaccatccatggcgttacatgcctaaccaagctatgactcctcatatttcgggcactaccatcgatgcacagttgcgatatgctgccggagttaaggacatgcttgaaaggtacttcaaaggagaagaattccctgctcaaaactacatcgtcaaggaaggacaacttgcacctcaataccggtaagtgctttaggttttgtcttatctgccatggtgtcctccctctctctcccacttagtcaacaattagtttccaaaataaattggcttctgtgggagttcacttgtgccttcaaaatcagcgtctttgtgagtctttttttctgtatgtatctcatcataatgtaattccatctaaaatggatatctttgaggatgaatcaaagtttttttttttct

SEQ ID NO: 1548 - DNA, 1414 bp, Ipomoea nil
aattcgaatccgtttcgactacaaataggctcgggctttacaattcacactcactcacgaatcatagcaagcaactaagaagttatagagagagagagatggcgatgaggcgtgttgctgcttctgggcttcgggcttttgcttcttacgggaacccatcccttctcacccgacaacttcacgcttctcccgggagcaaaaagatcgtcggtgttttctacaaagcaaatgagtatgcttcgatgaatcccaattttgtgggttgcgtggagaatgcactgggtattcgtgattggttggaatcccaaggtcaccagtacatagtcactcctgacaaagaaggacccgattctgagctggaaaagcatattcccgatctacatgtgttgataaccactccctttcatcctgcctatgtcacggccgaaaggatcaagaaagccaagaatttgcagctgttgctcactgctggcattggttcagatcacatagatctcaatgctgcagctgctgctgggctgacagtggcagaggtcactggaagcaacaccgtctcggttgcagaggacgaactgatgcgtatcctcattcttgttcggaacttcctgcccgggtaccatcaggtcatcaaaggggagtgggatgttgcgggaattgcttacagagcttatgatctcgaggggaaaaccgttgggacggttggggctggtcgaattgggaggcttttactccagagattgaagcctttcaactgcaatctgctgtaccacgatcgtctcaagatggatcccgcattggagaaggaaatcggggcaacattcgaggaagaccttgatactatgctgtcaaaatgcgacattgttgtcatcaatacccctctaacagacaaaacaaagggaatgttcgacaagaacaggatcgctaagatgaagaagggagtgttagtggtgaacaatgctcggggcgcaatcatggacactcaagcagttgctgacgcttgttccagtggacacattgcaggctacagtggcgacgtttggtacccacaaccagctcccaaggaccatccatggcgatacatgccaaatcaagccatgacgccccatatttccgggacgaccattgatgcacagctgcggtatgctgcaggaactaaggacatgctggacaggtatttcaagggtgaagaattccctgcccagaattacattgtaaaggatgggcaattggcgagccagtatcgttaaactgcttcggcatgatgctgtgttgttgttggtgtttttgttcagaatgtcagtaataaataggcccttatctacagtgtattcagaacacttgtaatgtgagaaaaggaacatttctctgttgtggctttcaatcccatctttgtgatctcttgaaattaaattat

SEQ ID NO: 1549 - DNA, 1675 bp, Solanum tuberosum
ggtcgcttctaagtactgggccttcgccctttcctataaaaaggcgatacgtctctccagtgagtcatctcagccaactggagtgtattcttctctctgtttttagcaagtacaaaaccctttgctgtaaatccaaaaaattccgatggcgatgagtcgtgtagcttctacagcagctcgtgctattacttcaccttcatccttagtttttaccagagaacttcaggcttcccctggccccaaaaagattgtgggtgttttctacaaagcaaatgaatatgctgaaatgaaccccaactttttgggctgtgcagaaaatgccttggggatacgtgaatggttagaatctaaaggtcatcagtacatagtcactcctgacaaagaaggaccagattgtgagcttgagaaacacattcctgatctccatgtgttgatttcgaccccttttcatcctgcctatgtcacggctgaaaggatcaagaaggcaaaaaatctacaactactgctgacagctggaattggatcagatcatgttgatctgaaagctgctgctgctgctggattgacagtagcagaggtcactggaagcaatactgtctcagttgcggaagatgaactgatgcgaatcttaattcttgtccgaaatttcttgcctggacatcatcaggttatcaatggggagtggaatgttgctgcaattgcgcacagagcttatgatttggaaggcaagactgttggaactgttggtgcaggacgtattggcagacttttactccaacgattgaagccatttaactgtaatctactttaccatgaccgtcttaagatggattctgagctagagaatcaaattggagcaaagttcgaggaagatctcgataagatgctctcgaaatgtgacatagtggtcatcaatacgcctcttacagagaaaacaaaaggaatgtttgacaaggaaagaattgcaaagttgaagaagggagttctaattgtaaacaatgctcgaggagcaattatggacactcaagcagttgttgatgcttgtaacagcggtcatattgcaggatacagtggagatgtttggtacccacaaccagctcccaaggaccatccgtggcgctacatgccaaaccaagctatgactcctcacatttctgggactaccattgatgcacagttgaggtatgcagctggaacaaaggatatgttggacaggtacttcaagggtgaggatttccctgctgaaaattacattgtcaaggatggggaattggcacctcagtatcgctaaatcattaatgtaccttagttgtgtctagatttctgtgtcaaataaactggcaagctgtgtcttcaataagctgataaaattggctacttatgttcttttagaactgtaatgcagtttttcttcggttggctgtatcgtaacttttgcgatggaaacatgtcctcttctgtgatggaggtctatgtatgagcctccagtgtctttcttgagtctataactgggaaacttccttgctatggtagttgtactggtgttgtcctggacattttatgattaaaaaaatattttcttcttcttgctagtatttgttgcagtcgctatgttaatcttttctacgatgccagggagaacctgggagaaaaatgaatgaattacaatggtgtg

SEQ ID NO: 1550 - DNA, 1601 bp, Solanum lycopersicum
attggagttgaagcaggtcgcttctaagtactgggccttcgccctttcctataaaaagccgttacgtctctccagtaagtcatctcagccaactggagtttattcttctctctgtttttagtaagtacgaaacccttttctgtaaatccaaaaaaaattccgatggcgatgaggcgtgtagcttctacagcagctcgtgctattgcttcaccttcatccttagtttttaccagagaacttcaggcttcccctggccccaaaaagattgtgggtgttttctacaaagcaaatgaatatgctgaaatgaaccccaactttttgggctgtgcagaaaatgccttggggatacgtgaatggttagagtctaaaggtcatcagtacatagtcactcctgacaaagaaggaccagattgtgagcttgagaaacacattcctgatctccatgtgttgatttcgaccccttttcatcctgcctatgtcacggctgaaaggatcaagaaggcaaaaaatctacaacttctgctgacagctggaattggatcagatcatgttgatctgaaagctgctgctgctgctggattgacagtagcagaggtcactggaagcaatactgtctcagttgcggaagatgaactgatgcgaatcttaattcttgtccgaaatttcttacctggacatcatcaggttatcaatggggagtggaatgttgctgcaattgcgcacagagcttatgatttggaaggcaagactgttggaactgttggtgcaggacgtattggcagacttttactccagcgattgaagccatttaactgtaatctactttaccatgaccgtcttaagatggattctgagctagagaatcaaattggagcaaagtttgaggaagatctcgataagatgctctcgaaatgtgacatagtggtcatcaatacgcctcttacagagaaaacaaaaggaatgtttgacaaggaaagaattgcaaagttgaagaagggagttctaattgtaaacaatgctcgaggagcaattatggacactcaagcagttgttgatgcttgtaacagcggtcatattgcaggatacagtggagatgtttggtacccacaaccagctcccaaggaccatctatggcgttacatgccaaaccaagctatgactcctcacatttctgggactaccattgatgcacagttgaggtatgcagctggaacaaaggatatgttggacaggtacttcaagggtgaggatttccctgctgaaaattacattgtcaaggatggggaattggcacctcagtatcgctaaattatttatgtatagagttgtgtctagatttctgtgttaaataaactggcaagccgtgtcttcaataagctgataaaattggctactttatgttcttctagaactctaatgcagtttttctccgggttagctgtaacttttgtgatggaaacatatgtcctcttctgtgatggaggtctatgtatgatcctccagtgtctttcttgagtctataactgaacttccttgctgtggtagttgtactggtgtttcctggacattttatgttttaaaaaaaattatcttcttgtttg

SEQ ID NO: 1551 - DNA, 1438 bp, Ambrosia trifida
taacacactccaaaactaacactcatttcgatcatcatcatcatcatcccaacaaactccggcgccgacgatggcgatgtcaatggcgatgaagcgttctgccgccgctgcaactcgtgctctaatttcctcctcctcttcatccatcctaaccagagaccttcatgcttcttcagggaaaaagaagattgtaggtgttttctacaaggcacatgagtatgctaagatgaaccctaattttctgggctgtgtagagaatgcgttgggcattcgcgactggttagaatcacaaggccatgagtacatagtcactgatgacaaagagggacccgactgcgaactagagaagcatattcctgatgcacatgtcattataaccactccgttccaccctggctacataaccgccgaaaggattaaaaaagcaaagaatctgcaacttttgctgacagctgggatcgggtctgaccatgttgatctcaaggctgctgctgctgctgggttaactgttgcagaggttactggcagcaatgtcgtttctgttgcagaagacgaacttatgagaatcctcattctggttcgcaatttcttaccgggataccatcaggttattagtggagattggaatgttgcaggtatcgcatacagagcttatgatcttgaagggaaaaccgtgggaacagttggttgtgggcgaattggtagacttttacttcaaagattgaagccatttgggtgcaatcttctgtaccatgatcgtattaagatggactcagaattggagaatcaaattggtgccagctatgaggaagatcttgataagatgctccccaaatgtgacgtagttgtcatcaacacacctttaacagagaaaaccaaaggaatgtttgacaaagaaaggattgctaaattgaaaaaggagttctcattgttaacaatgctcgaggagctataatggatacacaagccgttgctgatgcctgttctagcggacacatcggaggctacagtggagacgtttggtacccacaaccagctccaaaggatcatccatggcggtatatgccaaatcaggctatgactcctcacatttctggaaccaccattgatgcgcagttgcgatatgcggctggagtgaaagatatgctggataactatttcaagggagaagacttcccggcccagcattacattgtgaaggagggtgaattggcaagccagtaccgttgatccgcccagttctagtagtcattcgttttgaataagttatgctgagctggagctgttaaggaaagtcttttgtttttatcaccttgtaacagtgaggcgtggttatggtaaactgaatctctatggtttttatgatgtagaccagctacatatgtcaatcaatggttttcatcacctgttaagaataatcaactttgactattaagca

SEQ ID NO: 1552 - DNA, 1423 bp, Ambrosia trifida
tatcactctccaaaaccaacactcatttcgatcatcatcttcccaacaaactccggcgacgacgatggcgatgtcaatggcgatgaagcgttgtgccgccgctgcaactcgtgctctaatttcctcctcctcttcatccatcctaaccagagaccttcatgctgcttcggggaaaaagaagattgtaggtgttttctacaaggcacatgagtagtgctaagatgaaccctaattttctgggctgtgtagagaatgcgttgggcattcgtgactggttagaatcacaaggccatgagtacatagtcactgatgacaaagagggacctgactgcgaactagagaagcatattcctgatgcacatgttattataaccactccattccaccctggctacataaccgccgaaaggattaaaaaagcaaaaaatctgcaacttttgcttacagccgggatcgggtctgaccatgttgatctcaaggctgctgctgctgctgggttaactgttgcagaggttaccggcagcaatgtcgtttctgttgcagaagatgaacttatgagaatcctcattcttgttcgcaatttcttacccggataccaccaggttattagtggagattggaatgttgcaggtatcgcatacagagcttatgatcttgaagggaaaaccgtgggaacagttggttgtgggcgaattggtagacttttacttcaaagattgaagccattcgggtgcaatcttctgtaccatgatcgtattaagatggacccggaattggagaatcaaattggtgccagctatgaggaagatcttgataagatgctccccaaatgtgacgtagttgtcatcaacacacctttaacagagaaaaccaaaggaatgtttgacaaagaaaggattgctaaattgaaaaaaggagttctcattgttaacaatgctcgaggagctataatggatacacaagccgttgctgatgcctgttctagtggacacatcggaggctatagtggagatgtttggtacccacagccagctccaaaggaccatccatggcggtatatgccaaatcaggctatgactcctcacatttctggaaccaccattgatgcgcagttgcgatatgcggctggagtgaaagatatgctggataattatttcaagggagaagacttcccggcccagcattacattgtgaaggagggtgaactggcaagccagtaccgttgatccgcccagttctagtagtcatcgttttgaataagttatgctgagctggagctgttagtgaagcttttgttttatcaccttgtaacagtgaggcgtggttatggtaaactgaatctctatggtttttatgatgtagaccagctacatatgtcaatcaatggttttcatcaccttttaagaataatcaactttgacta

SEQ ID NO: 1553 - DNA, 1336 bp, Ambrosia trifida
ctaccccctcgtcgtggtccttcggtcgaagtcgtctagacgacggacggccgacgtatcaacgacacagtacgcgggacgtcacaagaagacgtattgccatttgttaacactctccaaaactaacaactcattccgatcatcgtcttcccaccaaactccgacgccgacgatggcgatgtcaatggcgatgaagcgttctgccgccgctgcaactcgtgctatcctttcctcctcctcctcctcatccatcctaaccagagaccttcatgcttcttcggggaaaaagaagattgtaggtgttttctacaaagcacatgagtatgctaagatgaaccctaattttttgggctgtgtagagaatgcgttgggcattcgcgactggttagaatcacaaggccacgagtacatagtcactgatgacaaagagggacccgactgcgaactagaaaagcatattcctgatgcacatgttattataaccactccattccaccctggctacataaccgccgaaaggattaaaaaagcaaaaaacctgcaacttttgcttacagccgggatcgggtctgaccatgttgatctcaaggctgctgctgatgccgggttaactgttgcagaggttaccggaagcaatgtcgtttctgttgcagaagatgaacttatgagaatcctcattcttgttcgcaatttcttacccggataccaccaggttattagtggagattggaatgttgcaggtattgcttacagagcttatgatcttgaagggaaaaccgttggaacagttggttgtggacggattggcagacttttacttcaaagattgaagccattcgggtgcaatcttctgtaccatgatcgtattaagatggactcggaattggagagtcaaattggtgccagctatgaggaagatcttgataagatgctccccaaatgtgacatagttgtcatcaacacacctttgacggagaaaaccaaaggaatgtttgacaaagaaaggattgctaaattgaaaaaaggggttctcattgttaacaatgctcgaggagctattatggacacgcaagctgttgctgatgcctgttctagcggacacattggaggctacagtggagacgtttggtacccacaaccagctccaaaggatcacccatggcgatatatgccaaatcaggccatgacccctcacatttctggaaccaccattgatgcacagttacgatatgcggctggagtgaaagatatgctggataactatttcaaaggagaagacttcccagcccagcattacattgtgaaggagggtgaactggctagccagtaccgttga

SEQ ID NO: 1554 - DNA, 1777 bp, Vitis vinifera
agttgaaggaaaatccaaaatggataaaaagacggaacagagaaacggaacgggggagggagaaacagtagaaagcgttttgtcttacggaagcagaagtggagaaggcaaaagctgattaggattttcctatataaaagctctgaggttggattggtttcgcaggtcgcagacacagccagtaagcgtagaaaccagtgttgtgactttgagagagagagatggcgatgatgaagcgagttgctgagtctgcggttagggcttttgctctgggttctacttccggggctcttaccaggcacctccatgcttcagctggaagcaaaaagattgttggggtgttttacaaggccaatgaatatgctgccatgaatcccaactttgtgggctgtgttgagggagccttgggcattcgagattggttggaatcacaagggcaccagtacattgttactgatgacaaagaagggccagattgtgaacttgaaaagcacattcccgacctccatgttctcatatctacccccttccaccctgcctatgtaacggcagagaggatcaagaaggccaaaaatctacaacttctgcttacagctggaatcggatctgatcatattgatttgaaggcagctgctgctgctgggctaacagttgctgaggtcactggtagcaacgtagtgtctgttgcagaagatgagctcatgagaatcctcattcttgtccggaatttcttgcctggacaccatcaggttattagtggggagtggaatgttgcaggtattgcttacagagcttatgatcttgaaggcaagacagtgggaactgttggtgctggacgtattggtaggcttttgctccagcgattgaagcctttcaactgtaatctcctctatcatgatcggattaaaatggacccagaattggagaatcagataggagcaaagtttgaagaggatgttgatgtgatgcttcccaaatgtgacataattgtcatcaacatgcctcttactgaaaaaacaaaaggaatgttcaacaaagagaggattgcaaagttgaaaaagggagttctaattgttaacaatgctcgaggagcaatcatggatacacaagctgttgccgatgcatgctccagtgggcatattgcaggttacagtggggatgtttggtatccacagccagcccccaaggaccatccatggcggtacatgccaaaccaagctatgacccctcatatttctggcaccaccattgatgcacagttgcgatacgcagctggagtgaaggacatgctagacaggtacttcaagggagaagactttccggcacaacattacatcgtcaaggagggccaactagcaagccagtaccagtaataattcagtgtttgtgttgtggacactgtcttctacttgagttcatttccttccattaggatgaataaataaatgtatggaagatgctttgtggttccttggttctcttttggttggaaatgcttagagctgtttgggggtgaacctttgatggttgtaatctgttctaatgctttatgagatgcaagttgttttctatcttgatcaaatattgatatatgcttgagtgagcaggaggtttgagaggacagaattgcatatgcccatggccatggccatgcccattgctgctgcagtcactgctgcaactgaaagtggggaatgacaggaccaccactcatgtaacattggtcacaaaccatgaccttctgtatccaaaaagaataaagataaaaggaaaacag

SEQ ID NO: 1555 - DNA, 1592 bp, Vitis vinifera
agttgaaggaaaatccaaaatggataaaaagacggaacagagaaacggaacgggggagggagaaacagtagaaagcgttttgtcttacggaagcagaagtggagaaggcaaaagctgattaggattttcctatataaaagctctgaggttggattggtttcgcaggtcgcagacacagccagtaagcgtagaaaccagtgttgtgactttgagagagagagagatggcgatgatgaagcgagttgctgagtctgcggttagggcttttgctctgggttctacttccggggctcttaccaggcacctccatgcttcagctggcagcaaaaagattgttggggtgttttacaaggccaatgaatatgctgccatgaatcccaactttgtgggctgtgttgagggagccttgggcattcgagattggttggaatcacaagggcaccagtacatagttactgatgacaaagaaggaccagattgtgaacttgaaaagcacattcccgacctccatgttctcatatctacccccttccaccctgcctacgtaacagcagagaggatcaagaaggccaaaaatctacaacttctgcttacagctggaattggatctgatcatattgatttgaaggcagctgctgctgctgggctaacagttgctgaggtcactggaagcaacgtagtgtctgttgcagaagatgagctcatgagaatcctcattcttgtccggaatttcttgcctggacaccatcaggttattagtggggagtggaatgttgcaggtattgcttacagagcttatgatcttgaaggcaagacagtgggaactgttggggctggacgtattggtaggcttttgctccagcgattgaagcctttcaactgtaatctcctctatcatgatcggattaaaatggacccagaattggagaatcagataggagcaaagtttgaagaggatgttgatgtgatgcttcccaaatgtgacataattgtcatcaacatgcctcttactgaaaaaacaaaaggaatgttcaacaaagagaggattgcaaagttgaaaaagggagttctaattgttaacaatgctcgaggagcaatcatggatacacaagctgttgccgatgcatgctccagtgggcatattgcaggttacagtggggatgtttggtatccacagccagcccccaaggaccatccatggcggtacatgccaaaccaagctatgacccctcatatttctggcaccaccattgatgcacagttgcgatacgcagctggagtgaaggacatgctagacaggtacttcaagggagaagactttccggcacaacattacatcgtcaaggagggccaactagcaagccagtaccagtaataattcagtgtttgtgttgtggacactgtcttctacttgagttcatttccttccattaggatgaataaataaatgtatggaagatgctttgtggttccttggttctcttttggttggaaatgcttagagctgtttgggggtgaacctttgatggttgtaatctgttctaatgctttatgagatgcaagttgttttctatcttgatcaaatattgata

SEQ ID NO: 1556 - DNA, 1417 bp, Ambrosia trifida
gggcccgacgtatctaacgaccacgaggtaacgcgggggacgtgtccactttgttaactaacactactccaaactaacactcattccgatcatcgtcttcccaacaaactccgacgccgacgatggcgatgtcaatggcgatgaagcgttctgccgtcgctgcaactcgtgctctaatctcatcatcctcatccatcctaaccagagaccttcatgcttcttcggggaaaaagaagattgtaggtgttttctacaaagcacatgagtatgctaagatgaaccctaattttttgggctgtgtagagaatgcgttgggcattcgcgactggttagaatcacaaggccatgagtacatagtcactgatgacaaagagggacccgactgcgaactagagaagcatattcctgatgcacatgttattataaccactccattccaccctggctacataaccgccgaaaggattaaaaaagcaaagaatctgcaacttttgcttacagccgggatcgggtctgaccatgttgatctcaaggctgctgctgatgccgggttaaccgttgcagaggttaccggaagcaatgtcgtttctgttgcagaagacgaacttatgagaatcctcattcttgttcgcaatttcttacctggctaccaccaggttattagtggagattggaatgttgcaggtattgcttacagagcttatgatcttgaagggaaaaccgttggaacagttggttgtggacggattggcagacttttacttcaaagattgaaaccatttgggtgcaatcttctgtaccatgatcgtattaagatggactcggaattggagagtcaaattggtgccagctatgaggaagatcttgataagatgctccccaaatgtgacatagttgtcatcaacacacctttgacggagaaaaccaaaggaatgtttgacaaagaaaggattgctaaattgaaaaaaggggttctcattgttaacaatgctcgaggagctattatggacacgcaagctgttgctgatgcctgttctagcggacacattggaggctacagtggagacgtttggtatccacaaccagctccaaaggatcacccatggcgatatatgccaaatcaggccatgacccctcacatttctggaaccaccattgatgcacagttacgatatgcggctggagtgaaagatatgctggataactatttcaaaggagaagacttcccagcccagcattacattgtgaaggagggtgaactggctagccagtaccgttgatccgcccagttctagtagtcgctgttttgaataagttatgctgagctggagctgatagaaaagtctttggttttatcacgttgtaacagtgaggtgcggttatggtaaactgaatggctatgaatttctattggttt

SEQ ID NO: 1557 - DNA, 1504 bp, Fagopyrum esculentum
gtcatgcagatgaggatttacattcatcatttctttctctcctcctcgtgttcgtctacaaattcgtttcatttgtgaagaacttacacaacagcattaggaagaaacaatggcgatgaaacgagttgctacctccgccctcaaagctttctctgctacttctgtcaattcgctttcctcatcctcttctcttcttgccagggattttcatgcttcaggtgggagcaaaaagattgttggtgtcttttacaaggcaaacgagtatgcatcgatgaacccgaactttgtaggttgtgttgaaggagccttaggcataagggagtggcttgagtcgcagggacaccagtacattgtcaccgatgataaagaagggcctgattgtgaactagagaagcacattgatgatctccatgttcttataacaacaccatttcatccagcctacgtcacagctgaaaggatcaagaaagccaaaaacctgcaattacttctaacagctgggatcggctctgatcatattgacctgcaggctgcagctgcatctggactgacagttgctgaggtgacaggaagcaacgttgtatctgttgctgaagatgaactgatgagaatcctaattcttgtcaggaacttcgtacctggttaccagcaagtaattaacggggaatggaatgtggcaggaatagcttaccgagcttatgacctcgaaggaaagactgttggaactgttggagctggaaggattggcaggcttttacttcagaggctgcaacctttcaactgtaatctgttgtatcatgacaggatcaggatggaccctgaactggagaaccaaactggtgcaaagtttgaggaggatctggaaaagatgcttcccaaatgtgatgtaattgtcatcaatatgcctcttactgagaaaactaggggtatgtttaacaaggaaacaattgcaaagctgaagaagggagtcttgattgttaacaacgcccgtggtgcaattatggatgcccaagctgttgctgatgctatttcaaatgggcaaataggaggctatagtggtgatgtctggtaccctcaaccagctccaaaggatcacccatggcgaaccatgccaaaccatgcaatgaccccacacatttcaggcaccaccattgatgctcagttgcgctatgctgcaggggttaaggacatgctggacaggtacttcaaaggagaagatttccctccacagcattacattgtgaaggagggtcaactagcaagccagtaccgctaagctttttgcttcttgcttcgatctgctgatgcgctatttacttgttcgaatgtcaagagtcttcttcaaagcctaataatgccagtgacaaggttcgaaatgttggtattttgagattagtctcatgaattattgttcctggggtgaagggtgtccttgtgatttccatgttggtagtattaccaccaaaaatttatcgtgtactgatacatgttctttgatgtttaa

SEQ ID NO: 1558 - DNA, 1344 bp, Linum usitatissimum
cctgaagcgagctgctacttctgccacccgcgcttttgcttcttcctcctctggatctctctccagacacctccacgcttctgctgggagcaagaagatcgtcggagtgttctacaaggccaatgagtacgcagagaagaaccccaatttcctcggttgcgctgagcacgctttgggcattcgcgaatggcttgaatctcaaggccaccactacatcgtcaccgatgacaaagacggtcccaactccgagctggagaagcacatccccgatcttcacgttctaatatccacaccattccatcccgcctacgtcaccgctgaacggatcaagaaggccaagaacctgcagctccttctcaccgccggaatcggatccgatcacatcgatctgccggcggcggctgccgccgggtcgaccgttgcggaggttaccggaagcaatgtggtttcggtggctgaggatgagctcatgaggattcttatcctgatgaggaacttcttgcctggtcatcaccaggtgatcaatggggagtgggatgttgctggtatagcttacagggcttatgatcttgaagggaaaactatcggtaccgttggctgtggacggattgggaagcttttgctccagaggctgaaaccttttggctgcaatctgctttatcatgacaggctgaaaatggagccggagctcgagactcagattggagctaagtttgaggaggatgttgatgccatgcttcccaaatgtgatgtggttgtcatcaacactccgctaactgagaagaccaaaggaatgttcgacaaagataggattttgaagatgaagaaaggagtactgatcgtgaataatgctcgaggggcgattatggatacacaagcagttgttgatgcttgctccagtggacatattggaggttatagtggggatgtttggtatccgcagccggcaccaaaggaccatccatggcgatacataccgaaccaggcaatgactccgcatatctctggcaccaccattgatgcacaactgaggtatgctgctggagtgaaggatatgctggatagatacttcaagggagaagattttccgccgcagcattacatcgtcaaggaaggcaagctggcaagccagtaccagtgatgatctcttttcttctgcaactatgataataacccgaatagcaatgtgtgtcggtctagaagagccgtttcgtgtcatgtagccggtgatgagtgtccatggacctgcaatctgctgcaactttcattcatggtcaatgagaaataatcagaaccgtcaaaaagactaaatttttatgaagaaaaagaagcttatccctgccg

SEQ ID NO: 1559 - DNA, 1606 bp, Populus trichocarpa
caatcagtcgagattatcccttcccgtgtatagaagaagaaaaagtttgccacgtcattcccgaccccatccctgacctctctccctctatataatacacatcctacttcagttcaccctcacatctcaaggtttcagctcaaataacaacaaaaataacaatggccatgaagcgtgctgctacctctgcaattcgcgctttctcgtcttcatcaccagcatcatctgtgagttctggctcctcaactaggcttctccatgcttcggcagaaagcaaaaaaattgttggggtgttttacaaagcaaatgagtatgcttcattgaatcctaattttgtgggttccttggaaggagctttgggcattcgtgactggctggaatcacaaggccaccagtacattgtcactgatgacaaagaaggactggattctgaacttgaaaagcatattcctgatctccatgtgctcattactacccctttccaccccgcctatgtaacggcagaaaggatcaagagggcaaaaaatctgcaactgcttctcactgctggaataggctctgatcatatagatttggaggcagcagctgctgctgggttaactgttgcagaggtcacaggaagcaatgtcgtctcggttgcagaagatgagctcatgagaatccttattcttgtacgaaatttcttacctggatatcatcaagttatcaatggggagtggaatgtggcagctatcgcctacagagcttatgatcttgaaggaaagacagtgggaactgttggtgctggacgcattggaaagcttttactccagaggttgaagcctttcaattgcaacctactgtatcatgacagacttaagatggatccagaattggagaaacagacaggggcaaagtttgaggaggatcttgattcattgctttctaaatgtgacgtagttgtcatcaacacgccgcttacagagaaaacaagagggatgtttgacaaagaaaggattgcaaagatgaagaaaggagttcttattgttaacaatgcccgaggagcaatcatggacactcaagcagttgttgatgcttgctccagtggacagattggaggttacagtggagatgtttggaatccgcaaccagctcccaaggaccatccatggcgttacatgccgaaccatgcaatgaccccccatatttctggaaccactatagatggacagttgcgatacgccgccggagttaaggacatgcttgacagatacttcaagggagaagaatttcctccacagaattacattgtgaaggagggcaaactggccagtcagtacctgtgatgcagagcacaaggtctatgaataatgaatgtatctttagagaggtctctagttttccctgagaaatcaataagagagttgtaataagagaatttatgacggtgatgatctcatctacaacctcgtgataaacatgcgtgtacccatcttaattcagcttttttggctgctagtggattggctttcgtttgactccctcctttttttcataacaactccgtgctcgattttctgtgattcttgatgtttcaactgtggaaaatatatatatatatatatat

SEQ ID NO: 1560 - DNA, 1437 bp, Helianthus annuus
aactctctctccacaccaacattcatttcgatcatcatcttccaacaaactccggcaacggcgatggcgatgtcaatggcgatgaagcgttctgccgccgctgcaactcgtgctctttcctctgctacttcctcctccatcctaaccagagatcttcactcttcttcagggaaaaagaagattgtgggtgttttctacaaggcacacgagtacgctaagatgaatcctaattttatgggctgtgtagagaacgcattgggcattcgcgactggttagaatcacaaggccacgagtacatagtcactgatgacaaagagggacccgattgtgaactagagaaacatattcccgatgcacacgttatcataaccactccattccaccctggctatatcaccgccgaaaggattaaaaaagcaaagaatctgcaacttttgttgacagctggaatcgggtctgatcatgttgatctcaaggctgctgctgacgctgggttaactgttgccgaggttaccggaagcaacgttgtttccgttgcggaagatgaacttatgagaatcctcattctcgttcgcaacttcttacctggataccatcaggttattaatggggattggaatgttgcgggtattgcttaccgagcttatgatcttgaagggaaaaccgttggaaccgttggttgtggacggattggtagacttttacttcaaaggttgaagccgttcgggtgcaatcttttgtaccatgatcgtattaagatggacccggagttggagaatcaaatcggtgcaagctatgaggaagatcttgataaaatgctcccgaaatgtgacgtagttgtcatcaacacacctttaacagagaaaaccaaaggaatgtttgacaaagaaaaaattgctaaaatgaaaaaaggggttctcattgttaacaatgctcgcggagctataatggatacacaagccgttgctgatggctgttctagtggtcacatcggaggctatagtggagatgtttggtacccacaacccgctccgaaagatcacccatggcggtatatgccaaatcaggctatgacccctcacatttctggaacaaccattgacgcacagttgcgatatgcggctggagtgaaagatatgctggagaattatttcaagggagaagactttccggcccagcattacattgtgaaggagggtgaactggcaagccagtaccgttgatctgtccggttcgaatagtatgtagttgtggttttgaataagttatgttgagttggagcttttagaaaagctttggtttttatcactttgtatcagtgaggtgtggttatgccgttatatggtaaactgaatggcaagaatttctatggtttttgtgatgtttgactgactacaaatgtcaatcaatggttcttatgacctgttatgaaattt

SEQ ID NO: 1561 - DNA, 1396 bp, Tripterygium wilfordii
tcaggagtcgaacttttcggtttcgaattcggaattctcagttgacggcgatggcgttgaagcgtgttgcgagctctgttattcgtgctcttggttcatcatcggccggattagactcttcgattactctcacgaggagtctccatgcctctgcaggaggcaaaaagattgtgggggtgttctacaaggcaaatgaatatgcttcactgaatcctaattttgtgggttctgctgaacgagccttgggcattcgtgaatggctggaatcgcaaggccacgaatacattgtcactgacgataaggaaggaccaaactgtgaacttgagaagcatattcctgatctccatgtccttataactacccccttccaccctgcctatgttacggcggagaggatcaaaaaggccaaaaatttgcaattgctcctcacagccggaatcggctccgatcatgttgatctgaaggcagccgcagctgctggattgactgttgcagaggttactggaagcaatgtcgtgtctgttgctgaggatgaactcatgaggatcctcattcttgttcggaattttgtacctggacaccagcaggttatcaagggagaatggaatgtggctggtattgcatatagagcatatgatctcgaggggaaaacggtgggaactgttggtgctggacgtattggcaagcttttactccaaaggttgaagcctttcaactgtaatctcctctatcacgaccggttgaagatggatccagaattggagactcagataggagcaaagttcgaggaagaccttgatggcatgcttgccaaatgtgacgtagttgtcattaacacgcctctcacagagaagacaagggggctgtttgacaaagctaggattgcaaagatgaaaaaaggggtgctaattgtcaacaatgctcgtggagcaatcatggatactcaggcagtggttgatgcttgctccagcggacatattgcaggctacagtggagatgtctggaacccacagcctgctccaaaggaccatccatggcgttacatgccaaaccaagctatgactcctcatatttctggtaccaccattgatgcacagctgcgttatgctgctggaaccaaggacatgctcgaaaggtacttcaagggagaagaatttcctccacagaattacattgttaaggagggcaaaatagcgccacaataccagtgatttttgtctgtctggacatcgtatcgtcagcagtgtcttttagtaatggggtttcttggagtcttgagttttctttttcttcagtcagtatcaaaaatgtcctaagtgcggcttttgtccctttaaataaaatcgtctcagcttatgttatcagaaactacctttgatcacttcttggagttata

SEQ ID NO: 1562 - DNA, 1420 bp, Manihot esculenta
aagaagacacatctatcccttttccctgtaaaatccctctcaatttcttctcctcctttttcaattcactgtagctctcgactctccagctcaaaaatggcgatgaagcgtgctgctacctctgcaattcgcgctttcccctcatcttttgggatctctggctcttctgctctcggtagacacttgcatgcttctgcagggagcaaaaagattgtgggggttttctacaaggccaatgagtacgctgcaatgaatcccaatttcttggggtgtgcggagggagctttaggcatacgtgagtggttggaatcaaaaggccaccgatacattgttactgatgacaaagaagggccagactgtgaacttgaaaagcatatccctgatctccatgtcctcataactacacccttccaccctgcctatgttacggcagaaaggataaaaaaggccaaaaatttgcaactgcttctcacagctggaattgggtctgaccatatagatctgaaggcggcagctgacgccgggttaactgttgcagaggtgacaggaagcaatgttgtctcagttgcagaagacgagctcatgagaattcttattcttctcaggaatttcttgcctggatatcatcaggttattaatggggaatggaatgtagctggtatcgcctacagagcctatgatctggaaggaaagacagtgggaactgttggtgctggacgcattggtaggcttttgctccagcgtttgaaaccttttaactgtaatctcctctatcatgatcgacttaagatggaccctgaattggagaatcaaactggggcgaaatttgaagaggatctcgatgcaatgcttcccaagtgtgacataattgttatcaacacacctcttacggagaagacaagggggttgtttaataaagataagattgcaaagatgaagaaaggggttctcatcgttaataatgctcgaggagcaattatggatacacaagcagttgttgatgcttgctcaagtggacagattggaggatatagcggggatgtttggtatccacaaccagctccaaaggatcatgcatggcgttatatgccaaatcaagctatgacccctcatatttctggaaccaccattgatgcacaattgcgatatgcagctggagtgaaggacatgcttgatagatacttcaagggagaggaatttcctctacagaattacattgtgaaggaaggtaaaatagcaagtcaatatcagtgatctgttttcaaggtcctagaataatgtaaccttcatagaggttccaagtttttcttgagaaaaaacaatgagtatgctgtatcgactgaacttaagatggttatgatccatctgcaacttcgtgcatatatcagtatcttgtatgtgagataaaaatttccccttt

SEQ ID NO: 1563 - DNA, 1690 bp, Malus domestica
ctaaaaaccagacagattaggtggagtggagttggatgatgaagagagtccctgagctctcggttcattcgtttattataaataaatgggcagaaaccttttggcttttgtgttgcacacaacacagagctttctctttttaattatttctcagtttttaataaatttcaaaatattttagtttcaaggttcatcggttggcaaccaattagcaggaaatttttaagaatccatggcgatgaagcgtgtgcttgtttctgcagttcgaggtcttgcttcatcaggaagctcagcatcttcaacaactttcaccaggcacctccatgcatctggtggaagcaaaaagatagttggggtgttttacaaggccaaggagtatgcagaattgaaccccaattttctgggttgtgaggaaagggccttggggataagggactggctggaatcacagggccacaagtatattgtcactgatgacaaggaaggaccaaattgtgaacttgacaaacacattgaagatcttcatgttctcataacaacgcccttccacccggcctatgtcacggccgaaaggataaaaaaggccaagaatttgcagctgcttctaacagctggaattggctctgatcacattgatctgaaagctgctgctgctgctggattaaccgtggcagaggtcacgggaagcaatgtggtttcggttgcagaagatgagctcatgagaatcctcattctcgtccgcaacttcgtacctgggtatcagcagattgttagtggggaatggaatgttgcaggcattgcctacagagcttatgatcttgaaggaaagacggtggggacggttggtgctggacgtattggcaggcttttgctccaaaggttgaagcctttcaactgcaatctcctctatcatgatcgtgtcaagattgaccccgaattggagaaacagaccggggcaaagtttgaggaggatctggatgcaatgcttccgaaatgtgacgttattgttgtcaacacaccccttactgaaaaaacaagaggactgtttgacaaagaaagaattgcaaaatgtaagaagggagttctgattgttaacaatgctcgtggggcaatcatggacacgcaggctgttgtcgacgcttgctccagcggacacattgcaggttacagtggtgatgtttggaatccacaaccagctccaaaagaccatccatggcgttacatgccaaaccatgctatgacccctcatatatccggtaccacaattgatgcgcagttgcgttatgctgctgggacgaaggatatgctcgacaggtacttcaagggagaagaatttccggcacaaaactacattgtcaaggacggtaaactagcaagccaataccagtagttcgggtgcttgttattaagtctgctactttgtgttcgcttgcagatgctatgaggcaggtccatatgaataatgtagccaaaagccttcgactttagggtctgtgtgcttttatcttcttcgttttcaccggttgtatagccgtatagggcaccggtttgatccgagcatgcatcaccatgtctctgtgagacttgtaagagtttatgctgccgggaaactttccctttcaataatgaaaagttgtaactttaattagcgagtttgctcaaaacccgtaagaaacttgttcaaatgttt

SEQ ID NO: 1564 - DNA, 1316 bp, Cirsium arvense
atcgatggccatggcgatggcgatgaagcgtgctgctgctactgcaattcgtgctatttcctctgctaattcctctgcttccattctcaccagacaccttcatgcttctgccgagaaaaagaagattgtaggtgttttctacaaggcacatgagtatgccgagatgaaccccaattttttgggctgtgcagagaatgcgttgggcattcgtaactggttggaatcacaaggccacgagtacatagtgaccgacgacaaagagggaccagattgtgaactagaaaagcatatttctgatatgcatgtccttataaccaccccattccatccggcctatgttactgctgaaaggattaaaaaggcaaagaatttgcagctgttgcttaccgccgggattggatccgatcacgttgatctccaggcggctgctgctgctggattaactgtagcggaggttaccggaagcaatgttgtttctgtagcagaagacgaacttatgaggatcctcattctcgttcgcaatttcttgcctggacaccatcaggttattaccggggattggaatgttgcaggtattgcttacagagcttatgatcttgaagggaaaactgtaggaacagttggttgtggacgtatcggtaggctgttacttcaaaggttgaagccttttggctgtaatcttctctatcacgatcggattaagatggacccggaattggagaatcaaattggtgccagttatgaggaagatcttgataagatgcttcccaaatgtgacataattgtcatcaatacccctttaacagagaaaactaaaggaatgtttgacaaagaaaggattgctaaattaaagaagggtgttttgattgttaacaatgcgcgaggagctatcatggatacacaagctgttgttgatggctgttctagtggacacattggagggtatagcggagatgtttggtatccgcaaccagctccaaaggatcatccatggaggtacatgccaaatcaagccatgacccctcacatatccggaaccaccatcgatgcacagttgcgatatgctgctggagtgaaagatatgctggagaattatttcaagggagaagacttcccggcccaacattacattgtgaaggaaggtgaactggcaagccagtaccggtaatctgtgttccaattgtgtcaactgatgcatgcttcttaataagttgagttgagttgagctcttaaaagtgtatcttatgaccttgtaatagtaaggtgtagttatggctaaaaaactgaattggcatcaatagaatatggtaatcttt

SEQ ID NO: 1565 - DNA, 1513 bp, Cucurbita pepo
ttttggcaactataaatattccacacgcgaaagctattagcatcatcatcactcacgggtccctaatttacacacagaagagagaaaaggacgacgataatggcgatgaagcaggcagctacagcagcgattcgagctttttcttcctctgtaccttctcagtcatcacctctcgtcaggcaccttcatgcttctgcagggagcaagaagatcgtcggtgtgttttacaaggctaatgagtatgctgctatgaaccctaatttcgtgggatgtgtggagggatccttgggcatacgcgaatggttggaatctcaagggcatcagtatatagtcactgatgataaggaaggactcaattgtgagcttgaaaagcacattccagatctccacgttctcataacaactcccttccatcctgcctacgtaactgctgaaaggatcaaaaaagccaaaaacttggagttgcttctcacggctggaattgggtctgatcatgttgacctcaatgcagcagctgcagctggactgacagttgccgaggttaccggaagcaatgtggtttcagttgcagaggatgagctaatgagaattctcattctcgtcaggaatttcctaccaggacaccaccaggttattaaaggtgaatggaatgttgctgggatagctcacagagcttatgatcttgaggggaagacaattgggaccgtaggtgctggacgaattggaaaacttttactccaaaggctgaaacctttcaactgcaatctcctctatcacgaccgactcaagattgaccctgaacttgagaagcagattggagcaaagtttgaggaggacatggatgcaatgctaccaaaatgcgatgtacttgtcatcaacactcctctaactgacaagacaaggggattatttaacaaagagagaattgccaaatgcaagaaaggagtactaattgttaacaatgctcgaggagcaattatggacactgaagcggtcgttgacgcttgtaacagtggacacattggaggttacagtggtgatgtgtggaacccgcaaccagctccaaaagaccatccatggcgttacatgccaaaccaagccatgacacctcatatttctggcaccaccattgatgcacagttgcgatatgctgcgggagtgaaggacatgcttgataggtacttcaaaggacaggactttcctgctcaaaactacatcgtcaaggaaggagaacttgcccctcagtaccgctagttagtttggttctattctcactgtgccctctgtagagggctttgatttcctacagctcccttttagtcgacaattagttcccagaataaattggctgtgtgggagctaacttgggccttttaagtccgtcagtatctttgttagtctttttgtgtaatgaaaatgaatgcatctcatcataatgtaattccatctggaatggatatctatggtattgagggagtgaatttgaatacacagttttctttctcttcttctt

SEQ ID NO: 1566 - DNA, 1547 bp, Primula obconica
actgagggccatttacggggaaaaaccactttctttctccgactgtgatatatatatatatagagagagagagaggagagagagatggctatgaagcgagctgctgtttctgcaatccgtgttttgtcagtaaactcaactccgtcaatcctaaccactagacaactccacgcttctccggggagcaaaaagattgtaggtgtattctacaaggctaatgaatatgcttcgatgaatccaaatttcttggggtgtgaggaaaatgctttgggcatacgcaaatggctggaatcgcaaggccacaaatacatcgttacagatgacaaagaaggacccaactgcgaacttgaaaagcatatccctgatttgcacgtcctcataaccactcccttccatcctgcctacgtcacagcagagcgaataaaaaaagccaaaaatttgcaactcgtgctcacagccggaataggctcagaccacgtggacctaaacgccgctgctgctgctgggctaacagttgctgaggtcacagggagcaacgtggtatctgttgctgaagatgagctcatgagaatattaattcttgttcggaatttcttgcctggatatcaccaagttattaaaggagattgggatgttgctgctattgcttatagagcttatgatcttgagggaaaaactgttgggactgttggtgctgggcgtataggcaagcttttgttacagaggttgaaaccttttaattgtaatcttttgtatcacgataggcttaagatggatgctgagttggaggctcagacgggggcgaagtttgaggaggatcttgataagatgctcccaaaatgtgacataattgtcatcaacatgcctcttacggacaaaacaaaagggatgtttgacaaagaaaagatttccaagctgaagaagggagttcttatagtgaacaatgctagaggtgctatcatggatacacaagcagttgtcgatgcctgttccagtgggcacattgcaggttatagtggtgatgtttggtacccacaaccagctccaaaggaccatccatggcgctacatgcccaatcaagccatgactcctcacatatctggcaccaccattgacgcgcagttgcgttatgcggctggaaccaaggacatgctggacaggtacttcaagggagaagagttccctgcacagaactacatagtcaaggagggtgaactcgcaagccagtatcgttaaacgagtattttatagaccctcgaaaaactagccgcttatccaatgtattaaataatttactatttcaagaattctgagtgttttgaagcctttcatagtcaaggagggtgaactcgcaagccagtatcgttaaacgagtatattttatagatccttgaaaaaactagcctgcttatccaatgtatgaaataatgtactatttctggaattctgagtgttatatcgagcaaaaataacatgttctcttgtaacatggtgacgttagtttcgatgtgtcaaaattgttctgttttaagcatgatgagtcacag

SEQ ID NO: 1567 - DNA, 1433 bp, Flaveria ramosissima
ggataattattattgacttatttaaaggggacgatgagatacgtacgacacttgtaagtcgaaagcatttttcattttgcatttttcgatcatcttcatcggaatttcaaaggaacaccggcgacggcgacggcgacggcgatggcgatgtcaatggcgatgaagcgatctgcagccactgcaactcgtgctatctcctctgctatttcaaactccattctaaccagagaccttcatgcttcttcagggaaaagaagattgtaggtgttttctacaaggcacatgagtatgcacagatgaaccctaattttcttggttgtgtagagaatgcgttgggcattcgcaactggttagaatcacaaggccatgagtacattgtcactgatgacaaagagggacctgattgcgaactagaaaagcatatccctgatgcacatgttattatcaccaccccgttccaccctggttatatcactgctgaaaggatcaaaaaagcaaagaatttgcagcttctgcttacagctgggatcggttctgatcatgttgatctcaacgctgctgctgctgctgggttaactgttgcagaggttacaggaagcaatgttgtttccgttgcagaagatgaacttatgagaatcctcattcttgttcgtaatttcttacctggataccatcaggttattactggagattggaatgttgcaggtattgcttacagagcttatgatcttgaagggaaaactgtcggaacagttggttgtggacgaattggtagacttttgcttcaaagattgaagccattcgggtgcaatcttctgtatcatgatcgtataaagatggaccccgaaatggagggtcaaattggtgccaaatttgaggaagatcttgataagatgcttcccaaatgtgacatagttgtcatcaacacgcctttaacagagaaaaccagaggaatgtttgacaaagaacgtattgctaagatgaaaaaaggagttctcattgttaacaatgcccgaggagctataatggatacgcaagctgttgctgatggctgttctagtggacacattgcaggctatagtggagacgtttggtttccacaaccagctccaaaggaccatccatggcggtacatgccaaatcaggctatgaccccacacatttctggaactaccattgacgcgcagttgcgatacgctgctggagtgaaaggtatgctggagaattatttcaagggtgaagactttccagcccagcattacattgtgaaggagggtgaacttgctagccagtaccgttgatctgactaccggaccgacacacgcctcggtagttgtgttgtttgaataagttatgttgggctggagctattagaaaggctttggttgtatcaccttgtaacagtgaggtgtggttatggtaaactgaatggt

SEQ ID NO: 1568 - DNA, 1401 bp, Arnica chamissonis
gagacgacatttgtaactctggaaagcattcatttcgatcatctttctcgagtctgtcttcatccgaatttccgaggaacaccggcgacgacgatggcgatgtcaatggcgatgaagcgtgctgctggccctgcatctcgtgctatttccgcctcgattctaaccagagaccttcacgcttcttcgggaaagaagaagattgtaggtgttttctacaaggcacacgagtatgctcagatgaaccctaattttgtgggctgcgtagagaatgcattgggcattcgcaactggttagaatcacaaggccatgagtacattgtcactgatgacaaagagggacctgattgcgaactagaaaagcatatttctgatgcacatgtcattataaccaccccattccaccctggctatatcactgctgaaaggattaaaaaagcaaagaatctgcaacttttgcttacagctgggattggttccgatcatgttgatctcaaggctgctgctgatgcagggttaactgttgcagaggttaccggaagcaatgttgtttctgttgcagaagatgaacttatgagaatcctcattcttgttcgtaatttcttacctggataccaccaggttattaccggggattggaatgttgcaggtattgcttaccgagcttatgatcttgaagggaaaactgttggaacagtgggttgtggacgaattggtagacttttacttcaaagactgaaaccatttgggtgcaatcttctgtaccatgaccgtctaaagatggacccagaattggagagtcaaattggtgccaaatttgaggaagatcttgataaaatgcttcccaaatgtgacatagttgtcatcaacacacctttaacagaaaaaaccaaaggaatgtttgacaaagaacggatcgcaaaaatgaaaaaaggggttctcattgttaacaatgctcgaggagctataatggatacgcaagctgttgttgatggctgttctagtggacacataggaggctatagtggagatgtttggtacccgcaaccagctccaaaggatcatccatggcggtatatgccaaatcaggctatgacccctcacatttctggaaccaccattgatgcacagttgcgatatgcggctggagtgaaagatatgctggagaattatttcaagggagaagacttcccggcccagcattacatcgtgaaggagggtgaactggcaagccagtaccgttgatccgaccctacccgacctgttactagtcgtggttttgaataagttatgttgagctgctgctgttagaaacgcttcggttttatcaccttgtaatattgaggtttggttatggtaaacttaatggctatgaatatctatggtttttatggtgtcggtaaa

SEQ ID NO: 1569 - DNA, 1495 bp, Theobroma cacao
ggtgggtaacttcgcaactggcaactgattgttttgcctataaaaaggacgagtgtggttcagctttaacaagatcgatatacagatcacttcaattattactttcaactcctcatagcatatcctgtgtcagtttcaactgtttttgagaaatggctatgaagcaagttgctagctctgctatcaaagccttggctaattctgggtcatcttctgttcttaccagacaactccatgcttctccagggagcaaaaagattgttggtgtgttttacaaggccaatgagtattacgaaaagaatcccaactttgttggttgtgtggagggagccttgggcttgcgtgagtggctggaatcacagggccaccagtatattgtcactgatgacaaagaaggacccgattgcgaactcgaaaagcatatccctgatctccatgtcctcatatccacccccttccacccagcctatgttacagcagagaggatcaagaaagccaaaaacttgcaactgcttctcacagcggggattggctctgatcacgtagatctgaaggcagctgcagaagctggcttgactgttgctgaggttacaggaagcaatgtagtgtctgttgccgaagacgagctaatgagaattcttattcttgtccggaatttcttgcctggccaccaccaagttattactggagattggaatgttgcaggtattgcttacagagcttatgatcttgaagggaagacggtgggaactattggtgcagggcgtattggcaggctcttactccaacgactgaaaccattcaactgcaatctcctatatcatgatcgagtcaagatagacccagaattggagaagcagactggagcaaaatttgaggaggatcttgatgcaatgcttccaaagtgtgacataattgtcataaacatgcctcttacagagaagacaagagggatgttcgacaaagataggattgcaaaattgaagaagggagtcctgattgttaacaatgctcgaggagcaattatggacacacaggcagttgcagatgcttgctcaagtggacacattgcaggttacagtggagatgtctggtatccacaaccagctccaaaggaccatccatggcgtttcatgccaaatcaagctatgacacctcatatttctggtaccaccattgatgcacagttgcgatatgctgctggagtcaaggatatgcttgacaggtacttcaagggtgaagaatttcctgcacaaaattacattgtcaaggaaggtgaactagctcctcagtaccgatgatttgtacttcttgtgcaagaatctgaatgtatcttatgtcagtcaataaggtccttttgaaatttcgtactgtttagtggttcaatatttcctttttggagcagagtcctctgcaaataatgtactgctgtggtgttgtacactttctgttttgaaacagaaacaaagtcgtaatgagttaacttttgatggtt

SEQ ID NO: 1570 - DNA, 1409 bp, Ricinus communis
acagctcaaaaaatatcacttcctttctttaaaattcacgtctctctctgttttctgcttctaaaaaatggcgatgaagaaagctgctgcctccgcaatttgcgccttggcttcatcatccacctcttcagctttctctagacacctccacgcttctgcagggagcaaaaagattgttggggtattctacaaggccaatgaatatgcttcaatgaatcccaatttttccgggtgtgcagagggagctttgggaattcgtgactggctagaatcacaaggccaccaatatatcgtcacagatgacaaagaaggaccacattgtgaacttgagaagcatattcctgatctccatgtcctcattacaactcccttccacccagcctatgttacagccgaaaggattaaaaaggcaaagaacctgcaattgcttctcacagctggaattggctctgatcatatagacttgaaggctgcagctgaagcaggattaactgttgcagaggtcacgggaagcaatgttgtctcagttgctgaagacgaacttatgagaattcttattcttgtccggaatttcttacctggataccatcaggttattagtggagactggaatgtggcaggtattgcatacagagcctatgatcttgaaggaaagacagttggtactgttggtgctgggcgcattggtaggcttttgctccaacgtttgaaacctttcaattgtaatctcctctatcatgatcgtattaagatggacccggagttggagaatcagacgggggcaaaatatgaggaggatcttgatgcaatgcttccaaaatgtgacatagttgtcattaacacacctcttacagaaaagacaaggggactgtttaacaaagatcggattgcaaagttgaagaaaggggtgcttattgttaacaatgctcgaggagcaatcatggatacacaagcagttgctgatgcttgctctagtggacatattggaggttatagtggggatgtttggtatccacaaccggcttcgaaggaccatccatggcgctatatgccaaatcaagcaatgactcctcatatttcaggaaccactattgatgcacaattgcgatatgctgctggagttaaggacatgcttgacagatactttaagggagaagaatttcctctacagaattacatcgtcaaggaaggcaaactggcaagtcaatatcagtgagctgtctagaggtgcagcatctgaggtcctggaataatgtaccgttatagagagattcagagtcttccatgagaaaataatgactatgctgtaaccagtgaacttttgatggctataattactataaccttgtgatttatgcaagaaacagtatattgttattgtatgataataactttcctctttggcgaca

SEQ ID NO: 1571 - DNA, 1513 bp, Ricinus communis
ggcgaagaaaaacttggccacgtcatcaactttcctatataaattcttaccattaggaacacgaaaaaaacacagctcaaaaaatatcacttcctttctttaaaattcacgtctctctctgttttctgcttctaaaaaatggcgatgaagaaagctgctgcctccgcaatttgcgccttggcttcatcatccacctcttcagctttctctagacacctccacgcttctgcagggagcaaaaagattgttggggtattctacaaggccaatgaatatgcttcaatgaatcccaatttttccgggtgtgcagagggagctttgggaattcgtgactggctagaatcacaaggccaccaatatatcgtcacagatgacaaagaaggaccacattgtgaacttgagaagcatattcctgatctccatgtcctcattacaactcccttccacccagcctatgttacagccgaaaggattaaaaaggcaaagaacctgcaattgcttctcacagctggaattggctctgatcatatagacttgaaggctgcagctgaagcaggattaactgttgcagaggtcacgggaagcaatgttgtctcagttgctgaagacgaacttatgagaattcttattcttgtccggaatttcttacctggataccatcaggttattagtggagactggaatgtggcaggtattgcatacagagcctatgatcttgaaggaaagacagttggtactgttggtgctgggcgcattggtaggcttttgctccaacgtttgaaacctttcaattgtaatctcctctatcatgatcgtattaagatggacccggagttggagaatcagacgggggcaaaatatgaggaggatcttgatgcaatgcttccaaaatgtgacatagttgtcattaacacacctcttacagaaaagacaaggggactgtttaacaaagatcggattgcaaagttgaagaaaggggtgcttattgttaacaatgctcgaggagcaatcatggatacacaagcagttgctgatgcttgctctagtggacatattggaggttatagtggggatgtttggtatccacaaccggcttcgaaggaccatccatggcgctatatgccaaatcaagcaatgactcctcatatttcaggaaccactattgatgcacaattgcgatatgctgctggagttaaggacatgcttgacagatactttaagggagaagaatttcctctacagaattacatcgtcaaggaaggcaaactggcaagtcaatatcagtgagctgtctagaggtgcagcatctgaggtcctggaataatgtaccgttatagagagattcagagtcttccatgagaaaataatgactatgctgtaaccagtgaacttttgatggctataattactataaccttgtgatttatgcaagaaacagtatattgttattgtatgataataactttcctctttggcgacaatggtttgtgcttggacatgtattacttgaaat

SEQ ID NO: 1572 - DNA, 1603 bp, Solanum phureja
gttgaagcaggtcgcttctaagtactgggccttcgcccttccctataaaaaggcaatacgtctctccagtgagtcatctcagccaactggagtgtattcttctctctgtttttagcaagtacaaaaccctttgctgtaaatccaaaaaattccgatggcgatgagtcgtgtagcttctacagcagctcgggctattacttcaccttcatccttagtttttaccagagaacttcaggcttcccctggccccaaaaagattgtgggtgttttctacaaagcaaatgaatatgctgaaatgaaccccaactttttgggctgtgcagaaaatgccttggggatacgtgaatggttagaatctaaaggtcatcagtacatagtcactcctgacaaagaaggaccagattgtgagcttgagaaacacattcctgatctccatgtgttgatttcgaccccttttcatcctgcctatgtcacggctgaaaggatcaagaaggcaaaaaatctacaactactgctgacagctggaattggatcagatcatgttgatctgaaagcggctgctgctactggattgacagtagcagaggtcactggaagcaatactgtctcagttgcggaagatgaactgatgcgaatcttaattcttgtccgaaatttcttgcctggacatcatcaggttatcaatggggagtggaatgttgctgcaattgcgcacagagcttatgatttggaaggcaagactgttggaactgttggtgcaggacgtattggcagacttttactccaacgattgaagccatttaactgtaatctactttaccatgaccgtcttaagatggattctgagctagagaatcaaattggagcaaagttcgaggaagatctcgataagatgctctcgaaatgtgacatagtggtcatcaatacgcctcttacagagaaaacaaaaggaatgtttgacaaggaaagaattgcaaagttgaagaagggagttctaattgtaaacaatgctcgaggagcaattatggaaactcaagcagttgttgatgcttgtaacagcggtcatattgcaggatacagtggagatgtttggtacccacaaccagctcccaaggaccatccatggcgctacatgccaaaccaagctatgactcctcacatttctgggactaccattgatgcacagttgaggtatgcagctggaacaaaggatatgttggacaggtatttcaagggtgaggatttccctgctgaaaattacattgtcaaggatggggaattggcacctcagtatcgctaaattattaatgtacaccttagagttgtgtctagatttctgtgtcaaataaactggcaagctgcgtcttcaataagctgataaaattggctacttatgttcttttagaactgtaatgcagtttttctccggttggctgtatcgtaacgtttgtgatggaaacatgtcctcttctgtgatggaggttaatgtatgatcctccagtgtctttcttgagtctataactgaacttccttgctatggtagttgtactggtgttgtcctggacattttatgattaaaaaaaagattatcttctctttgcta

SEQ ID NO: 1573 - DNA, 1673 bp, Mimulus guttatus
cacaatctctctcgcctcttcttttgcctataaaaaggcagcagagtcccaacagttcacaatacttatatcaccacctgcaccctgcggttctctgcaattcctctcttttcttctcctgaaatcggttctctaatttttacaaaattaagatggcgatgaagcgtgctgctgtttctgcagttcgtgcttttacttcttcagggaaccccgccccttcagttctagcccgcggccttcacgcttcacccggaagcaagaagattgtgggcgttttctacaacgcaaacgagtatgcttcgatgaatcccaatttcctcggttgtgttgagaatgctttgggtatacgtgactggttggaaactcagggtcacgagtacatcgttactgccgacaaagatggcccacatagtgagctcgagaaacacatgtccgatctccatgtgctgattagtaccccattccacccggcatacgtgacagccgagagaatcaaaaaggcaaaaaatctgcagcttctgctcacggctggaattggctcggaccacattgacctcaaggcggctgccgctgctggattaacagtggcggaggtcaccggaagcaacgttgtctcggtagctgaagatgagctgatgaggattctcatcctcgttcggaatttcttgcctgggcaccatcaggtgattaatggtgaatggaatgttgcagccattgcccaccgagcttatgaccttgaaggtaagactgtcggaacagttggcgccggaagaatcggccgacttttgctgcagaggctgaagcctttcaactgtaatctgttgtaccacgatcgccttcagatggacgctgagctggagagtcaaatcggggcaacctacgaggaggatctagatgctatgcttccgaaatgtgacatcatcgtcattaatacgcctctcactgagaaaaccaaagggatgttcgacaaagagaggatagcgaagcttaagaagggagttttgatcgtgaacaacgctagaggtgcgattatggacacgcaagccgttgtcgatgcttgttcgagtgggcatatagcaggttacagtggagatgtgtggtacccgcagcctgcaccgaaggatcacccttggaggtacatgccaaaccaagctatgacccctcatatatcgggaactacaattgatgcacaacttcgttatgctgctggagtgaaagacatgttggagtgttatttcaagggggaggattttccggaacaaaactacattgtcaaggacggagaattggctagccaatatcgctagatgtgctttcgcccgagtgtcgattctgccatctccgactaatgccagatctaatgagttgctatttaaataaaaaaagaacatgacttttgttcgggtgtgtaatttcttgttttaagttgactcaaactttggaattaaccttgatgcatatggatttccagttctttttgtgcatgtgttggttgtgtttgtaatcacatatatgataattagtattaatcttgtttaaataatatttttgctcattcctcattaaaaaattaaaacaattcattttctgttgtacttgtattttggaaacataatagtattttatcagacaaattttaaataatttatagatactgctttcaagattttttt

SEQ ID NO: 1574 - DNA, 1609 bp, Humulus lupulus
acccaaatcaacctcttctttcttccttcctgtctttcttactcctaaaatattatagtaatggcgatgaagcgtgtggccgtctctgcatttcaagctctttcttcttcatcatcatcatcatcacccctcactaggcacctccatgcttctgctggcagcaaaaagattgttggggtcttctacaaggccaatgactatgctaagctcaaccccaattttgtgggctgcgcagagggagccttgggcatccgggactggctggaatcacaaggtcatcagtacattgtcactgatgacaaagaggacctggctgtgaacttgagaaacatattcctgatctggaagttcttataactactccattccaccctgcctatgtaacggctgaaaggattaagagggcaaagaacttgaagcttgttcttactgctggtattggttctgaccatgttgatctgaatgcggctgctgctgctggattaacagttgctgaggtgacaggaagtaatgtggtttcggtagctgaggatgagctcatgagaatcctcattcttgtccggaacttcgtacctggtcatcatcaggttatcaatggggattggaatgttgctggtattgcttacagagcttatgatctggaaggaaagacggtgggaactgttggtgctggacgtatcggcaagcttttacttcaacggttgaagcctttcaactgtaatttgttgtatcatgacagactcaagatggactctgaattggagaaggaaataggggccaagtttgaggaggatcttgataccatgcttcccaaatgtgacatagtcgtcatcaacatgcctcttactgacaaaacacgaggaatgtttgacaaagagagaattgcaaagtgtaagaagggagtcctgtttgttaacaatgctcggggtgcgatcatggacacacaagcagttgttgatgcttgctccaatggacacattgcaggctacagtggtgatgtttggtacccacaaccagctccgaaggaccatccatggcgttacatgccaaaccaagctatgactcctcatatttctggcaccacaattgacgcacagttgcgatatgcggatggagtgaaggatatgctcaataggtacttcaagggagaagatttcccagcacagaactacattgtcaaggaaggtgaactggccagccagtaccgatgatcagcggcatgtgagtctacttgtttttgagtctcttcactgctgacataataaaaaaaccagaatggtcatcagataatgtctactttctggaagctccaaactgttgtgttagtaataaaagtctgaactcattatgaggatagtgtttacttgatggtcaatagaccctcaattttatttctgtagtttcgcgtttgaagtgttttgagtctagtttttgcatatgttatgtgttttgtctgtgtgtctgtatttgcctacctaactgggtggaaggaataaacttttcttgaagttgtctaacaacgacaatgtcttaaaacgacgaagtttctagatttgatgaacgatgaccttgccaatgccaattatcgtaaaaggccaaattttacccg

SEQ ID NO: 1575 - DNA, 1586 bp, Amsonia hubrichtii
gtaaactacacagacaagatagtaacatagtagagggaagccagtataaggactctactattactatatctctacatagtcgtcactcttcttacataatttgccttgatctcatcgccgagtgcacatatctctgctaatttgacgggtatcaagagtgagattcagatttcagggagagatggcgatgaagcgggttgctgcctctgcgattcgtgcctttgcttcttccggggattcaagttttctcacccgaaaccttcatgcttctcccggtagcaaaaagattgtcggtgtcttctacaagggaaatgaatatgctgcgatgaatcccaattttcttggctgcacagagaatgcattgggcattcgggactggttggagtcacagggtcacgaatacatagtcactgcagacaaagaaggacctgattgtgaacttgagaaacatattcctgacctccatgtgttgataaccacgccttttcatcctgcctatgtcacggctgaaaggattaaaaaggcaaagaatttgcaactattgctgacagctggaattggttcagatcacattgatctcaaagctgcagcagatgctgggttaacagttgcagaggtcactgggagtaatacagtctctgttgcagaagatgaacttatgagaatcctcattcttattaggaattttttgcctggataccatcaagctatcactggagattggaatgttgcaggtattgcttacagagcttatgatcttgaaggcaagactgttggaactgttggggcaggacgtattggcaggctcttgttacagaggttgaagccttttaattgtaatctactatatcatgatcgcattaagatggaaccagaattggagaatcagataggggcaaaatttgaggaagatcttgatgccatgcttcccaaatgtgacataattgtcatgaatacacctcttacagagcaaacaaaagggatgttcaacaaagagaggattgctaagctaaagaagggagtactgattgtaaataatgctcgaggtgctctcatggacacgcaagcagttgtggatgcttgttccagcggacatattgcaggttacagtggagatgtatggtatccacaaccagctccaaaggaccatccttggcgttacatgccaaaccatgctatgacccctcatgtttctggcactaccattgatggacagctgcggtatgctgctggggttaaggacatgctggacaaatacttcaaaggagaggatttccctgctcaaaattacattgtcaaggatggagaactagcaagccaatacaaataaatcatgattccatgttgactgcaggccatcgagaggatatatgctgaataaattagcatccatggttcttgtttctttctgaaaagaaacgtaatgcttttaaaagtagctttactagtatgatccagtataatagtgaggctgaattgctttttcttttttctggtcaggaaaagatgaaggcgaattagtagtgctagtactggatccttttaactttttattctgctatgtactattggaagtcctccaatag

SEQ ID NO: 1576 - DNA, 1438 bp, Cirsium arvense
tctgactgtcacagacacttgtcttctctcagtcttgccttcctcccaattcactactatcccacacagacaaccggcgatggcgatgaagcgtgccgctgccactgcagttcgtgctatttcctctgctaattccggttcgattctcaccagacagcttcatgcttctgctgagaaaaagaagattgtaggtgttttctacaaggcacatgagtatgctgagatgaaccccaactttttgggttgtgcagagaatgcattgggcattcgcaaatggttggaatcacaaggccatgagtacatagtcaccgatgacaaagagggaccagattgtgaactagaaaagcatatttctgatatgcatgtccttataaccaccccattccatccagcctatgttactgctgaaaggattaaaaaggcaaagaatttgcaactgttgcttaccgctgggattggatctgatcatgttgatctccaggctgctgctgctgctggcttaactgtagcagaagttactggaagcaatactgtttctgtagcagaagacgaacttatgaggatcctcattcttgttcgtaatttcttgcctggacaccatcaggttattagtggggattggaatgttgcaggtattgcttacagagcttatgatcttgaaggaaaaactgtaggaacagttggttgtggacgtatcggtaggcttttacttcaaaggttgaagccttttggctgtaatcttctctatcatgatcgtattaagatggaccaagaattggagaatcaaattggtgctaagtttgaggaggatcttgataagatgcttcccaaatgtgacataattgtcatcaacacacctttaacagagaaaactaaaggaatgttcgacaaagaaaagattgctaaactaaaaaagggggttctaattgttaacaatgctcgaggagctatcatggatacacaggctgttgtagatggctgttctagtggacacattggagggtatagcggagatgtttggtatcctcaaccagctccaaaggatcacccatggaggtatatgccaaatcaagccatgacacctcacatatctggaaccaccattgacgcacagttacgatatgctgctggagtgaaagatatgctggagaattatttcaagggagaagacttcccggcccaacattacattgtcaaggaaggtgaactagcaagccaataccggtaaatccaaaagctctgtgttccaatttagatgcatgctttttaataaagttcagttgagctcctaaaagtgtaatttaccaccttgtaatatataatactaaggtggtgttatggcatcaatgaatttggatcttttttctttaatggtgtaccttatagttatttggatctcttgggaagtagtaaccaatctaaggttttacaataaaca

SEQ ID NO: 1577 - DNA, 1458 bp, Zingiber officinale
aaagctttcgtctccttcaatttggtttctgattcctcgatttgattagggttatggcgatgttgagggcggcgaagcatgcgatgagagcgctgggatcgagggctccggatgcgtcgcctttcgctaggatgctccatgcttctactgggagcaagaagatagtcggagtattctataaagccaacgagtatgcatcaatgaatcccaagtttgttggttgcgtggaaggatccttaggcatccgggactggcttgaatctcaaggccaccaatatattgtcactgacgataaagaaggcccgaattgtgaacttgagaaacatattcctgatatgcatgttcttataacaaccccatttcatccggcatatgttactgaagagaggataaagaaggccaaaaacttgcaacttcttctgactgctggaattggctcagatcacattgatctgaaagctgcagctgcagctggattgacagttgcagaagtcactgggagcaatacagtctctgttgcagaggacgagctgatgcgaatccttatccttgttcggaacttcttacctggatatcatcaggtgattaatggtgactggaatgttgcagctattgcctacagggcttatgatcttgaaggcaagactgtcggaactgttggtgctggccgcatagggaagcttctgctccagcgtttgaagcctttcaactgcaatttgctctatcatgaccgcctcaagatggaacctgacttagagaaagagatcggggctaagtttgaggaagatcttgataaaatgcttcccaagtgtgacgttattgttataaacactcctcttacagagaaaaccagaggattgtttaacaaggaaagaatcggaaagctgaagaaaggagtccttattgtgaataatgctcgaggtgcaatcatggacactcaagcagtagcagatgcttgttccagtgggcacattgctggttacagtggcgatgtttggaatccgcagccagctcccaaggatcatccatggaggtacatgccaaaccatgccatgacaccccatatttctggcactactattgacggtcaactgagatacgcagctggaaccaaggacatgctggatagatacttcaagggacaagacttcccagcccaaaactacattgtcaaggaaggaaagctagcgagccaataccagtgaaaataaaactcccaatgccggacagtctgttctcggccttttttctgaaaataaatccctatggatgaatctgtttgtcatcttaaaaatgtttatctgggaatcttgtgaaaccttcatgaattcatgttcgctattaacgcggctgcttgtgtttgcaattcaaaactatgagcttctaatttatgctcttgcttgtgaaatgtttcggatgtgagttgataatttttattataattcaattagccaagga

SEQ ID NO: 1578 - DNA, 1377 bp, Linum usitatissimum
ccacgcgtccgccaaaattaccaccaacaatggcgatgatcgctaccctgaagcgagctgctacttctgccacccgcgcttttgcttcctccccctctggatctctctccagacacctccacgcttctgctgggagcaagaagatcgtcggagtgttctacaaggccaatgagtacgctgagaagaaccccaatttcctcggttgcgccgagcacgctttgggcattcgcgactggcttgaatctcaaggccaccactacatcgtcaccgacgacaaagacggtcctaactccgagctggagaagcacatccccgatcttcacgttctcatatccacaccattccatcccgcctacgtcaccgccgagcggataaaaaaggccaagaatttgcagctccttctcaccgccggaatcggatccgatcacatcgatctgccggcggcggctgccgccgggttgaccgttgcggaggtcaccggaagcaatgtggtttcggtggctgaggatgagctcatgaggattcttatcctgatgaggaacttcttgcctggccatcaccaggtgatcaagggagaatgggatgttgctggtatagcttacagggcttatgatcttgaagggaagactattggtaccgttggctgtggaaggattgggaagcttttgctccagaggctcaaaccttttggctgcaatctgctttatcatgaccggctgaaaatggagccggagctcgagactcagattggagctaagtttgaggaggatgttgatgccatgcttcccaagtgtgatgtggttgtcatcaacactccgctaactgagaagaccaagggaatgtttgacaaagaaaggatttccaagatgaagaaaggagtactgatcgtgaacaatgctcgaggggcgattatggatacacaagcagttgttgatgcttgctccagtggacatattggaggttatagtggggatgtttggtatccgcagccggcaccaaaggaccatccatggcgatacatgccgaaccaggcgatgactccacatatatctggcaccactattgatgcacaactgaggtatgctgctggagtgaaggacatgctggatagatacttcaagggagaagatttcccaccgcagcattacatagtcaaggaaggcaagttggcaagccagtaccagtgatgatctctggtcttctgcaactatgataataacccgaatagcaatgtgtgtcggtctagaagagtcgtttcgtgtcatgtagccggtgatgagtgtccatggacctgcaatcttttgcaactttcattcatggtcaatgagaaataatcagaaccgtcaaaaagactaaatttttaagaagaaaaagaag

SEQ ID NO: 1579 - DNA, 1502 bp, Manihot esculenta
acattgctaatttctcatttacttgcctcaatttcttcttccattgtatctctccatctcaagattggccatgaggcgtgcagctatctctgcgattcgctctttcacgtcatcttccaggatttctggttctcccgcgatctctagggacttgcacgcttctgcagggagcaaaaagattgtgggggttttctacaaggcgaatgagtatgctgcaatgaatcccaattttttggggtgtgcagagggagctttaggcatacgtgattggttggaatcacagggtcaccgatatattgtcactgatgacaaagaaggaccacactctgaacttgaaaagcatattcctgatctccatgtcctcgtaagcacacccttccaccccgcctatgttaccgcagaaaggattaaaaaggccaaaaacttgcaactgcttctcacagctggagttggctctgatcatatagatctgaaggctgctgctgctgctgggttaactgttgcagaggttacaggaagcaatgttgtctcagttgcagaggatgagctcatgagaattctcattcttgtccgaaatttcttacctggatatcgtcaagttattaatggggaatggaatgtagcaggaattgcttacagagcatatgatattgaaggaaagacagtaggaactgttggtgctggacgcattggtaggcttttgctccaacggttgaaacctttcaattgtaatctcctctatcatgatcgacttaggatggaccctgaattggagaatcagacaggagcaaaatttgaagaggatcttgacgcaatgcttcccaaatgtgacataattgtcatcaacacacctcttacagagaagacaagggggttgtttaacaaagataggattgcaaagatgaagaaaggggttctcattgtaaataatgctcgaggagcaatcatggatactcaagcagttgtcgatgcttgctctattggacatattggaggttatagtggggatgtttggcatccacaaccagctccaaaggaccatccatggcgttatatgccaaatcatgctatgacacctcatatttctggaaccaccattgatgcacaattgcgatatgcagctggagtgaaagacatgcttgatagatacttcaaaggagaagaatttcctccacagaattacattgtgaaggacggtaaaatagcaagtcaatatcagtgagctgtgcctttatataggttccagttttccatgtcgtaactcggaaacttccgatggttataatccatctgcaactccatgatctatctatttatatatgtgtcgcatgaattatgattgtgtcaatggacgtgtgatttccattaatttgaacttttgggatctgtttggcaatggatgcaaaatggaatcatgttatttgtgtgaattttgataatggtgcatggatagtctgtatgcagttatgctcgagtctctcaaatacaataatatctaaatc

SEQ ID NO: 1580 - DNA, 1490 bp, Triphysaria pusilla
aacatttctcctgtataaagctttcatcaattatcacgccatcgttcagtacaccagtgaccctacctacgattctcttcaatttctttgtcttactcctaacagtaatcctaattttcgaagctcgataaaagtgaagatggcgatgaagcgtgctgttgcctctgcagttggtgcaattacttcatcaggaaacccagcttcttcagttctggccagataccttcatgcttcacctggcagcaagaagatcgttggtgttttctacaaggcgaatgagtatgcctcgatgaaccccgatttcgtgggatgtgccgagaacgcgttgggcattcgcgagtggttggaatccaaaggtcaccactacatagttactccggacaaggacgggccagactgcgagcttgagaaacacatacccgatctccatgtgctgatatcaacccccttccacccggcttatgtgacggctgaacgaatcaaaaaggcgaaaaatctacaactcctgcttactgccgggattggctcggaccacatcgatctccaggctgcagccgatgctggactaacagtggcagaggtcacaggaagcaatgtcgtctcagttgccgaagatgaactcatgaggattctcatactcgtccgtaatttcttgcccggacaccatcaggttattaacggtgactggaatgttgcagctattgctcacagagcttatgatctcgaaggaaagactgttgggacagttggagctggacgcattggccggcttttactacagaggttgaaacctttcaactgcaatctgttgtatcatgatcgccttaagatggaaccggagctggagagtgagataggagcgaaatttgaggaggatcttgatgcgatgctgcctaagtgtgacataattgtcatcaacacgcctcttactgagaaaaccaaagggatgttcgacaaagataagatcgcgaagctgaaaaagggagttttgattgtgaacaatgctagaggtgcaatcatggacacacaagccgttgttgatgcttgctccagtgggcatattgcaggttacagtggagatgtttggtacccacagccagccccgaaggaccacccttggcgatacatgccgaaccaagctatgacccctcatatctctggaacgaccattgacgcacagttgcgttatgctgctggagtgaaggacatgctggagcggtatttcaagggcgaagattttcctccacagcattacattgtcaaggacggagagctggctagccagtatcggtagatttgctgcttcgccaagtgtttgattcggaggtctacgagtgttgcagtatgtagtaaccaaataaagcaaccttggtctgtttatttctaaataatctacgtccttgtaagaactgcacctagtatgcagctgttggatggaacttgaaaatgccaataaaacaaatgctttcgcccatgtttatgggtagaaa

SEQ ID NO: 1581 - DNA, 1508 bp, Aquilegia formosa
tatccatccaaattggattttgcttcttgatagctagctatatttataaaaggggagtgtgatagctagtctgaacagtcaaaacaacacacaacacaagtgagagaaaatggctacgaggaaagcagttgttttgggtgctcaaagtttgttaagatcatcatcaacatcttcaccttcaatcaggaatctccatgcttcttctgaaagtaagaagatcgtgggggtattttacaaggccaacgaatatgcgtcaatgaatcccaactttgtcggttgtgcagaaggggctttgggtatccgagattggttagaatctcaaggtcatcagtacattgtcactgacgacaaagacagtcctaactctgaactcgagaaacatattcctgacctccatgttttgatatctactcccttccatccggcgtatgttacagcagagaggatcaagaaggctaagaatttacaacttcttctcactgctggaattggctctgaccatattgatttgaaagctgcagcagctgctggattgactgttgcagaggttactggaagcaatgtggtgtcagtagctgaagacgagctgatgagaatactcattcttgtccgtaatttcgtacctggttacaaacaggtgatcactggagactggaatgttgcagcaattgctcatagagcttatgatcttgaagggaagacagtggggacagttggtgctggacgtattggcaggcttttgcttcaacggttaaagcccttcaattgtaacctattatatcatgatcgggtgaagatggattctgatctggagagtcaaacaggggcaaagtatgaggaggatcttgatgcaatgcttcctaagtgtgacataattgtcattaacatgcctttaacggaaaaaactgcggggatgttcaacaaagaaaaaatagctaagttaaagaaaggagttttgattgtcaacaatgctcgaggagcaatcatggatactcaagcagtggctgatgcttgctcaagtggtcatattgcaggttacagtggggatgtttggtttccacaaccagctccaaaggatcacccttggcgttatatgccaaatcaggcgatgacaccgcatatttctggcaccaccattgatgctcagttgaggtatgcagctggagttaaggacatgttggataagtactttaaaggcgaagattttccagcacaaaattatatcgtcaaggaaggggaattggcaagtcagtaccgataatctgttggcttcggatgggtatataatcgaatgtcacttttcatgcgaataaaaaggaactcacttgagagttccaaatctatgtaatagagttacagtcagttattttggaaatgtccaaagacttgtcattagattgaaaaatgcaggagttcattaagcaatactgtatgtttatttgaccccaagtttgactatgtttccaacttttcactgctggttacatttgagaaaatctgaattctcc

SEQ ID NO: 1582 - DNA, 1512 bp, Primula obconica
tggctatgaagcgagctgctgtttctgcaatccgtgtttgtcagtaactcaactccgtcaatcctaaccactagacaactccacgcttctccggggagcaaaaagattgtaggtgtattctacaaggctaatgaatatgcttcgatgaatccaaatttcttggggtgtgaggaaaatgctttgggcatacgcaaatggctggaatcgcaaggccacaaatacatcgttacagatgacaaagaaggacccaactgcgaacttgaaaagcatatccctgatttgcacgtcctcataaccactcccttccatcctgcctacgtcacagcagagcgataaaaaaagaccaaaaatttagcaactcgtgctcacagccggaataggctcagaccacgtggacctaaacgccgctgctgctgctgggctaacagttgctgaggtcacagggagcaacgtggtatctgttgctgaagatgagctcatgagaatattaattcttgttcggaatttcttgcctggatatcaccaagttattaaaggagattgggatgttgctgctattgcttatagagcttatgatcttgagggaaaaactgttgggactgttggtgctgggcgtataggcaagcttttgttacagaggttgaaaccttttaattgtaatcttttgtatcacgataggcttaagatggatgctgagttggaggctcagacgggggcgaagtttgaggaggatcttgataagatgctcccaaaatgtgacataattgtcatcaacatgcctcttaccgacaaaacaaaagggatgtttgacaaagaaaagatttccaagctgaagaagggagttcttatagtgaacaatgctagaggtgctatcatggatacacaagcagttgtcgatgcctgttccagtgggcacatagcaggttacagcggtgatgtttggtacccacaaccagctccaaaggaccatccgtggcgctacatgccaaatcaagccatgactcctcacatctctggcaccaccattgacgcgcagttgcgttatgcggctggaaccaaggacatgctggacaggtacttcaaaggagaagagttccctgcacagaattacatagtcaaggagggtgaactcgcaagccagtatcgttaaacggtgtattttctagattctcgaaaaactagcccgcttatccaatgtattaaataatttactatttcaaaaattctgagtgttttgaagcctttcatagtcaaggagggtgaactcgcaagccagtatcgttaaacgagtatattttatagatccttgaaaaaactagcctgcttatccaatgtatgaaataatgtactatttctggaattctgagtgttatatcgagcaaaaataacatgttctcttgtaacatggtgacgttagtttcgatgtgtcaaaattgttctgttttaagcatgatgagtcacaatttcgcttgagccgattgagtttgagtggccatagaaagtttaatctca

SEQ ID NO: 1583 - DNA, 1471 bp, Flaveria ramosissima
aatatggacaaattgatgagcaccacacttctgtagcgtaacgcagggaaagaagcagattctaggtctgaagcgcggtcgagagcatttttcattttgcatttttcgatcatcttcatcggaatttcaaaggtacaccggcgatggcgatgtcaatggcgatgaagcgttctgcagccactgcaactcgtgctatttcctctgctatttcaaactcgattctaaccagagaccttcatgcttcttcggggaaaaagaagattgtaggtgttttctacaaggcacatgagtatgctcagatgaaccctaattttcttggttgtgtagagaatgcattgggcattcgcaactggttagaatcgcaaggccacgagtacattgtcactgatgacaaagagggacccgattgcgaattagaaaagcatatccctgatgcacacgtcatcataaccaccccgttccaccctggttatatcactgctgaaaggatcaaaaaagcaaagaatctgcaacttctgcttacagctgggattggttctgatcatgttgatctcaacgctgctgctgctgctgggttaactgttgcagaggttacaggaagcaatgttgtctccgttgcagaagacgaacttatgagaatcctcattcttgttcgtaacttcttacctggataccatcaggttattactggagattggaatgttgcaggtattgcttacagagcttatgatcttgaagggaaaactgtgggaacagttggttgtggacgaattggtagacttttgcttcaaagattgaagccattcgggtgcaatcttctgtaccatgatcgtataaagatggaccccgaaatggagaatcagattggtgccagctttgaggaagatcttgataagatgcttcccaaatgtgacgtagttgtcatcaacacacctttaacggataaaaccaaaggaatgttcgacaaagaacgcattgctaaaatgaaaaaaggggttctcattgttaacaatgcgcgaggagctataatggatacgcaagctgttgctgatggctgttctagtggacacattgcaggctatagtggagacgtttggtttccacaaccagcgccaaaggaccatccatggaggtacatgccaaatcaggctatgaccccacacatttctggaaccaccattgacgcgcagttgcgatatgctgctggagtaaaaggtatgttggagaattatttcaagggtgaagactttccggcccagcattacattgtgaaggagggtgaattggcaagccagtaccgttgatctgactaccggaccgcctgctcacctcagtagtcgtgctgtttgaacttcgaataagttatgttgagctggagctgttagaaaagctttggttgtatcaccttgtaatagtgaggtgtggttgtgataaactgaatggttatggatttctatggtttttatgatgt

SEQ ID NO: 1584 - DNA, 1608 bp, Malus domestica
gggaaataataaaaaaataagcatcgaggtgatgaagaggagagaagccgagagggactgagctctctttttatttgcttgtctataaataaatgggcagaaagctttgagttgcagacaatttttaagcatcatctggcaaaccaattagcagggaaagcttaagaatccatggcgagtaagggtgtgattgcttctgcagttcgagctcttgcttcatcaggaagctcagcatcatcaacaactttcaccaggcacctccatgcatctggtggaagcaaaaagattgttggggtgttttacaaggcaaatgagtatgcagaattgaaccccaattttctgggttctcaggagagggctttggggataagggactggctggaatcacagggccacgagtatattgtcactgatgacaaggaaggaccaaattgtgaactagagaaacacattgaagatcttcatgttctcataacaaccccgttccaccctgcctatgtcacggctgaacggatcaaaaaggccaagaatttggaactgcttctaaccgctggaattggctctgatcacattgatctgaaagctgcagctgctgctggtttgacagtggcagaggtcacgggaagcaatgtggtttcggttgcagaagacgagctcatgagaatcctcattctcgtccgcaacttcgtacctgggtatcagcagattgtaaccggggaatggaacgttgcaggtattgcccacagagcttatgatctcgaaggaaagacggtggggacggttggtgctggacgtattggtaggcttttgctccaaaggttgaagcccttcaactgcaatcttctctatcatgatcgcgtcaagattgaccccgaattggagcaacagactggggcaaagttcgaggaggatctggatgcaatgcttccgaaatgtgatgttatcgttgtcaacacaccacttactgaaaaaacaagaggactgtttgacaaagaaagaattgcgaagtgtaagaagggagtcctgatcgttaacaatgctcgtggagcaatcatggacacgcaggctgttgtcgatgcttgctccagcggacacattgcaggttacagtggtgatgtttggaacccacaaccagctccaaaagaccatccatggcgatacatgccgaaccatgctatgacccctcatatatccggtaccacaattgacgcacagttgcgttatgctgctgggacgaaggatatgcttgacaggtacttcaagggagaagaatttccagcacaaaactacattgtcaaggacggtaaactagcaagccagtaccagtagttcggtgcttgtgatgaagtctgctacttcgtgttcgcttgcagacgccaacgatgatgtagctccatatgaataatgtagccaaaagctttcgactttagggtctgtgcacccaatgtttttatcttctttgttccaccggttgtatagccgtatagggcaccggtttaatctgagcatgcgttactatgtctctgtgagacttgtgagagtattttccctttcaataataagaacttgttactgttctagttcataaatggaagagcattaacggaa

SEQ ID NO: 1585 - DNA, 1561 bp, Malus domestica
gaagaggagagaagccgagagggactgagctctctttttatttgcttgtctataaataaatgggcagaaagctttgagttgcagacaatttttaagcatcatctggcaaaccaattagcagggaaagcttaagaatccatggcgagtaagggtgtgattgcttctgcagttcgagctcttgcttcatcaggaagctcagcatcatcaacaactttcaccaggcacctccatgcatctggtggaagcaaaaagattgttggggtgttttacaaggcaaatgagtatgcagaattgaaccccaattttctgggttctcaggagagggctttggggataagggactggctggaatcacagggccacgagtatattgtcactgatgacaaggaaggaccaaattgtgaactagagaaacacattgaagatcttcatgttctcataacaaccccgttccaccctgcctatgtcacggctgaacggatcaaaaaggccaagaatttggaactgcttctaaccgctggaattggctctgatcacattgatctgaaagctgcagctgctgctggtttgacagtggcagaggtcacgggaagcaatgtggtttcggttgcagaagacgagctcatgagaatcctcattctcgtccgcaacttcgtacctgggtatcagcagattgtaaccggggaatggaacgttgcaggtattgcccacagagcttatgatctcgaaggaaagacggtggggacggttggtgctggacgtattggtaggcttttgctccaaaggttgaagcccttcaactgcaatcttctctatcatgatcgcgtcaagattgaccccgaattggagcaacagactggggcaaagttcgaggaggatctggatgcaatgcttccgaaatgtgatgttatcgttgtcaacacaccacttactgaaaaaacaagaggactgtttgacaaagaaagaattgcgaagtgtaagaagggagtcctgatcgttaacaatgctcgtggagcaatcatggacacgcaggctgttgtcgatgcttgctccagcggacacattgcaggttacagtggtgatgtttggaacccacaaccagctccaaaagaccatccatggcgatacatgccgaaccatgctatgacccctcatatatccggtaccacaattgacgcacagttgcgttatgctgctgggacgaaggatatgcttgacaggtacttcaagggagaagaatttccagcacaaaactacattgtcaaggacggtaaactagcaagccagtaccagtagttcggtgcttgtgatgaagtctgctacttcgtgttcgcttgcagacgccaacgatgatgtagctccatatgaataatgtagccaaaagctttcgactttagggtctgtgcacccaatgtttttatcttctttgttccaccggttgtatagccgtatagggcaccggtttaatctgagcatgcgttactatgtctctgtgagacttgtgagagtattttccctttcaataataagaacttgttactgttctagttcataaaaaaaa

SEQ ID NO: 1586 - DNA, 1386 bp, Valeriana officinalis
ccattgacggctaatcatcttttcacaacatctaattcaactcacacagagaaaccatggcgatggcgttaaagcgtgctgcttcttccgtcggttcttcgttcctcgccaggcaccttcatgcttctagtggaaacaagaagatagtaggggtattctacaaagcaaatgaatatgctgcaatgaatcccaattttgtcggttgccaagaaaatgctttgggtattcgtgattggctcgaatctaaaggccacgaatacattgtcactgatgacaaagaaggaccggattgtgagcttgagaaacatattccagatcttcacgtccttataacaactccgttccatccggcctatgtaacagctgaacggatcaagaaagccaaaaaccttcaacttcttttaacggctgggatcggttcagatcacgttgatctacaggctgcagctgcagctggcctaactgtggccgaggtcactggtagcaacacagtatcagttgctgaagatgagctaatgagaatcttaattcttgttcgcaactttctacctggtcatcatcaagttattaacggagaatggaatgtagctgcaattgctcacagagcttatgatcttgaaggaaaaacagttggaacagttggtgctggccgtatcggtaaactattactgcaacgattaaaaccttttaactgtaatttactttaccatgaccgtcttaagatggaacctgaattggagaacgagattggggcaaaattcgaggaggatcttgatgcaatgcttcccaaatgtgacatcatcgttatcaatacacctcttactgaaaaaactaagggtatgtttaataaggagaagattgctaaattgaagaaaggggttcttatcgtaaataatgctagaggagctataatggatactcaagctgttgttgatgcttgttctagcggtcatattgccggttacagtggagatgtttggtatccccaaccggctccgaaggatcatccgtggcgatacatgcctaaccaagccatgacccctcatatttctggcactacaatcgatgcacagttgcgatacgcggcaggggtgaaggacatgctagataggtacttcaagggcgaagagttccctgcacagcattacattgtcaaggaaggcgaacttgcgagccagtaccgttagattcgtgtttatgagaaagtatgcttacttttgaaataaataaatttaagaaacagtgttttcaatgttgttggaaagagctttgaacttttctatcttgtatctggactcatttgactgtaagctccatctatgcatttacagatttcatcttacatactgcatgtatattggttggaagttgaaaccataaatgtct

SEQ ID NO: 1587 - DNA, 1458 bp, Fagopyrum esculentum
gacacaacagcattaggaagaaacaatggcgatgaaacgagttgctacctccgccctcaaagctttctctgctacttctgtcaactcgctttcctcatcctcttcccttcttgccagggattttcatgcttcaggtgggagcaaaaagattgttggtgtctttttacaaggcaaacgagtagtgcgatcgatgaacccgaactttgtaggttgtgttgaaggagccttaggcataagggagtggcttgagtcgcagggacaccagtacattgtcaccgatgataaagaagggcctgattgtgaactagagaagcacattgatgatctccatgttcttataacaacaccatttcatccagcctacgtcacagctgaaaggatcaagaaagccaaaacctaacaattacttctaacagctgggatcggctctgatcatattgacctgcaggctgcagctgcatctggactgacagttgctgaggtgaacgggaagcaacgttgtctctgttgctgaagatgaactgatgagaatccttattcttgtaaggaacttcgtacctggttaccagcaagtaattaacggggaatggaatgtggcaggaatagcttaccgagcttatgacctcgaaggaaagactgttggaactgttggagctggaaggattggcaggcttttacttcagaggctgcaacctttcaactgtaatctgttgtatcatgacaggatcaggatggaccctgaactggagaaccaaactggtgcaaagtttgaggaggatcttgaaaagatgcttcccaaatgtgatgtacttgtcatcaatatgcctcttacagagaaaactaggggtatgtttaacaaggaaacaattgcaaagctgaagaagggagtcttgattgtgaacaacgcccgtggtgcaattatggatgcccaagctgttgctgatgctatttcaagtgggcaaataggaggctatagtggtgatgtctggtaccctcaaccagctccaaaggatcacccatggcgtaccatgccaaaccatgccatgaccccacacatttcaggcaccaccattgatgctcagttgcgctatgctgcaggggttaaggatatgctggacaggtacttcaaaggagaagattttcccccacagcactacattgtcaaggagggtcaactagcaagccagtaccgctaagcattttgcttcgatctgctgatgctctatttacctgtttgaatgtcaagagtcttcttctaagcttaataatgccagtgccaagctttgaaatgttggtattttgagattactctcatgaattattgttactggggtgaagggtgtccttgtgatttccatgttggtaatattaccaccaaaatttctcgtgtactactagtacatgttctttgatgtttaatggcatgtatgtttccaaattttatgcaacgcaattgca

SEQ ID NO: 1588 - DNA, 1185 bp, Cirsium arvense
accaccggcgatcgatggccatggcgatggcgatgaagcgtgcagctgccactgcagttcgtgctatttcctctgctaattccgcttccatcctcaccagacaccttcatgcttctgctgagaaaaagaagattgtaggtgttttctacaaagcacacgagtatgctgagatgaaccctaaattttttgggttgtgcagagaatgcgttgggcattcgtaactggttggaatcacaaggccacgagtatatagttaccgacgacaaagagggaccagactgtgaactagaaaagcatatttccgatatgcatgtccttataaccaccccattccatccggcctatgttactgctgaaaggattaaaaaggcaaagaatttgcagctgttgcttaccgccgggattggatccgatcacgttgatctccaggcggctgctgctgctggattaactgtagcggaggttaccggaagcaatgttgtttctgtagcagaagacgaacttatgaggatcctcattctcgttcgtaatttcttgcctggacaccatcaggttattaccggggattggaatgttgcaggtattgcgtacagagcttatgatcttgaagggaaaactgtaggaacagttggttgtggacgtatcggtaggctgctacttcaaaggttgaagccttttggctgtaatcttctctatcatgatcggattaagatggacccggaattggagaatcaaattggtgccagttatgaggaagatcttgataagatgcttcccaaatgtgacataattgtcatcaatacccctttaacagagaaaactaaaggaatgtttgacaaagaaaggattgctaaactaaagaagggtgttctgattgttaacaatgcacgaggagctatcatggatacacaagctgttgttgatggctgttctagtggacacattggagggtatagcggagatgtttggtatccgcaaccagctccaaaggatcatccatggaggtacatgccaaatcaagccatgacccctcacatatccggaaccaccatcgatgcacagttgcgatatgctgctggagtgaaggatatgctggagaattattcaagggagaagacttcccggctcaacattacattgtgaaggaaggtgaactggcaagccagtaccggtaatctgtgttcc

SEQ ID NO: 1589 - DNA, 1455 bp, Euonymus alatus
acaagtaaacaaaacaaactttgcaattattgtttcagcagtcgaaaggttacgaattcggaattcgatggcgatggcgttgaagcgtgttgcgagctctgctattcgtgcttttggttcatcatcggcgagattcgactcttcgattactctcacgagggacctccatgcctctgctggaggcaaaaagattgtgggggtgttctacaaggcaaatgaatatgctaaactgaatcctaattttttgggttccgctgaacgagccttgggcattcgtgaatggctggaatcgcaaggtcacgaatacattgtcactgacgataaggaaggaccaaactctgaacttgagaagcatattcctgatctccatgtccttataagtacccctttccaccctgcctatgttacagcagagaggatcaaaaaggccaaaaatttgcaactgctcctcacagccggaattggctcagatcatgttgacctcaaggcagcagcagctgctggattgactgttgcagaggttacgggaagcaacgtcgtgtccgttgcagaggatgaactcatgaggatcctcattcttgttcggaatttcgtacctggacaccagcagataatcacgggagaatggaacgtggctggtattgcttatagggcatatgatctcgaggggaaaacagtgggaactgttggtgctggacgtattggaaagcttttactccaaaggttgaagcctttcaactgtaatctcctctatcacgaccggttgaagatcgatccggaattggaaactcagctaggagcaaagtttgaggaagaccttgatgacatgcttgccaaatgtgacatagttgtcattaacacgccactcacagagaagacaagagggttgtttgacaaagctaggattgcaaagttgaaaaaaggggtgctgattgtcaacaatgctcgtggagcaatcatggatactcaggcagtggttgatgcttgctccagcggacatattggaggctacagtggggatgtctggaacccgcagcctgctccaaaggaccatccatggcgttacatgcctaaccatgctttgactcctcatatttctggtaccaccattgatgcacagctgcgttatgctgctggaaccaaggacatgctcgaaagttacttcaagggagaagaatttcttccacagaattacatcgttaaggatggcataatagcaccacaataccagtaatttattttcattgtgtctttcactggacatcatatcgtcagcagtgtcttgtggtgatggggtttctttgagcttgaggttttcattttattaagtctgtatcaagaatgtaacaagtgtggcttttgtccctaaaataaaatcgtctctgcatctgtgatcaatatttactgatcactttattttactggtaattgtgaatggaaggaagctaccttaat

SEQ ID NO: 1590 - DNA, 1561 bp, Coffea canephora
cggccgggggaaaaatggatgaagtgaggagtcgtcactcaccctcacagctcggaagcctgtagccactggccagtcacagaggtacagaaacaagagatcttagttggcgatccgcttactagaaaatataaaagttgcctcgatccggtcgatacatgcaagcaattttggttttaattaaggaggaattgagtggggtgaagtggcaagagtgagagatcagagatggcgatgaagcgtgtagctgcctctgcacttcgtgcttttacttcttcggggaattcaacttcatcacttctcaccagacgcctccatgcctctcctggtagcaaaaagattgttggtgttttctatgatgcaaaagaatatgctgcaaagaatcccaattttcttggctgcacagaaaatgcattgggtatccgccaatggctagaatcacagggccatcaatacatagtcacttcggacaaagaaggaccacattgtgaacttgagaaacatattccggacctccatgtgttgataactaccccatttcatcctgcatatgtcacggccgaaaggattaagaaggccaaaaatctgcaacttttgctgactgctggaattggctcagatcatgttgatctgaaagctgcagcagatgctgggttaacagttgcagaggtcactgggagtaacgttgtgtcggttgctgaagacgaattgatgagggtcctcattcttgttcgcaatttcgtgcctggacaccatcaagtcataagtggggattggaatgttgcaggtattgcttacagagcttatgatctcgaaggcaagactgtaggaactgttggtgctgggcgtataggcaggcttttgctgcagagattgaaacctttcaactgtaatcttctttatcacgatcggatcaagatggatcctgagttggagaatcaaactggagccaaattcgaggaagatctcgataagatgctgccaaaatgtgacataattgttattaatatgcctcttacagagaaaactagagggatgtttgacaaagataggatcgctaggctaaagaagggagttttgattgtaaacaatgctcgaggagcaatcatggacacacaagcagttgttgatggttgttctagcggacaaattggaggttacagtggggatgtttggaatccacaaccagctccaaaggaccatccttggcgttacatgcctaaccaagctatgaccccccatatttctggtactaccattgatgcacagatacgctatgcagctggagtcaaggacatgctggataggtactttaagggagaagatttccctccacaacattacattgtcaaggatggagagcttgcaagccagtatcgttgaataaaaaattagcttacgtagtttggtgtgtgcaataagtgtcaacttaggaagacgcatgcagaataatctggttggctattctagatcattcctaaaagatgtctaagaaattttgtgtgaaaaccatctctgtttggcttgaattcaaatcctgcacatagctcgattgatgatt

SEQ ID NO: 1591 - DNA, 1292 bp, Cirsium arvense
tggccatggcgatggcgatgaagcgtgctgctgctactgcaattcgtgctatttcctctgctaattcctctgctaattcctctgcttccattctcaccagacaccttcatgcttctgctgagaaaaagaagattgtaggtgttttctacaaagcacatgagtatgccgagatgaaccccaattttttgggttgtgcagagaatgcgttgggcattcgcaactggttggaatcacaaggccacgagtacatagttaccgacgacaaagagggaccagattgtgaactagaaaagcatatttctgatatgcatgtcctcataaccaccccatttcacccggcctatgttactgctgaaaggattaaaaaggcaaagaatttgcagctgttgcttaccgccgggatcggatccgatcacgttgatctccaggcggctgctgctgctggattaactgtagctgaggttaccggaagcaatgttgtttctgtggcagaagacgaacttatgaggatcctgattctcgttcgcaatttcttgcctggacaccatcaggttattaccggggattggaatgttgcaggtattgcatacagagcttatgatcttgaagggaaaactgtaggaacagttggttgtggacgcatcggtaggctgttacttcaaaggttgaagccttttggctgtaatcttctctatcatgatcgtattaagatggacccggaattggagaatcaaattggtgccagttatgaggaagatcttgataagatgcttcccaaatgtgacataattgtcatcaatacccctttaacagagaaaactaaaggaatgtttgacaaagaaaggattgctaaactaaagaagggtgttctgattgttaacaatgctcgaggagctatcatggatacacaagctgttgttgatggctgttcaagtggacacattggagggtatagcggagatgtttggtatccgcaaccagctccaaaggatcatccatggaggtacatgccaaatcaagccatgacccctcacatatccggaaccaccatcgatgcacagttgcgatatgctgctggagtgaaagatatgctggagaattatttcaagggagaagacttcccggcccaacattacattgtgaaggaaggtgaactggcaagccagtaccggtaatctgtgttccaattgtgtgtccaactgatggatgcttcttaataagttgagttgagttgagctctcaaaagtgtatcttatgaccttgtaatagtaaggtgtagttatggcaaaaac

SEQ ID NO: 1592 - DNA, 1478 bp, Euphorbia peplus
gaaatcaaaattagacacgtaatccaatctcctctcctgcctatatatatacatacatagacaccattgattaagaaaagaaaagaaaacatctacccattttctcctcctctatcaaattaaaaatggctgtgaggcgtgctggtgtctctgcaattcgtgctttatcatcatcttcatcgtcatcttctccgatctcagcctcaattctctctaggcatctccatgcttctgcagacagcaaaaagattgttggtgtattctacaaggcgaatgagtatgcttcaatgaatcccaattttgtggggtgtgcagagggaggtttgggcatacgtgactggctcgaatcgcaaggacaccaatacattgccactgatgacaaagaaggaccagattgtgaacttgaaaaacatattgacgatcttcatgtcctcataactactccgttccatccagcctatgttacagcagaaaggatcaagaaggccaaaaacttacaattgcttctcactgctggaattggttccgatcatatagatttgaatgcagctgctgctgctgggttgacagttgcagaagtgactggaagcaatgttgtctcggtcgcagaagatgagctcatgagaattcttattctcgtccgaaatttcttacctggataccatcaagttatcgctggagactggaatgtagcaggtattgcttacagagcttatgatcttgaaggaaagactgttggaacagttggtgctggacgaatcggtaaactcttgctccaacgtttgaaacctttcaactgcaatcttctctatcatgatcgacttaagatggaccccgaattggagaatcagataggggcgaaatttgaggaggatgttgatgcaatgcttcccaaatgtgacatagttgtcatcaacacacctcttacagacaagacaatggggatgtttaataaagaaaggattgcaaagatgaagaagggagtgcttatcgtcaacaatgctcgaggagcaatcatggatacacaagcagttgctgatgcttgttccagtggacagattggaggttacagtggggatgtctggtatccacaacctgctccaaaggaccatccatggcgtcatatgccaaatcaagctatgacccctcatatttctggaaccactatcgatgcacaactgcggtatgctgaaggagtgaaggacatgctggcaagatactttaagggagaagaatttccgctgcaaaattacattgttaaggaagggaaacttgcaagtcaatatcagtaagctgtgtagaagtgcagcttctgaggttcggaataatgtaaccttgatagaggttcaaaccttttctatgggaaaataagtgaacttaagacgtgaaaaaccatgtaccagtttgtgaagtatgcatgtattagtttcttattatcgtgtaatggagttgtgttttctttatgcattaatttccag

SEQ ID NO: 1593 - DNA, 1277 bp, Flaveria ramosissima
aggttgcaactcaaactcaattttcattaatcattttccgatcatcttcatcggaatttcaaaggaactccggcgacggcgatggcgatgtcaatggcgataaagcgttctgcagcctctgcaagtcgtgctatctcatcttctatttcaaagtctattctaaccagagaccttcatgcttcttcggggaaaagaagattgtaggtgtttctacaaggcacatgagtatgctcagatgaatcctaattttcttggttgtgtagagaatgcattgggcattcgcaactggttagaatcacaaggccacgagtacattgtcaccgatgacaaagagggacctgattgcgaattagaaaagcatatccctgatgcacacgtcatcataaccaccccgttccaccctggttatatcactgctgaaaggataaaaaaagcaaagaatctgcaacttctgcttacagctgggatcggttctgatcatgttgacctcaatgctgctgctgctgctgggttaactgttgcagaggttacaggaagcaatgttgtctccgttgcagaagacgaacttatgagaatcctcattcttgttcgtaacttcttacctggataccatcaggttattactggagattggaatgttgcaggtattgcttacagagcttatgatcttgaagggaaaactgtgggaacagttggttgtggacgaattggtagacttttgcttcaaagattgaagccattcgggtgcaatcttctgtaccatgatcgtataaagatggaccccgaaatggagaatcagattggtgccagctttgaggaagatcttgataagatgcttcccaaatgtgacgtagttgtcatcaacacacctttaacggataaaaccaaaggaatgttcgacaaagaacgcattgctaaaatgaaaaaggggttctcattgttaacaatgcgcgaggagctataatggatacgcaagctgttgctgatggctgttctagtggacacattgcaggctatagtggagacgtttggtttccacaaccagcgccaaaggaccatccatggaggtacatgccaaatcaggctatgaccccacacatttctggaaccaccattgacgcgcagttgcgatatgctgctggagtaaaaggtatgttggagaattatttcaagggtgaagactttccggcccagcattacattgtgaaggagggtgaattggcaagccagtaccgttgatctgactaccggaccgcctgctcacctcagtagtcgtg

SEQ ID NO: 1594 - DNA, 1363 bp, Flaveria ramosissima
gatatcaatggcgatgaagcgttctgcagccactgcaactcgtgctatctcctctgctatttcaaactccattctaaccagagaccttcatgcttcttcggggaaaagaagattgtaggtgttttctacaagcacatgagtatgcacagatgaaccctaattttcttggttgtgtagagaatgcgttgggcattcgcaactggttagaatcacaaggccatgagtacattgtcactgatgacaaagagggacctgattgcgaactagaaaagcatatccctgatgcacatgttattatcaccacccctttccaccctggttatatcactgccgaaaggatcaaaaaagcaaagaatttgcagcttctgcttacagctgggatcggttctgatcatgttgatctcaacgctgctgctgctgctgggttaactgttgcagaggttacaggaagcaatgttgtttccgttgcagaagatgaacttatgagaatcctcattcttgttcgtaatttcttacctggataccatcaggttattactggggattggaatgttgcaggtattgcttacagagcttatgatcttgaagggaaaactgtcggaacagttggttgtggacgaattggtagacttttacttcaaagattgaagccattcgggtgcaatcttctgtaccatgatcgtataaagatggaccccgaattggagaatcaaattggtgccagctttgaggaagatcttgataagatgcttcccaaatgtgacatagttgtcatcaacacacctttaacagagaaaaccagaggaatgtttgacaaagaacgtattgctaagatgaaaaaggggttctcattgttaacaatgcccgaggagctataatggatacgcaagctgttgctgatggctgttctagtggacacattgcaggctatagtggagacgtttggtttccacaaccagctccaaaggaccatccatggcggtacatgccaaatcaggctatgaccccgcacatttctggaactaccattgacgcgcagttgcgatatgctgctggagtaaaaggtatgttggagaattatttcaagggtgaagactttccggcccagcattacattgtgaaggagggtgaactggcaagccagtaccgttgatctgactaccggaccgcctgcccgcctcggtagtcatgctgtttgaacttcgaataagttatgttgagctggagctgttagaaaagctttggttgtatcaccttgtaatagtagaggtgtggttacgataaactgaatggttatggtattttattggtttttatgtagtgttggaccggtctaccactattcgtcgtatactaatgttag

SEQ ID NO: 1595 - DNA, 1361 bp, Thalictrum flavum
cagtctgggggaaatggcgttgaggaaagcagctgaattgggtgctaaaagtttgtttagatcatcatcttcacccttcaccagaaatctccatgcttcttctgaaagtaagaagattgtgggggtattttacaaggccaatgaatatgcgtcaatgaatcccaactttgtaggttgtgcagaaggggctttgggtatccgagattggttagaatctcaaggtcatcagtacattgtcactgacgacaaggacggtcctaactctgaactcgaaaaacatatccctgacctccatgttctgatatctactcccttccacccagcttatgttacagcagagaggatcaagaaggctaagaatttacaacttcttctcactgctggaattggctctgaccatattgatttgaaggctgcagcagctgctggattgactgttgcagaggttactggaagcaatgtggtgtcagtagctgaagacgagctgatgagaatactcattcttgtccgtaattttgtacctggttacaagcaggtgatcactggagactggaatgttgcagcaattgctcatagagcttatgatcttgaagggaagactgtggggacagttggtgctggacgtattggcaggcttttactccagcggttaaagcccttcaattgtaacctcttatatcatgatcggctgcagatggattctgatctggagagtcaaataggggcaaagtttgaagaggatcttgatgcaatgctccctaagtgtgacataattgtcattaacatgcctctaacggaaaaaactgcgggaatgttcaacaaagaaaaaatagctaagttaaagaaaggagttttgattgtcaacaatgctcgaggagcaatcatggatactcaagcggtggctgatgcttgctcaagtggtcatattgcaggctacagtggggatgtttggtttccacaaccagctccaaaggatcacccctggcgttatatgccaaatcaggcgatgacacctcatatttctggcacaaccattgatgcccagttgaggtacgcagctggagttaaggacatgttggataggtactttaaaggtgaagattttccagcacaacattatatcgtcaaggaaggagaattggcaagccagtaccgataatctattggctccggatgggtatttaatcaaatgtctgttttcatgctaataaaaaggagctcgtttcaaatctatgtaatagagttccagtgtctttgtttttgtaaagtgttcaagacttgtgtttagattgataaacataggtggtcattaagtaatatataaggatttaggtcttttggcctgattggggaatgtatta

SEQ ID NO: 1596 - DNA, 1397 bp, Tragopogon dubius
tcggggaattctgtagcggtccaacattttcactgtccattgtcattctcgatttgccttcttccgaattccaaagagcactaggtggcgacggcaatggcgatggcgatcgcgatgaagcgtgctgctgctgctgcaactcgtgctatttcctctgcaaattccggttcgattctcaccagacaccttcatgcttcttctgggaaaaagaagatcgtaggcgttttctacaaggcacatgagtatgctgaaatgaaccccaattttgtgggttgtgcagagaatgcattgggcattcgcaactggttggaatcacaaggccacgagtacatagtcactgatgataaagagggaccagattgtgaactagaaaaacacattccagacttacacgtcctcatcaccaccccattccacccagcctatgtcactgctgaaagaatcaaaaaggcgaaaaacttgcaactcttacttacagctgggataggatctgatcatgttgatctcaaggctgctgctgctgctggattaactgttgcagaagttactggaagcaatgttgtttctgttgcagaagatgaacttatgagaatcttgattcttgttcgcaattttttacctggacacaatcaggtaatttctggcgattggaatgttgcaggaattgcttacagagcttatgatcttgaagggaaaacagtgggaacagttggttgtgggcgtattggtaggcttttacttcaacggttgaagccttttgggtgtaatcttctttaccatgatcggattaagatggattcagagttagagaaccaaattggtgctagttatgaggaagatcttgataagatgcttcctaaatgtgacattattgtcattaatacccccttaacagagaaaaccaaaggaatgtttgataaagaaaggattgctaaattgaagaagggggttttgattgttaacaatgctagaggagctatcatggatacacaagctgttgttgatgggtgtaatagtggacatataggagggtatagtggcgatgtttggtaccctcaaccagctccaaaggatcatccatggagatacatgccaaatcaagcaatgacacctcatatttcgggaaccacgattgatgcacagttgcgatatgcggctggagtgaaggaaatgctggagaattatttcaagggagaagagtttgcaccccaacattacattgtcaaggagggtgagcttgcaccccagtaccgttgatcacctattaaatggacggctcagatgcttctcaaataaacatctgttttttcaccttgtaatagtgatgtgtagttattgccaaactcaatcccaaatgcaatgaacttggatctcttttcagtattaaataaataaaa

SEQ ID NO: 1597 - DNA, 1432 bp, Fragaria vesca
agcagactgagctagattgtagactataaataaagccgaggactctgatcatatgcaacacagaaccttctcacttcttatctgatatctcactctcgcactttgtactcctcaatctccggtccttggtctgtttcgaaaaatggctatgaagggtgcgattgtctcggctgctaaggctcttgcctcaccacgctcatcctccactgtcctctccaggcacctccacgcatctccggggagcaagaagattgttggggtgttctacaaggcgaatgagtatgccaaactcaaccctgattttttgggttgtgaggaaaacgctttgggcattagggactggctggaatcgcagggacacaaatatattgttactgatgacaaggagggaccaaattgtgagcttgagaaacacattgaggatatgcatgttctgatcacaacccctttccaccctgcctatgtcacggcggagaggattaaaaaggccaagaatttgcagcttcttttgactgccggaattggctctgaccacattgacctcaaggctgccgcggcggctggactgacggttgctgaggtcaccgggagcaatactgtgtcggttgcggaagatgaactcatgagaatcctcattcttatgaggaactttgttccggggtatcagcaggctgttaatggggattggaaggttgcagccatttcctacagggcttatgatttggaagggaagacagttggtactgttggagctggaagaatcgggaagcttttgatgcaaaggttgaagcctttcaactgtaatatcctctatcatgacagaattaaggctgatgccgagtttgagaaagagaccggggctaagttcgaggaggatcttgataagatgcttccgaaatgtgatgttgttgttgtcaacacccccctaacagaaaagacaagggggatgtttgataaagagagaatttccaagctcaagaagggagtcctgatcgtgaacaatgcccgtggggcaattatggacacgcaagcagttgttgatgcttgcaacagtggacacatagcaggttacagtggcgatgtctggaacccccaaccagctcccaaagaccatccatggcgttacatgccaaaccatgccatgacccctcatacatctggcaccacaattgatggacagttacgttatgctgctggtaccaaggatatgcttgaccggtacttcaagggcgaagaatttccagcacaaaactacattgtcaaggagggcaagctagcaagccagtaccagtgaggaggagtacttctgaaaaactgttgccaaaagctttctttggaagaataatgttactgatatagtgatcttagcctccttagggtctgtgcacccactctctctcttctctctctctctctctctctctctctctct

SEQ ID NO: 1598 - DNA, 1304 bp, Chelidonium majus
aaaatcttcacagagatggcgatgaggaaggctgctgctgcacttgggagtcgaactcttggtgctgggcttttatatagatcacctttccaaagacacctccatgctactccaggaagcaagaaaattgttggtgtgttttacaaggccaatgagtatgcctctatgaatccgaatttcgtaggttgtgtcgagggcggcttgggcatccgaaattggctggagtcacaaggccatcagtatattgtcaccgatgacaaagaaggcccggactctgaactcgaaaaacatattcccgatctccatgtcctaatatcgaccccctttcatccggcttacgttacagctgaaaggatcaagaaggccaagaatttacagcttcttctaactgcaggaattgggtctgatcacattgatctaaaagctgcagccgctgctggactaacagttgcggaggtcacaggaagcaatacggtttcagtagcagaagatgagctgatgagaatactcattctcacccgaaatttcttacctggttatcatcaagtgatcaatggggaatggaatgtcgcagccattgcttatagagcttatgatctcgagggaaagacagttgggacagttggagctggacgcattggcaagcttttactccaacggctgaagcccttcaattgtaatctcctataccatgatcggctaaagatggaccctgagttggagaaccaaataggtgccaagtatgaggaagatgtagatgctatgctcccaaagtgtgatatattagtcatcaacacacctctaacagagaaaaccaaaggaatgtttaacaaagaaaggattgcaaagctgaagaagggagttcttattgtgaacaatgcccgaggggcgatcatggatgcccaagcagttgctgatgcttgctcgagtggacacattggcggttacagtggggatgtatggtatccacaaccagctccaaaggaccacccatggaggtacatgccaaaccatgcaatgacacctcatatttctggtaccaccattgatgctcagttgcgttacgcggaagggactaaagacatgctggacaagtacttcaagggagaagacttcccctcagcaaattatatagtcaaggaaggtcaattggcaagccaatatctctaagctatgccttcttatatataagtctggtgcaaataaaggattaggaactagtaaaaagacaaccgagttaaaaccttacttttaattcagttctttaagttatgttgtactttgttttgttttcttagtatcat

SEQ ID NO: 1599 - DNA, 1522 bp, Eucalyptus grandis
accagtgttttatccacttttctctcttcttccgatactgaatctctcttcgaatcacttcgaacccgtcaactgcgagaaccgcccggctcggaaatggcgatgaagcatgccggtgtgtctgccatcagagctctgtgttcgtctccgagcttgactcgacgagtccattctactgctggaagcaagaagatcgtgggtgtgttctacaaggccaatgagtatgccgagttgaatcccaatttcgtgggcactgtcgagagaggtctgggcatacgcgactggctggaatcgcagggccatcagtacgtagtcacagatgacaaagagggaccagactgcgaacttgaaaagcatctttccgatcttcatgtcctcataacgaccccttttcaccctgcctatgttactgcggaaaggatcaagaaggcgaagaatctgcagcttcttctcactgctgggattggttccgatcacatcgatttgaaggctgcggctgaggcagggttgacagttgcagaagtgactggaagcaatgtagtttcggttgcagaggatgagctcatgagaattctcattcttgtaaggaactttttgcctggatatcatcaggtcatcaatggggactggaatgtggctggcatagcacacagagcttatgatctcgaaggaaaaactgtcgggactgttggtgctggacgaattggcaggcttttgctacagagattgaagcctttcaactgcaatctcctttatcacgaccgtgtcaaaattgatccggaactggaggttcagactggtgcaaaatttgaggaggacctcgatgcaatgcttccgaaatgtgacataattgtgctcaacacccctctgactgagaaaacaagaggaatgcttgataaagagaggatttccaagatgaagaaaggtgtgcttatcgtcaacaatgctagaggagcgctcgtggatacacaagctgttgctgacgcctgtgccagtggacacatcggaggttatagtggagatgtctggttcccacagcctgcaccgaaggaccacccctggcggtacatgccgaaccaggccatgacgcctcatatttccggcacaactatagacgcccagctgcgatatgcggccggaaccaaagacatgctggataggtacttcaagggagaggaattccctctccagaattacatcgtcaaggagggcgtgctggcccctcagtaccagtgatctccccgtctcctcagctcgtgcagtttccgtgttcaagaattatcgatcgtcgggctcattagaagttgcaggatgttgaataagtgtagtaatgctgccgtttcaacgtttgttcttgaagcgtgtcttttagtttgcgctgtattgaagattgaggtggtcttgtttgagaatagaaacagcactcattgtgactaaattttctaacaccaacgttacttttgcttagtccaaaaggtggcgcgatagatcacggtccattaaacagaaactcatatcccaa

SEQ ID NO: 1600 - DNA, 1417 bp, Flaveria ramosissima
ttgtaggttgtaactcaaaagcaactttcattaatcattttccgatcatcttcatcggaatttcaaaggaactccggcgacggcgacggcgatggcgatgtcaatggcgataaagcgttctgcagcctctgcaactcgtgctatctcatcttctatttcaaagtctattctaaccagagaccttcatgcttcttcggggaaaaagaagattgtaggtgttttctacaaggcacatgagtatgctcagatgaaccctaattttcttggttgtgtagagaatgcattgggcattcgcaactggttagaatcacaaggccacgagtacattgtcactgatgacaaagagggacccgattgcgaattagaaaagcatatccctgatgcacacgtcatcataaccaccccgttccaccctggttatatcaccgctgaaaggattaaaaaagcaaagaatctgcaacttctgcttacagctgggattggttctgatcatgttgatctcaatgcagctgctgctgctgggttaactgttgcagaggttacaggaagcaacgttgtttccgttgcagaagatgaacttatgagaatcctcattcttgttcgtaatttcttacctggataccatcaggttattactggggattggaatgttgcaggtattgcttacagagcttatgatcttgaagggaaaactgtcggaacagttggttgtggacgaattggtagacttttacttcaaagattgaagccattcgggtgcaatcttctgtaccatgatcgtataaagatggaccccgaattggagaatcaaattggtgccagctttgaggaagatcttgataagatgcttcccaaaggtgacatagttgtcatcaacacacctttaacagagaaaaccagaggaatgtttgacaaagaacgtattgctaagatgaaaaaaaggggttctcattgttaacaatgcccgaggagctataatggatacgcaagctgttgctgatggctgttctagtggacacattgcaggctatagtggagacgtttggttccacaaccagctccaaaggccatccatggcggtacatgccaaatcaggctatgaccccgcacattctggaactaccatcgatgcgcagttgcgatatgctgctggagtaaaaggtatgttggagaattatttcaagggtgaagacttcccggcccagcattacattgtgaaggagggtgaactggcaagccagtaccgttgatctgactaccggaccgcctgcccacctcggtagtcatgctgtttgaacttcgaataagttatgttgagctggagctgttagaaagctttggtgtatcaccttgtaatagtgaggtgtggttacgataactgaatggttatggtattttattggttttatgtatgtgg

SEQ ID NO: 1601 - DNA, 1263 bp, Amorphophallus konjac
cgtcatccctttctacagtagtaggcttcttctacctcgccgtctgctgctgtgtggcgtgatctgatcgctgctgttgtggagggaagggaagaatggcgatgaggaaggcgctggcacaggcgacgcaggctctcggatcgggatccgcggcgcccctcctctcccggcagctccatgccactcctggaagcaagaagattgttggtgttttttacaaggctaatgagtatgcagcgatgaatcctaactttgtaggatgtgtcgaggggagcttgggaatacgggactggctagaatcacaaggtcaccagtacatcgtcaccgacgacaaagagggccccaattctgagcttgagaaacatattgaagacatgcatgtcttgataaccaccccatttcacccggcttatgttagtgccgaaaggatcaagaaggccaagaacttgcagttgcttctcactgctgggatcggttcagatcacattgacctgaaggcggcggctgccgctggattgacagttgctgaggtcacgggaagcaatgtggtttctgttgcagaggatgaactcatgagaattcttattctggttcgcaacttcttacctggttatcaccaggtcgtcaagggagagtggaatgtcgctgggattgcttacagagcctatgatcttgaagggaagactgttggtactgttggtgcaggtcgcattggaaagcttttgctccaacgcttgaagcccttcaattgtaatcttctctaccatgatcggcttaagatggagccagagttggagtcacagctgggagcaaagtttgaggctgacctagatgccatgcttcccaagtgtgacatagttgtcattaacacacctcttactgaaaaaaccaggggaatgtttaacaaagagaggattgccaaactgaagaaaggtgttctcattgtgaataatgcccgtggagctattatggacactcaggctgttgcagatgcttgtgccagtgggcacattgcaggctacagtggagatgtgtggtatccacaaccagccccaaaggatcacccatggagatacatgcccaaccatgccatgacccctcatatttcaggaaccaccattgatgcccagctgaggtatgcagctggagtgaaggagatgctggactgttacttcaaggggaaggacttcctccctcagaactacattgtcaaggaaggccagctagctccccagtacctctaagcacttcttgtgcacacac

SEQ ID NO: 1602 - DNA, 1366 bp, Amorphophallus konjac
tttctacagtagtaggcttcttctacctcgccgtctgctgctgtgtggcgtgatctgatcgctgctgttgtggagggaagggaagaatggcgatgaggaaggcgctggcacaggcgacgcaggctctcggatcgggatccgcggcgcccctcctctcccggcagctccatgccactcctggaagcaagaagattgttggtgttttttacaaggctaatgagtatgcagcgatgaatcctaactttgtaggatgtgtcgaggggagcttgggaatacgggactggctagaatcacaaggtcaccagtacatcgtcaccgacgacaaagagggccccaattctgagcttgagaaacatattgaagacatgcatgtcttgataaccaccccatttcacccggcttatgttagtgccgaaaggatcaagaaggccaagaacttgcagttgcttctcactgctgggatcggttcagatcacattgacctgaaggcggcggctgccgctggattgacagttgctgaggtcacgggaagcaatgtggtttctgttgcagaggatgaactcatgagaattcttattctggttcgcaacttcttacctggttatcaccaggttgtcaagggagagtggaatgtcgctgggattgcttacagagcctatgatcttgaagggaagactgttggtactgttggtgcaggtcgcattggaaagcttttgctccaacgcttgaagcccttcaattgtaatcttctctaccatgatcggcttaagatggagccagagttggagtcacagctgggagcaaagtttgaggctgacctagatgccatgcttcccaagtgtgacatagttgtcattaacacacctcttactgaaaaaaccaggggaatgtttaacaaagagaggattgccaaactgaagaaaggtgttctcattgtgaataatgcccgtggagctattatggacactcaggctgttgcagatgcttgtgccagtgggcacattgcaggctacagtggagatgtgtggtatccacaaccagccccaaaggatcacccatggagatacatgcccaaccatgccatgacccctcatatttcaggaaccaccattgatgcccagctgaggtatgcagctggagtgaaggagatgctggactgttacttcaaggggaaggacttcctccctcagaactacattgtcaaggaaggccagctagctccccagtacctctaagcacttcttgtgcacagagagagagagagagagagagagagttttcaattcgtgcaaataaaacggggttgcacaccctgcttcgagtgtaactgtgttttcctagtgcttgtaagagaattgcagtgtat

SEQ ID NO: 1603 - DNA, 1472 bp, Artemisia annua
tactccgacggggactatcaactactacaaacaaacacactttcattttcacttctcttatcgaaataaaaacaaaccccggcgacgatggcgatggcgtttgcgatgaaacgcgctgcaacacgcgctatttccggttcgatcatcagtcgacaccttcatgcttctgctgggccaaagaagattgttggtgttttctacaaggcacatgagtatgctgagatgaaccccaatttcgtgggttgtgtagagaatgctctgggcattcgcaagtggctggagtcacaaggacatgaatacatagtcactgatgacaaagaaggaccagattgcgaactagaaaaacatattcctgatgcacatgtcattataaccaccccgttccacccgggatatattacagctgaaaggattaaaaaagcaaagaatctgcaactgttgcttacagctgggatcggatctgaccatgtcgatctccctgctgcggctgctgcagggttaactgttgcagaagttaccggaagcaatgtcgtttctgtagcagaagatgaacttatgaggatcctcattctcgttcgtaatttcttgcctggatacaaacaggttgttaacggggattggaacgttgctggtatagcttacagagcttatgatcttgaagggaaaactgtaggaacagttggctgtggacgtatcggtaggcttttacttcaaagattgaagccttttgggtgtaatcttctctatcatgaccgtattaagatggaccctgaattggagagtcaaactggtgccagctttgaggaagatcttgataaaatgctttctaaatgtgacatagttgtcgtcaatactcctttaacagagaaaaccaaaggattgtttgacaaagaacggattgctaaactgaaaaagggagttctcattgttaacaatgctcgaggagctataatggatacacaagctgttgtagatggctgtaatagtggacacattggaggctatagcggagatgtttggtatcctcaaccagctccaaaagatcatccatggaggtatatgccaaatcaagcaatgacccctcacatttctggaaccacaattgatgcgcagttgcgatatgcggctggagtgaaggatatgctggagaactatttcaagggagaagacttcccgccacaacattacattgtcaagaagggtgaactagcaagtcagtaccggtaatctgtgcgtgttccagtagttgtgttgactgcagtggcagatgcttatcaaataagttgaggtgttcaaaaaagcttcagtgtaatagagaggttgagttatgctgaatgacaatgaatttctatatatatggttggttttttgtgatgtgtgtgaatcagaacactgttgatcgaccatgtaacatgttaaaacaaggaaataattagaatcctaaaatgaaagaaacttataaacaggtcatg

SEQ ID NO: 1604 - DNA, 1538 bp, Prunus persica
tttttggttgggcaattgttgaccaaattcatatgtacctccaaacagctttcatcaaaagtcactgaaaaaacactaaaggcgatcgacaaattgaaattaaattaaagctgctctgcatatgcgagttagcaggaaatccataaggaacatggcgatgaagggtgtcattgcatctgccgttcgaactcttgcttcatcagggagctcagcatcatcaaccaccttcaccaggcacctccatgcatctgctggaagcaaaaagattgttggggtgttttacaaggccaatgaatatgcagaactgaaccccaattttctgggttgtgaggagagagcgctgggcataaaggactggctggaatcacaaggccacaagtatattgtcactgatgacaaggacggaccagattgtgaacttgacaaacacattcaagatctccatgttctcatatcaacccccttccatcctgcctatgtcactgctgaaaggatcaaaaaggccaagaatttgcaattgcttctcacggccggagttggttctgatcatattgatctgaaggctgctgctgctgctggattaacagttgcagaggtcacaggaagcaatgtggtttcggttgcagaagacgagctcatgagaatcctcattcttgtgcggaacttcgtgcccgggtacactcagattgttaatggggagtggaaagttgcaggtattgcccacagagcttatgatctggaaggaaagacagtggggactgttggtgctggacgtattggcaagcttttgctccaaaggttgaaacctttcaactgtcatctcctctatcatgaccggttcaagattgacccagaattggagcaacagataggggctaagtttgaggaggatctggatgccatgcttccaaaatgtgatgttattgttatcaacacaccccttactgagaaaacaagaggactgtttgacaaagaaagaattgcaaagtgtaagaagggagtcctgatcgttaacaatgctcgaggggcaatcatggacacacaggcagttgttgacgcttcctccagtggacatattgcaggttacagcggcgatgtttggaatccacaaccagctccgaaagaccatccatggcgttacatgccaaaccatgctatgacccctcatatatctggtaccacaattgatgcacagttacgttatgctgccggtgttaaggacatgcttgacaggtacttcaagggagaagactttcctgcacaaaactacattgtcaaggacggtaaaatagcaagccagtatcagtaataaattcggtgcttgtgataaagtctgctagttcgtgttctcttgcagacactaactatgtgagctcctcctaaataatgtagccgaaactgagagctttttatagggtctgtgcacccaatgtttttcttttttcctttttctgttgtagtttcctccttgtgagtgtacgctgcctggatggacagtttccctttcaataataagaacttgttagctattggtactt

SEQ ID NO: 1605 - DNA, 1455 bp, Zea mays
ggagtctttttatcggtcgtgcccgcagtcgactcgccgcccacttctgtagctgtagactgtagttctgttcctccccactcactcctgcgcttcctcgccgcgcggttccttctccctgatcctcctttggcttcgcggttcatggcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcagggccatcagtacattgtcaccgatgacaaggaaggccccaactgtgaactggagaagcacattgaagacatgcatgtcctgattaccaccccattccacccagcttatgtcactgcagagaggataaagaaggcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaacaggtagttcaaggcgaatggaacgtagcaggcattgcccatagagcttatgatcttgaaggaaaaactgttgggactgttggggctggtcgtattggcaggctcttgcttcagcgtcttaagccctttaactgcaacctgctttaccatgacagacttcagattgacccagagcttgagaaagaaattggggccaaatttgaggaggacctggatgctatgcttccaaagtgtgatgtgattgtgatcaacacacctcttacggagaaaacaagaggcatgtttaacaaagagaggattgcaaagatgaagaaaggtgtaattgttgtaaataatgctcgaggagcaatcatggatgctcaagcagtcgcagatgcatgttctagcggtcacattgctggatacggtggtgatgtgtggttcccacagccagcaccaaaggatcacccctggcgctacatgcctaaccatgccatgacccctcacatctctgggactacaattgatgcgcagctgcggtatgcggatggtgtgagggacatgctggataggtatttcaagggcgaggacttcccggtgcagaactacatcgtcaaggaaggccagcttgccagtcagtaccagtgaccgcgcgagatgttgctgtgctgtgtaggcttttctggtgagaagctgcgaggaagaaactcctgttgcgtacttgcgttactgtatgagtagctctgagaaatctgtcagcggccacctgtaataaaagaatgccttgctggtatctcaccgtggagatcaataagtcccttttttttc

SEQ ID NO: 1606 - DNA, 1456 bp, Brachypodium distachyon
ctctctctctgcactggctgactcatcactctcatcgtcgctttcctccctcgccgcccccccgtgaagcttagcgattgtaggtttctccgccgggatatccgtccgtccgtccatggcgatgtggagagccgccgcgaggcagctcgtcgaccgggcgcttgttggatccagggccgcgcacacatctgcgggcagcaagaagattgtgggcgtgttctacaaggccggcgagtacgccgacaagaaccccaacttcgtcggctgcgttgagggcgccctcggcatacgcaactggctggaatccaagggccatcaatacattgtcacggacgacaaagagggactggacagcgaactggagaagcacattgaagacatgcacgtcctgataaccaccccattccatccagcctatgtttccgcagagaggatcaagaaagcaaagaaccttgagctgcttctcactgctgggattggctctgatcatattgatttgccagctgctgctgctgctggcttaactgtggcagaggttactggaagtaacactgtttcagtggcggaagacgagctcatgcgcatcttgattctgctcaggaacttcttgcctggctatcaacaggttgttcaaggtgattggaatgttgcaggcattgcacatagagcttatgatctggaaggaaagacagtcggcactgtcggggctggtcgtatcggcaggctcttacttcagcgtcttaagcccttcaactgtaacttgctctaccatgacagacttcagattaacccagagcttgagaaagaaatcggggccaaatttgaagaggatctggatgctatgctcccaaagtgtgatgtcattgtgatcaacacacctcttacagagaaaacaagaggcatgtttaataaagaaaagatcgcaaaaatgaagaaaggtgtgatcgtagtgaataatgcccgaggagcaatcatggacacccaggcagtcgcggacgcttgttccagcggtcacattgctggatatggaggtgacgtctggttccctcaaccagcaccgaaagatcacccgtggcgctacatgcctaatcacgcaatgacccctcacatctctgggactacaattgatgcacagctgaggtacgcggcgggagtgaaagacatgctggacaggcacttcaagggggaggacttccctgcggagaattacatcgtcaaggaaggggagctcgcgagccagtaccggtagtagaagaaaccaagaccagcctagctagctaagctgcatgatgccatttctgaagcgagatgcaaagagaagaaaccaaaccgtttgttgtcgtaagagtgtggtgtgaggacctgtcggacaccggaaataattggctccctgcttggggctgcaaccatagtccatatacatggcggtgaataaaagctttgagatcggactatc

SEQ ID NO: 1607 - DNA, 1466 bp, Taraxacum officinale
cattttcacattctattattgtcttcttgagtttgtcttcatccaaatttccaatagcaccagtgttgggcgatgatgatggcgatcgcgatgaagcgcgctgccgctgctgctgcaactcgtgctatctcctctgctaattccggttcaattttcaccagacacctccatgcttcttctggcaaaaagaagattgtaggtgttttctacaaggcacatgaatatgcagaaatgaaccccaatttcgtgggctgtgcagaaaatgcattaggcattcgcaactggttggaatcacaaggccacgagtacatagtcacagatgacaaagaaggactagattgtgaactagaaaaacacatccctgatttacacgtcctcatcaccaccccattccaccccgcctatgtcactgctgaaagaatcaaaaaggcaaaaaacctgcaactgttacttacagctgggattggatccgatcatgttgatctaaaagctgctgctgctgctggattaactgttgcagaagttaccggaagcaatacagtttctgttgcagaagatgaactcatgaggatcctgattcttgttcgtaatttcttacctggacaccatcaggtcatttctggtgattggaatgttgcaggtattgctcacagagcttatgatcttcaaggcaaaactgttgggacagttgggtgtgggcgtattggtaggcttttacttcaaaggctgaagccttttgggtgtaatcttctttaccatgatcgcattaagatggaaccagaattggagaatgaaattggtgcggaatatgaagaagatcttgataagatgcttcctaaatgcgatattattgttgtcaatacccctttaactgagaaaactaaaggaatgtttgataaagaaaggattggtaaattgaagaaaggggttctgattgttaacaatgctagaggcgctatcatggatacacaagctgttgttgatggatgtaatagtggacacataggagggtatagtggagatgtttggtatcctcaaccagctccaaaagatcatccatggagatacatgccaaatcaagcaatgacccctcatatatccggaaccaccattgatgcacagttgagatatgcggctggagtgaaggatatgctggagaattatttcaagggagaagagtttccacctcagcattacattgtcaaagagggtgagctggcaccacagtataggtgatcttgatgagttgagtttactgctgagtcagatgcttttgaattgaataaattgagttgagcttgttatgagctcctaaaatgactttgggtttatcaccttgtaatataataaggtgtagttatggcaaactgaatggcaatggatttgggtttcttccttgtttttatggtgtagtgtataactgcgtggttatgaatggtatcaatgttaaacataaaatgtgtaaa

SEQ ID NO: 1608 - DNA, 1296 bp, Cynara scolymus
  misc_feature (1144)..(1144): n is a, c, g, or t
  misc_feature (1218)..(1218): n is a, c, g, or t
  misc_feature (1243)..(1243): n is a, c, g, or t
  misc_feature (1245)..(1245): n is a, c, g, or t
  misc_feature (1261)..(1261): n is a, c, g, or t
cacggacatcgtcttctctcagtcttgccttcctcccaattcactactattccacacagagcaccggcaccagcaccggcgatggctttggcgatgaagcgtgccgccgccactgcagttcgtgctatttcctctgctaattccgcttcgattctcaccagacagcttcatgcttctgctgagaagaagaagattgtaggtgttttctacaaggcacatgagtatgctgagatgaaccccaactttttgggttgtgcagagaatgcgttgggcattcgcaactggttggaatcacaaggccacgagtacattgtcaccgatgacaaagagggaccagattgcgaactagaaaagcatatatctgatatgcatgtccttataaccaccccattccatccggcctatgttactgctgaaaggattaaaaaggcaaagaatttgcaactgttgcttaccgctgggattggatcggatcatgttgatctccaggctgctgctgctgctgggctaactgtagcagaggttactggaagcaatgttgtttctgtagcagaagacgaacttatgaggatcctcattcttgttcgtaatttcttgcctggacaccatcaggttattagtggggattggaatgttgcaggtattgcttacagagcttatgatcttgaagggaaaactgtaggaacagttggttgtggacgtattggtaggcttttacttcaaaggttgaagccttttggctgtaatcttctctatcatgatcgtattaagatggaccaagaattggagaatcaaattggtgccaagtttgaggaagatcttgataagatgcttcctaaatgtgacataattgtcatcaatacacctttaacagagaaaactaaaggaatgtttgacaaagaaaggattgctaaattgaagaagggggttctgattgttaacaatgctcgaggggctatcatggatacacaagctgttgttgatggctgctctagtggacacattggagggtatagtggagatgtttggtatcctcaaccagctccaaaagatcatccatggaggtacatgccaaatcaagcaatgacccctcacatatctggaaccaccattgatgcacagttgcgatatgcagctggagtgnaggatatgttggagaattatttcaagggagaagacttccctgcccacattatattgtgaaggaaggtgaactancaagccagtaccggtaatctgtggnancacaggtctttgtccnatggggtcgactgctgtgctaatgcatgcttctaa

SEQ ID NO: 1609 - DNA, 1539 bp, Eucalyptus grandis
gtacttcaccagtgtttcattcacttttctctcgtcttccaataccgaaaatctctcttcgaatctcttcaaacctgtggactgcgagaaccgctcggctcggatatggccatgaagcgcgccggtgtgtctgccatcagagctttgtgttcgtctccagacttgacccgaggcgtccactctactgctggaagcaagaagatcgtgggtgtgttctacaaggccaatgagtatgccgagttgaatcccaatttcgtgggcactgtcgagagaggtctgggcatacgcgactggctggaatcgcagggccatcagtacgtagtcacagatgacaaagagggaccagactgcgaacttgaaaagcatctttccgatcttcatgtcctcataacaactccttttcacccggcttaccttaccgcggaaaggattaagaaggcaaagaatttgcagcttcttctcactgctgggattggttccgatcacatcgatttgaaggctgcagccgaagcagggttgacagttgcggaagtcactggaagcaatgtcgtttcagttgcagaggatgagctcatgagaatcctcattcttgtaaggaactttttgcctggatatcatcaggtcatcaatggggactggaatgtggccggcatagcacacagagcttacgatctcgaaggaaaaactgtcgggactgtcggtgccgggcgaattggcaggcttttgctacagagattgaagcctttcaactgcaatctcctctatcacgaccgcatcaaaatcgacccggaactggaggttcagactggtgcaaaattcgaggaggaccttgatacaatgcttccgaaatgcgacataatcgttctcaacacccctctgactgagaaaacaagaggaatgcttgataaagagaggatttccaagctgaagaaaggtgtccttatcgtcaacaatgctagaggagcgctcgtggatacacaagctgttgccgacgcctgcaccagtggacacatcggaggttatagtggggatgtttggttcccccaaccagcacccaaggaccacccctggcggtacatgccgaaccaggccatgacgcctcatatttccggcacaactatcgatgcgcagctgcgatatgcagccggaaccaaagacatgctggataggtacttcaagggagaggaattccctctccagaattacatcgtcagggagggcgtgctggcccctcagtaccggtgattttcccctgcctcctcggctcgtgcagtttctgtgttcgagaattcacaatggtcgagcccattagaagttgcaggatcttgaataagtttagtaatgcttgctgtttcaatttttgtcttgaagcgtgtcttcagtttgtgctgtattgaagattgatgaaggtctgtttgagaatggaaacgtactcttcgtgcaaactctctcctgtagttttgttttgttttggctcacagtccaaaagatggcatgacagaccacggtctaagatgcactccacgaaaagcggataaa

SEQ ID NO: 1610 - DNA, 1550 bp, Musa acuminata
cacgtgttctcttctgccgtttggcttccctgaactctctcttgctctcacaagtctactagtcctatatacagtgacttcacctcttcgctgactctcccgtctccgttccgatctctcgtctcgatcgcaataggccgatggcgatgctgagggcggcgaaacacgcgatgagatccctgggttctacggctcccgaggcggctcctttctcaaggatgcttcatgcttctcccggaagcaagaagatcgtcggagtattctacaaagccaatgagtatgcttcgttgaaccccaagttcgtagggtgcgtcgagggatccttgggcattcgggactggctggaatctcaaggccaccaatacattgtcactgatgataaagaaggcccaaattgtgagcttgagaagcatattcatgatatgcatgttctgataacaaccccatttcatccggcttacgttaccgcggagaggataaagagggctaaaaacttgcaacttcttctcactgctggaattggctcagaccacattgatctgaaagctgcagcggaggctggattgactgtagcagaggtcaccggaagcaatgtggtctctgttgcagaagatgagctcatgcgaattctcattcttgtccgaaacttcgttcccggttatcttcaggtgattaaaggtgattggaatgtagcaggaatcgcatacagagcatatgatctggagggcaagactgttggaactgttggtgctggccgaattggaaagcttttgctccagcgtttgaagcccttcaactgcaatctgctctatcatgaccggataagatagacctgcactggagaaagagataggggcaaagtttgaggaagatcttgacacaatgcttcctaaatgcgacattattgttataaacacacctcttacagagaaaaccagaggaatgtttaacaaggagaggattggaaagctgaagaagggagttcttatcgtgaataacgctcgaggcgctatcatggacactcaagcagttgctgatgcttgctccagtgggcacattgcaggttacagcggcgatgtctggaatccacagccagctcccaaagatcatccatggcggtacatgccaaaccaggcaatgacaccccacatttctggaactaccatcgacggccaactgaggtatgctgctggagtgaaggacatgctggattgttacttcaaaggacaggaattcccagcccaaaactacattgtgaaggagggaaagctagcgagccagtaccagtgatgatacacctctcttctgcaccgggaagctttcatgtgaatcatcgtgttggtttatcgtaataaaccatgtagtgtgctacatgggttgcgttccaattcgcgaagtgttcatttcagtgtatcgaactctcctcttgtgctagctactacaaatccttgtaatggctattgttctggtttctctgagtcctactctagcagttccacaataacagaacaccattgtagacaacctgacttgtgtgccatcatcaatgt

SEQ ID NO: 1611 - DNA, 1511 bp, Setaria italica
tcccctgctcttcttcctcgtctatcagccgtcgacactctcctccccaccgctccgccgcgtggttcctccccctctccttccgcggatccatggcgatgtggagggcggccgcgaggcagctggtcgaccgggcgatcggctcaagggccgcgcacacatctgcaggcagcaagaagatcgtgggggtgttctacaaggccggcgagtacgccgacaagaaccccaacttcgtcggatgcgtggagggagcactcggcatccgcaactggctcgaatcgcagggccatcactacattgtcaccgatgacaaggagggccccaactgtgaactggagaagcacattgaagacatgcatgtcctgattaccaccccgttccacccagcttatgttactgcagagaggattaagaaggcaaagaaccttgagcttcttctcacggctggaatcggctctgatcatattgatttgccagcagccgctgctgcaggcttaactgtggcagaggttactggaagtaacaccgtctctgtggcagaagatgagctcttgcgcattctcattctgctcaggaacttcttgcctgggtatcaacaggtggttcagggtgagtggaacgtcgcaggcattgcccacagagcttatgatcttgaaggaaaaactgttggaactgtcggggccggtcgtatcggcaggctcttgcttcagcgtcttaagcccttcaactgcaacctgctttaccatgacagactaaagatcgacccagagcttgagaaagaaattggggccaagtttgaagaggacctggatgctatgcttccaaagtgtgatgttattgtgatcaacacacctctcaccgagaaaacaagaggcatgtttaacaaagagaggattgcaaaggtgaagaaaggtgtaataatagtgaataatgctcgaggtgcaatcatggatactcaggcagttgcagacgcttgttccagtggtcacattgctgggtacggtggtgatgtgtggttcccccagccggcaccaaaggatcacccctggcgctacatgccgaaccatgccatgacccctcacatctctgggactacaattgatgctcagctgcgatacgcagagggtgtgaaggacatgctggacaggtacttcaagggcgaagacttccccgtgcagaactacatcgtcaaggaaggccagctcgccagccaatatcagtgatatttctcttttcctgaagagattgcaaggaagaaaccgttgttccgttgctgtatgagtagtaatgttctcagagatctgtcggccatcggaaataaataagggatgcctttgctgtaatgttctcagagacttaaatcactcgggtgagctatagctttatttcctgtcatcgtaccagacgttctgtggttagtctcggctggaacatctgtgttggtttggtgctatcccttctgtttataaagcatttttttcaccggaaaggcatatatgttttgagttcca

SEQ ID NO: 1612 - DNA, 1619 bp, Sorghum bicolor
ctcttcctcttccgcctcgctctcactcctgctcttcctggccgtgcggttccttctccctgatccttctttggcttcgcggttcatggcgatgtggagggccgccgctaggcagctggtcgaccgggcgctcggttcaagcgccgcacacacgtctgcaggcagcaagaaaatcgttggggtgttctacaaggccggggagtatgccgacaagaaccccaacttcgtcggctgcgtcgagggagcactcggcatccgcggctggctcgagtcgcagggccatcagtacattgtcaccgatgacaaggagggccccaactgtgaactggagaagcacattgaagacatgcatgtcctgattaccacccctttccacccagcttatgtcactgcagagaggataaagaaggcaaagaatcttgagcttcttctcactgctggaatcggctctgatcatattgatcttccagcagcggctgctgcaggcttaactgtggctgaggtcactggaagtaacaccgtctctgttgcagaagatgagctcttgcgcattctgattctgctcaggaacttcttgcctgggtaccaacaggtagttcaaggtgaatggaacgtagcaggcattgcccacagagcttatgatcttgaaggaaaaactgttgggactgttggggctggtcgtataggcaggctcttgcttcagcgtcttaagccctttaactgcaacctgctttaccatgacagacttcagattgacccagagcttgagaaagaaattggggccaaatttgaggaggacctggatgctatgcttccgaagtgtgatgtgattgtgatcaacacacctcttacggagaaaacaagaggcatgtttaacaaagagaggattgcaaagatgaagaaaggtgtaattattgtgaataatgctcgaggagcaatcatggatactcaagcagtcgcagatgcatgttctagcggccacattgctggatacggtggtgatgtgtggttcccccagccagcaccaaaggatcacccctggcgctacatgcctaaccatgccatgacccctcacatctctgggactacaattgatgcgcagctgcggtatgcggagggtgcgagggacatgctggataggtatttcaagggagaggacttcccggtgcacaactatatcgtcaaggaaggccagcttgccagccagtaccagtgaccgtgcgagatgtcgctgcaatatggcttttctcgggagaagctgcgaggaagaaactgctgttgcgtcactgtatgagagtagctctgagaaacctgtcagcggccacctgcaataagaataccttgcttatctcaccgaggagctgagaaacctgtcagcggccacctgcaataagaatgccttgcttgtctcaccgaggtgatgaataagagtcatttttttcccttctctgtcaacgaactgatagtgttttggttgtcacatgatagtgttttggttcaacctgtgataacgcaaatggtaacgaactgcatgcgctatgtcatttgctgctattcccttggttttagcagatttttgttccggaaagcatatttccagccagctgggtaggacatga

SEQ ID NO: 1613 - DNA, 1545 bp, Saccharum officinarum
ctgtagtcctgttcctcttccgcctcactctcactcctgcagtcctgcgcttcctcgccgtgcggttccttcaccagttcaccctgatccttctttcgctttgcggttcatggcgatgtggagggccgccgctaggaagctggtcgaccgggcgctcggctcaagggccgcacacacgtctgcaggcagcaagaagatcgtcggggtgttctacaaggccggggagtatgccgacaagaacccaaacttcgtcggctgcgtcgagggagcactcggcatccgcggctggctcgagtcgcagggccatcagtacattgtcaccgatgacaaggagggccccaactgtgaactggagaagcacattgaagacatgcatgtcctgattaccaccccattccacccagcttatgtcactgcagagaggattaagaaggcaaagaatcttgagcttcttctcacggctggaatcggctccgatcatattgatcttccagcagccgctgctgcgggcttaactgtggctgaggtcactggaagtaacaccgtctctgtggcagaagatgagctcttgcgcattctgattctgctcaggaacttcttgcctgggtaccaacaggtagttcaaggcgaatggaacgtagcaggcattgcccacagagcttatgatcttgaaggaaaaactgttgggactgttggggctggtcgtattggcaggctcttgcttcagcgtcttaagccctttaactgcaacctgctttaccatgacagacttcagattgacccagagcttgagaaagaaattggagccaaatttgaggaggacctggatgttatgcttccaaagtgtgatgtgattgtgatcaacacacctcttacggagaaaacaagaggcatgtttaacaaagagaggattgcaaagatgaagaaaggtgtaattgttgtgaataatgctcgaggagcaatcatggatactcaagcagtcgcagatgcatgttctagcggccacattgctggatacggtggtgatgtgtggttcccccagccagcaccaaaggatcacccctggcgctacatgcctaaccatgccatgacccctcacatctctgggactacaattgatgcgcagctgcgttatgcggagggtgtaagggacatgctggatcggtatttcaagggcgaggacttcccggtgcacaactacatcgtcaaggaaggccagctagccagtcagtaccagtgaccgtgcgagatgttgctgtgctgtatggcttttctggggagaagctgcgaggaagaaaatgctgccgcgttactgtatgatgagtagctctgagaaacctgtcagcggccaccggcctgtaataaaagaatgccttgctggtatctcaccgtggagatgaataagtcttgatcgttttttttccttctctgtcaacgaactgcatgcgcactgtcttttctcggctgtgacatgatagtgtttggttcaacctgtgataacgcaaatggtaacgaactgcatgctatgtcatatgtactaatttt

SEQ ID NO: 1614 - DNA, 1506 bp, Lactuca sativa
gcttcggcgggggtacagacttggcagtccaacattttcacgttcgactgtcttcctgagtttgcctttatccaaatttccaaagagcaccagcgttgcgacggcgatgatgatggcgatcgcgatgaagcgtgctgctgctactgctgctcgtgctatttccactgctaattccggttcgattctcaccagacaccttcatgcttcttccggcaaaaagaagattgtaggtgttttctacaaggcacatgagtatgctgagatgaatcccaatttcgtgggttgtgcagaaaatgcattgggcattcgcaactggttggaatcacaaggccatgagtacatagtcactgatgataaagaaggaccagattgtgaactagaaaaacatatccccgatttacatgtcctcattaccaccccattccatccagcctatgtgactgctgaaaggataaaaaaggcaaagaatttacaactcttgcttacagctggaattggatctgatcatgttgatctcaaggctgctgctgctgctggattaactgttgcagaagttactggaagcaatactgtttctgttgcagaagatgaacttatgaggatccttattcttgttcgtaatttcttacctggacaccatcaggttatctctggtgattggaatgttgcaggtattgctcacagagcttatgatcttgaaggaaaaacagtaggaacagttggttgtgggcgaattggaaggctattacttcaacgattgaagccttttgggtgtaatcttctttaccatgatcggattcagatggattcggaattggagaatcaaattggtgcaacatttgaggaagatcttgataagatgcttcctaaatgtgacattattgtcatcaacacccctttaacagagaaaacaaaaggaatgtttgataaagaaaggattggtaaattgaagaagggggttttgattgttaacaatgctcgaggtgctattatggatacacaagctgttgttgatgggtgtaatagtggacacattggagggtatagtggagatgtttggtatcctcaaccagctccaaaggatcatccatggagatacatgccgaatcaagcaatgacacctcacatttctggaaccaccattgatgcacagttgcgatatgcggctggagtgaaggatatgctggagaattatttcaagggagaagagtttccaccccaacattacattgtcaaggagggtgagctggcaagccagtacaggtgatctgttctgtatttgcctcttaagtcttaatgggttgagtttactgctgaataagttgagttgatctcctaagctgttgttttatcaccttgtaatatagtaaggtgtagttatggacaactgaatggaaatgaatttggatctcttgattttatggtgtatgcggttatggaatcagacaattgttgaacataaaatgtgtaaaacattaattgaagaacaagttcaaaacacgaaaa

SEQ ID NO: 1615 - DNA, 1481 bp, Actinidia deliciosa
  misc_feature (459)..(459): n is a, c, g, or t
  misc_feature (1347)..(1347): n is a, c, g, or t
aatcaccaagtggataactctctctctctctctctcatggcgatgaagcgtgctgctgcctctgcagtccgtgctcttgcttcgtcggggaattcgaattcgtcgattttgaccagagagctccatacttctcctgggagcaaaaagatagttggagtgttctataaggcaaatgaatatgctgcaatgaatcccaattttttgggctgtgtggaaagagcattgggcataggtgactggttgaaatcacaagggcaccaatacatcgtcacagatgacaaagagggacctgattgtgagctcgagaaacacatttctgatatgcacgtcctcataactaccccatttcatccggcctacgttactgcggaaaggatcaagaaggctaaaaatctgcaactattgctcacagctggaattggctctgaccatgtcgatctgaaggctgcagctgctgcngggttaacagttgctgaggtcactggaagcaatgtggtttcggtagcagaggacgagctcatgagagttctcattctcactcgaaatttcttacctggataccatcaggttattaaaggggactggaatgttgcagctattgctcacagggcctacgatctggaaggaaagactgttggaactgtcggtgctgggcgtattggcaggctgttactccaaagactgaagcctttcaactgtcatctcctctatcatgaccggatcaagatggacccagagttggagaatcaaatcggtgcaaagtttgaggaggatcttgatgtgatgcttccaaaatgtgacattattgtcatcaacatgcctcttactgagaaaacaaaaggtatgtttaacaaggagaggatcgctaagttgaagaagggagttctcattgttaacaacgctagaggagctataatggatacacaagcagttgttgatgcctgttccagtggacatattgcaggctacagtggggatgtttggaatccacaaccagctccaaaggaccacccatggcgatacatgccaaaccaagccatgacccctcatatttctgggactacaatcgatgcacagttgcgatatgcagcaggagttaaggacatgttggataggtatttcaagggagaagagtttcctccacagcattacattgtcaaggagggtgaactcgctagccaataccgttaaacctgcgtttgcatgagtctacaagttgagtttgtctctgaacaccaagcataatcagcttctcgaataatgtagttacaagtgcgtttgcacgagtctacaaggagtttgttgctgaaccccaagcaataatcagcttctcgaataatgtagttncaagtcgagtgtccgagtttcctgctttctgccttcttagagcatatgtagactctatggattgaataatatgtttgtaatttcttggactgtctttataatgaatgaacgctatttttgtccttaaaaaaaaa

SEQ ID NO: 1616 - DNA, 1310 bp, Phalaenopsis aphrodite
ctcccatcacttttgcagagcactgatcaacgatcaggatgtggcgggcagcatcaaagcaagtgatccggactgtcggttcctccctctccgacctttcgcctctccggaagcagctccatgcttctcctgggaaaaagaaaatagtgggtgtgttctataaggggaacgagtatgcagcgaagaaccctaattttttggggacggtggagagggctttgggaatcagagagtggttggaaagtcaaggccaccagtacattgtaactgatgataaagatggccctaattccgaacttgagaagcacattcctgacctccatgttctaatcaccacccccttccaccccgcatacgtcaccgccgaacgaatacaaaaaagccaaaaacctccaactcctcctaaccgccggcatcggctccgaccacattgatctcaaagccgccgccgacgcgaagctcaccgttgccgaagtcaccggaagcaatgttgtgtccgtcgccgaagacgagctcatgagaattctcattctcgttcgaaacttcgttcctggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcgactgaagatcgatccggagttggagaaggagatcggagcgaagtttgaggaagatcttgatgtcatgcttcccaaatgtgatgttgttgtgatcaatacacctcttactgagaagacaaagggattgtttgataggaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggggtgaaggacatgcttgacaaatacttcaaaggagaagactttcctcagcagaactatattgtgaaggaaggcaaacttgcaagccagtacctgtgaatctgtgattttcactctctactcggtctgaggggcagctgccttattatatgattatataaataaccctttgctggtggagttagtctggtctctgtattttctcttgtttgatgctttgagt

SEQ ID NO: 1617 - DNA, 1374 bp, Avena sativa
atcatcactctcatctctttcgtgctccgcgaagcgctttatctctcttcctctgctcgtgatttctccgccgggatccgtccatggcgatgttgagggccgccgggaggcagctcgtcgaccgggcggtcggatccagggccgcgcacacatctgcaggcagcaagaagatcgtcggtgtgttctaccaggccggcgagtacgccgacaagaaccccaacttcgtcggatgcgtcgagggcgccctcggcatacgggactggctggaatccaagggacataactacattgtcacggacgacaaggaggggatgaacagcgaactggagaagcacatcgaagacatgcacgtcctgataaccaccccgttccacccagcctatgttactgcagagaggatcaagaaggcaaagaaccttgagctgcttctcaccgctggaattggctcagatcatattgatttgccagctgctgctgctgcgggcttgactgttgcagaagttaccggaagtaacaccgtctctgtggcagaagacgagctcatgcgcatcttgattctgctcaggaacttcttgcctggctatcaacaggtcgttcaaggtgaatggaatgttgcaggcatcgctcatagagcttatgatcttgagggaaagactgtcggaactgtcggggctggtcgaattggcaggctcttacttcagcgtcttaagcccttcaactgcaacctgctctaccatgacagacttcagattaaccctgagcttgagaaagaaattggtgccaaatttgaagaggacctggatgctatgcttccaaagtgtgatgtcattgtgatcaacacgcctcttactgagaaaaccagaggcatgttcaataaagagaagattgcaaagatgaagaaaggtgtaatcatcgtgaataacgctcgtggagcaatcatggacacccaggcagttgctgatgcttgttccagcggtcatgttgctggatatggaggcgatgtctggttcccccaaccagcacccaaggagcacccatggcgctacatgcctaatcacgcaatgacccctcacatctctgggactacaatcgatgcacagctgaggtacgcggcgggagttaaggacatgttggacaggtacttcaagggcgaggacttccccgcggagaactacatcgtcaaggaaggcgagctcgccagccagtacaagtagagtaaaccaaccctcggcgctgcatggtgacattacctgaagtgcgagagaagagaaacaaaccattctgttgttgtatgagcgttccctgagaacgggaatgaataatggatgcctgcctgggggttgcgaccatggcagtgaataaaaagatttagga

SEQ ID NO: 1618 - DNA, 1665 bp, Pennisetum glaucum
ggactattgagcacaaacaggcccctcaacaaaacacaagtttagtgcttagactcccctgctcttcttccacatctatcagcggtcaacactcgcctccccaccgctgtccttggttcttcccctctccttccgcgaatccatggcgatgtggagggcggccgcgaggcagctggtcgaccgggcgatcggttcaagggccgcgcacacatctccaggcagcaagaagatcgtgggtgtgttctacaaggccggcgagtacgccgacaagaaccccaactttgtcggatgcgtcgagggagcacttggcatccgcaactggctcgaatcgcagggccatcactacattgtcaccgatgataaggagggccccaactgtgaactggagaagcacattgaagacatgcatgtcctgattaccaccccgttccacccagcttatgttactgcagagaggattaagaaggcaaagaaccttgagcttcttctcacagctggaatcggctctgatcatattgatttgccagcagccgctgctgcaggattaactgtggcagaggttaccggaagtaacaccgtctctgtggccgaagatgagctcttgcgcattctcattctggtcaggaacttcttgcctggatatcaacaggtggttcagggtgagtggaacgtcgcaggcattgctcacagagcttatgatcttgaaggaaaaactattggaactgtcggggccggtcgtattggcaggcttttgcttcagcgtcttaagcccttcaactgcaacctgctttaccatgacagactaaagatcgaccgagagcttgagaaagaaattggggccaagtttgaagaggacctggatgctatgcttccaaagtgcgatgttattgtgatcaacacacctctcaccgagaaaacaagaggcatgtttaacaaagagaggattgcaaagatgaagaaaggagtaataatagtgaataatgctcgaggtgcaatcatggatactcaggcagttgcagacgcttgttccagtggtcacattgctgggtacggtggtgatgtgtggttcccccagccggcaccgaaggatcacccctggcgctacatgcctaaccatgccatgacccctcacatctccgggactacaattgatgctcagctgcgatacgcggagggtgtgaaggacatgctgaacaggtacttcaaaggcgaagacttccctgtgcagaactacatcgtcaaggaaggccagcttgccagccagtatcaatgatatatctctttttctgaagagattgggaggggaaaaaaagaaacctgaaacctgtcatcgtatcagacctgtcagccattggaaataacaaggaaggcatcccatcgtggagacgaataaatcgtttatgtcctgtcatcgtaacagacgtgctgtggttagtctagggaggaacatctgtgttgggtgcttggcttggtgctaataatcccttatgtttaaaaaacagtatatccaccggaaaggaataattttttgagttcccgtgaatgtgtgtgtgagcaaatgcttttaaaatagggtgtctcctcatcaaatgactgaaaataagacatctctctatcacttttttcctgaccattgattatagatccaatggtgtattttctgtg

SEQ ID NO: 1619 - DNA, 1536 bp, Orobanche aegyptiaca
cgttcattacacaagtggggccttacggttctcttcggacctctctatgttataatatacacctgataaacgttatcctaatttcccaagttcagtaaaagtaaaaaaaaaaataggcgatgaagcgagctgctgcttctgtagttcgtgcatttacttcttcagggaacccatctgctccttcttcaatcttagccagacatattcatgcttcagttgctggaagcaagaagatcgtgggtgtattttacaaagcaaacgagtatgcttcgatgaatcccaattttgtgggttgtgttgagaatgcattaggcatacgcgaatggttggaatcacagggtcaccactatatagttactccagacaaagacggaccagattgcgagcttgataaacacataccggatctccacgtcttgataacgacccctttccacccggcatacgtcactgccgaaaggataaaaaacgcgaaaaatttgcaacttctgctgacagctggcatcgggtcggaccatatagatctcaaggccgctgctgatgctggactgacggtcgctgaggtcaccggaagcaacgtcgtctctgtagccgaagacgaactcatgaggatactcatactcgtccggaacttcttgcccggttatcatcaggttatcaatggtgactggaatgtggcggccatttctcatagagcttacgatctccaaggtaagactgtcggaactgtcggcgctggtcgtattggtcggcttttattgcagaggttgaaacctttcgactgtaatttactgtatcatgatcgtgttaagatggatacggagctagagagtgaaatcggagccaagtttgaggaggatcttgatgcgatgcttccgaaatgtgacgtaattgtcatcaatacacctcttactgagaaaaccaaagggatgtttgacaaagatcggatagcgaagctaaaaaaaggagttctaattgtgaacaatgctagaggtgcaatcatggatactcaagcagttgttgatgcttgttccagtgggcatattgcaggttacagtggagatgtttggtacccacagccagccccaaaggaccatccttggcggtacatgccgaaccaagctatgacacctcatatttccggaactaccattgacgcacagttgcgttatgcggccggagtgaaggacatgctggagcggtatttcaagggtgaggattttctggcagcgaactacattgtcaaggacggagagcttgctagccagtatcggtagatgtgggttcgcctagtgtttgattcgggggtctcgtgtgtttggactatgtattagtgcctaaataaagcgatctcgtgcatttcttttcgatcttttgaaactaccgatgaataaatgctttcgatcgagaacaaactttgcaaggttttatggtttttatttcttggttgacagacatttttatggcttttttcgttgaagtatccattttccatattttcagttatttaaatattgcattcggatatcaaaaaaa

SEQ ID NO: 1620 - DNA, 2124 bp, Arabidopsis thaliana
acacgtcacatctcttcttcttcttcttcttttccacttcagtctctgtttttagctctgtgatttgagtttttattttgcggtggcgttgtatggctatggcctttcctctttcttatactccgacgattactgttaaaccagtaacgtactctcggagatcgaactttgtagttttctcgtcgagttctaatggacgagatcctttagaggagaattcagtacctaatggtgtgaaaagcttggagaagcttcaagaagagaagcgtcgtgctgagttatctgctaggattgcttctggagctttcactgtacggaaatctagttttccatctacagtgaagaatggtttatctaagattggaataccaagcaatgttcttgatttcatgtttgattggactggttctgaccaagactaccccaaggttcctgaggctaaaggctcgattcaggcggtccggaacgaagctttcttcatccctttgtatgagcttttccttacttatggtggaattttcaggttgacctttgggcctaagtcattcttgatcgtgtcggatccttctattgctaaacatatattgaaggacaatgcaaaagcttactccaaggggattttagctgaaattctagattttgtgatgggaaaaggactcattcctgctgatggggagatatggcgtagacgaaggcgtgccattgttcctgcattgcatcaaaagtatgtagcagctatgattagtttattcggagaagcttcagataggctttgtcagaagcttgatgctgctgcattgaaaggggaagaagtagagatggaatcactcttctctcgtttgacacttgatattattggcaaggcggttttcaattacgactttgactcccttactaatgataccggtgtgatcgaggcagtgtacactgttctaagagaagctgaagacagaagtgtttcacctattcctgtttgggacatacccatttggaaagatatttccccacgtcagaggaaagttgctacttccttgaaattaatcaatgacacacttgatgatttgattgcaacatgcaagagaatggtagaagaagaggagttgcagtttcacgaggagtatatgaacgaaagagatcctagcatccttcactttcttttagcttcaggagatgatgtctctagtaagcagcttcgtgatgacttgatgacaatgcttatagccggacatgaaacatcggcggcagtattaacatggaccttttaccttttaacaacggaaccaagtgtagttgccaaacttcaagaagaggttgattctgtaattggagatagattcccaaccatacaagatatgaaaaagctgaaatacactactcgagtcatgaatgagtcattgagattatatccacaaccaccagtactgatccgtcgttctatagataatgatatacttggagagtatccgataaaaaggggagaggatatcttcatctcggtttggaatctacatcgaagtcctctgcattgggatgatgcagagaagttcaatcccgagagatggcctttggatggaccaaacccaaatgagacaaaccaaaacttcagttacttacctttcggtggaggaccgcggaaatgtataggcgacatgtttgcttcctttgagaatgtggtagcaatcgcaatgcttattcgaagatttaactttcagattgcaccaggagctcctccggtgaaaatgactacaggagctacaatacacaccacagaaggattgaaattgacagtaacaaagaggacaaaacctctggacataccatccgtaccgatacttccaatggatacttcacgggatgaagtttcatctgctctttcttaagtcttcatctttacaaaactgaaaacaaacaagctcagatgaagaagcaaaaatcttgtgttagaacagcaaatgttgaattgttggaacatgaccaatgctttctgattatttatctgcactgtaaaatgcagacaagtaaaatgagaagatttattattctttggaaaaaaaaatgtttttgtctgcacagtgaagataatataacttctgggttctatgtaagttcaaatattttctagga

SEQ ID NO: 1621 - DNA, 1730 bp, Eutrema halophilum
aaggtttaacaacctccaccatagactttcttgagcaaagagattggttataaaggaccaaccattttcatgtagagtaatcattctactatcgagagagagagaaaaagagagcaaaatgagctttaaccggaatttattaaatataataatagtcctttgtgtatgtctcagttgggactgtaacgagggagctcaagaaagagagaagagagagattgattctcatactattcaactcagctctctcttcccttcttcatcatcttgtgttctttctagcagagcgtctaagacaaagtcctcactgcacgtgacgcacagacacggcacgtgctcgcgtttaaccagtggcaaagccaagagtccagaccatgtcgaggtcctcagactcgaccaagcgcgcgtaaaatccatccactcaaaactatcgaagaaactcacagatcgagtcaggcaaagccagtccacggatctaccggcaaaagacggaagcacattcggatcaggaaactacgtagtcacggtcggaatcggaacgccgaaacacgatctgtctctgatcttcgataccggaagcgatctgacgtggactcaatgcgagccatgtgttcgatcttgctattcacaaaaggaacccatctttaacccttcttcctcttcttcttactacaacgtctcctgctcatcgtcggcgtgtggatctctctcttctgctacaggaaacgctggaagttgttcggcttctaattgcctctacggtattcaatacggcgaccaatcgttctctgttggatttctcgccaaggagaaatttaccctaacgagctccgatgtcttcgacggcctttatttcggctgcggcgagaacaaccaaggacttttcaccggagtcgccggacttctcggacttggccgcgacaagctctcatttccgtctcagacggcgacgacctacaataagatgttctcctattgccttccttcttccgctagctacaccggacatctcacattcggatccgccggaatctctagatccgtcaaatacactccgatttccaccatcacagatggcacatcattctatggcctcgatatcgtcggaatcaccgtcggcggtcagaaattggcgattccatcaaccgtattctctactccgggagctctaatcgactccggaaccgtcatttctcgccttccgccgaaagcctacgcggcgctgcggagcgcgttcaaggcgaagatgtcaaagtatccgtctacctcggccgtctcgatcctggacacgtgcttcgatctcaccggatttaagacggtgacgatcccgaaagtagcgttctctttcagcggcggcgccgtcgtggagcttggctcgaaagggattttgtacccgtttaaggtatcgcaggtttgtttggcgttcgctgggaatagcgacgacaataacgctgccatctttggaaacgttcagcagcaaacgctagaagttgtctacgatggtgcgggcgggcgggtcgggtttgctcctaatggctgtagttaattgaaaaaaatatggtaaaattatgtctctctctctctatggatttggcacaaatcagctctatcctccagttaagtatgtattttgggaaaggtcttgaagtaattgtacagtaataaggttgtgttgaactgttgatacaacattattgcacctttcattatagaagcccaaactttaattt

SEQ ID NO: 1622 - DNA, 1729 bp, Eutrema parvulum
aaactttaacaacctccactagagcaaagccatttgcttataaaggaccaaccatgttcatgttattgagtgacacttttatcattgcgagagagaaagaagagagaagaagaagaacaacaaaaatgagttttaataggaagttgttgaatatcataataatcctttgtgtatgtctcatctggagctgtactgatggagctcgaaaattagagagtgaagagattgattctcatactatccaactcagctctctcttcccttcatcatcatcaccttgtgttctttctaccagagcgtctaatataaagtcctcactgcacgtgacgcacaggcacggcacgtgctcgcctttaaccagtggcaaagccacgagtccagaccatgtcgagatccttagacttgaccaggcgcgtgtaaactcgatccactcgaaactgtcgaagaagctcacagaccgagtcaggcaaagccagtcaacggatctacctgctaaagacggaagcacctacggatcaggaaactacgtcgttacggtcggaatcggaacaccgaagcacgatctgtctctgatcttcgacaccggcagcgatctgacgtggattcaatgccagccatgtgttcaaacttgctattcccaaaaggaacccatctttaacccttcttcgtcttcctcctactccaacgtctcctgctcttcggcggcttgtggttctctctcttcttccacaggtaacgctggaagctgctcggcttcgaattgcgtctacggtattcaatacggcgatcaatcattctccgttggatttctcgccaaggagaaatttgccctaactagctccaacgtattcgacggcgtttacttcggctgcggggagaacaaccaaggacttttcaccggtgtcgccggacttctcggacttggccgtgacaagctctctttcccgtcgcagactgcgacgacctacagtaagatcttctcctactgcctcccttcttcagctagctacacgggacatctcaccttcggatccgccggaatctccaaatccgttaaatacactccgatttccacaatcacagatggcacatccttttatggtcttgatatcgtcggaatcaccgtcggcggtcagaaattggcgattccttcaaccgtgttctctacgccgggagctctaatcgactcaggaaccgtcatttctcgtctcccgccgaaagcgtacgcggcgttgcgaagcgcgttcaaggcgaagatgtcgcagtatccgaatacatcggccatctcgattttggacacgtgcttcgatctcagcggatttaagacggtgacgatcccgaaagtggcgttctccttcagcggtggcgccgtcgtggagcttggatctaaagggattttgtacgcgtttaagtcatcgaaggtttgtttagcttttgcagggaatagcgatgacaataacgccgccatcttcgggaacgttcagcagcaaacgctagaagttgtgtacgacggtgcggccgggcgggtcgggtttgctccaaatgggtgtagttaaactaaaaacgggtgggtatgtttaatttatggatatggcacaatttagctttatccttaatcaaatgtgtgtaatttgggtgagcatcacatatagtctgtcaagtaaattgtacagtaataagtttgtgtggctgatacaacagtcacatacacaccttttattggagaaac

SEQ ID NO: 1623 - DNA, 1642 bp, Arabidopsis lyrata
aaagttaaacaacctccactagcgactttctttgagcaaaaagattggttataaaagaccaaccattttcatgttaccgaatgtcatttttttgagggagagaaagagaagagagcaaaatgagcataaataggaatttgttgaatatcataataatcctttgtgtatgtctcaatttgggttgtaacgagggagctcaagaaagagagattgatgattctcatacaatccaagtcagctctctcttcccagcatcatcatcatcttgtgttctttctcccagagcgtctaccacaaagtcctcactgcacgtgacgcatagacacggcacgtgctcgcgtctaaacaatggcaaagccacgagtccagaccatgtcgagatcctaagactcgaccaggctcgcgtaaactcaatccactcaaaactgtcgaagaaactcacaacaaatcacgtcagtcaaagccagtcaacggatctaccggctaaagacggaagcacactcgggtcaggaaactacatcgtgacggtcgggctcgggacaccaaagaacgatctatcactaatcttcgacaccggaagcgatttaacgtggactcaatgtcagccatgtgttcgaacttgctatgaccaaaaggaaccaatctttaacccttccaagtctacttcttactacaacgtctcctgctcatcagcagcgtgtggttccctctcttcagctacaggaaacgccggaagttgttcggcttcgaattgcatctacggtattcaatacggcgatcaatcattctccgtcggatttctcgccaaggataaatttacactaacgagctccgacgtattcgacggtgtttatttcggttgcggtgagaacaaccaaggacttttcaccggtgtcgccggacttctcggtcttggccgtgacaagctttcatttccgtctcagacggctacggcttacaataagatcttctcttactgtctcccttcctccgctagctacaccggacatctcaccttcggatccgccggaatctccagatcagtaaaattcacaccgatttcaaccatcactgatggaacctccttctacggccttaatatcgtcgcaatcaccgtcggcggtcagaaactgccgattccttcaaccgtcttctctactccgggagctttaatcgattcaggaaccgttatcactcgtctcccgccaaaagcctacgcggcgttacgaagctcgttcaaggcgaagatgtcaaagtatccgaccacgtcaggcgtctcgatcttggacacgtgtttcgatctcagcggatttaagacggtgacgatcccgaaagtggcgttctctttcagcggtggcgctgtcgtggagcttggctcgaaagggatattttacgcgtttaagatatcacaggtttgtttggcgtttgcagggaatagcgatgacagtaacgctgccatctttggaaacgttcagcagcaaacgctagaagttgtgtatgatggtgcgggtgggcgggtcgggtttgctccaaatgggtgtagttaagttagttaatgaaaaaaaaaaacgggtaatttaaaatttatggatttggcacaaattagctttatccttaattaagtgtgtaattcgggtaaaga

SEQ ID NO: 1624 - DNA, 1721 bp, Arabidopsis thaliana
aaagcttaacaacctccactagagactttcttgagcaaaaaagattggttataaaggaccaaccattgtcatgttattgagtgtcatttttgtgagggagagaattaagagagcaaaatgagcataaataggaatctgttgaatatcataataatcctttgtatatgtctcaatttgggttgtaacgatggagctcaagaaagagagactgattctcatactatccaagtcagctctctcctcccttcatcatcatcatcttgtgttctttctcccagagcgtctactacaaagtcttcactgcacgtgacgcatagacacggcacgtgttcgcgtctaaacaatggcaaggccacgagtccagaccatgtcgagatcctaagactcgaccaggctcgcgtaaactcaatccactcaaaactatcgaagaaactcgcaacagatcacgtcagtgaaagcaagtcaacggatctaccggctaaagacggaagcacactcggttcaggtaactacatcgtgacggtcggcctcgggacaccaaagaacgatctatcactaatcttcgacactggaagcgatttaacgtggactcagtgtcagccatgtgttcgaacttgctatgaccagaaggaaccaatctttaacccttctaagtctacttcttactacaacgtatcctgctcatcggctgcgtgtggttctctctcttctgctacaggaaacgccggaagctgttcggcttcgaattgcatctacggtattcaatacggcgatcaatcgttctccgtcggatttctcgccaaggagaagtttacactaacgaactccgacgtatttgacggcgtttatttcggttgcggcgagaacaaccaaggacttttcaccggtgtcgccggacttctcggtcttggtcgtgacaagctttcgtttccgtcgcagacggcaacggcttacaataagatcttctcttactgcctcccttcctccgctagctacaccggacatctcacattcggatccgccggaatctccagatccgttaaattcacaccaatttcaaccatcactgatggaacttccttctacggccttaatatcgtcgcaatcaccgtcggcggtcagaaattgccgattccttcaactgtattctctactccgggagctttaatcgattccggcaccgttatcactcgtctcccgccgaaagcctacgcggcgttaagaagctcgttcaaggcgaagatgtcaaagtatccgaccacgtcgggcgtctcgatcttggacacgtgtttcgatctcagcgggtttaagacggtgactatcccgaaagtggcgttctctttcagcggtggcgccgtcgtggagcttggttcgaaagggatattttacgtgtttaagatatctcaggtttgtctggcgtttgcagggaatagcgatgacagtaacgctgccatctttggaaacgttcagcagcaaacgctagaagttgtgtatgatggtgcgggtgggcgggtcgggtttgctccaaacgggtgtagttaagttagttaatgaaaaacagaacggggtaaattttaaatttatggatttggcacaaattagctttatccttaatcaagtgtgtaatttgggtaaagatcggaattcgtgatggtctttgaagtaattgtatagtaataagtgtgcatgatacaacaattacaagaacaaactgtttattg

SEQ ID NO: 1625 - DNA, 1228 bp, Brassica napus
tcccaacttttttttttcttcctttctccaaacagacaagaaagaacaatcccgctattctatctacccggaagaagaagaaaacaaacatgtgtagtaagatggcgtttgctctaacaatccctcgatttcactctccaatttctcgcaaacccaccaccacttgttcatctcctccttcgaagacacagtctgctcacttcagccatggacgatccatttctctcagacgaagacttttcttattacccgtcaaagccactaccgatcagtcaggtcaggtgggtggggaagaagttgatagcaagatcttaccttactgtagcatcaacaagaacgagaagagatcaatcggtgaaatggagcaagagtttctccaagcgatgcaatcattctattatgaaggaaaggctgttatgtctaacgaagagtttgataaccttaaagaagagttgatgtgggaaggaagcagtgttgtcatgctaagttctgatgaacaaagattccttgaagcttcaatggcttatgtgtctggcaatccaattttgagtgatgaagaatacgacaagctcaaaatgaaactgaagatggacggaagtgagattgtttgtgagggtcctagatgcagtcttcgtagtaaaaaggtttacagtgatctcgccgtagattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtgtatcttgcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccaaggtttcattctcaggggaaatgtattatgtaatattgatactaatagatgaacaagatggagaaatcaaagaagagaaaaagaaagcaaaagagtttgtttgtgtgctgtctttatagacttcagacgtttccttgtagtctgtcattgactggtattgtgt

SEQ ID NO: 1626 - DNA, 1327 bp, Brassica oleracea
  misc_feature (1311)..(1311): n is a, c, g, or t
  misc_feature (1318)..(1318): n is a, c, g, or t
agggagaatacttccatcataatctcaattctcaaccacaggtccaaacctcccaactttttttttcttcctttctccaaacagacaagaaagaacaatcccgctattctatctacccggaagaagaagaaaacaaacatgtgtagtaagatggcgtttactctaacaatccctcgattcaactctccaatttctcgcaaacccaccaccacttgttcatctcctccttcgaagacacagtctgctcacttcagccagggacgattcatttctctcagacgaagacttttcttattacccgtcaaagccactaccgatcagtcaggtcaggtgggtggggaagaagttgatagcaagatcttaccttactgtagcatcaacaagaacgagaagagatcaatcggggaaatggaacaagaatttctccaagcgatgcaatcattctattacgaaggaaaggctgttatgtctaacgaagagtttgataacctcaaagaagagttgatgtgggaaggaagcagtgttgtcatgctaagttctgatgaacaaagattccttgaagcttcaatggcttatgtgtctggcaatccaattttgagtgatgaagaatacgacaagctcaaaatgaaactgaagatggacggaagtgagattgtgtgtgagggtcctagatgcagtcttcgtagtaaaaaggtttacagtgatctcgccgtagattatttcaaaatgttcttgttgaacgtaccagcaaccgttgtggctctcggactgtttttcttccttgatgaccttacgggttttgaaattacgtacttgctcgagcttccggaaccattcagtttcatcttcacatggttcgctgcggtgcctgcaattgtgtatcttgcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcaccttaccagaaggaggcaatgcttaaacactatgggccaaggtttcattctcaggggaaatgtatgtaatattttgatactaatagatgaacaagatggagaaatcaaagaaaagcaaaagagtttgttttgtgtgctgtcttttataagcttcagacgtttccatgtagctgtcattgactggtattgtgtgttgtaagtaaatctgaggtgaaatcagagaaaaaacaccatgngattacntctttgagg

SEQ ID NO: 1627 - DNA, 1274 bp, Brassica rapa
tcctttctccggaaaccacaagaaagaacaatctcgatcgtctctctcccgggaagaggaaaagaaacatgtgtagtaagatggcgtttactctaacaatccctcgattccactctccagtttctcgcaaatccaccaccacttgttcttctcctccttcgaggacacactctgctcagttcagccctcgacgatctatttctctcagacgaagacttttcttattacccgtcaaagccactaccgatcagtcaggtcaggtgggtggggaagaagttgatagcaagatcttaccttactgtagcatcaacaagaacgagaaaagatcaatcggtgaaatggaacaagagtttctccaagcgatgcaatcattctattacgaaggaaaggctgttatgtctaatgaagagtttgataaccttaaagaagagttgatgtgggaaggaagcagtgttgtcatgctaagttctgatgaacaaagattccttgaagcttcaatggcttatgtgtctggcaatccaatcatgagtgatgaagaatacgacaagctcaaaatgaaactaaagatggacggaagtgagattgtgtgtgagggtcctagatgcagtcttcgtagtaaaaaggtttacagtgatctggccgtagattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtgtatcttgcgctatcactcacaaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccaaggtttcattctcaggggaaatgtattatgatgtaatattgatactaatagataaacaagatggagaaatcaaagaagagaaaaagaaaagcaaaagagtttgttttgtgtgctgtcatttataagcttcagacgtttccatgtagctgtcattgactggtattgtgtgttgtaagtaaatctgaggtgaaatcagagaaaaaacaccatgtgatactcaaaaacccgcg

SEQ ID NO: 1628 - DNA, 1313 bp, Brassica napus
ctccggaaaccacaagaaagaacaatctcgatcgtctctctcccgggaagaggaaaagaaacatgtgtagtaagatggcgtttactctaacaatccctcgattccactctccagtttctcgcaaatccaccaccacttgttcttctcctccttcgaggacacactctgctcagttcagccctcgacgatctatttctctcagacgaagacttttcttattacccgtcaaagccactaccgatcagtcaggtcaggtgggtggggaagaagttgatagcaagatcttaccttactgtagcatcaacaagaacgagaagagatcaatcggtgaaatggaacaagagtttctccaagcgatgcaatcattctattacgaaggaaaggctgttatgtctaacgaagagtttgataaccttaaagaagagttgatgtgggaaggaagcagtgttgtcatgctaagttctgatgaacaaagattccttgaagcttcaatggcttatgtgtctggcaatccaatcatgtctgatgaagaatacgacaagctcaaaatgaaactaaagatggacggaagtgagattgtgtgtgagggtcctagatgcagtcttcgtagtaaaaaggtttacagtgatctcgccgtagattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtctatcttgcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccatggtttcattctcaggggaaatgtattatgatgtaatattgatactaatagataaacaagatggagaaatcaaagaagagaaaaagaaaagcaaaagagtttgttttgtgtgctgtcttttataagcttcagacgtttccatgtagctgtcattgactggtattgtgtgttgtaagtaaatctgaggtgaaatcagagaaaaaacaccatgtgattacttcttttgaggaatttcgctctcactagaaaaagtaaaatggaacaacaagttgcct

SEQ ID NO: 1629 - DNA, 1393 bp, Raphanus sativus
ggatcacacaaacgttacgaaaaaaaatcagaacacttccatcacaatctcaattctcaaccatagatccaaacctcccaaccttttttttcttcccggaaatcacaagaaagaacaatcacgatcttctatctccccggaagaagaaaaacaaacatgtgtagtaagatggcgtttactctaacaatccctcgatttcactctccaatttctcgcaaacccaccaccaccaccacttgttcatctcctccttcgaggacacagtctgctcacttcagccatgaacgatccatttctctcagacgaagacttttcttattacccgtcaaagccactaccgatcagtcaggtcaggtgggtggggaagaagttgacagcaagatcttaccttattgtagcatcaacaagaacgagaagagatcaatcggtgaaatggagcaagagtttctccaagcgatgcaatcattctattacgaaggcaaggctgttatgtctaacgaagagtttgataacctaaaagaagagttgatgtgggaaggaagcagtgttgtcatgctaagttccgatgaacaaagattccttgaagcttcaatggcttatgtgtctggcaatccaatcatgactgatgaagaatacgacaagctgaaaatgaaactaaagatggatggaagtgagattgtgtgtgagggtccaagatgcagtcttcgtagtaaaaaggtttacagtgatcttgcagtagattatttcaaaatgttcctgttgaatgtaccagcaaccgttgttgctctcggactgtttttcttccttgatgaccttactggttttgaaatcacttacttgctcgagcttccggaaccattcagtttcattttcacatggtttgctgcggtgcctgcaattgtgtatctggcgctatcactcaccaagctgatcatcagagactccttgatcttgaagggcccttgtccaaactgtggaacagagaatacatccttctttggaacaatactgtccatctccaatgatggttccaccaacaatgttaaatgctccggatgtggaacggcgatggtctatgactcaagtactcgtttgatcacattaccagaaggaggcaatgcttaaaccctatgggccaaggtttcatttctcagggagatgtatgtaaaattgatactaatagatgaagaaggtggaaaaattaagcaaaagggttattttgtgtgcttctataatcttcagatgtttccgtgtagctctcgttgacttgtattgtgtgttgtaagtagatgtgaggtgaaatcagagaaagaacaccatgtgattacttctttggggaatttcgctctcactagaaaaataaaatgaaaaaatggcacaacaaattacctac

SEQ ID NO: 1630 - DNA, 1650 bp, Eutrema halophilum
atggctactttcttctcttcgtcgatgatgaaactcttggaaatcggaatgtcatcgaagtctggtcccatatccattttcaagaacttgctccacaacacattttctgcctcaatctttgtagtaatccatatctcaatctcatttggacaagcttcgttgtgctattctcaattctcaaccacaaatcctaaagatcctaacttttgttttactttcccggaaatcacacgaaagaaggatttcagtctctcctctttcccggaagaaaaaagtatgtgcagtaagatggcgtttactctaacgatccctcgattttactctgcgatttctcgcaaacccaccacttgttcatcttcttcgttctcgtcgtcgccttcgaggccacagtgtgcttacttcagctatagacgatcgatttctctcagacgaagacttttcttattgcccgttaaagctaccactgatcaatcaggtccggtgggtggagaagaagtggatagcaagattttaccttattgtagcatcaacaagaatgagaagagatcactcggcgaaatggaacaagagtttctccaagcgatgcaatcattctattacgaaggcaaagcgattatgtctaacgaagagtttgataaccttaaagaagagttgatgtgggaaggaagcagtgttgtgatgctaagttctgatgaacaaagattccttgaagcttcgatggcttatgtctctggaaacccaatcttgagtgatgaagaatatgataagctgaaaatgaaactaaagatggatggaagtgatattgtgtgcgagggtccaagatgcagccttcgtagtaaaaaggtttacagtgatctagccgtagattatttcaaaatgttcttgttgaatgtaccagcaactgttgttgctctcggactatttttcttcctcgatgaccttacgggttttgaaatcacgtaccttctcgagcttccagaaccattcagtttcattttcacgtggttcgctgcggtgcctgcaattgtatatctggcgctctcactcactaagctaatcatcaaggacttcttaatcttgaagggcccttgtccaaactgtggaacagagaatacatccttctttggaacaatactatctatctccaatgacggttccaccaacaatgtcaagtgctccggctgtggaacggagatggtttatgactcgagttctcgtttgatcacattgccagaaggaggcaaagcttaaacaattaagccaaggttgaaatctcatcggaaatgtatgtaaaatttatactaacagttgaaggaaggtggagaaatcaaagaagaaagaaggagaaaaggcaaaagagtttgtttgtgtgctgttttgtataatcttgagatctttccatgtagctctcgttgacttgtattgtgtttgtaagtaagtgtgaggcgcaatcagagagaaacatcatataattacttctttggggaatttcgctctcactagaaaaaaaatcaagaaaaaatggcacaacaattacatacatttgattttttttttatttgatagtttaatatgtgtgtatcatataacttgcatagaaaatcttattaatccttgtgaactgtaatatcaaatatgatgttttaaatc

SEQ ID NO: 1631 - DNA, 1298 bp, Eutrema parvulum
acatttccatcacaatctcaattctcaaccacaaatccaaagctcctaactttttttttgctttccccagaaaacacaagaaagaaagatctcaatcttctctttccctgaggaaagaaaatatgtgcagtaagatggcgtttactctaacattccctcgattttactctgcaaattctcgcaaacccaccacttgttcatctccttctccttcgttctcgtcgtctctttcgaggactcagagtgctcacttcagccatggacgatcgatttctcttagaagaagactttttctattgcccgttaaagctactactgatcaatcaggtcaggtgggtggagaagaagttgatagcaagattttaccttattgtagcatcaacaagaatgagaagagatcactcggcgaaatggaacaagagtttctccaagcgatgcaatcgttctattacgaaggcaaagcgattatgtctaatgaagagtttgataatcttaaagatgagttgatgtgggaaggaagcagtgttgtcatgctaagttctgatgagcaaagattccttgaggcttcaatggcttatgtctcaggaaacccaatcttgaatgatgaagaatacgacaagctgaaaatgaaactaaagatggacggaagtgaaattgtgtgtgagggtccaagatgcagtcttcgtagtaaaaaggtttacagtgatctcgcagtagattatttcaaaatgttcttgttgaatgtaccagcaaccgttgttgctctcggactatttttcttccttgatgaccttactggttttgaaatcacgtacttgctcgagcttccggaaccattcagtttcattttcacatggttcgctgcggtgcctgcaatcgtatatctggcgctatcactcaccaagctgatcatcaaggacttcttaatcttgaagggcccttgtccaaactgtggaacagagaatacatccttctttggaacgatactatccatctccaatgacggtaccaccaataatgtcaaatgttccggctgtggaacggagatgatctatgactcgagttctcgtttgatcacattaccagaaggaggcaaagcttgaaccaaggttcaattctgatcaaactaattcttgaaaatgtatgtaaaattgatactaacagatgaagaaggtgaagaaactaaagaaacaaaacagaaaaagcaaaagagtttgtttgtgtaatgttttgtataatcttcagatattttcatgtttcctctcgtggacttgtattgtgtttgtaagtaaatgtga

SEQ ID NO: 1632 - DNA, 1438 bp, Arabidopsis thaliana
acagtaaaaaacatcaccatctcaattctcaaccacacaaatccaaagcttctaactttttttttgttcttcgtcccggacaaaaaaaaacaacgatctcactcaatcatcggcgtgagggataaagacgatggcttttactctaacaatccctagattttctgcaatttctcgcaaacccatcacttgttcttcttcgaggacacagtgtcctgctccctttacccatggacgatcgatttctctcagacgaagacttaccttattgccccttaaagcttctactgatcaatcaggtcaggtgggtggggaagaagttgatagcaagattttaccttattgtagcatcaacaagaatgagaagagaactatcggtgaaatggaacaagagttcctccaagcgatgcaatcgttttattacgaaggcaaagcgattatgtctaatgaagagtttgataaccttaaagaagagttgatgtgggaaggaagcagtgttgtcatgctaagttctgatgaacaaagattccttgaagcttcaatggcttatgtctctggaaatccaatcttgagtgatgaagagtatgataagctcaaaatgaaactaaagatggacggcagtgagattgtgtgtgagggtccaagatgcagtcttcgtagtaaaaaggtttatagtgatcttgccattgattacttcaaaatgttcttgttgaatgtaccagcaactgttgttgctctcggactatttttctttcttgatgacattactggttttgaaatcacgtacctgctcgagcttccggaaccattcagtttcattttcacatggttcgctgcggtgcctgcaattgtatatctggcgttatcactcaccaaactgatcctcaaagacttcttgatcttgaagggcccttgcccaaactgtggaacagagaatgtatctttctttggaacgatactatccatccccaatgatagtaacaccaacaatgtcaaatgctcaggctgtggaacggagatggtctatgactcaggttctcgtttgatcacattaccagaaggagggaaagcttaaatctaagagccaagggttatgtagaagtgtatgtaaaattaatactaacaaatgaagaaggtggagaaattgaagaagaaggagaaaaaccaaagtttgtatgctgttttgtataatcttcagatcttttcatgtagctctcattggcttgtgttgtgtttgtaagtaagtgtgaggcacattcaaagaaaaacatcatatgattacttctttgagaaactttgctctcattaggaaagtaaaataattcaagaaataagcacaaccttgtgtagttttgaaataatacttgtattttttttgttgttataattttgaatgtgttccataatatagtttcgttaatccatgtgaaaatcaaatatg

SEQ ID NO: 1633 - DNA, 1126 bp, Brassica napus
aagacacagtctgctcacttcagccagggacgattcatttctctcagacgaagacttttcttattacccgtcaaagccactaccgatcagtcaggtcaggtgggtggggaagaagttgatagcaagatcttaccttactgtagcatcaacaagaacgagaagagatcaatcggggaaatggaacaagaatttctccaagcgatgcaatcattctattacgaaggaaaggctgttatgtctaacgaagagtttgataacctcaaagaagagttgatgtgggaaggaagcagtgttgtcatgctaagttctgatgaacaaaggttccttgaagcttcaatggcttatgtgtctggcaatccaatcatgagtgatgaagaatacgacaagctcaaaatgaaactgaagatggacggaagtgagattgtgtgtgagggtcctagatgcagtcttcgtagtaaaaaggtttacagtgatctcgccgtagattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtgtatcttgcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccaaggtttcattctcaggggaaatgtattatgtaatattgatactaatagatgaacaagatggagaaatcaaagaagagaaaaagaaaagcaaaagagtttgttttgtgtgctgtcttttataagcttcagacgtttccttgtagctgtcattgactggtattgttgtaagtaaatctgaggtgaaatcagagaaaaaacaccatgtgattacctctttgaggaatttcgctctcgctagaaaaa

SEQ ID NO: 1634 - DNA, 1159 bp, Arabidopsis lyrata
aaatcatcaccatctcaattctcaaccacacaaatccaaagcttccaacttttttttttcttcttcttcccagacaacgatctcactcaatcatctaaaaacgatggcctttactctaacaatccctcgattttctgcaatttctcgcaaacccatcacttgttcttcttcgaagactgctcactttactcatggacgatcgatttctctcagaagaagacttctcttattgccccttaaagcttctactgatcaatcaggtcaggttggtggggaagaagttgatagcaagattttgccatattgtagcatcaacaagagtgagaagagaacaatcggagaaatggaacaagagtttctccaagccatgcaatctttctattacgaaggcaaagcgattatgtctaatgaagagtttgataaccttaaagaagagttgatgtgggaaggaagcagtgttgttatgctaagttctgatgaacaaagatttcttgaggcttcaatggcttatgtctctggaaacccaatcttgagtgatgaagagtatgataagctcaaaatgaaactaaagatggacggaagtgagattgtgtgtgagggtccaagatgcagtcttcgtagcaaaaaggtttacagtgatcttgccattgattacttcaaaatgttcttgttgaatgtacctgcaactgttgttgctctcggactatttttcttccttgatgacattacgggttttgaaatcacgcacctgctcgagcttccggaaccattcagtttcattttcacatggtttgctgcggtgcctgcaattgtttatctggcgctatcactcaccaaactgatcctcaaagacttcttgatcttgaagggcccttgtccaaactgtggaacagagaatgtatccttctttggaacaatactttccatccccaatgacagtaacaccaacaatgtcaaatgctctggctgtggaacggagatgatctatgactcaggttctcgtttgatcacattaccagaaggaggcaaagcttaaaacctatgagccaaggcaaatgtggaaatgtatgttaaatgatactaacagatgaagaaagtggagaaattaaacaagaagaagaaaatcaaaagagtttgtttgtgtcctgttttgtataat

SEQ ID NO: 1635 - DNA, 1143 bp, Cleome spinosa
aggaaatcaatagaaagccatttccttttctgtttccccgggaaatgggtagcaagatggcgttcactcttacaagccctcgatttttctcggcgatttctcgcaaacccaccactcgtttctctccttcttctccgacgacttcgaaggcacagtggaatctcttcagccatggaagatcagttcccctcagaagaagactgttcttgttgcccaccaaagctactaccgatcaatcgggtcaggtgggaggagaagaggttgatgatagcaagattttaccatattgtagcatcaacaagaatgaaaagaaaacaatcggcgaaatggaacaagagtttctgcaagcgatgcaagcattctattacgagggcaaagcggttatgtccaatgaagagtttgataaccttaaagaagagctaatgtgggaaggaagcagcgttgtgatgctaagttctgatgaacagagattcttggaagcttcaatggcttatgtgtctggaaacccaatcatgaatgatgaagaatatgataatttgaaattgaaactgaagatggacgggagtgaaattgtggttgagggtccaagatgcagtctccgtagcaaaaaggtgtacagtgatctctccgtagattatttcaaaatgtttttgttgaacgttccagctaccgttgttgccctcggactgtttttcttcctcgacgatcttacggggttcgagatcacataccttttggagctttccgaaccattcagtttcatcttcacgtggtttgccgccgtgcctgtcatagtttggcttgctctatctcttaccaaacttatcgttaaggatttcttgatcttgaagggcccttgcccaaactgcgggacagagaacgtctccttctttggaacgatactgtccatctccagcggcggaaccaacaacaacgtcaaatgcgccaactgtgcaaccgagatggtatacgactcgaaaacccgtttgatcacattgccagaaggtggcaaagcttgaacccgatgagggcaaaatgcatgtagtggtattgatactaacagttggaggaggaggaagaacaggtggttttttttttcagaataaaatagaaaataagtttgttgttgtatgatcgatccat

SEQ ID NO: 1636 - DNA, 1199 bp, Cleome spinosa
tgggtagcaagatggccttcactttgacaagccctcgatttttctcgtcgatttctcgcaaacccaccacttgtgtctctccttcttccccgccgtcttcgagggcacagtgtagtaatcacttcagtcatggaagatcgggttccgtcagtcgaagattgttcctgttgcccaccaaagctaccaccgatcaatcgggtcaggtgggaggagaggaggtcgatggcaagattttaccgtattgtagcatcaacaagaatgaaaagaaaacaatcggtgaaatggagcaagagtttctgcaagcgatgcaagcattctattatgagggcaaagccattatgtccaacgaggagtttgacaaccttaaagaagagctaatgtgggagggaagcagcgttgtgatgctaagttccgatgaacagagattcttggaagcttcaatggcttatgtgtctggaaatccactcatgaatgatgaagaatatgataagttgaaattgaaactgaagatggatggcagtgaaattgtggctgagggtccaagatgcagtctccgtagcaaaaaggtatacagtgatctatccgtagattatttcaaaatgttcttgttgaacgttccagcaaccgtcgttgcccttggactgtttttcttcctcgacgatcttactgggttcgagatcacataccttttggaactctcggaaccatacagtttcatcttcacgtggtttgcggccgttcctctcatagtttggctggctctatcactcaccaaacttatcgttaacgatttcctgatcttgaaggggccttgccctaactgcgggaccgagaacctctccttctttggaacaatactgtccatctccaatggcggcagcaccaacaaccttaaatgctccaactgtggaactgagatggtttacgattcaaaaacccgtctgatcacattgccagaaggaggcaaagcttaaaccgaggtatatgtacacattcatcccgtatatatacatggaaaaattgtacttctgggtactaacagaggaaagaagagatagttttgtgttgtatacctcagatgttacataagctcttgttgatgggcccatgcatttgtgttctgtaagtaatgtgcgtctgcaatgagagaatcaccacgagatgaaatacaaaaatagtattttttttctaaaaaaaac

SEQ ID NO: 1637 - DNA, 1328 bp, Cleome gynandra
gaagctcccagtgacaccaccacagccacagccgcttagttactgaatttttcccgcaaaacaatagaaagccaaatccttttttgtttcccggaaaatgggaagtaagatggcgttcactttgacaagccctcgatttttctcggcgatttctcgcaaacccaccacttgtttctctcccccttctccgtcgtcctcgagggtacagtggattcacttctgccatggaagatcagtttctatcagaagaagattgttcttgttgtccatcaaagctaccaccgatcagtcgggtcaggtgggaggtgaggaggaggtggacagcaagattttaccatattgtagcatcgataagaatgcaaagagaacactgggtgaaatggaacaagaatttcttcaagccatgcaagcattctattacgagggcaaagcgattatgtccaatgaggagtttgataaccttaaagaagagctaatgtgggaaggaagtagcgttgtgatgctcagttcggatgaacagagattcttggaagcttcaatggcttatgtctccggtaatccaatcatgagcgatgaagaatatgacaagctgaagttgcagctaaagatggatgggagtggtattgtcgctgagggtccacgatgcagtcttcgtagcaaaaaggtgtacagtgatctctccttggattatttcaaaatgttcttattgaacgttccagccactgttgttgcccttggactttttttcttcctcgacgatcttacggggtttgaaatcacataccttttggagctccctgaaccattcagttttatcttcacgtggttcgctgccgtcccgtttatagtttggttagccctatcgctcaccaaactgatcgttaaagatttctctatcttgaagggaccgtgcccaaactgcggaacagagaacgtttctttctttgggacgatattgtcgatctccagtggcggcaccaccaataacgttaaatgcaccaactgtggaaccgagctggtgtacgactccaaaactcgtctgatcacattgccagaaggaggcaaagcttgaagagagcgcaagggatgtgaaaatgaaaatgatactaacagatgatgaagaaggagaagaagggaacagaaaaagggtttctcagagggaaaagaacagaattttgtgttgtgttgtgttgtgttctgtaagtaaatttgtttgcaatgaatgaatacttcctcaatacattcaaacaatgtgatttaatgtataaattgttgtatatttatatgaattggattattttaaataaaattatataatttaaaatgat

SEQ ID NO: 1638 - DNA, 1521 bp, Cleome gynandra
gagtcggaatgaacctgaagctcctagtgacaccaccacaaccacagattccaagtacctgaattttcccggaaaacagtagaaagtaattttcttttctgtttcctggagaatgggtagcaagatggcattcactttgactatccctcgttttttctcggcgttttctcgcaaacccatcacttgtttctctccttcttctccgttgccttcgaggacacagtggaatcacgtcatccatggacaatcagtttccgttcgaagaagattgttcttgttgcccacccaagctacaaccgatcaatcaggtcaggtgggaggagaggaagaggtggatagcaagattttaccatattgtagcatcaataagaatgaaaagaaaacactcggtgagatggaacaagagtttctgcaagcgatgcaagcattctattacgagggtaaagcaattatgtcgaatgaagagttcgataaccttaaagaagagcttatgtgggaaggaagcagtgttgtgatgcttagttctgatgaacagaggttcttggaagcttcaatggcatatgtctctggcaaaccaatcatgagtgatgaagaatatgacaagctgaaattgaagctaaagatcgatgggagtgatatcgtggttgagggtccaagatgcagtctacgtagcaaaaaggtgtatagtgacctctccgttgattatttcaaaatgttcttgttgaacgttccagcaaccgttgtggcacttggactatttttcttccttgatgatcttacggggtttgaaatcacttatcttttggagctccctgagccattcagtttcatcttcacatggtttgctgccgtgcctttcatagtttggctatcaatatcgctcacgaaactcattgttaaagatttcttgatcttaaagggtccttgccctaactgcggaacagagaacgtttccttctttggaaccatactgtcaatctccagcggtggcacatccaataacgtcaaatgcaccggttgtggaacggagatggtgtatgactccaatacccgtttgatcacattgccagaaggagccaaagcttgaaccaagggggcaattgatgtaatagtaagaaaactaacagaggagaaggaagcaaaatggttttgtggtgttgttgttgtaagtaaagtgtgtgcagtgagagaaagaccatatgaacactacctcctcaacaaatgagatcatcagagaagatgggtttcatttatctttgtaaatcctcgttgtttcttctgttcattagaaaagatttgaataatttgttaggtatgaacaaattcaaagggaaagagacaagaaagacccacagtcatagtcaaaagggttgaaagacaactaaagtggggaacatgcaatgagatgagaccaaaggtgaagttttaaacctatgatacaatgcctaaaaggcaaactgcttacaaagcctttgcacgccaatgcctattcattttttaaaaaataataatgctaaaagg

SEQ ID NO: 1639 - DNA, 1389 bp, Eutrema parvulum
atctcttcataatttcttccctccaaaattaaaaataaaataaatataacaaataataaaaaaaatcagaacaaacctgaagctcacagtaactctcatcttcaaccacaggttcatctacctcccggaaaacagaggaaaaggagctcctttcttctcctggggaaaatgggtagcaagatgttgttcagtttaacaagccctcgacttttctccgccgtttctcgcaaacccaccacttctgtctctccttctcctccgtcgtcgtcgtcgaggactcaatgggctcagctcagccctggaagatcgatttccttgagaaaaagagtcttcttgttgcctgcaaaagccaccaccgagcaatcaggtcaagtgggaggagaagacgtcgatagcaatattatgccttattgtagcatcaacaaggctgagaagaaatcgattggtgaaatggaacaagagtttctccaagccatgcaatcgttttattatgatggcaaagcggtcatgtcaaatgaggagtttgataaccttaaggaggagttgatgtgggaagggagcagtgttgtgatgctaagctctgatgagcaaaggttcttggaagcttcaatggcttatgtttctggaaatccaatcctgaatgatcaagaatatgataagctgaaactgaaactaaagatggatggtagcgagattgtgtgtgaaggtccaagatgcagtctccgtagtaaaaaggtgtatagtgatctcgccgtagattatttcaaaatgctcttgctaaatgttccagcaaccgttgttgctctcggactgtttttcttcctggacgatgtcactggttttgagattacatacatcttggaacttccagaaccattcagtttcatattcacgtggttcgctgctgtacctttgattgtgtatctggctctatcgatcaccaaactgatcatcaaagacttcgtgatcttgaagggtccttgtccgaattgtggaacggagaatgtctccttcttcggaacaattctgtcaatctccagcggtggcaaaaccaacgctgtcaaatgcaccaactgtggaaccgcattggtgtacgactccgattctcggttgatcacattgccagaaggaagccaagcttgaaccctatgagatgaagatggaaagaagaagaatgggttttgtcagaagcaaaatagatttggtgctgtatatttaagatcttccatgttagctctctcctccttcacatgttttctgatttgtaagtattgtgtaagcaataagagaaatattttatgaatacttcttcaccattttataggtaaaatgataatttatttaaactgatatagcccgtaacgaaattaaattttattttagctttat

SEQ ID NO: 1640 - DNA, 1186 bp, Brassica juncea
aagaaaaaggaatctcctttcttctcccggtgaaatgggtagcaagatgttgttcagtttgacaagccccagactgttctccgtcgtttctcgcaaacccaccacttgtctctcttctccttctcctccctcatcttccagggctcaatgggctcaggtgagccctggaagatctatctccttgagaaaaagattcttcttgttgcctgcaaaagccaccacagagcaaccaggtcaagttggaggagaagacgttgatagcaatatcatgccttattgtagcatcaacaaggctgaaaagaaatcgattggtgaaatggaacaagagtttctccaagccttgcaatcgttctattatgatggcaaggcggttatgtcaaatgaggagtttgataaccttaaagaggagttgatgtgggaagggagcagtgttgtgatgctaagttctgatgaacaaaggttcttggaagcttcgatggcttatgtttctggaaatccaatcctcaatgatgaagaatttgataagctcaaactgaaactaaagatcgatggtagcgagattgtgtgtgagggtccaagatgcagtctccgtagtaagaaggtgtatagtgatcttgccgtagattatttcaaaatgctcttgctaaatgttccagcaaccgttgttgctctcggactgtttttcttcctggacgacattacaggttttgagatcacatacatcttggagctttcagaaccatacagtttcatattcacttggttcgctgccgttcctttgattgtatatctggctctaacaatcaccaaactgatcatcaaagacttcttgatcttgaagggtccttgtccgaattgtggaacggagaatacctccttctttggaacaattctgtcgatctcaagcggtggcaaaaccaacactgtaaaatgtaccaactgtggaaccgcgatggagtatgactcgggttctcggttgatcacattgccagaaggaagccaagcttgaactctgtgagatgaagatggaaaaaagaagaatgggttttgtcagaggcaaaatatagatttgatgctgtatacttaaagatcttgcatgttctttcacatgttttctgatatgtaagtattgtgtaagcaataagggaaatattttatgaatatattcaccaacctttcataggta

SEQ ID NO: 1641 - DNA, 1164 bp, Brassica rapa
cttctttcttctcccggtgacaatgggtagcaagatgttgttcagtttgacaagcccccgtcttttctccgccgtgtctcggaaacccaccgcttctctctcttctccatctccgaggactcagtgggctcagctcagccctggaaggtcgatctccttgagaaaaaggttcttcttgttgccagcaaaggccaccacagagcaatcaggtcaaggtggaggagaagacgttgatagcaatatcatgccgtactgcagcatcaacaaggctgaaaagaaatcaattggtgaaatggaacaagagtttctccaagccttgcaatctttctattatgatggcaaggcgactatgtcgaatgaggagtttgataaccttaaagaggagttgatgtgggaaggaagcagtgttgtgatgctaagttctgatgaacagaggttcttggaagcttcaatggcttatgtttctggtaatccaatccttaatgatgaagagtttgataagctcaaactcaaactaaagatcgatggtagtgagattgtgtgtgagggtccaagatgcagtctccgtagtaagaaggtgtatagtgatcttgccgtagattacttcaaaatgctcttgctaaatgttccagcaaccgttgttgctctcggactgtttttcttcctggacgacattacaggttttgagatcacatacatcttggagctttcagaaccatacagtttcatattcacttggttcgctgccgttcctttgattgtatatctggctctaaccatcaccaaactgatcatcaaagacttcttgatcttgaagggtccttgtccgaattgtggaacggagaatacctccttctttggaacaattctgtcgatctcaagcggtggcaaaaccaacactgtaaaatgtaccaactgtggaaccgcgatggagtatgactcgggttctcggttgatcacattgccagaaggaagccaagcttgaactctgtgagatggaaaaaggaagaatgggttttgtcagaggcaaaatatagatttgatgctgtatacttaaagatcttgcatgttctttcacatgttttctgatatgtaagtattgtgtaagcaataagggaaatattttatgaatatattcacctacctttcataggtaatatgata

SEQ ID NO: 1642 - DNA, 1531 bp, Brassica napus
aatgggtagcaacatgttgttcagtttgacaagcccccgtcttttctccgccgtgtctcggaaacccaccgcttctctctcttctccatctccgaggactcagtgggctcagctcagccctggaaggtcgatctccttgagaaaaaggttcttcttgttgccagcaaaggccaccacagagcaatcaggtcaaggtggaggagaagacgttgatagcaatatcatgccgtactgcagcatcaacaaggctgaaaagaaatcaattggtgaaatggaacaagagtttctccaagccttgcaatctttctattatgatggcaaggcgactatgtcgaatgaggagtttgataaccttaaagaggagttgatgtgggaaggaagcagtgttgtgatgctaagttctgatgaacagaggttcttggaagcttcaatggcttatgtttctggtaatccaatccttaatgatgaagagtttgataagctcaaactcaaactaaagatcgatggtagtgagattgtgtgtgagggtccaagatgcagtctccgtagtaagaaggtgtatagtgatcttgccgtagattacttcaaaatgctcttgctaaatgttccagcaaccgttgttgctctcggactgtttttcttcctggacgacattacaggttttgagatcacatacatcttggagctttcagaaccatacagtttcatattcacttggttcgctgccgttcctttgattgtatatctggctctaaccatcaccaaactgatcatcaaagacttcttgatcttgaagggtccttgtccgaattgtggaacggagaatacctccttctttggaacaattctgtcgatctcaagcggtggcaaaaccaacactgtaaaatgtaccaactgtggaaccgcgatggagtatgactcgggttctcggttgatcacattgccagaaggaagccaagcttgaactctgtgagatgaaccctatattcaaaccaccggagcgtgaaacgagacacaggatcgatcataaacatgttcatgcgtaaatgatattccgtgtttttaacggttttaaactcgttttggagcaattaaatggtcggttttaattaattttttggtctatttgatgcgttttggtgttcttaagtgtaatatgcaggttactagatagcttgcaagaaaagaacgcattcgggatttattcagaagcaagatggaccgaacaatggaccgaatgaagtattgatcgcacaggacacgagatcgaccgatccgggctacttggatcgaccgatcccaggctttcatacacgagatcgaccgatccgagccatgtggatcgaccgatctcaggcgctacgggctccacacgcacaaacgagcttttcactcctttttacccactcccctcaataattcacaaaagaactcgactttggagactcacaaaagaccaggggcgaccaaggaggagatttacaagttctagagagaagatttgagtgttttgtacttgttttggtgtgat

SEQ ID NO: 1643 - DNA, 1416 bp, Eutrema halophilum
atctctaatttcttccctccaaatcatctctactaaattaataaacaaataaaaaaaacaagcaattaaaaaaaaaatctcaaaatcagaacaaacctgaagctcacagtaacaaacgcatcttcaaccacaagctcctgcaaaaaatttcccggaaaacagaggaaaaggatctcctttactctcctagggaaaatgggcagcaagacgttgttcagtttgacaagccctcgacttttctccgccgtttctcgcaaacccaccgtttctttctctcctccgtcgtcgtcgaggtctcagtgggctcagctcagccctggaagatcgatttccctgagaagaagattcttcttgttgcctgcaaaagccaccacagagcaatcaggtcaagtggaaggagaagaagtcgatagcaatattaatgcttattgtagcatcaacaaggctcagaagaaatcaattggtgaaatggaacaagagtttctccaagccttgcaatcgttctattacgatggcaaagcgatcatgtcaaatgaggagtttgataaccttaaagacgagttgatgtgggaaggaagcagtgttgtgatgctaagttcggatgaacaaaggttcttggaagcttcaatggcttatgtttctggaaatccgattctgaatgatgaagaatatgataagctgaaactgaaactaaagatggatggtagcgacattgtgtgtgagggtccaagatgcagtctccgtagtaaaaaggtgtatagtgatctcgccgtagattatttcaagatgctcttgctgaatgttcctgctaccgtcgttgctctcggcctattcttctttctggacgacattacaggttttgagatcacatacatcttggagcttccggaaccattcagcttcatattcacgtggttcgctgctgtgcctttgattgtatatctggctctatcaatcaccaaattaatcatcaaagacttcttgatcttgaagggtccttgtccgaattgtggaacggagaatgtctccttctttggaacaattcttacaatctccagtggcggtaaaaccaacgctgtcaaatgctccaactgtggaacagcaatggagtatgactcgggttctcggttgatcacattgccagaaggaagccaagcttgaaggctgtgaggtgaagatgggaaaagaagaatgggttttgtcagaagcaaaatagatattgatggttgtatatttaagatcttccatgttagctctttcctccttcacatgttttctgatttgtaagtattgtgtaagcaataagagaaatattttatgaatacttcttctatcaaccttttgtagtgataatatagtctttaataataagttaggtatcaaactgatctaacccgaaacgaaacaaaatatttt

SEQ ID NO: 1644 - DNA, 1128 bp, Brassica napus
ttcttcttccagggaaaatgggtagcaagatgctgttcagtttgacaagccctcgtcttttctccgccgtgtctcgcagacccaccgcctctctctcttctccatctccgaggactcagtgggctcagctcagccctggaaggtcgatctccttgagaaaacgattcttcttgttgccagcaaaggccaccacagagcaatcaggtcaaggtggaggagaagacgttgatagcaatatcatgccgtactgcagcatcaacaaggctgaaaagaaatcaattggtgaaatggaacaagagtttctccaagccttgcaatctttctattatgatggcaaggcgactatgtcgaatgaggagtttgataaccttaaggaagagttgatgtgggaaggaagcagtgttgtgatgctaagttctgatgaacaacggttcttggaagcttcaatggcttatgtttctggtaatccaatcctcaatgatgaagaatttgataagctgaagctgaaactaaagatcgatggtagcgagattgtgtgtgagggtccaagatgcagtctccgtggtaaaaaggtgtatagtgatcttgcagtagactatttcaaaatgctcttgctaaatgttccagcaaccgttgttgctctcggactgtttttcttcctggacgacattacaggttttgagatcacatacatcttggagctttcagaaccatacagtttcatattcacttggttcgctgccgttcctttgattgtatatctggctctaacaatcaccaaactgatcatcaaagacttcttgatcttgaagggtccttgtccgaattgtggaacggagaatacctccttctttggaacaattctgtcaatctccagcggtggcaaaaccaacactgtaaaatgcacaaactgtggaaccgcgatggagtatgactcgggttctcggttgatcacattgccggaaggaagccaagcttgaagatgaagatggaaaaaagaagaatgggttttgtcagaggcaaaatatagatttgatgctgtatacttaaagatcttgcatgttctttcacatgttttctgatatatacgtaagtattgtgtaagcattaagggaaatattttatgaa

SEQ ID NO: 1645 - DNA, 1164 bp, Brassica napus
ttcttcttctcccggggaacatgggtagcaagatgctgttcagtttaacaagccctcgacttttctccgccgtctcccgcaaacccacaacttctttctcttctccttcgtcgtcgaggactcaatgggctccgctcagccctgggagatcggttcccttgagaaaaagattcttcttgttgccttcaaaagccaccacagagcagtcaggtcaagctggaggagaagacgtggatagcaacatcatgccgtattgtagcatcaacaaggctgagaagaaaacaattggtgaaatggaacaagagtttctccaagccatgcaatcgttttattacgatggtaaagcgatcatgtcgaatgaggagtttgataatcttaaagaagagctcatgtgggaaggaagcagtgttgtcatgctaagttctgatgaacaaagattcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctaggactgtttttcttcttggacgacattacaggttttgagatcacatacatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatctccagcggtggcaaaaccaacaatgtcaaatgcaccaactgtggtaccgcgatggagtatgactctggttctaggttgatcacattgccagaagcaagctaagcttgaaccctgtgagatgaagatggagaaaagaagaatgggttttgtcagaagcaaaaatggatttgatgctgtatatttaagatcttccatgttagctctctatctccttcacatgttttctgatttgtaagtactgtgtatgcaataagggaaaatattttaatgaatacatcttcaccaa

SEQ ID NO: 1646 - DNA, 1258 bp, Brassica napus
aggaacctcctttcttcttctcccggggaacatgggtagcaagatgctgttcagtttaacaagccctcgacttttctccgccgtctcccgcaaacccacaacttctttctcttctccttcgtcgtcgaggactcaatgggctccgctcagccctgggagatcggttcccttgagaaaaagattcttcttgttgccttcaaaagccaccacagagcagtcaggtcaagctggaggagaagacgtggatagcaacatcatgccgtattgtagcatcaacaaggctgagaagaaaacaattggtgaaatggaacaagagtttctccaagccatgcaatcgttttattacgatggtaaagcgatcatgtcgaacgaggagtttgataatcttaaagaagagctcatgtgggaaggaagcagtgttgtcatgctaagttctgatgaacaaagattcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctaggactgtttttcttcttggacgacattacaggttttgagatcacatacatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatctccagcggtggcaaaaccaacaatgtcaaatgcaccaactgtggtaccgcgatggagtatgactctggttctaggttgatcacattgccagaagcaagctaagcttgaaccctgtgagatgaagatggagaaaagaagaatgggttttgtcagaagcaaaaatggatttgatgctgtatatttaagatcttccatgttagctctctatctccttcacatgttttctgatttgtaagtactgtgtatgcaataagggaaaatattttaatgaatacatcttcaccaacctttctaatcataggtgtaatatgatagctaattcagacttcacttcacacagtgaaattaaaattttaaacatagttagga

SEQ ID NO: 1647 - DNA, 1227 bp, Brassica rapa
  misc_feature (243)..(243): n is a, c, g, or t
  misc_feature (1188)..(1188): n is a, c, g, or t
cccacgcgtccgggaaaaaaaggaacctcctttcttcttctcccggggaacatgggtagcaagatgctgttcagtttaacaagccctcgacttttctccgccgtctcccgcaaacccacaacttctttctcttctccttcgtcgtcgaggactcaatgggctccgctcagccctgggagatcggttcccttgagaaaaagattcttcttgttgccttcaaaagccaccacagagcagtcaggncaagctggaggagaagacgtggatagcaacatcatgccgtattgtagcatcaacaaggctgagaagaaaacaattggtgaaatggaacaagagtttctccaagccatgcaatcgttttattacgatggtaaagcgatcatgtcgaacgaggagtttgataatcttaaagaagagctcatgtgggaaggaagcagtgttgtcatgctaagttctgatgaacaaagattcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctaggactgtttttcttcttggacgacattacaggttttgagatcacatacatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatctccagcggtggcaaaaccaacaatgtcaaatgcaccaactgtggtaccgcgatggagtatgactctggttctaggttgatcacattgccagaagcaagctaaagcttgaaccctgtgagatgaagatggagaaaagaagaatgggttttgtcagaagcaaaaatggatttgatgctgtatatttaagatcttccatgttagctctctatctccttcacatgttttctgatttgtaagtactgtgtatgcaataagggaaaatattttaatgaatacatnttcaccaacctttcaatcataggtgtaatatgatagtta

SEQ ID NO: 1648 - DNA, 1242 bp, Raphanus sativus
acacaaagggttcctggaaaacagaggaaaaaaggattctcctttctcctcccagggaaaatgggtagcaagatgctgttcagtttaacaagccctcgactcttctccgctgtttctcgcaaacccaccacccctccttgtttctcgtcgaggactcaatggtctcagctcacccctggaagatcggttcccttgagaaaaagattcttcctgttgcctgcaaaagccaccacagagcaatcaggtcaagtgggaggagaagacgtggatagcaacatcatgccttactgtagcatcaacaaagctgagaagaaatcaattggtgaaatggagcaagagtttctccaagccatgcaatcgttctattacgatggcaaagcgatcatgtcgaatgaggagtttgataaccttaaagaagagctcatgtgggaaggaagcagcgttgtcatgctaagttctgatgaacagagattcttggaagcttcgatggcttatgtttctggaaatccaatcctcaatgatgaagaatttgataatctcaaactcaaactaaagatggatggtagcgagattgtgtgcgagggtccaagatgcagtctccgtagtaaaaaggtgtatagtgatctcgctgtagattacttcaaaatgctattgctcaatgttccagcatccgttgttgctcttggactgtttttcttcttggacgacattacaggttttgagatcacatacatcttggagcttccagagccatttagtttcatattcacttggttcgctgccgtgcctttgatcgtatacctggcttcaaccatcaccaaattgatcatcaaagacttcctgatcttgaagggtccttgtccaaattgtggaacagagaatgtttccttctttggaacaattctttcaatctccagtggtggcaaaaccaacaatgtcaaatgcaccaactgtggaaccgcgatggagtatgactctggttctaggttgatcacattgccagaaggaagctaagcttgaaccctgtgagatgaagatggaaaaggaaagaatgggttttgtcagaagcaaaaatggatttgatgcctgtatatttaagatcttccatgttagctctctatctccttcacatgatttctgatttgtaagtactgtgtaagcaataagggaaaatatttaatgaatacttcttcaccaacttttcaaaggtgtaatatgatatttaattcagactttactcca

SEQ ID NO: 1649 - DNA, 1170 bp, Brassica napus
aatgggtagcacatgttgttcagtttgacaagcccccgtcttttctccgccgtgtctcggaaacccaccgcttctctctcttctccatctccgaggactcagtgggctcagctcagccctggaaggtcgatctccttgagaaaaaggttcttcttgttgccagcaaaggccaccacagagcaatcaggtcaaggtggaggagaagacgttgatagcaatatcatgccgtactgcagcatcaacaaggctgaaaagaaatcaattggtgaaatggaacaagagtttctccaagccttgcaatctttctattatgatggcaaggcgactatgtcgaatgaggagtttgataaccttaaagaggagttgatgtgggaaggaagcagtgttgtgatgctaagttctgatgaacagaggttcttggaagcttcaatggcttatgtttctggtaatccaatccttaatgatgaagagtttgataagctcaaactcaaactaaagatcgatggtagtgagattgtgtgtgagggtccaagatgcagtctccgtagtaagaaggtgtatagtgatcttgccgtagattacttcaaaatgctcttgctaaatgttccagcaaccgttgttgctctcggactgtttttcttcctggacgacattacaggttttgagatcacatacatcttggagctttcagaaccatacagtttcatattcacttggttcgctgccgttcctttgattgtatatctggctctaaccatcaccaaactgatcatcaaagacttcttgatcttgaagggtccttgtccgaattgtggaacggagaatacctccttctttggaacaattctgtcgatctcaagcggtggcaaaaccaacactgtaaaatgtaccaactgtggaaccgcgatggagtatgactcgggttctcggttgatcacattgccggaaggaagccaagcttgaactctgtgagatgaagatggaaaaaagaagaatgggttttgtcagaggcaaaatatagatttgatgctgtatacttaaaatcttgcatgttctttcacatgttttctgatatgtaagtattgtgtaagcaataagggaaatatttaatgaatatattcaccaacctttcataggtaatatgatagttaattcaaactgctataagcc

SEQ ID NO: 1650 - DNA, 1242 bp, Brassica oleracea
gtccgctcaatactcctcttcaaccataggttcatcttgacaaaacttccccggaaaacagaggaaatctcttttctttctcccaaggaaaatgggtagcaagatgttgttcagtttgacaagcccccgtcttttctccgccgtgtctcgcaaacccaccgcttctctctcttctccatctccgaggactcagtgggctcagctcagccctggaaggtcgatctccttgagaaaaaaattcttcttgttgcctgcaaaagccaccacagagcaatcaggtcacgctggaggagaagacgttgatagcaatatcatgccctattgcagcatcaacaaggctgaaaagaaatcgattggtgaaatggaacaagagtttctccaagccttgcaatctttctattatgatggcaaggcgactatgtcgaatgaggagtttgataaccttaaagaggagttgatgtgggaaggaagcagtgttgtgatgctaagttctgatgaacaacggttcttggaagcttcaatggcttatgtttctggtaatccaatcctcaatgatgaagaatttgataagctgaagctgaaactaaagatcgatggtagcgagattgtgtgtgagggtccaagatgcagtctccgtagtaaaaaggtgtatagtgatcttgcagtagactatctcaaaatgctcttgctaaatgtcccagcaaccgttgttgctctcggactgtttttcttcctggacgacattacaggttttgagatcacatacatcttggagctttcagaaccatacagtttcatattcacttggttcgctgccgttcctttgattgtatatctggctctaacaatcaccaaactgatcatcaaagacttcttgatcttgaagggtccttgtccgaattgtggaacggagaatacctccttctttggaacaattctgtcaatctccagcggtggcaaaaccaacactgtaaaatgcacaaactgtggaaccgcgatggagtatgactcgggttctcggttgatcacattgccggaaggaagccaagcttgaagatgaagatggaaaaaagaagaatgggttttgtcagaggcaaaatatagatttgatgctgtatacttaaagatcttgcatgttctttcacatgttttctgatatatacctaagtattgtgtaagcattaagggaaatattttatgaagccatacctttcatagctaatatgaaagttagcttcacca

SEQ ID NO: 1651 - DNA, 1229 bp, Brassica juncea
cttcaaccataggttcatcttgacaaaacttcctcggaaaacagaggaaaaaaaaaggaatctcttttccttctcccaaggaaaatggatagcaagatgttgttcagtttgacaagccctcgtcttttctccgccgtgtctcgcaaacccaccgcctctctctcttctccatctccgaggactcagtgggctcagctcagccctggaaggtcgatctccttgagaaaacgattcttcttgttgccagcaaaggccaccacagagcaatcaggtcaaggtggaggagaagacgttgatagcaatatcatgtcgtattgcagcatcaacaaggctgagaagaaatcaattggtgaaatggaacaagagtttctccaagccatgcaatcgttctattacgatggcaaagcgatcatgtcgaatgaggagtttgataaccttaaagaagagctcatgtgggaaggaagcagtgttgtcatgctaagttctgatgaacaaagattcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctaggactgtttttcttcttggacgacattacaggttttgagatcacatacatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatctccagcggtggcaaaaccaacaatgtcaaatgcaccaactgtggtaccgcgatggagtatgactctggttctaggttgatcacattgccagaagcaagctaaagcttgaaccctgtgagatgaagatggagaaaagaagaatgggttttgtcagaagcaaaaatggatttgatgctgtatatttaagatcttccatgttagctctctatctccttcacatgttttctgatttgtaagtactgtgtatgcaataagggaaaatattttaatgaatacatcttcaccaacct

SEQ ID NO: 1652 - DNA, 1422 bp, Arabidopsis thaliana
atctcctaatttcttccctccaaatttataataaaaccaaaaaaaaaaaaaaaaaaaaaaatcagaagaaacctgagaagctcacagtaaacacatcttcaaccacaggttcatacttactgaaaaaaacagaggaaaaaaaggagctcccttttctatctctaagggaaaatgggtagcaagatgttgtttagtttgacaagtcctcgacttttctccgccgtttctcgcaaaccttcctcttctttctctccttctcctccgtcgccgtcttcgaggactcaatggactcagctcagccctggaaaatcgatttctttgagaagaagagtcttcttgttgcctgctaaagccacaacagagcaatcaggtccagtaggaggagacaacgtcgatagcaatgttttgccctattgtagcatcaacaaggctgagaagaaaacaattggtgaaatggaacaagagtttctccaagcgttgcaatctttctattatgatggcaaagcgatcatgtctaatgaagagtttgataaccttaaagaagagttaatgtgggaaggaagcagtgttgtgatgctaagttccgatgaacaaagattcttggaagcttccatggcttatgtttctggaaatccaatcttgaatgatgaagaatatgataagctcaaactcaaactaaagattgatggtagcgacattgtgagcgagggtccaagatgcagtctccgtagtaaaaaggtgtatagtgatctcgctgtagattatttcaaaatgttattgttgaatgttccagcaaccgttgttgctctcggactctttttcttcctggacgacattacaggttttgagatcacatacatcatggagcttccagaaccatacagtttcatattcacttggttcgctgctgtgcctgtgattgtatatctggctttatcaatcaccaaattgatcatcaaggacttcttgatcttgaagggtccttgtccgaattgtggaacggaaaacacctccttctttggaacaattctgtcaatctccagcggcggcaaaaccaacactgtcaaatgcaccaactgcggaaccgcgatggtgtatgactcgggttctaggttgatcacattgccagaaggaagccaagcttaaaccctgtgagctagatgaagatgggaaaagaagaatgggttttgtcagaagcaaaatagattcgaagttaaatgtatatgtaagatcttccatgttagctctctctccttcacatgttttctgatttgtaagtattgtgtgtaagcaataagagatatataatatgagcacttcttcatctacctttgtagataaaaatataatcattactatagttaaatcaaattgtatacatgaaagaccaaattcgaatttaaaatgtttatttcgataact

SEQ ID NO: 1653 - DNA, 1272 bp, Raphanus sativus
  misc_feature (14)..(14): n is a, c, g, or t
  misc_feature (19)..(19): n is a, c, g, or t
  misc_feature (566)..(566): n is a, c, g, or t
ggaaacctgaagcncacantaactcaacactcatcttcaaccataggttcatcttgacaaaactttcccacaaaacagaggaaagaggaacggtgaaaatgggtagcaagatgttgttcagtttgacaagcccccgactgttctccgccgtctctcgaaaacccaccaccacttttctctcttctccttctccttctcctcctccgtcgtcttcatggactcagctcaaccctggaagatcgatctccttgagaaaaagattcttcttgttgcctgcaaaagccaccacagagcaatcaggtcaagttggaggagaagacgttgatagcaatatcatgccttattgcagcatcaacaaggctgaaaagaaatcaatcggtgaaatggaacaagagtttctccaagccttgcaatcgttctattatgatggcaaagcggtcatgtcaaatgaggagtttgataaccttaaggaagagttgatgtgggaaggaagcagtgttgtgatgctaagttctgatgaacaaaggttcttggaagcttcaatggcttatgtttctggaaatccnatcctcaatgatgaagaatttgataagctcaaactcaaactaaagattgatggtagcgatattgtgtgtgagggtccaagatgcagtctccgtagtaaaaaggtgtacagtgatctcgcagtggattatttcaaaatgttcttgctaaatgttccagcaactgttgttgctctaggactctttttcttcctggacgacattacaggttttgagatcacatacatcttggagctttcagaaccatacagtttcatattcacgtggttcgctgctgttcctttgattgtatatctggctttaacaatcaccaaactgatcgtcaaagacttcttgatcttgaagggtccttgtccgaattgtggaacggagaatacttccttctttggaacaattctgtcgatctctagtggtggcaaaactaactctgtcaaatgcaccaactgtggaaccgcgatggagtatgactcgggtactcggttgatcacattgccagaaggaagccaagcttgaaccctgtgagatgaggatggaaaaagaagaagaatgggttttgtcagaggaacaatagatatgatgttgtatacttaagatcttgcatgttctttcacatgttttctgatatccaagtattgtataagaaataagggaaatattttatgaatatttcttcaccaacctttcataggtaataggatgatagttaatt

SEQ ID NO: 1654 - DNA, 2259 bp, Brassica napus
cactgaaaagcaaaataaaaccaaatgatgaaatatgtatatgactaaacgcaaacgcaccatcagatggttatccttagaagcaataattaagtaacattggaatatatcaagaagatgcagatggaagttttttcacaatgtcaacagaaactctcatcaaacaaagtgtacaaagcatcttcgaagctccttaaaatggaaatgtcttagagagtgggagctctctcagcagtaccagcgatgacggtaagcaaattgttccgaaaggatcacttagatgctttgaaaggttctcaacaggcccttctccggtaacataagcttggatgaagaaagcgaacatggaaacatggccaatctcccgttcttgatctcttaaccttgtgaagagctcctgttcagggctttagcaagtcccaaagggtcgaatggggcgtcctgggtgaagcttgtcttcgaagtccaagccgttggtgattcggtagtactcagctccaccaaggagaacaacctcagcaactacagcgagaacaaggttgattgggatgttcttgccaaagtagctcaatgtgtttccatcaagaagaagagcaccagtcttaaaccagacggcttcagggccacagttagcgccatatttgtttaaggcttcagggatgatgcaaccagctgctcccaacatagcccatctcgcgtgaatcagttcaaaggcttggtatttagcgaagttctcaggcttcttgccaagtccaaatgggtcatatccatagtctccagcaacttcaccgttcaagtactctgggatttctgatctgtccaaaagaccatccggcaagaagattctcctgtcagggccataccacttggcgagctcgtcgttggcagcagagacggtcttggccttgggaggaggagctggcttcttcttggagaacagagcaactgtcttgaacgtggcgggaattgacgccaatggagcagacggtctcgacactgccctgaagttaaggggcgtaccaagcatttccgacacacccaaagacgccatctttttagcccaagtctttttttctactcttctttcaaccacacaaaggttcctcaaatatttccccggaaaacagaggaaaaggaacctcctttcttcttcttctcccggggaacatgggtagcaagatgctattcagtttaacaagccctcgacttttctccgccgtctccagcaaacccacaacttgtttctcttctccttcgtcgtcgaggactcaatgggctccgctcagccctgggagatcggttcccttgagaaaaagcttcttcttgctgccttcaaaagccaccacagagcagccaggtcaagctggaggagaagacgtggatagcaacatcatgccgtattgtagcatcaacaaggctgagaagaaaacaattggtgaaatggaacaagagtttctccaagccatgcaatcgttttattacgatggtaaagcgatcatgtcgaatgaggagtttgataatcttaaagaagagctcatgtgggaaggaagcagtgttgtcatgctaagttctgatgaacaacggttcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctcggactgtttttcttcttggacgacattacaggttttgagatcacatatatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatatccagcggtggcaaaaccaacaatgtcaaatgcaccaactgtggtaccgcgatggagtatgactctggttctaggttgatcacattgccagaagcaagctaagcttgaaccctgtgagatgaagatggagaaaagaagaatgggttttgtcagaagcaaaaatggatttgatgctgtatatttaagatcttccatgttagctctctatctccttcacatgttttctgatttgta

SEQ ID NO: 1655 - DNA, 1269 bp, Arabidopsis lyrata
aaaagaaaaaaaaaactcaaaaatcagaacaaacctgaaggtcacagtaacatatcttcgaccacaggttcatacttactgaaaaaacagaggaaaaggagctccttttctctatctatctctcagggaaaatgggtagcaagatgttgtttagtttgacaagtcctcgacttttctccgccgtttctctcaaacccacctcttctttctctccgtcgtcgtcgaggactcaatgggcccagctcacccctgcaaaatcgatttctttgagaagaagagttttcttgttgcctgctaaagccacaacagagcaatcaggtacagggggaggagacaacgtggatagcaatgttttgccttattgtagcatcaacaaggctgagaagaagacaattggtgaaatggaacaagagtttctccaagcgatgcaatctttctattacgatggcaaagcgatcatgtctaatgaagagtttgataaccttaaagatgagttgatgtgggaaggaagcagtgttgtgatgctaagttccgatgaacaaaggttcttggaagcttccatggcttatgtttctggaaaaccaatcttgaatgatgaagaatatgataagctcaaactgaaactaaagattgatggtagcgaaattgtgtgcgagggtccaagatgcagtctccgcagtaaaaaggtgtatagtgatctcgctgtagattatttcaaaatgttattgttgaatgttccagcaaccgttgttgctctcggactctttttcttcctcgacgacattacaggttttgagatcacatacatcatggagctttcggaaccatacagtttcatattcacgtggttcgctgccgtgcctgtgattgtatatctggctttatcaatcaccaaactgatcatcaaagacttcttgatcttgaagggtccttgtccgaattgtggaacggaaaacacctccttctttggaactattctgtcaatctccagtggtggcaaaaccaacgctgtcaaatgctccaactgtggaaccgcgatggtgtatgactcgggttctcggttgatcacattgccagaaggaagccaagcttaaaccctgtgagatgaagatggaaaaagaagaatgggttttgtcagaagcaaaatagattcgaagttaatgtatatgcaagatcttccatgttagctctctctccttcacatgttttctgatttgtaagtattgtgtaaacaataagagaaatattatatgaaagaccaaatccgaa

SEQ ID NO: 1656 - DNA, 1967 bp, Brassica napus
gagagtctttgtttcttcttctcccttcttctccgactaaccaggaagcaaattttttcagataaccatgggatcttcagctactccaggctgagctttgtttcttctattccccgatctctgctagctctttacaagtgttgtcatcctccattgaatctctcacctgagcttgtaaggattagtgatggagactaattcgtctggagaagatctggttgttaagacgagaaagccgtatacgataacaaagcaacgtgaaagatggactgaggaagaacataataggttccttgatgccttgaggctttacggtagagcctggcaaaagatcgaagaacatgtagcaacgaaaactgctgtccagattagaagccatgctcagaaatttttctccaaggtagagaaagaggctgaagctaaaggtgtaccagtggctcaaacgctagacatagctatccctcctccgcgccctaaacgaaaaccaaacaatccttatcctagaaagaccggaactggatctctccccatctcaaaaccgggtctgaatgatggaaaagagtcccttggatcaggaaaagtttcgcttcctgagacgaccaatgaagatctgcaggaagacaactgctcagactgtctcactcatcaacacctctctgctgcatcaaacgcaagcacttttctagagttcttaccttcacgggaacaggggaataacaaggagtcaaactcagccaattacagtgaacctcagacttatccaaggcatatccctctgctagttccattggggagctccataacaacctctctgtcacatgctcctccttcagatccagacgagagtagtcatcacctccacacagtttcaggccatcaccagtcctttcctgaccatatcatgtcgtctcttttacaaacaccagctctatacacagctgcatctttcgcctcaacgtttggtggcggcggcccacaagggaacttagccgccatggctgcagccaccgttgcagctgcaagtgcttggtgggccgccaatggaatgctacctctatgcgctccttttacttcaggtcaccctccagctacttatgaagtaaacgccgtcacaaaaacagtggatcaagaacactccgaggcgtcaaaggctagatcttcgttggactcagaggaggctaaaaatgggagtaaaccagattgtcatcatcatccttgtgcagcgaccgagactgatgcaaagggatcagatggagctagagatagaaagcaagttgacaggtcttcttgtggctcgaacactccttcgagtagtgacgatgttgaggctgatgctttggtggagaggcaagagaatggtggcaccaccaatgaggaagtgaaagaagtggatggggacactactaacaacccacaaacgtcagagtctaatgcgcgacgcagtagaatcagtacctctaacttagctgatccatggaagtctgtttctgatgagggacgaattgcttttagagctctgtttgcaagagaagtgttgccacaaagttttacatataagagagaggagggtcaacaacaaagatatccaatggagcttgatcttaactcagcagctgatgatcaagaagagaacagaaacatagcgtttttgggtgcttcaaagcagcagctattaagtagaggaaggacaggtttcaagccttacaaaagatgttcaatggaagctaaagaaagtagagtcatcagcaacaccaatcctatcatcagtgttgaacagaaagatcctaagcggattcggttggaaacacaaacttcaacatgaaaaaaagttgtaactctattattatatctgttgtttctctattttcattcaagtttcaaagatcactgatacattttcttctgtttttgagggcctgtgtattttgtccatagtcttcttgtaacgtttgactctgtattatcaa

SEQ ID NO: 1657 - DNA, 1944 bp, Brassica napus
ctttctcccttcttcttccgacgtaatacaggaagcaaaagaataaccaactgggagtcttctagctactcctaggctgagctttgtttcttcgattctccgatctctgctagctctttacaagtgttgtcatcttccattgaatctctcactgagtttaaatcgaagaatcttgtgggagaggatctgaagctgtgtgtgtgtgtgtgtgttttagcttctaaggattagtgatggagacaaattcgtctggagaagatctggttgttaagacgaggaagccgtatacgataacaaagcaacgtgaaagatggactgaggaagaacataataggttccttgatgccttgaggctttacggtagagcctggcaaaagatagaagaacatgtagcaacgaaaactgctgtgcagattagaagccatgctcagaaatttttctccaaggtagagaaagaggctgaagctaaaggtgtaccagtggctcaagcgctagacatagctatccctcctccacgccctaaacgtaaaccaaacaacccttatcctagaaagaccggaactggatctctccccatctctaaaacgggtctgaacgatggaaaagagtcccttggatcagcaaaagtttcccttcctgagacgaccaatgaagacaactgctcagactgtctcactcatcaacacctctctgctgcatcaaacgcaagcactttccgggagttcttaccttcacgggaacaggggaataacaaggagtcaaactacagtgatttgaatatagaggcaggaggacctcacacttatccaacgcctatccctctgctagtttcattggggacaaggtctctatcacatgctcctacttcacagccagacgagaatagtcatcagtcctttcctgaacatatcatgttgacccttttacaaacaccagctctctatacagctgcctctttcgcctcaacgtttggtggcggcccacaagggaacttggctgccatggctgcagccaccgttgcagctgcaagtgcttggtgggccgccaatgggatgctccctctctgcgctcctccttttagttcaggcaaccctccaactacttatgaagtaaacgccctcacaaaaacaatggatcaagaacactccgaggcttcgaaggctagatcttcgttggaatcagaggagactagaaatgggagtaaaccagattgtcatcatcatacttgtgcagcgactgagactgatgcaaagggatcagatggagctagagatagaaagcaagttgacaggtcttcttgtggctcgaacactccttcgagtagtgatgatgttgaggcggatgtggagaggcaagagaacggtggcaccaccaatgaggaagtgaaagaagtggatggggacactactaacaacccacaaacttcagaatctaatgcgcgacgcagtagaatcagtagctctatcttagctgatccatggaaggctgtttctgatgagggacgaattgcttttagagctctctttgcaagagaagtgttgccacaaagttttacatatcagagagaggagggtcaacaacaaagatatccaatggagcttgatcttaactccacagctgatgatcaagaagagaacagaaacatagcgtttttgggtgcttcaaagcagcagctaagtagaggaaggacaggtttcaagccttacaaaagatgttcaatggaagccaaagaaggtagagtcatcaacaacaccaatcctatcatcagtgttgaacagaaagatcctaagcggattaggttggaaactcaaacttcaacatgaaaaaagttgtaactcttattattatatctgttgtttctctgttttcattcaagtttcaagatctcactgatacaatcttcttctgtctttgaggcatttgtattttgtccataatcttctt

SEQ ID NO: 1658 - DNA, 1979 bp, Brassica napus
ctccgagtatcaggaagcaaaagataaccatgggatcttcagctactccaggctgagctttgtttcttcgattctccgatctctgctagctctttacaagtgttgtcatcttccattgaatctctcactgagtttaaatcgaagaatcttgtgggagaggatctgaagctgtgtgtgtgtgtgtgtgtttagcttctaaggattagtgatggagacaaattcgtctggagaagatcgtggttgttaagacgaggaagccgtatacgataacaagcaacgtgaaagatggactggaggaagaacataataggttcctgatgccttgaggctttacggtagagcttggcaaaagatagaagaacatgtagcaacgaaaactgctgtgcagattagaagccatgctcagaaatttttctccaaggtagagaaagaggctgaagctaaaggtgtaccagtggctcaagcgctagacatagctatccctcctccacgccctaaacgtaaaccaaacaatccttatcctcgaaagaccggaactggatctctccccatctctaaaacgggtctgaacgatgcaaaagagtcccttggatcagcaaaagcttctcttcctgagacgaccaatgaagatctgcaggaagacaactgctcagactgtctcactcatcaacacctctctgctgcatcaaacgcaagcacttttctagagttcttaccttcacgggaacaggaacaggggaataacaaggagtcaaactacagtgatttgaatatagaggcaggaggacctcacacttatccaacgcatatccctctgctagttccattgggtacaacctctctgtcacatgctcctccttcacagccagacgagaatagtcatcagtcctttcctgaacatatcatgtcgacccttttacaaacaccagctctctatacagctgcatcttttgcctcaacgtttggtggcggcccacaagggaacttggctgccatggctgcagccaccgttgcagctgcaagtgcttggtgggccgccaatgggatgctcccactctgcgctcctccttttagttcaggcaaccctccaactacttatgaaagaaacgccctcacaaaacaatggatcaagaacactccgaggcttcaaaggctcggtcttcgttgggatcagaggagactaaaaatgggagtcaaccagattgtcatcatcatacttgtgcagcgactgagactgatgcaaagggatcagatggagctagagataggaaacaagttgacaggtcttcttgtggctcgaacactccctcgagtagtgacgatgttgaggctgatgctttggtggagaggcaagagaatggtggcaccaccaatgaggaagtgaaagaagtggatggggacactactaacaacccacaaacttcagaatctaatgcgcgacgcagtagaatcagtagctctatcttagctgatccatggaagtctgtttcagatgagggacgaattgcttttagagctctctttgcaagagaagttttgccacaaagttttacatatcagagagaggagggtcaacaacaaagttatccaatggagcttgatcttaactccacagctgatgatcaagaagagaacagaaacatagcgtttttgggtgcttcaaagcagcagctaagtagaggaaggacaggtttcaagccttacaaaagatgttcaatggaagctaaagaaagtagagtcatcaacaacaccaatcctatcatcagtgttgaacagaaagatcctaagcggattaggttggaaactcaaacttcaacatgaaaaaagttgtaactcttattattacatctgttgtttctctgttttcattcaagtttcaagatctcactgatacaatcttcttctgtctttgaggcatttgtattttgtccatagtcttcttgtaacgtttgactctgtattatcaaacaaaatcataa

SEQ ID NO: 1659 - DNA, 1633 bp, Brassica napus
cagaattagtaaaaacgtgaaccaggagagcacacgagagctgatcggcgatcagcagagtcagccaaattagcggtgaacagtcgggaggaagggaagggatgatgatctctcaattcttcgtcctatctcagcgaggagataacatcgtcttccgtgactatcgagctgaggtaccaaaaggaagtacagagacattcttccgtaaggtcaagttctggaaagaggatggtaatgcagaggcaccacctatctttaatgtcgacggtgtgaactacttccatgtcaaggttgttggtctatacttcgttgccactacgagggttaacgtctcgccttctctggttttggagcttctacaaaggatcgctcgtgttattaaggattacctcggtgttttgaatgaggactctttcaggaaaaactttgtgcttgtctatgagttgcttgatgaagtcattgattttggctacgtgcaaactacatcaaccgaggttttgaaatcctatgtattcaacgagccaattttgattgctcctgcacgccttcagcctatcgatcctgctgctatcttcacccaaggatccaaaagaatgcctggaacagcagttacaaagtcggttgtagctaatgatcctgggggtcggaagagagaggaaatctttgtggacatcatcgagaaaatcagtgttacttttagttcaagcggttatatactgacttctgagattgatggcaccattcaaatgaagagttatctttctggcaatccagaaattcgtttagctcttaatgaagacctaaacataggaagaggaggagcatcagtatatgattataggagttcttcaggttcaggggtgatacttgatgattgtaactttcatgagtctgttcgtcttgatagcttcgactcggatagaactttgtccctggttccaccagatggtgagtttccagtaatgaactaccgtatgactcaggagtttaagcctccttttcatgttaataccttgattgaagaggccggacgccttaaggctgaagtgattattaagatacgagctgaattcccttctgacgtagttgcaaacacgattactattcagatgccattgccaaattatacttccagggctagttttgagttagaacttggtgcagctggacagaagacagatttcaaggaaaccagcaaaatgcttgaatggagttttaaaaagattgttggcggggctgaacacacactgcgtgcgaagctgacattttcacaagaatttcatggtaacatcacaaaggaagctgggcctgtcagcatgacgttcacgattccgatgtacaatgtttctaaacttcaggtcaaatacttgcagatagcaaagaactcaagtagtcaaaatccatatcgttgggtgagatatgtgacacaggccaattcgtacgtggctcggatatgacctactttcagataatgttttgtcacttttatgtcccacataacttctctttccttgtcgacaatgtttgttcggattctggtcatacttgttctaagttctaagaggttgttgacaaaatgcttcacagtacgtgtcgaatgttagctcttctatcttatttctctttatatatg

SEQ ID NO: 1660 - DNA, 1601 bp, Brassica napus
gaacagacagacacgagactgatcgaaccaaatcagcggtgaacagtcgggagggaagggaagggaagggatgatgatctctcaattcttcgtcctatctcagcgaggagataacatcgtcttccgtgactatcgagccgaggtaccaaaaggaagtacagagacattcttccgtaaagtcaagttctggaaggaggatggtaatgcagaggcaccacctatctttaatgtcgacggtgtgaactacttccatgtcaaggttgttggtctctatttcgttgccactacgagggttaacgtctcgccttctctggttttggagcttctacaaaggatcgctcgtgttattaaggactacctcggtgttttgaatgaagattctttcaggaaaaactttgtgcttgtctatgagttgcttgatgaagtcattgattttggctacgtgcaaactacatcaaccgaggttttgaaatcctatgtattcaacgagccaattttgattgctcctgcacgccttcaacctatcgatcctgctgccatcttcacccaaggatccaaaagaatgcctggaacagctgtcacaaagtcggttgtagctaatgatcctagtggtcggaggagagaggaaatttttgtggacatcattgagaaaatcagtgttacttttagttcaagcggttatatactgacttctgagattgatggcaccattcaaatgaagagttatcttttcggtaatccagaaattcgtttagctcttaatgaagacctaaacataggcagaggaggagcatcagtatatgattataggagttcttcaggttcaggggtgatacttgatgattgtaactttcatgagtctgttcgtcttgatagcttcgactcagatagaactttgtccctggttccaccagatggtgagtttccagtaatgaactaccgtatgactcaggagtttaagcctccttttcatgttaataccttgattgaagaggccggacgccttaaggctgaagtgattattaagatacgagctgaattcccttctgacgtagttgcaaacacgattactattcagatgccattgccaaattatacttctagggctagttttgagttagaacttggtgcggcgggacagaagacagatttcaaggaaaccagcaaaatgcttgaatggagttttaaaaagattgttggcggggctgaacatacactgcgtgcgaagctgacattttcacaggagtttcatggtaacatcacaaaggaagctgggcctgtcagcatgacgttcacaataccgatgtacaatgtttctaaacttcaggtcaaatacttgcagatagcaaagaactcaactagtcaaaatccgtatcgttgggtgagatatgtgacacaggccaattcgtacgtggctcggatatgacctactttcatataatgttttgtctcttttgtatgtccccaagtaacttttctctttcccttctcaataatgtttgttcggattctgatcatacttgttctaagttctaagatgttgttgaggagatgcttcacagtacgaatgttaactcttctatcttatttctctttatata

SEQ ID NO: 1661 - DNA, 1931 bp, Theobroma cacao
taaaatttaattaaatatattttactattcaatttatgatatatttcaacaaaattgttttaattaaatccgaaacttacatctcaccctcctaaacccaaagcaattaaaataaaacgtataattttgatacttacatatgcatccgggagctgcatttgcagggaaaagaaaaccgggaggagacgagtcgaaagcccaaatcatgatatctcagttcttcgtgctctctcagcgaggcgataacatagtttttcgcgattatcgtggtgaagtagcgaaaggaagtgcagagatattcttccgtaaagttaagttttggaaagaggatggacaagaggaggcaccccctgtctttgtaggtattatcttactaaagaataatgtggatggtgtgaactacttccatgtgaaggttgttgggctgttgtttgttgcaaccacaagggttaatgtgtcaccatctcttgtcctggaacttctgcaaaggattgctcgtgtcattaaagattatttaggggttttaagtgaagattcactgcggaaaaattttgtacttgtatatgagttgctggacgaagtcattgacttcggttatgtgcaaacaacatctactgaagttttgaagtcctatgtatttaatgagccaatagtggttgatgctgcgcgtttgcaacctcttggccctgctgccatctttatgcaaggatccaaaagaatgcctgggacagcagttacgaagtctgttgtagccaatgagcctggaggtcggaagagagaggaaatttttgtggatataattgagaaaatcagtgtcacatttagctctagcggatatatactgacttccgagattgatggcactattcaaatgaaaagttatctgacaggaaatccagaaatccggttagcacttaatgaagacctgagcataggaagaggagggggatcagtctatgattataggagttcatctggtgcagggccagtgatactcgatgattgtaattttcatgaatcagtgcgtcttgatagtttcgatatggacagaactctggctctggtaccaccagatggtgaatttcctgtcatgaactacagaatgacgcaggaattcaagcctccttttcatattaactgtttaattgaagaagcaggacaccttaaggcagaagtaattcttaaagtacgcgccgagttcccctcgaacattaccgcaaacacagttgttgtgcagatgccacttcctaaatatactaccaggcattttccttttcccatcttttatacttgagctagttttgagttggaacctggagctgttgggcaaagaacagatttcaaagaagcaaacaagaaactagaatggggtttaaagaagattgttggtggatcggaacatacacttcgtgcaaagctgacattttcacaggaatcacatgcaaacatcacaaaggaagctggaccagttagcatgactttcacaataccgatgtataatgcgtcaaggcttcaggtgaaatacttgcagatagcaaagaaatctagttcctataatccatatcgatgggtgagatatgttactcaggccaattcatatgttgctcgaatatgatatggtggaatctccattcttttgtatgtttcatatatgtcggctccttggtgtcactttatttttctgaactagattatacttttttgctgaatcacaccatattttcaagttgtatcatctggtgaaatttatctaatttgtatattagtgatgttgaatagaaaatctagcacaattttttcccctgctggttatgagagaattccaactggtaaaatatgttatttaagaagcctttctgaactcatgctatcagagcaacaggtaatctactgtctactgcctaatatttgaatgaacattaagcattgaa

SEQ ID NO: 1662 - DNA, 1401 bp, Vinca minor
agcagtagaatcagttatcgtcatcataatgatctctcagttctttgtgctctctcagagaggcgacaacatcgtcttccgcgattgcaggggtgatgtacagaaaggaagtgcagagatatttttccgcaaagtgaagttctggaaagaagatgatgaagaggaggctccacctgtctttaatgtggatggtgtgaactacttccatgtaaaggtggctggtttgctgtttgttgcaaccacgagaacaaacacctcgccttctcttgttttggagcttttacagaggattgcacgtgtcaccaaagactaccttggtgtccttaatgaagattctctgcggaaaaattttgtgcttgtttacgagcttctcgacgaagtgattgactttggctatgttcaaaccacatcgactgaagtcttgaagtcttatgtgttcaatgagcccattgttgttgatgctagccggttaccacctcttggtcctgcttcccttttatgcaaggaaccaaaagaatgccagggacagccatcacaaaatctgttgtggcaaacgaaccagggggccgaaaaagggaggagatctttgtggacattattgagaaaatcagtgtcacttttagctctagtggatatatattaacttctgaaattgatggcaccattcaaatgaagagttatctaactggtaatccagaaatcagattagctcttaatgacgatttaagcattggacgaggcgggaggtcaatatacgattatggtggttcctccggttcgggagcagtgatactggacgactgcaatttccatgagtctgtccatctggatagttttgatgtggataggaccctgagtctcgtcccacctgatggtgaatttccagttatgaattatcgtataacccaggaattcaagcctccttttcgtatgaacactttgattgaagaagccggacagcaaaaggctgaagtgattctgaaaatccgcgccgagtttccttctagcgtcacagcaaacacaattgcagtccagatgccggtgccaaaatacacaacaagagttagttttgagttggaacctggagcaattggacagacgaccgacttcaaggaatcaaataaaagattggagtggaatttgaagaagattgttggtggatccgaacatacactgcgtgcaaagcttacctttgcacaggaatctcatggaaatatcacgaaggaagcgggtccagtgagcatgacattcacaatacctatgtataatccttcacggctccaggtcaaatacttgcagatagcaaagaaatccaaaacatacaatccctatagatgggtgagatatgtcactcaggccaattcttacgttgctcgcatatgacttcccattgaagctgtg

SEQ ID NO: 1663 - DNA, 1745 bp, Euonymus alatus
gatgatctcgcaatttttcgtgctctcgcaaagaggcgacaatattgtcttccgtgactatcgtggagaagtccagaaaggaagtactgaaatatttttccggaatgtaaagttttggaaggatggagaggaggatgcgccacctgtatttaatgttgatggtgttaactattttcacgtgaaagttgctggattgttatttgttgcaacaacaaggataaatgtatcgccttctctggtcttggagcttttgcaaagaattgcacgggtcatcaaggactatcttgggattcttaatgaagactccttcaggaaaaattttgtccttgtgtatgagctgctggatgaagttattgattttggttatgttcagacaacatcaacagaggttttgaaatcatatgtattcaatgagccgattgtcattgatgctgctcgtttgccaagccttggtcctgctggaatttttatgcaaggtagcaaaagaatgcccgggactgcagttacaaaatctgttatagccaatgagcctcggggtaggaagagggaggaaatatttgtggatgtgattgagaaaataagtgttacattcagctctagtggatacatactgacctctgagattgatggcaccattcaaatgaaaagttaccttactggaaatccagaaatccgagttgctcttaacgatgacttgagtataggaagaaatggaagctccatttatggctatagtgcctcatctggatcgggggcagtgatccttgatgattgtaacttccatgaatccgtacatcttgatagttttgacattgacagaaccttgagtctggtaccacccgatggagagtttcctgttatgaactaccgtatgacgcaggagttcaagcctccctttcgtatcaacgcattggtcgaagaggctagaccccttaaggctgaagttattcttaaagtacatgctgacttcgcctcaagtgtcactgcaaatactattctcatacagatgccagtcccagtatacacaaccagggttagttttgagttggagcctggagcggttggaaactccaccgattttaaggaatctagtaagaaacttgaatggggtctaaagaagattgttggtggatccgaacacacccttcgtgccaagctaactttttcacaagagatgcatggaaacatcacaaaagaagtgggaccagttagcatgaccttcacaatacccatgtacaatgcttcaagacttcaggtgaagtacttacagattgcgaagaagtccaagaccgacaatccatatcgatgggtgagatatgtaacacaagcaaattcttatgtcgcccggttatgattctaacctttctacctaccaaattttcctctcgccttctcgtcgtcctctgcgtgtcctttgctggtttcagctttacgtaatgacttcagaggtatgaacttagaaaatggtgattcgaacggataaacccttgttttgtatgatactcgataagataccccttcccctctttgagcatgttttttggatttggtttaaactttggaagctttgttcatcatagacggcaatcagccagtctcgctggattatcctcttaagttaagtaggactttgaatgggcttaagtccaactttcatgttcaaggtcggcccaactatatcacagcccagactcattcaataatgtgggccttgtaataccatatcaaaggttggcccatttatt

SEQ ID NO: 1664 - DNA, 1625 bp, Glycine max
acagccgttaattgcaacgagtaatgttcactgcgaagaaaatatcaaaataatactactagccatttacaaaggcagcagctgcaggaggtgcgtgcatcgagcggagccatgatctcgcaattcttcgttctgtcacagcgtggcgataacatcgtttttcgagattatcgtggtgaagtgcagaagggaagtgcggagatatttttccgcaaagtaaagttttgggaagatgggggactgcaggaggcaccacctgtctttaatgtggatggagtaaattactttcatgtgaaagttgttggcttattgtttgttgcaactacaagggttaatacatcaccttcttttgtcttggagcttttacaaagaattgctcgagttattaaaggattaccttgggattctcaatgaagactcattacggaaaaactttgtgcttgtgtacgagttacttgatgaagttattgattttggttatgttcaaacaacatctactgaattgttgaagtcctatgttttcaatgagccgcttgtaattgatgctgcacgtctgccacctcttggacctgctgcaatttttacgcaaggaacaaaaagaatgccagggatagctgtcacaaaatctgttgttgctacagagcctgggggtagaaagagggaagagatttttgtagacataattgagaaaatcagcatcactttcagctccagtggatatatactgacttctgagattgatggcaccatacaaatgaagagctatctttctggcaatcctgaaattcgattagcacttaatgatgacctctccattggaagaagccagggatcagctttcggttataggagctcatctggctcaggaacagttatattagatgactgtaatttccatgaatctgttcgtcttgatagttttgatatagacagaactctatccctggtaccaccggatggtgaatttccagtcatgactaccgttgacacaggaatttagtcctccttttcgtataatgctttgattgaagaagcagggtcacttaaggcagaagtaattcttaaagtaagtgccgagtttccctcaagtgtaacagctaacactatcaaagtgcagatgccactaccaaaatgtacctccagagttagttttgagctggaacctggagctgtaggacaaacaactgattttaaggaagcaaataagaggctagaatggagtttaagaaagatcgtcgggggatcggagcacactctacatgcaaaactaaccttttctcaggaatctcacgttaatataacaaaagaatcaggacctgtgagcatgacatttactataccaatgcataacgtttcacggcttcaggtaaagtatttgcagatagcaaagaaatctgcaacgcatgaaccataccggtgggttagatatgttacacaggcgaattcctacgtcgctcgtatatgatgccgttaagaacactgtcccctcccccgctctttgtttttctattttgttttcctgctcttattgctctttacacacatgctttgtttatttacttattctttatttgtaaattacactctaagtttacattctaagtcgaatatagatgacgttttca

SEQ ID NO: 1665 - DNA, 1764 bp, Cajanus cajan
gggggggagttgagtgcttattactagccatttacaaaggcagcagctgtagccattaggaggtgtgtgcatcgagcggaaacatgatctcgcagttcttcgttctctcgcagcgtggcgataacatcgttttccgtgactaccgtggtgaagtgcagaagggaagtgcagagatatttttccgcaaagtaaagttctgggaagatggggacctgcaggaggcaccacctgtctttaatgtagatggtgtaaattacttccatgtgaaagttgttgggttattgtttgttgcaactacaagggttaatatatcaccttcttttgtcttggagcttttacaaagaattgctcgtgttattaaggattaccttgggattctcaatgaagactcattacgaaaaaactttgtgcttgtgtacgagttacttgatgaagtcattgattttggttatgttcaaacaacatcaactgaattgttgaagtcctatgttttcaatgagccgcttgtaattgatgctgcacgtctgtcacctcttggtccttctgcagtttttgcgcaagggacaaaaagaatgccagggatagctgttacaaaatctgttattgctacagagcctgggggtagaaagagggaagaaatctttgtagatataattgagaaaatcagcatcacttttagctccagtggatatatactgacttctgagattgatggcaccatacaaatgaagagctatctttctggcaatcctgaaattcgattagcacttaatgatgacctctccattggaggaagccagggatcagtttacggttataggagctcctctggctcaggaacagttttattagatgactgtaattttcatgaatctgttcgtcttgatagttttgatatggacagaactctatccctggtgccaccagatggtgaatttccggtcatgaactaccgtatgacacaggaatttaggcctccttttcgtattaatgctttgattgaagaagcagggccgcttaaggctgaagtaattcttaaagtaagtgctgagtttgcctcaagtgtaacagcaaacactatcaaaatgcagatgccactacctaaatgtacctccagggttagttttgagctggaacctggagctgttgggcaaacaactgattttaaggaagcaaataagaggctagaatggagtttaaagaagattgtcgggggatctgagcatactctacgtgcaaagctaaccttttcacaggaatcacatgttaatataacgaaagaatctggacctgttagcatgacatttactataccaatgtataacgcatcacggcttcaggtaaagtatttgcagatagcaaagaaatctgcaacgcatgagccataccgatgggttagatatgttacacaagcaaattcctatgtcgctcgtttatgatgccgttaagaacactgtcgtcctccatcctcttgctctatattacacatgctttgttttattgactttattctttatttgtaaattacattctaagtcgaatatagaagacgttagtagtttgccttgtcgttcattacaatttacacatgcacaagctggtcatacaacatgcatgaattacatcactttccatccgataaaggatcactcagttttatttgtgttttcaatatacactctaatggaacctcatcttggacataaggtttaaaggggagattgtctgttgactaggtctatcactatgcatgtgactgaacag

SEQ ID NO: 1666 - DNA, 1491 bp, Tripterygium wilfordii
ttttcgtgctctcgcaaagaggcgacaatattgtcttccgcgactatcgcggagaagtccagaaaggaagtactgaaatatttttccggaatgtaaagttttggaaggatggagaggaggatgcgccacctgtatttaatgttgatggtgtgaactattttcatgtgaaagttgctggattgttatttgttgctacaacaagggtaaatgtgtcgccttctcttgtcttggagcttttgcaaagaattgcacgtgtcatcaaagactaccttgggattcttaatgaagactcattcaggaaaaattttgtccttgtgtatgagctgctggacgaagttattgattttggttatgttcagacaacgtcaaccgaggttttgaaatcatatgtattcaatgagccaattgtcattgatgctgctcgtttgccaagccttggtcctgctggaatttttatgcaagggagcaaaagaatgcctgggactgcagttacaaaatctgttatagccaatgagcctcgtggtaggaagagggaggaaatatttgtggatgtgattgagaaaataagtgttacattcagctctagtggatacatactgacctctgaaattgatggcaccattcaaatgaagagttaccttactggaaatccagaaatccgtgttgctcttaacgatgacttaagtataggaagaaatggaagctccatttatggctatggtggctcatctggatcaggggcagtgatccttgatgattgtaacttccatgaatccgtacatcttgatagttttgacattgacagaaccttgagtctggtaccacccgatggagagtttcctgttatgaactaccgtatgactcaggagttcaagcctcccttccgtatcaacgcattggtcgaagaagctggatcccttaaggctgaagttattcttaaagtgcatgctgacttctcctcaagcgttactgcaaatactattctcgtacagatgccactcccagtatacacaaccagggttagttttgagttggagcctggagcagttggaaacacaaccgattttaaggaatctagtaagaaacttgaatggggtctaaagaagattgttggtggaactgaacacaccctacgtgctaagctgactttttcacaagagatgcatggaaacattacaaaagaagtgggaccagttagcatgaccttcacgatacccatgtacaatgcttcaagacttcaggtgaagtacttgcacattgcgaagaagtcgaagaccgacaatccatatcgatgggtgagatatgtaacacaagcaaattcttatgtcgcccggttatgagtctaatctttctatctaccgaattttcctcgccttcttgtcgtcatctgcgtgtgctttgctggtttcagctttacgtaatgagctcaaaagtatgaactcagaaaatggtgataaacccttgttttgtatgctacttgataagatactt

SEQ ID NO: 1667 - DNA, 1665 bp, Glycine max
accgcttagaaaataatactagccatttacgaaggcagcagctgcaggaggtgcgtgcatcgagcggagccatgatctcgcaattcttcgttctgtcgcagcgtggcgataacatcgtttttcgagactatcgtggtgaagtgcagaagggaagtgcagagatattttttcgcaaagtaaagttttgggaagacggaggactgcaggaggcaccacctgtctttaatgtggatggtgtaaattactttcatgtgaaagttgttggcttattgtttgttgcaactacaagggttaatacatcaccttcttttgtcttggagcttttacaaagaattgctcgagttattaaggattaccttgggattctcaatgaagactcattacggaaaaactttgtgcttgtgtacgaattacttgatgaagttattgattttggttatgttcaaacaacatctactgaattgttgaagtcctatgttttcaatgagccgcttgtaattgatgctgcacatctgtcacctcttggacctgctgcaatttttacgcaaggaacaaaaagaatgccagggatagctgtcacaaaatctgttgttgctacagagcctgggggtagaaagagggaagagatttttgtagacataattgagaaaatcagcatcacttttagctccagtggatatatactgacttctgagattgatggcaccatacaaatgaagagttatctttctggcaatcctgaaattcgattagcacttaatgatgacctctccattggaagaagccagggaccagcttacggttataggagctcatctgactctggaacagttatattagatgactgtaatttccatgaatctgttcgtcttgatagttttgatatagacagaactctatccctggtaccaccagatggtgaatttccagtcatgaactatcgtttgacacaggaatttaggcctccttttcgtattaatgctttgattgaagaagcagggtcacttaaggcagaagtaattcttaaagtaagtgctgagtttgcctcaagtgtaacagcaaacactatcaaagtgcagatgccactaccaaaatgtacctccagggttagttttgagctggaacctggagctgttggacaaacaactgattttaaggaagcaaataagaggctagaatggagtttaagaaagattgtcgggggatcagagcacactctacgagcgaaactaaccttttctcaggaatctcccgttaatgtaacgaaagaatcagggcctgttagcatgacatttactataccaatgcataatgtttcacggcttcaggtaaagtatttgcagatagcaaagaaatctgcaactcatgagccataccggtgggttagatatgttacacaggcaaattcctacgtcgctcgtatatgatgctgttaagaaaactgtggcctccccctcccccctttgtttttcatttttattttcctcccacaattgctctttacagtttacagacatgctttgattttttactttattctttatttgtaaattacattctaagtcgagtatagatgccgtttgtagtttgccttatttatcattcattacacaataacaagctggtcataaaacctggatgaaatacatcagttttttcttctta

SEQ ID NO: 1668 - DNA, 1737 bp, Panicum virgatum
ccaccctcttcacctcgtcgtcgtcttcctcctcaccttgcatcctacttcctccgttcctccggtcgccgtcgcgtcacgtttcagccgcagggcccggccccgaggagaagcgtggtagcgggaagcggcggcggggagagatgatctcgcagttcttcgtgctgtcgcagcgcggcgaccacatcgtcttccgcgactatcgcggcgaggtgcctaagggcagcgcggagatcttcttccggaaggtgaagttctggaacgacgacgaggcagaggaggcgcccccagtcttcaatgttgatggggttaactatattcacgtcaaggtcgcagggctattttttgtagtaactacaatggttaatgtttctccatcccttctcttggaacttctgcaaaggattgcacgtgtcacaaaagattatcttggtgttctgaatgaagattcactgcggaagaattttattttggtgtatgaattgctcgacgaagtcattgactttggatacccacaaacaacctctactgaggttctgaagtcatacatatttaatgaacctatcatggttgatgctggacgactaccaccgcttggtcctgctgctatgttcatgcaaggcacaaagcgtatgcctggtacagctgttacaaaatctgttgttgctaatgagcctggggggaagaagagggaggaaatttttgttgatataattgagagaataagtgtgacattcagctctagtggctacatacttacatctgagattgatggaacaattcaaatgaaaagttacctcactggaaacccagaaattcgtcttgctctcaatgaggatttgagcattggaagaaccggatcttcttcctatgattacagaagttcttcttctggaggagcagtcattcttgatgattgtaacttccatgagtcagtatatctggacagctttgacattgacagaactttgactttaataccacctgatggagaatttgctgtaatgaactaccggatgacccaagaatttaagccaccattccgtgtaactgcactgattgaagaagctggaccatcgagggctgaagttctactgaagataagagcagacttctctgcaaatgtcacagctaacacaatcacaatacaaatgccagtgccctcctacacaatgagagcaagttttgagttagaagctggagcagttgggcaaacaacagattttaaggagggatccaggagacttgagtggaatctaaagaagattgttggtggttctgagcacacccttcgtgcaaagctgacattttcccaggagtcgcatggaaatatcacaaaggaagctggtccggtgaacatgaatttcactatacctatgtacaatgcgtcaaagttgcaggtcaggtatcttcagatagcgaagaaatcaaagacatacaatccatacagatgggtgcgatatgtaacacaagctaactcctacgtagctcgtctatgaggaacccgtgtttgtacacttgtttctggtccattttttggtgtattatttgaggtttatcttggacagagtggcatgcatttgtaactttatagtggaacaatatcactctgctcctgcagtcgaatacattgtagggtcacaatttttccccttgtacaatgtccagaagattcatgatcatgttttaatactgcaaaatgaatgaagttcttcatgccttcatggcacttctggg

SEQ ID NO: 1669 - DNA, 1712 bp, Setaria italica
cctcgccttgctctccttctactccctctgttcctcgcgtcgccgtcgcgtcacgttacagccgcagggcacgcggccccaacgagaagagtggtagcgggaagcggcggcggggagggatgatctcgcagttcttcgtcctgtcgcagcgcggcgaccacatcgtcttccgcgactatcgcggcgaggttcccaagggcagcgctgagatcttcttccggaaggtgaagttctggaacgatgacgaggcagaggaggcgcccccagtcttcaatgttgacggggttaactatattcacgtcaaggtcgccggactattttttgtagtaactacaatggtcaatgtttctccatcccttctcttggaacttttgcaaaggattgcacgtgttacaaaagattatcttggtgttctgaatgaagattcattgcggaagaattttattttggtgtatgaattgctcgatgaagtcattgactttggatacccacaaacaacctctactgaggttctgaagtcatacatattcaatgaacctatcatggttgatgctggacgactaccaccacttggtcctgctgctatgttcatgcaaggcacaaagcgtatgcctggaactgctgttacaaaatctgttgttgctaatgagcctggggggaagaagagggaggaaatttttgttgacataattgagagaataagtgtgacattcagctctagtggctatatacttacatctgagattgatggaacaattcaaatgaaaagttacctcactggaaatccagaaattcgtcttgctctcaatgaggatttgagcattggaagaactggatcttcgtcatatgattacagaagttcttctggaggagcagtcattctcgatgattgtaacttccatgagtcagtacatctggacagctttgacattgacagaactttgactttaataccacctgatggagaatttgctgtaatgaactaccggatgacccaagaatttaagccgccgttccgtgtaacagcactaattgaagaagctggaccatcgagggctgaagttctactgaagatacgagcagacttctctgcaaatgtcacagctaacacaatcacagtacaaatgccagtgccctcgtacacaatgagagcaagttttgagttggaagctggagcagttgggcaaacaacagattttaaggaaggatccaggagacttgagtggaacctaaagaagattgttgggggttctgagcacacccttcgtgcaaagctgacattttcccaggaatcacatggaaatatcacaaaggaagctggtccagtgaacatgaatttcactatacctatgtacaatgcatcgaagttgcaggtcaggtatcttcagatagcgaagaaatcaaagacatacaatccatacagatgggtgcgatatgtaacacaagctaactcctacgtagctcgtctatgaggaactcgtgtttgtacacttgtttctggtccattttttggtgtattatttgaggtttatcttggacagagtggcatgtatctgtaactttatagtggaacaaatatcactctgctcctgtagtcgaatacattgtaggttcacaacttttccctcgtacaatgtgcagaagattcgtgatcacgttttaatgctacaaaatgaatgaagttcttgttcatgccttcatggcacttctgg

SEQ ID NO: 1670 - DNA, 1751 bp, Brachypodium distachyon
cggcgtcttcttcctcccttctcccccttaccccgtgttttacttcctctgttcttcgaatcgccctcagcgccacgtcatagccacgaggcgcgagtcctgaggaggaggggcggaagcacagccgggaagaggcgggtgtggggagatgatctcgcagttcttcgtgctgtcgcagcgcggcgaccacatcgtcttccgcgactatcgaggcgaggtgcccaagggcagcgcggagatcttcttccgtaaggtcaagttctggaacgaggacgaggccgaggaggcgcctccagtattcaatatcgatggggttaattatattcatgtcaaagtcgcaggactatattttgtagtaaccacaatggtcaatatatctccatctcttctcttggaacttctgcaaaggatcgcacgtgttacaaaagattatctcggcgttctgaatgaagattctctgaggaagaatttcattttggtgtacgaattgctcgatgaagtcattgactttggatacccacaaacaacctctaccgaggctctgaagtcatacatatttaatgaaccgatcatggttgatgctggacggatgccaccacttggtcctgctgctatgttcatgcaaggctcgaagcgtatgcctggtacagctgttacaaaatctgttgtagctaatgagcctggtgggaaaaagagggaggaaatttttgttgacatcattgagaaaataagtgtcacattcagctcgagtggttatatacttacctctgagattgacggaaccatccaaatgaaaagttaccttagtggaaatccagaaatccgtctagctctgaatgaagatttgggcattggaaggagtggctcttctacacatgattatagaagttcttctggaggaggatcagtcgttcttgatgattgtaactttcatgagtcagtgcagctagacagttttgacattgacagaactctgcatttaataccacctgatggagaatttccagtcatgaactaccggatgactcaggaatttaagccaccgttccgcgtaaccgcactaattgaagaagctggaccatctagggctgaagttctactgaaaatacgggcagacttttctgcaaatgtcactgctaacacaatcacagtacaaatgccggtgccctcgtacacgatgagggcaagttttgaattggaagctggagcagttggacagacaactgattttaaagaaggatctaggaggcttgagtggaacctaaagaagattgttggtggttctgagcatacgcttcgtgcgaagctcacattttctcaggagtcacatggaaatctcacaaaagaagctggaccagtaaacatgaatttcactatccctatgtacaatgcttcaaagttgcaggtcagatatcttcagatatcgaaaaaatccaagacatacaacccatataggtgggtgagatatgtgacgcaggccaactcgtatgtagctcgtctatgaggatcttctgtctgtacaattttctcttggagatttcatgcttggcagagtggcatgtattgtaactttatactgggatcccagacatcactctgctcatgcagcctcaaaaaattttagtgtcatattttccttgtgccatatgcagaaaatacatgctatgtttgtattatgcgaaagatgaagtccttgttcatcccgcaaatggaactgcctctgttcctgcactctgaagaagtatgcactg

SEQ ID NO: 1671 - DNA, 1685 bp, Pennisetum glaucum
ccgatctcagaggcagcggccgcgtcctcgtctcccctccctctgttcctcgcgtcgccgtcgggtcacgttacagcagcagggcgcgcggtcccgacgggaagcgtcgtagcggggagcggcgtcggggagagatgatctcgcagttcttcgtcctgtcgcagcgcggcgaccacatcgtcttccgcgactatcgcggcgaggtgcccaagggtagcgcggagatcttcttccggaaggtgaagttctggaatgatgacgaggcagaggaggcgcccccagtcttcaatgttgacggtgttaactatattcacgtcaaggtcgccggactattttttgtagtcactacaatggtcaatgtttctccatcccttctcttggaacttctgcaaaggattgcacgtgttacaaaagattatcttggtgttctgaatgaagattctctgcggaagaattttattttggtgtatgaattgctcgatgaagtcattgactttggatacccacaaacaacctctactgaggttctgaagtcatacatattcaatgaaccaatcatggttgatgctggacgactaccacctcttggtcctgctgctatgttcatgcaaggcacaaagcgtatgcctggtactgctgttacaaaatctgttgttgctaatgagcctggggggaagaagagggaggaaatttttgttgacataattgagagaataagcgtgacattcagctctagtggttatatacttacatctgagattgatggaacaattcaaatgaaaagttacctcactggaaatccagaaattcgtcttgctctcaatgaggatttgagcattggaagaacaggatcttcgtcatatgattacagaagttcttctggaggaggagcagtcgttctcgatgattgtaacttccatgagtcagtacatctggacagctttgacattgacagaactttgactttaataccacctgatggagaatttgctgtaatgaactaccggatgacccaagaatttaagcccccattccgtgtaacagcattaattgaagaagccggaccgtcgagggctgaagttctactgaagataagagcagacttctctgcaaatgtcacagctaacacaatcgcagtacaaatgccagtgccctcgtacacaatgagagcaagttttgagttggaagctggagcagttgggcaaacaacagattttaaggaaggatccaggagacttgagtggaacctaaagaagattgttgggggttctgagcacacccttcgtgcaaagctgacattttcccaggaatcacatggaaatatcacaaaggaagctggtccagtgaacatgaatttcactatacctatgtacaatgcgtcaaagttgcaggtcaggtatcttcagatagcgaagaaatcaaagacatacaatccatacagatgggtgcgatatgtaactcaagctaactcctacgtagctcgtctataaggaactcgtgtttgtacacttgtttctggtccatttttttggtgtattatttgaggtttatcttggacagggtggcatgtatctgtaactttatagtggaacaatatcactctgctcctatagtccaattacattgtagggtcacatttttccctcgtacaatgtgcagaagattcgtgattagttttgatgcta

SEQ ID NO: 1672 - DNA, 2197 bp, Flaveria ramosissima
cgtctacaaccacccattacacctccgatcaccacctccgccaccgtaccaccacacattcccaattccccctttttctccactcaattcgctcaatcaccgtccaaatcgaccctttttcaatggccctttgtgggttcgcatttccggcgaatatgaaccaccgggcgattggttctcacgctccggtggtgcagcattgcttctttggtaaagatctgcaacacccgcaatcgtcccacaagcccttcaatcagttgagtaaaagggtaggtgtggttcaagcgacaatggctgatagaggtgagtatcactcgcagagacccccgactccactgttggacaccattaattacccaattcacatgaagaatctctcgatcaaggaactgaagcaactagccgatgagctgcggtctgatgtaatctttaatgtttctaagactggtggtcatttgggttcgagcctcggtgtggtggagctcacagtggctcttcattatgtgttcaatacgccgcaagataagatcctttgggatgttggtcatcagtcttacccacataaaatattgacgggaagaagagaccgaatgcataccattagacagacaaacgggttggcgggtttcactaaacgctctgaaagcgagcatgattgttttggcactgggcatagctctaccaccatttctgcagggttaggtatggctgtgggaagagatctaaaaggtggaacaaacgatgtagttgctattataggcgatggtgctatgactgcgggtcaagcctatgaagccatgaacaacgcgggctatctagattcagatatgatagtcatccttaacgacaataaacaagtctcattaccaactgcaacacttgacgggcctatacctcctgttggcgctttaagcagtgctctcagtaggctacaatctaaccgccctcttagggaactgcgtgaagttgccaaagaagttaccaaacaaataggcgggcccatgcatgaactcgctgctaaagttgacgaatatgctcgtggtatgattagtggttcagggtcaacactgtttgaagaacttggtttgtattacatcgggcccgttgatggtcatagcattgatgatcttgttgccattcttaaagaggtcaagagtactaaaacaacgggtccagttttgattcatgttattacagagaaaggtagaggatatccatatgcagagaaagctgctgataagtaccatggtgtggcgaaatttgaccctgcaactgggaaacagttcaagtcaagtgcagcaactcaatcttacactacttactttgcagaggcattgattgctgaagctgaggtggataaaaagattgtgggtatccatgctgcaatgggtggtgggaccgggatgaacctatttcaccgccggttcccgaaccggtgttttgatgttgggatcgctgaacaacacgcggttacttttgctgctggtttggcctgtgaaggccttaagccattttgtgcaatttactcatcattcctgcaaaggggttatgatcaggtggtgcatgatgtggacttgcagaagttgcctgtgaggtttgcaatggaccgggctgggctcgttggcgcagatggcccgacacattcgggctcgtttgatgtgacttacatggcgtgccttccgaacatggtggtcatggctccttctgacgaggctgagctttttcacatggtggcaaccgctgcagccattgatgacagacctagttgcttccgttatccccgtggaaacgggataggcgcacccttgccacctggcaacaaaggcgttcctctcgaggttggaaaaggtagaatattgattgaaggagagcgtgtcgcgctcctaggttacggaaccgcggtccagagttgcttggtagcagcccgtttggtacaagaacgaggcttaaacataacagttgcagatgcccgtttttgcaaaccgttggaccataatctcatccgggcccttgcaaagtcacacgaggtcttgatcacagttgaagaaggttccatcggtgggttcggctcacacgtggctcacttcatggcactagatggtcttctagatggaaaactgaagtggagaccactagtgcttccggaccgttacatcgaccatggtgcgcctgatgaccaactagccgaagcgggtct

SEQ ID NO: 1673 - DNA, 2154 bp, Flaveria ramosissima
taccatcacacattcccaattccccctttttctccactcaattcgctcaaccacctctgcaaatcgacccgtattccatggcgctttgtgggttcgcatttccggcgtatatgaaccaccgggcgattggttctcacgctccggtggttcagcattgcttctttggaagagatctgcatcacctgcaatcgtcccacaaaccctttaatcagttgagtaaaagggtaggtgtggttcaagcgacaatgtctgaaagaggtgagtatcactcgcagagacctccgactccactcttggacaccatcaattacccaattcacatgaagaatctatcgatcaaggaactgaagcaactagccgacgagctgcggtctgatgtcatattcaatgtatctaaaactggaggtcatttgggttcgagcctcggtgtggtggagctcaccgtggctcttcattatgtgttcaattcgccgcaagataagatcctttgggatgttggtcatcagtcttacccgcataaaatcttgactggaagaagagaccgaatgcataccattagacagacaaacgggctggcgggcttcaccaaacgctctgaaagcgagcatgattgttttggcacgggtcatagctctaccaccatttctgcagggttaggtatggctgtgggaagggatctaaaaggtggaacaacgacgtagttgctattataggtgatggtgctatgaccgcaggacaagcttatgaagccatgaacaacgcaggctatctagattcagatatgattgttatccttaacgacaacaaacaagtctcactaccaactgcaacacttgacggcctatacctcccgtcggagctttaagcagtgctctcagtaggctacaatccaaccgccctcttagggaactgcgtgaagttgccaaagaagtaaccaaacaaattggcgggcccatgcatgaactcgctgctaaagttgacgaatatgctcgtggtatgattagtggttcagggtcgacgctgtttgaagaacttggtttgtattacatcgggccagttgatggtcatagcattgatgaccttgttgccattcttaaagaggtcaagagtactaaaacaacgggtccggttttaattcatgttattacagagaaaggtagaggatatccatatgcagagaaagctgctgataagtaccatggcgtggcgaaatttgaccctgcaactgggaaacagttcaagtcaagtgcagcaactcaatcttacactacttactttgcagaggcttgattgctgaagctgaggtggataaaaagattgtgggtatccatgctgcaatgggtggtgggaccgggatgaacctatttcaccgccggttcccgagccggtgcttggatgtcgggattgctgaacaacacgcggtcacttttgctgctggtttggcctgtgaaggccttaaaccattttgtgccatttactcatcattcttgcaaaggggttatgatcaggtggtgcatgatgtagacttgcagaagttgcctgtgaggtttgctatggaccgtgctgggctcgttggcgcagatggaccgacacactcgggctcgtttgatgtgacttacatggcgtgccttccgaacatggtggtcatggctccttctgatgaggctgagctttttcacatggtggcaaccgctgcagccattgatgacagacctagctgcttccgttatccccgtgggaacgggataggcgcacccttgccacctggcaacaaaggcgttcctctcgaggttggaaaaggtagaatactgatcgaaggagagcgtgtcgcgctcctaggctatggaccacggtccagagttgcttggtagcagcccgtttggtacaagaacgaggcttaaacataaccgttgcagatgctcgtttttgcaaaccgttggaccataatctcatccgggcccttgcaaagtcacacgaggtcttgataacagttgaagaaggatctatcggtgggttcggctcacacgtggctcacttcatggctctagatggtcttctagatggaaaactaaagtggagaccactggtgcttccggaccgttacatcgaccatggtgcgcctgatgaccaactagccgaagcgggtctgactcc

SEQ ID NO: 1674 - DNA, 2649 bp, Fraxinus spp
ctctcccgttaatcccccgttgtcgtttagcccgtttaggtccaggttacgtcctaaggtcgtacttcctaacccttgaagttactaattggaaaaagtacttctaggcttttaccgtaggtagtataccgaatctttaaagtactaaaggggtaagtaaaagaaaggtactactagtttgtaattgcacttgactgatgatactgtgatgaaccaagatacggatgaataaggtagtgagaaacaacctcaggttaggctcggagatgagtttctgttcatcaatgtgctgatgtcaagtatgggaagcgtgtccacattcttcctgtggatgacaccattgaaggcgttactggaaacctgtttgacgcttaccttaaaccatatttccttgaggcataccgaccggtgaggaagggcgatctttttcttgtaaggggaggaatgagaagtgtagaattcaaggttattgagactgatcctcccgagtactgtgtcgttgcccctgatactgagatcttctgtgagggagagcctgtaagaagggaggatgagaatcggttggatgaggttggctatgatgatgttggtggtgtacgtaaacagatggcgcagattcgagagttggtggagctaccactaaggcacccacagctttttaaatcaattggcgtgaagcctcctaaaggatactgctttatggacctccgggatctgggaagaccctgattgctcgagctgttgctaatgaaactggtgctttcttcttctgtattaatggaccagaaattatgtcaaaattggccggagaaagtgaaaagcaatctcagaaaagcatttgaggaagctgagaaaaatgcaccatcaatcatatttatcgatgagattgattcaattgctcccaaacgagagaagaccaacggagaggttgagaggagaattgtttcccaactcttaacgctaatggatggactcaaatcacgtgctcatgttattgtaatggtgctcaaaacgtccaacagcattgacctgccttgagaaggttggggagatttgatagggaaattgatattggtgttccagatgaagttgggcgtctcgaagttcttcgtattcataccaagaacatgaagcttgctgaagatgttgatttggaaagaattgccaaagacacacatggttatgtcggtgctgatttggcagctctgtgcactgaggctgcccttcaatgcattagggagaagatggatgtgattgacttggaagatgataccatcgatgcagagatactcaactccatggctgttactaatgagcacttccagactgctcttggaaccagcaacccctcagctctacgtgaaacagttgttgaagtacccaatgttagttgggaagatataggaggcctcgagaatgtcaaacgtgagctccaagagactgttcaatatccagtggagcatcctgagaagtttgagaagtttggcatgtcaccttcaaagggagttcttttctatggccccccgggatgtggaaaaactttgctggccaaggctattgccaatgagtgtcaggcaaacttcatcagtgtcaagggtcccgaattgctcactatgtggtttggagagagtgaggccaatgttcgagaaatttttgacaaggctcgccaatctgccccatgtgtcctattctttgatgaattggactcgattgctactcagagaggaagcagtggaggagatgctgggggtgctgctgacagagtattgaatcaacttttaacggaaatggatggaatgaacgcgaagaaaactgttttcattattggtgccaccaataggcctgatataattgatcctgcacttcttcgtcctggacgtcttgatcaattgatttacatccctctccctgatgaggagtcgcgcctacagattttcaagtcttgcttgagaaaatcccctctttccaaagatgtagacctgacagcccttgccaagtacactcagggtttcagtggtgctgacattactgaaatatgccaacgtgcagtcaaatatgctatcagagagaacatcgagaaagatattgagagggagaagagaagaagtgagaatcccgaggccatggaggaggatgttgaagaagaagtggcagagattaaacctgctcattttgaagaatcgatgaagtttgcccggaggagtgtcagtgatgctgacattcgcaagtaccaggcatttgctcagacgttgcagcagtcaagagggttcggaactgaattccgatttgctgagaccaatgccggtgctactgggtccgacccttttgctgcttctgctggtgcagctgatgaagatgacctatatagttaggtcgtttatctacttctacgcgttatgatactctttctagcttatgttttattaatgtttacagaaggattttatcatattaaagctgtatcttaaggcttcataatttagtacttcgaagattggaaaaaaagtgaaaatgattatgactttctttatcattattattattgttgttgtatttttttaattgtgctttccacacttgacagttgacacccacaccctgttgatttggcagatttgagcctaaagcaaagttgtacaaaaagaaaaa

SEQ ID NO: 1675 - DNA, 1608 bp, Brassica rapa
gaggagaaacttaaagataaatagtagagatagggttaaagcattgacgacgaaaaaggcttcttcgatctacacttctcttctctcctctctctctctctctctctctctctcgcaggcaaggtttggtaatggcggaatcatccaaagtcattcatgttcgtaatgtcggacatgagatttctgaaaatgacttgcttcagcttttccaaccatttggtgtcataactaagctcgtcatgctcagggcaaagaatcaggctcttctccagatgcaagatgtttcttcagcaatcactgctcttcagttcttcactaatgtgcagccaaccataagaggtaggaatgtgtatatccaattctcgtcccaccaagaattgacaacagccgagcagaatattcatggacgtgaagatgagccgaatcgtattctcttggtcacagtccatcacatgctgtatccaattaccgttgacgtcctgcatcaagttttttctccttatggatttgtggagaagatcgtcactttccagaagtctgctggttttcaagctcttatacagtatcaggcacaaccgtgtgctgcctctgctagaacttctctacagggtcgtaacatatatgacgggtgttgtcagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatccccagatggcaaacacatctgcgattgcagctgcctttggcggtggcttgcctccgggtataactggcacaaatgataggtgtacaatccttgtctctaatcttaatactgatagtgttgatgaggataagctgttcaatctgttttctctttacgggaacattgtgaggataaagcttcttcgaaacaaacctgaccatgcccttgtccaaatgggagatggtttccaggctgagcttgcagtacatttccttaagggagcgatgctgtttggtaagcggctagaggtaaactactctaagcatccaaatattacaccagggacagactcgcatgattatgtaaactcgaacctgaaccgcttcaaccgcaatgctgcaaaaaactaccgctattgctgctcccctaccaagatgattcacttgtccactcttccgcaagacgtgacagaggaagaagtggtgaaccatgtccaagagcacggggcgatactgaacacaaaagtgtttgagatgaacgggaaaaagcaagctctggtgcagtttgagaacgaggaggaagctgcggaagcactggtttgcaagcacgcgacctctctaggcggatcaattatcagaatctccttctctcagctacagacaatttaaagtcgacaaaggcctctctctcttttctctctctctcacctctaataacatttgggtatggtgaggatgatcaatgtgtgtttctttaactcaaatatctctgctacttgtttggacttttctgcactctttttaaacttggtcccttggtttaaatttgtttgtgttgatttaatgg

SEQ ID NO: 1676 - DNA, 1627 bp, Raphanus sativus
ggaaaggcattgacgacgaaaaaaaagccttcttcgatctacacttctcttctcttctcttgtctctctctctctctcccatctaacctctcgcagacaaggttggtaatggcagaatcatccaaagtcattcatgttcgtaatgttggacatgagatttctgaaaatgatttgcttcagcttttccaaccgtttggtgtcataactaagctcgtgatgctcagggcaaagaatcaggctcttctccagatgcaagatgtttcttcagcaatcactgctcttcagttcttcactactgtccagccaaccataagaggaaggaatgtgtatatccaattctcgtctcaccaagaattgacaacagccgagcagaatattcatggacgtgaagatgagccgaatcgtattctcttggtgacagtccatcacatgctgtatccaatcaccgttgacgtcctgcatcaagttttttctccctatggatttgtggagaagatcgtcactttccagaagtctgctggttttcaagctcttatacagtatcaggcacaacagtgtgctgcctctgctagaacttctctacagggtcgtaacatatatgacgggtgttgtcagttggatatccagttctccaaccttgaggagctgcaagtaaattacaacaacgatcgatctagggattatacaaatccaaacctgccatcagagcaaaaaggccgtttacctcaccctggctatggtgatgcaggagtggcctatcctcagatggcaaacacatctgcgattgcagctgcctttggcggtggcttgcctccgggtataactggcacaaatgataggtgtacaatccttgtctccaatcttaatacagatagtgttgatgaggataagctgttcaatctcttttctctttacgggaacattgtgaggataaagcttcttcgaaacaaacctgaccatgcccttgtccaaatgggagatggtttccaagctgaacttgcagttcatttcctcaagggagcgatgctgtttggtaagcggctagaggtgaactactcgaagcatccaaatataacaccaggcacagactcgcatgattatgttaactcgaacctgaaccggttcaaccgcaatgctgcaaagaactaccgctattgctgctcccctaccaagatgattcacttgtccactcttccgcaagacgtgacagaggaagaagtggtgaaccacgtccaagagcatggggccatactgaacacaaaagtgtttgagatgaacgggaaaaagcaagctctggtgcagtttgagaacgaggaggaagctgcggaagcactggtttgcaagcatgcgacctctctaggaggttcaattatcagaatctccttctttcagctgcagacaatttaaagtcgacaaaggcctctctctcttttctctctctctctctcacctctaatgacatttgggtatggtgaggatgatgaatgtgtgtttgtttaactcaaatatctctgctacttgtttggacttttctacactcttttttaaacttggtcccttggtttaaatttgtttgtgctgatttaatggtaataaacatttaatggttatctttatgattaaagca

SEQ ID NO: 1677 - DNA, 1709 bp, Brassica napus
gagagagagagagaaacttaaagataaatagtagagatagggttaaagcattgacgacgaaaaaggcttcttcgatctacacttctcttctcttctctacctctcgcaggcaaggttgttaatggcggaatcatccaaagtcattcatgttcgtaatgtcggacatgagatttctgaaaatgatttgcttcagcttttccaaccatttggtgtcataactaagctcgtcatgctcagggcaaagaatcaggctcttctccagatgcaagatgtttcttcagcaatcactgctcttcagttcttcactaatgtgcagccaaccataagaggtaggaatgtgtatatccaattctcgtcccaccaagaattgacaacagccgagcagaatattcatggacgtgaagatgagccgaatcgtattctcttggtcacagtccatcacatgctgtatccaattactgttgacgtcctgcatcaagttttttctccctatggatttgtggagaagatcgtcactttccagaagtctgctggttttcaagctcttatacagtatcaggcacaaccgtgtgctgcctctgctaggacttctctacagggtcgtaacatatatgacggctgttgtcagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatcctcagatggcaaacacatctgcgattgcagctgcctttggctgtggcttgcctccgggtataactggcacaaacgataggtgtacaatccttgtctctaatcttaatactgatagtgttgatgaggataagctgttcaatctgttttctctttacgggaacattgtgaggataaagcttcttcgtaacaaacctgaccatgcccttgtccaaatgggagatggtttccaggctgagcttgcagtacatttccttaagggagcaatgctgtttggtaagcggctagaggtaaactactcgaagcatccaaatattacaccaggaacagactcgcatgactatgtaaactcgaacctgaaccgcttcaaccgcaatgctgcaaaaaactaccgctattgctgctcccctaccaagatgattcacttgtccactcttccgcaagacgtgacagaggaagaagtggtgaaccatgtccaagaacacggggcgatactgaacacaaaagtgtttgagatgaacgggaaaaagcaagctctggtgcagtttgagaacgaggaggaagctgcggaagcactggtttgcaagcacgcgacctctctaggtggatcaattatcagaatctccttctctcagctacagactatttaaagtcgacaaaggcctctctctcttttctctctctcacctctaataacatttgggtatggtgaggatgatcaatgtgtgtttctttaactcaaatatctctgctacttgtttggacttttctgcactctttttaaacttggtcccttggtttaaatttgtttgtgttgatttaatggtaataaacatttaatggttatctgtattatgaggtggagccgcgcgctgccgtgggacacaaaaagagaaaaagagggggggggcgctctaaaggagccaagcttacgtacgc

SEQ ID NO: 1678 - DNA, 1558 bp, Brassica napus
gacgaaaaaggcttcttcgatctacacttctcttctcttctctacctctcgcaggcaaggttgttaatggcggaatcatccaaagtcattcatgttcgtaatgtcggacatgagatttctgaaaatgatttgcttcagcttttccaaccatttggtgtcataactaagctcgtcatgctcagggcaaagaatcaggctcttctccagatgcaagatgtttcttcagcaatcactgctcttcagttcttcactaatgtgcagccaaccataagaggtaggaatgtgtatatccaattctcgtcccaccaagaattgacaacagccgagcagaatattcatggacgtgaagatgagccgaatcgtattctcttggtcacagtccatcacatgctgtatccaattactgttgacgtcctgcatcaagttttttctccctatggatttgtggagaagatcgtcactttccagaagtctgctggttttcaagctcttatacagtatcaggcacaaccgtgtgctgcctctgctaggacttctctacagggtcgtaacatatatgacggctgttgtcagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatcctcagatggcaaacacatctgcgattgcagctgcctttggctgtggcttgcctccgggtataactggcacaaacgataggtgtacaatccttgtctctaatcttaatactgatagtgttgatgaggataagctgttcaatctgttttctctttacgggaacattgtgaggataaagcttcttcgaaacaaacctgaccatgcccttgtccaaatgggagatggtttccaggctgagcttgcagtacatttccttaagggagcgatgctgtttggtaagcggctagaggtaaactactcgaagcatccaaatattacaccagggacagactcgcatgactatgtaaactcaaacctgaaccgcttcaaccgcaatgctgcaaaaaactaccgctattgctgctcccctaccaagatgattcacttgtccactcttccgcaagacgtgacagaggaagaagtggtgaaccatgtccaagagcacggggcgatactgaacacaaaagtgtttgagatgaacgggaaaaagcaagctctggtgcagtttgagaacgaggaggaagctgcggaagcactggtttgcaagcacgcgacctctctaggtggatcaattatcagaatctccttctctcagctacagactatttaaagtcgacaaaggcctctctctcttttctctctctcacctctaataacatttgggtatggtgaggatgatcaatgtgtgtttctttaactcaaatatctctgctacttgtttggacttttctgcactctttttaaacttggtcccttggtttaaatttgtttttgttgatttaatggtaataaacatttaatgg

SEQ ID NO: 1679 - DNA, 1719 bp, Eutrema parvulum
agagaatgcacacaaagagagaaaatctttgatataaaagataattagtagatagatagggttaaagcattgacgacgaagcctccttcgatctacacttctcttctctcagattctctctccctccttctcgctctgtctctcgcaggcaaggttcctcatggcggaatcttccaaagtcattcatgttcgcaatgttggacatgagatttctgaaaatgatttgcttcagcttttccagccatttggtgtcataactaagcttgtgatgctcagggcaaagaatcaggctctgctccagatgcaagatgtttcttcagcgatcagtgctcttcagttttttactaatgtgcagccaaccataagaggtaggaatgtgtacatccaattctcatctcaccaagaattgacaacagtagaacagaatattcatggacgggaagatgagccgaatcgtattctgttagtcacagtgcatcacatgctgtatccaattactgttgacgtgctgcatcaagttttttctccctatggatttgtggagaagctcgtcactttccagaagtctgctggttttcaagctcttatccagtatcaggcacaacagtgtgctgcctctgctagaactgctctacagggtcgtaacatatatgacgggtgttgtcagttggatatccagttttcaaaccttgaggagctgcaagtgaattacaacaatgatcgatctagggattatacaaatccaaacctgccatcagagcaaaaaggccgtccatctcatcctggctatggtgatgcaggagtggcatatcctcagatggcaaacacagctgcgattgctgctgcctttggtggaggcttgcctccgggtatcactggcacaaatgataggtgtacaattcttgtctctaatctgaatgcagatagtgttgatgaggataagctattcaatcttttttctctttatgggaacattgtgaggataaagcttctccggaacaaacctgaccatgccctagtccaaatgggagatggtttccaagctgaacttgcagtacatttcctcaagggagccatgctgtttggtaagcggctagaagtaaacttctcgaagcatccaaatataacaccaggcacagactcgcatgattatgtgaactcgaacctgaatcgcttcaaccgcaatgctgcaaagaactaccgctattgctgctcccctaccaagatgattcacttatcgactcttccgcaagatgtgacagaagaagaagtggtgaaccatgtccaagagcatggggtgatagtgaacacaaaagtgtttgagatgaacgggaaaaagcaagctctggtgcagtttgagaacgaggaggaagctgcagaagcactagtgtgcaagcatgcgacttctctaggcggatcagtcatcagaatctccttctctcagctacagacgatttaaagtcgagaaaggtctctatctctctcctctaataacattagggtgtgaggacaatgatgtatgttgctttaactcaaacctctctgcttcttgttcggactttactgcactcttttttaacttcttggtttcttgttttaattgtttgtgttgctttcatgagcttacatttaatggtaactaaagacataagaaagccaatggtaagagacaagtgtagtaatactgtttcattcatatatatatccttttctccaatt

SEQ ID NO: 1680 - DNA, 1696 bp, Eutrema halophilum
acgaagaaagaaaaaaacttgatataaagatgattaatagatagggttaaaagcattgacgacgagatcctctcaagccttcttcgatctacactttcttcttctctctctctccctctttctctctctctcctgtgtctctctcaggctaggttcttaatggcggaatcttccaaagtcattcatgttcgaaatgttggacatgagatttctgaaaatgatttgcttcagcttttccagccatttggtgtcataactaagcttgtgatgctcagggcaaagaatcaggctcttctccagatgcaagacgtttcttcagcagtcagtgctcttcagttttttactaatgtgcagccaaccataagaggaaggaatgtgtatatccaattctcgtctcaccaagaactgactacaatagagcagaatattcatggacgcgaagatgagccaaatcgtattcttttagtcacaatccatcacatgctgtatccaatcactgtggatgtgctgcaccaagttttttctccctatggatttgtggagaagctcgtcactttccagaagtctgctggttttcaagctcttatccagtatcaggcacaacagtgtgctgcctctgctagaactgctctacagggtcgtaacatatatgacgggtgttgccagttggatattcaattctcaaaccttgaggagctgcaagtaaattacaacaatgatcgatctagggattataccaatccaaacttgccatcagagcaaaaaggccgttcatctcatcctggctatggtgatgtaggagtggcatatcctcagatggccaacacagctgcgattgcagctgcctttggaggaggcttgcctcccggtataactggcacaaatgataggtgtacagtccttgtctccaatctgaatgcagagagtatggatgaggataagttattcaatctgttttctctctacgggaacattgtaaggataaagattctccggaacaaacctgaccatgcccttgtccaaatgggagatggttttccagctgaacttgccgtacatttcctcaagggagcgatgctgtttggtaagcggctcgaagtaaacttctctaagcatccaaatataacaccaggaacagactcgcatgattatgtaaactcgaacctgaaccgcttcaaccgcaacgctgcaaagaactaccgctattgctgctcccctacaaagatgattcacctgtcgactctgccacaagacgtgacagaggaggaagtggtgaaccatgtccaagaacacggggtaatagtgaacacaaaagtgtttgagatgaacgggaagaagcaagctcttgtgcagtttgagaacgaggaggaagctgcagaagctctggtgtgcaagcatgcgactcctctaggcggatcagttatcagaatctccttctctcagctacagacgatttaaagtcgagaaaggcctctctctcttctctaataacattagggtttggtgaggataatgaatgtatgttgctttaactcaaacctctctgcttcctgttcggactttcaactttttggttccttggatttaaattgtttgtgttgattccatgggcttatatataattagtagtaataaagacttaagaaaagcaatggtagagactggtgtaagtgatgatattgtatcattcattgtt

SEQ ID NO: 1681 - DNA, 1779 bp, Arabidopsis thaliana
aagataaattagtagatagggttaaagcattgacgacgagacatagacgagagaccctctcaaatctcaagctcctttccttccttccttcgatctacactctcagattctctctctctctctttcctctctctttgtcttctctcaggttttgtaatggcggaatcttccaaagtcgttcatgttcgtaatgttggtcatgagatttctgaaaatgatttgcttcagctttttcaaccatttggtgttataactaagcttgtgatgctcagggcaaagaatcaggctcttctccaaatgcaagatgtttcttctgcagttagtgctcttcagttttttactaatgttcagccaactataagaggtaggaatgtgtatgtccaattctcttctcaccaagaattgacaacgatagagcagaatattcatggaagggaagatgagccgaaccgtattctcttagtcacaatccatcacatgctgtatccaattactgttgacgtcctgcatcaagttttttctccctatggatttgtcgagaagctcgtcactttccagaagtctgctggttttcaagctcttatacagtatcaggtacaacagtgtgctgcctctgctagaactgctctacagggtcgtaacatatatgacgggtgttgtcagttggatatccagttctcaaaccttgaggagctgcaagtaaattacaacaatgatcgatctagggattatacaaatccaaacctgcctgcagaacaaaaaggccgttcatcgcatccttgctatggtgatacaggagtggcatatcctcagatggcaaacacatcagcgattgcagctgcctttggaggaggcttgcctccgggtataaccggcacaaatgataggtgtacagtccttgtctctaacctgaatgcagatagtattgatgaagataagctattcaatctattttctctttacgggaacattgtaaggattaagcttcttcggaacaaacctgaccatgcccttgtccaaatgggcgatggtttccaagctgaacttgcagtacatttcctcaagggagcaatgctgtttggtaagcggttagaagtaaacttctcaaagcatccaaatataacaccaggcacagactctcatgattatgtaaactctaacctgaaccgcttcaaccgcaatgctgcaaagaattaccgctattgctgctcccctacaaagatgattcacttatcgactcttcctcaagacgtgacagaggaggaagtgatgaaccatgtccaagaacacggtgcagtagtgaacacaaaagtgtttgagatgaacgggaaaaagcaagctctggtacagtttgagaacgaggaggaagctgcggaagcattggtatgcaagcacgcgacttctctaggcggatcaattatcagaatctccttctcccagctacagacgatttaaaatcacgaaagacctctctctctctctctctctttctctatctctctttcctctaataacattagggtttggtgaggattaatgaatgtatgttgcttttaacttaaaactctctgctctttgttctgttctctctgttttttctttttaacgtgttggttttaattgtttgtcttgatttcatgggcttaacatttaatggtaataaagacataagaaaaaaaatggtagagacaattgtagtggtggttgtataatagtgtttctgaaacttcattttgtatcctttctcatttatattatgtttagatatattctcattta

SEQ ID NO: 1682 - DNA, 1942 bp, Arabidopsis lyrata
gaaagttgaggatgggagaaataagagagagagagagaaacttaaagataaatagtagagatagggttaaagcattgacgacgaaaaaggcttcttcgatctacacttctcttctcttctctatctctctctctctctctcccatgttttgtaatggcggaatcttccaaagtcattcatgttcgtaatgttggtcatgagatttctgaaaatgatttgcttcagcttttccaaccatttggggttataactaagcttgtgatgctcagggcaaagaatcaggctcttcttcaaatgcaagatgtttcttctgcaatcagtgctcttcagttttttactaatgttcagccaaccataagaggtaggaatgtgtatgtccaattctcgtctcaccaagaattgacaacgatagagcagaatattcatggacgggaagatgagccgaatcgtattctcttagtcacaatccatcacatgctgtatccaattactgttgacgtgctgcatcaagttttttctccctatggatttgtcgagaagcttgtcactttccagaagtctgctggttttcaagctcttatacagtatcaggtacaacagtgtgctgcctctgctagaactgctctacagggtcgtaacatatatgatgggtgttgtcagttggatatccagttctcaaaccttgaggagctgcaagtaaattacaacaatgatcgatctagagattatacaaacccaaacctgcctgcggagcaaaaaggccgttcatcgcatcctggctatggtgatgtaggagatggcaaacacatctgcgattgcagcggcctttggaggaggcttgcctccgggtataaccggcacaaatgataggtgtacagtccttgtctccaacctgaatgcagatagtattgatgaggataagctattcaatctattttctctttacgggaacattgtaaggattaagcttcttcggaacaaacctgaccatgcccttgtccaaatgggcgatggtttccaagccgaacttgcagtacatttcctcaagggagcggtgctgtttggtaagcggctagaagtaaacttctcaaagcatccaaatataacaccaggcacagactctcatgattacgtaaactctaacctgaaccgcttcaaccgcaatgctgcaaagaactaccgctattgctgctcccctacaaagatgattcacctatcgacacttcctcaagacgtgacagaggaggaagtgatgaaccatgtccaagaacacggtgcaatagtgaacacaaaagtgtttgagatgaacgggaaaaagcaagctctggtgcagtttgagaacgaggaggaagctgcggaagcgttggtgtgcaagcacgcgacttctctaggcggatcaattatcagaatctccttctcccagctacagacgatttaaaatcatgaaaggcctctctctctttctctcttctctaataacattagggtttgatgaggattaatgaatgtatgttgcttttaactcaaatatctctgctacttgtttggacttttctgcactctttttaaacttggtcccttggtttaaatttgtttgtgttgatttaatggtaataaacatttaatggttatctttatgattaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaggttcttgggttggacccccggcttaaggggaaattttggaaaattcccttcaatgggggggcccccaagattggttttagagggcccaattccccccaaaggggggggataaaaaatttccgggccggggttttaaaaccgcggggagggaaaaacccggggtgtacccaatttaatccccttgggaacaaccccccttt

SEQ ID NO: 1683 - DNA, 1750 bp, Gossypium hirsutum
caggtccttgcaaatggcggaagcttctaaagtcattcatgttcgcaacgttggccatgaaatttctgaaaatgatttgcttcaacttttccagccatttggagtgataacaaagcttgtaatgctccgtgcaaagaatcaggctcttctccaaatgcaagatattccttcagccatcaatgcaatgcagttctacactaatgttcaaccaactatcagggggaggaatgtgtatgttcaattctcatcacatcaagaactgacaaccatggatcagaatgctcaaggacgaggtgatgagccgaatcgaatcctcctggtcacaatccatcatatgctttatcctattactgtggaagtgctacaccaggttttctcacctcatggatttgtggagaagattgtcacatttcagaagtcggctggctttcaagccctgatccagtatcaaggacgccagaatgctatctcagctagaacttctcttcagggccgtaatatttatgatggctgctgccagcttgatatacagttttcaaaccttgatgaattacaagtccattataataatgagcgatcaagggatttcacaaacccaaatctcccgacagagcagaagggcagatcatcacagcatcctgggtatggtgatgcaggagttggattcccacagatggctaatgcagctgcaattgcagcagcttttggaggaggtttgcctccaggaataagtgggacaaatgataggtgcacagtgctcgtttccaatctaaatcctgatagaatagatgaggataagctattcaacttgttctcactctatggaaacattgtgagaattaaacttctacgtaataaaccagatcatgctcttgttcaaatgggtgatggcttccaggctgaactggcagtacattttctcaagggggccatgctatttgggaagcgactggaggtcaatttttcaaaacatccaaatataacacagggaactgatacccatgaatatgtgaactcaaatctcaaccgctttaatcgcaatgctgcgaagaactaccgttactgctgctcccctacaaagatggttcatctttctactttacctcaggatgtcactgaagaggaaattgtgaaccacttggcggaacatggcaccatcgttaataccaagctctttgaaatgaatggaaagaagcaagcccttgttatgtttgaaaatgaggagcaagctacagaagcccttgtttccaagcacgcaacctcacttggtgggtcaataatccgaatttcattctctcagttgcagacaataagagagaactcacagtaatagtttgtcggtaaggaactgcgatgatactggcattaagaattcattatcacccaggatattttatatcgggttgtaggttcatctttttatttcttgtttcgtttaacgttaagtctaattacttttatggtgctggatactatgttttatttttcggtcttcatatgactagttcatgtaaggtatgccacttaatctctctagggtctgaaaatttctgggtagattttttattatgcggataatggtcagttttgaggaaatagggagagaaacattagctgaaattgcatgatctttgtatcattgtgttgtatatttcttgtaagccaggccaactggtccattcctgtttgtatccgtatgccataccaggacgcgttttcgttcagtcattaagataatttattcttcgag

SEQ ID NO: 1684 - DNA, 3150 bp, Ricinus communis
ggagagggagagatagggtaaaataaaaacagcttcgaaccgcaacaacaacatgcgtagcagtcgatctatactagtacatctcttctgattctctctctctctctctctctctcttcagggtgcttcaaaatggcagaaccttccaaagttattcacgttcgcaatgttgggcatgaaatttctgaaaatgatctgcttcagcttttccagccattcggagtgataactaagcttgtcatgcttcgtgctaaaaatcaggctctcctccaaatgcaagatatcccttccgccattaatgctctgcaattttatggaaatgtccagccgaccataaggggtaggaatgtttatgtccagttctcatcacatcaggaactaaccacaatggatcaaaattcccaaggacgggcagatgagccgaatcgaatcttttagttacaatccatcacatgctatatcctattacagtggaagtgctacatcaagttttttctcctcatggatttgtggagaagattgtcacatttcagaagtcggctggttttcaagcccttattcagtatcagttacgccagagtgctgttgcagctaggactgctcttcagggacgtaatatatatgatggttgctgtcagctggacatccaattttcaaacttggatgagttgcaagtgaactacaataatgatcgatcaagggatttcactaacccacatctgcctgctgaacagaaaggcagatcttcacaagctggatatggtgatgcaggagttgcatatccacagatggccaatgctgctgctattgctgctgcctttggtggaggtctgcctcctggaatcagtggaacaaatgataggtgtacggttctcgtgtccaatttaaatcctgataaaatagacgaggataaactcttcaacctgttttccttatatgggaacattgtgaggattaaacttctccgcaataaacctgatcatgcacttgttcagatgggggatggctttcaggctgaattggcagtacacttcttaaagggtgcggtgctttttgggaagcgattggaggtcaacttttcaaagcatccaaatataactcaaggtgctgatacgcatgagtatgtcaattctaatctcaatcgcttcaaccgcaatgctgcaaagaactacaggtactgctgctcaccaacaaagatgatccacctttctactctacctcaggacatcacagaagaagagattgtgagccacttggaggagcatggcaccattgtcaacaccaagctctttgagatgaatgggaaaaagcaggcccttgttctgtttgaaacagaagagcaggccactgaagcgcttgtgtgcaagcacgccatatcagttgctgggtcaataatccggatctccttctcccagctacaatcaattagagaatcctcataaaacaatgaatgggggtaaggattcgtcttccagtggaaatcaacttttaaggattggtactcagcaaaggatatttagtatgttggtttcgttgcttgcttctttttgtcttgtaacagttcatttcttctatgactgatggatgctcttgtttcttatttaccatccttcttactctaatatttgtagcaattatttctttaggtttttgttgaatatgaggattccgagtagattccttcgtctgcagcagaaatgctcaattttgaaagtaggaagggagagtgaatgtatcatccttttttttagtcatgcttttgtatcagttttgtaaattttgcttataaattcaggctaattgggcgttttctgatgtttcttaacccaagcccaatttgttctatcgtctgctcagataagctaaactactttgcatgtctttccctctattcattttattcttcctcttcaccacctccttctcctcctcatcctcctttgtcttcctcttctgctgctgctgctcctcctcctctctctctgtctctctcttgtgtttgtgtatttcgttagcattatctcagcaataagttttactcttaagcaaatgattgcaactgacggattaagagatgagagtggttctccagataaagctcttggcaagggattatttcagtatttaattcttgtacatcacttccaaaagcctccgtgcaggaaatatggtatatgaaactgaatcatgactgcgaggatagggtctagtaaattgcaaatgttgtaagatccaactggttaataacagttgaattactggttcttaaggaggatcagactagtcgattttgctactcagttatatatagctaaagcagttctttgtcagcaaatgagagtaccaagaaatcaatccaaaaaacaataaaaatacaggggtcacatatgggttattccttgtataaactatcattgcatttcttggtctggttggttccatgcattcctagatgaagagcattaccttaatctatgcccgggtagacacaagttgttcgactcctcaacatcatttgagaatctctccacttgaatctgacatgtttctcccctgatactattcttgaatctggtatgacagccattgatgattcaacaccagtcatcgcaaaaactattctgaatcctgcttcctgctgttccatcttaacctcctacttcaagcttacaattaactctgtaattatgttgagcaacaaataaattattttgtctgcatgcaattgtatatatgggctctgggaattggaaatgattccttatttaaaagggactgctttgagaaaacttctgttcctgctcgttacaattgatattagcaagttgtaaagatgaaattatacatgtataatctgctaagtccacatggttttcacctttccatgtggaagtatgttgcctaagcatctaattctctaaaaattataaacctgactgtcaatcattaaattgatgaaacaaaaaaaaatgcccaagtggatgaaataagcaacaatcgggggagacatctgtaagttctataatacatcaacaattaccattcttctgtactttcatatgattctgctcataggaatcctattgctctgatgaggaatcctttctatagaagtgatcaattgcggcatagtcataccaactgaaacaa

SEQ ID NO: 1685 - DNA, 3258 bp, Theobroma cacao
actgatacatttaaaaatccatcagaatctaattctttgttctggatgaggtagtaatttgaaacaaattcctataatttgtcttgtttagcctctaggtactagctatgctacattatgggaactaggttgcacaattgcatatggaatagtaacacgtatttagaggtgatagtcaatgatgcctaacttaatggaggatcattgcaattatatttcaggtatacggcatatggttaattcatgtgaaattgtttatgtatgtgaggttattgagccatgaatagttgatatgaaatatgatctatgaatgttgtggaatgatgacctatgaacttgattttgttctgtctgatggatgaattttgaaagtagatttgatttgaggtttcccccgtgactatgttctttgcttgcaaggatgatggtaaaagtctcgcctatagtcttgtgatgccatccattgagtgattttgaatgatgactaatgagaattgatgggaagctcacagatcaaggagcaagaattcagaaaattgaagaaaggttaacagaaatggaaaacaaaatgaaagaaaaagaaaaaatgccatctgaaccagttgctgcagatagctctgcaactcctagcctggcttcagtagaacaagaagctgaggtgcaagctaaaggtcatgagcttgaggaggaacaattgagaaaatccccctcacctgaacctcaggataaagaagaatcagtacaaggaactgagatgttgggatcacttaatgaaaatcctcccactgaaccccaacctcaaccatctcctccacattctgaagaggtttcaatcatgggacttttccatcaaatggttcaagaggagcaagctgagaaagaggtaggtaaggcaaaaactcaacaagcagcatctacatcagctcctactgcagaagagaaacttggaaaaggaaaagcaaagaccactactactccccaagtcaagtccaaaccacttggcaagggaaagaaaacaatggcaactaaaacaaagttcatcagaaggaggaaatcatccagattggttgaaaaagctaggccagcaactgtttcttctccttataatcctatagaaggcagtgagagaagcggggggtattttagggcgaaagagatagggcaaaataaacatgcgaagaaacacttctactcctcttctgtgattcctctcaaatccccctcttgcctcttcctctccctctctttctcaggcaagttctctctctctgatctcactatgtcgttgcaaatggcggaaccttctaaagtcattcatgttcgcaatgtaggccatgaaatttctgaaaatgatttgcttcagcttttccagccatttggagtgataacaaagcttgtaatgctccgcgcaaagaatcaggctcttcttcaaatgcaagatattccttcagccatcaatgcgttgcagttctacactaatgttcaaccaactattagagggaggaatgtctacgtccaattctcatctcatcaggaactaactacaatggatcagactgctcaaggacgaggtgacgagccgaatcgaatcctcctggttacaatccatcatatgctatatcctattaccgtggaagtgctacaccaggttttctcacctcatggattcgtggagaagatcgtcacatttcagaagtcggctggttttcaagccctgatccagtatcaactgcgccaaagtgcagtctcagctagaacttcccttcagggccgtaatatttatgatggctgctgtcagctggatatacagttttcaaaccttgatgaattacaagttcattacaataatgatcgatcaagggatttcacaaacccaaatcttccaacagaacagaagggcagatcctcacagcctactgggtatggtgatgtaggagttggatttccacagatggctaatgcagctgcaattgcagctgctttcggaggaggtttgcctccaggaataagtgggacaaatgataggtgtacagtgcttgtttccaatctaaatcctgatagaatagatgaggataagcttttcaacctgttctcactttatggaaacattgtgagaattaaacttctacgcaataaaccagatcatgctctagttcagatgggtgatggctttcaggctgaactggcagtacactttctcaagggggccatgctatttgggaagcgactggaggtcaacttttccaaacatcctaacataacacagggagctgacacacatgaatatgtgaactcaaatctcaaccgctttaatcggaatgctgcaaagaactaccgttactgctgttccccaacgaagatgattcatctttccactttacctcaggatgtatctgaagaggaaattgtgaatcatttggcggaacatggcaccattgttaataccaagctctttgaaatgaatggaaagaagcaagcccttgttatgtttgaaactgaggagcaagccactgaagcccttgtctccaagcatgcaagctcgcttggtgggtcaataatccgaatttcattctctcagttgcagacaataagagagaactcacagtaatagtttaatggtaaggaattgcaatggtactggcattaaggattcattattgcccaggatatttgtaaggggttgtaggtcgtcatttatctctcttatcgtgtaatgctcatctaattgcttttaatggtgttggatactttttcgtttaacttttacccccactttttacttcatttctctagtgcatgtacggtgtaccacttaattttgattttttataatgcagatggtcagtttcgaggaataggaagggagagagaagtaagtgtagttgcaattgcagttgagggagtctttgtatcatttttgtatatttcttgtaatccaggctaagtggtccatttctgtttgtatccgcatgccatacccgaatgcgttttccttgcagtcattaagatgatttaaattctcttactccctcttctggaaatatttgacactggattcaaacttgaattctctcctcttctatcttcttggattggagctttggcaactcgcttaggtttcctctgtttcatagactggagttgtggcatttatgcgtctgtagtgtgcttcagaagcacagccaagggttagttaattttggtaattttgaatctgtttcgccactcccacaatacaaagaaagcgagattctcacg

SEQ ID NO: 1686 - DNA, 1426 bp, Manihot esculenta
catagcagtcgatctctatatacatctccgatcctcttttttttcatttctctccatctctgttcagtctcttttctccatctctctatctttatttctctcagggtggtacaaaatggcagaactttccaaagtcatccacgtacgcaatgtggggcatgaaatttctgaaaatgatttgcttcagttattccagccatttgggatcataacaaaacttgttatgcttcgtgctaaaaatcaggctctcctccaaatgcaagatgttgcttcagccatgaatgctctgcaattctactcaaatgtccagccaaccataaggggtagaaatgtttatgtccaattctcatcgcatcaggaactaaccacaatggatcaaaattctcaaggacgaggagatgagccaaatcgcattcttttagttacaatccatcacatgctatatcctattactgtggaagtgctgcatcaagttttttctccccatggatttgtggagaagatcgtcacatttcagaagtcggctggttttcaagctcttattcagtatcagttgcgccagagtgctgttgcagctaggacttctcttcagggacggaatatttatgatggttgctgtcagctggacattcagttttcaaacttggatgagttgcaagtgaactacaataacgatcgatcaagggatttcactaacccacatctaccttctgaacagaaaggcagatcttcacaggctggatatggtgatgtaggagttgcatatccacagatggcgaatgcagctgcaattgctgctgcctttggtggaggtttgcctcctggaattagtgggacgaatgataggtgtacagtccttgtatccaatttaaatcctgatagaatagatgaagataagctttttaacctgttttccctctatggaaacattgtgaggattaagcttctccacaataaaccagatcatgcacttgttcagatgggggatggttttcaggctgaattggcggttcatttcctgaagggtgcaatgcttttcgggaagcggctggaggttaacttttctaagcatccaaacataactcaaggtgctgatacacatgagtacagcaactccaatctcaatcgcttcaaccgaaatgctgcaaagaactacaagtactgctgctcaccaacaaagatgatccacctttccactcttcctcaggacatcactgaagaggagatagtgagccatttggaggatcatggtgccattgtcaacactaaactctttgagatgaatgggaagaagcaggcccttgttctgtttgaaactgaggagcaggccactgaagccctcgtgtgcaaacatgcgagttcacttgctgggtcaataatccggatttccttctcccagctacaatcaattagagaaacctcatag

SEQ ID NO: 1687 - DNA, 1913 bp, Populus trichocarpa
ggcaaaatagccactaacaccaaagacgggacaacgtgcctgcgttgcagtcgatctacatagcacttctgctccttccccctctcttcttctttctctacagaacaatctttctctctccccttctctcccagggttgttaaaaaatgactgagccttccaaagttatacatgttcgcaacgtggggcatgaaatttctgaaaatgacttgcttcagctgttccagccattcggggttataacgaagcttgttatgcttcgtgctaaaaatcaggctctccttcaaatgcaagatgttccttcagctatcaatgctctccaactctatacaaacattcagccaaccataaggggaaggaatgtttatgttcaattctcatcacatcaagaacttactacaatggatcaaaatactcaagggcgaggagacgagccaaatcgaattctgttagttacaatacatcacatgctttatcctattacagtggaagtgctgcatcaagttttttctccccatggatttgtggagaagattgtcacgtttcagaagtcggctggttttcaagcccttatccagtaccagtcacgccagtgtgctgttcaggctaggacttctcttcagggacgcaatatctatgatggctgctgtcagctggacattcagttttcaaacctggacgagctgcaagtgaactacaacaatgaccgctcaagggatttcactaatcctaacctgccttcagaacagaaaggcagatcttcccaacagccagcatatggcgatgtagttggatatcctcctcagatgcccaatgcagctgcaattgctgctgcctttggtggaggtttgcctcctggaattagcgggacaaatgatagatgcacagttcttgcctccaatttaaatcctgatagtatagatgaggataagctgttcaacctgttttctctctatggaaacatagtgcggatcaagcttcttcgcaacaagcccgaccatgcacttgttcagatgggggatggtttccaagcagagttggcagtacattttttgaagggtgccatgctttttggaaagcgattggaggtgaatttttcgaagcacccaaacataactcaaggtgctgacacacacgagtacatgaactctaatctgaatcgcttcaaccgtaatgctgcgaagaactaccgatactgctgctcaccaacaaagatgattcatctttccactttacctcaggacatcactgaggaggagattgggaatcttgtagaggaacacgggaccattgtgaacaccaagctctttgagatgaatgggaagaagcaagcccttgttctgtttgaaaccgaggaggaggctactgaagcccttgtgtgcaagcatgctacttcgcttgctgggtcaatagtccggatctcgttctcccagctacagtccattagagagaaccaataaaagaatagcagtgttaaggatttgctgtggaaataataattcttgaggattcatgcttggccaggatattcacatgttagtgacagctcctattctctcctcttgtaatgggttcattgctttcgtactggtggatgttcattctcttttatttatcgtctttttcgctcacattttttcctaggaatgtttatttaatatcaggagtagagttcatgtttgcagatttggtcagttttgaagagtagggagggagaaatgtgttgcctttctcgttgaggggatcactttgtatcattgctgtacattcttgtaattcaggctaattgggccgtttctgttgtattctgagtccacacccccccccccccccaagcgtaaaatttattcttccctctttcctgatgttcactactatggatatctgctaatctactctctacctcattgtcc

SEQ ID NO: 1688 - DNA, 1609 bp, Catharanthus roseus
gaataggggaaaaaaacgatgagcctatagtctataacctcacgtgtagtgtaccaaaggtcaaaaatccccaaaccctattcgtctctcccttcttccccatctttgtctctctgctttgctcagcagaggttttagctcgcaatctctccttttcaggttgttgagatgacagaaccttcaaaagtcattcatgtgcgcaatgtgggacatgaaatttctgagaatgacttacttcagctattccaaccatttggagttatcaccaaacttgtgatgcttcgggacaaaaaaccaggctctccttcaaatgcaagatgttccatctgctgtaaatgcattgcaatactatacaactgttcaaccgagtataaggggtagaatgtctacattcagttttcgtcacatcaggaactaacaactatggatcagaatactcaggggcggggagatgagcctaatcgaattctgttagttacaatacatcacatgctataccccattactgtggaagtgctgcatcaagtgttttctcctcatggatttgtggagaagatcgtcacctttcagaagtcggctggcttccaagctttaattcagtatcagttacagcagagtgctgtttctgcaagaaattctcttcaaggccgtaacatatacgatggttgctgtcagcttgacattcagttctcaaaccttgatgagttacaagtaaattacaataatgagcgctctagggatttcacaaacccagctctgccatcagaacagaagggcagatcgtctcatcctggatatggagacatgggagttggatatccgcagatgcccaatgctgctgctattgctgctgcctttggagggggtttgcctcctgggataagtgggacaaacgatagatgcactgttcttgtttctaatttgaattctgatagaatcgacgaggataagctgtttaacctgttctccatctatggtaacattctgaggatcaagcttcttcgtaataagccagatcatgcgttggttcagatgggtgatggcttccaggctgaattggctgtcaactttctgaagggtgccaagctttttgggaagcgtttggaggtgaatttttcgaaacatccaaacatcactacaggtcctgatacacatgaatattcaaactcaaacctcaaccgcttcaaccgcaatgcagcaaaaaattaccgttactgttgttcaccaaccaagatgattcacatatccacccttcctcaggatgtaacagaggaggaattatatcccatttggaggagctacggggccattgtcaactctaagctattcgaaatgaatggaaagaaacaggctctggtgctgtttgagaatgaggagcaagcaactgaagcccttgtatgcaagcatgcaacgtctcttggtggttcaaccattcgtatttctttctctcagttgcagaccatctgagaaggaggggggtagcatatgctggaattggatctcacacttgcttggaatattaatggtttagtaattgttttgaaattcatcacctgtaactgtagttcccttgttcacttgtgtactaagattttttctgattgtctca

SEQ ID NO: 1689 - DNA, 2050 bp, Eucalyptus grandis
ggtagagcttggcgcgatcaatctagggcaagaagaagacaaaattcccaaggctttttcccaggaccccatcgtatcgtccaagctccaaaaaactccagaacaataacaacatcggccctcgtcgtcccgtgccgctccgcttctccttccgctccatcatcccataacgatgatgatgaacatcccgaacagtcgatccattcactcctgacccatctctctctctctctctctctctctttctctctctgtgtcaggttcgttgctgaaaaatgacagagccgtccaaagtgattcacgtccgcaacgtcgggcatgaaatttcagagaacgatctgcttcaactatttcagccatttggagtcattacgaagcttgtaatgctccgtgcaaagaatcaggctcttctccaaatgcaggatataccgtctgcaattaatgccttgcagttctatgcaaatgttcagccaagtattaggggtaggaatgtatacgttcaattctcatcacatcaagagcttaccacagtggatcaaaatgctcaagcaagaggagatgagcccaatcggattttactggtcaccattcaccacatgctgtatcctataaccgtagaggtgctgcaacaagtgttttctccttatggatttgtggagaagattgtgacatttcaaaaatcagccggttttcaagctcttattcaataccaatcacgccagtgtgcaattgcagcaagaacttctcttcagggacgtaatatctatgatggttgctgtcagctggacattcagttttcaaaccttgatgaactacaagtgaactacaacaatgagagatcaagggattttacaaacccaaatttgccttctgaacagaaaggtagatcatcacagcctgggtatggggatgctggaagcatttatgcactccaagctggtggagcacgggcagttccatttcctcagatggctaatgctgctgcaatagcagctgcctttggaggaggtttgccacctggaattagtggaactaatgacaggtgtaccgttcttgtctctaatttaaatcctgataaaatagatgaggataagcttttcaacttattctctctttatggaaacattgtgaggatcaagcttctgcggaataaaccagatcatgcactggttgagatgggtgatggatttcaggctgagttggctgtacactttttgaagggagctgcactttttgggaagcggctggaggtcaacttctccaagcatccaagcataactcaaggtgccgacacacatgactacatgaactcaaatcttaaccgcttcaaccgtaatgctgcgaagaactaccgctactgttgctcaccaaccaagatgatacatctctccagtcttcctcaggaggtgacagaggaggagatagtgaaacatctggaggaacatggccccattgtaaacacaaaggttttcgagatgaatggcaaaaagcaggccctggttctctttgagaacgaggaacaggccaccgaagccctagtgtgtaagcacgctagctctctggctgggtcgataatccggatttctttctcccagttgcaggagatttaggtcgctgtatggtcagacgcattgcatggtaaaacttttttgctcaaatagtggggagttcgaacccttctgtttttttatttatgtgggtggccgtcttctaagtctcaacgtttgataaagacttaattgcttcataatcaacgacgccctctacttttctctatatcttttttcttttcatgcttgtactgattattctgttaggggtccttttcaagtttagtgggtagatgtcctgcgttgcagataggatcaattttgaaggatggggaaggagatacagagagcatgtagggtacttgttttcctttttcttgtatcattgtagtaaatccaggctaagtttttagccgtttctgttgtatcctgttcatttttcttccctgttgaattggcacaaagagctagttatgaaggatgttttagtctcttgagag

SEQ ID NO: 1690 - DNA, 1983 bp, Euphorbia peplus
gtatagaacgaacttaattgagatgtgattattgataagaattcttgtctcgtaacgaattaatgcctctacgtacaattccttacaattcctaccatagtttaagtttttttccgttttacggttatttcctaaccatcttattttcgaaggatagtaagaaccgttacctttttaccaccatgtaacaagactacgaatagtcggtaacttatagaaagagcttctacacaaaccaaaaagaaaaaaaaacagaagaagaagaagaagaacatatgatataatagcagctgcagaagcagtcgatctaataataagcgttgttctgtggtttgtaatggcagaaccatccaaagttatccacgttcgcaatgttgggcatgagatttctgaaaatgatttgctccaattattccagccatttggggtgataacaaaactggttatgcttcgcgctaaaaatcaggctcttctccaaatgcaagatgttccttcagccatcaatgccttgcaattctatacaaatgtccagccaactattagaggcaggaatgtttatgttcaattctcatcccatcaagagctaaccactatggatcaaaatacccaaggaagaggagatgagccaaatcgaattcttttagttacaattcatcacatgctatatcctattactgtggaagtgctgcatcaagttttttctcctcatggatttgtggagaagattgtcacgtttcagaagtcggctggttttcaagcccttattcaatatgagttgctacagagtgcggtagcagcaaggacttctcttcagggtcgcaatatttatgatggctgctgccagctggacattcaattttcaaatttggatgagttgcaagtgaacttcaataatgatcgatcaagggatttcactaacccacatctcccagctgaacagaagggtggcaggtcttcacaacaatcaggatacagtgatgtcggagttgcatatccacaggtggccaatgccgccgcaattgctgctgcctttggaggaggtttaccaccaggaattagtgggacaaatgataggtgtacagttcttgtgtccaacttaaatcctgatagtgtagacgaggataaacttttcaacctgttttctctctatggaaacattatgaggattaaactgctccgcaataaacctgatcatgcacttgttcagatgggcgacggcttccaggctgaattggcagttcattttttgaagggtgctatgctttttgggaaaagaatagaggtgaacttttcaaagcatgcaaacataacacaaggtgctgatactcgtgaatttgtgagctcaagtctgaaccggttcaaccgaaatgccgcaaagaactacaggtactgttgttcgccgacaaagatgatccacctttcaactttacctcaggacataacagacgaggagatagtgatgcacttagaggaacatggtcccattgtgaatacgaagctgtttgagatgaatgggaagaagcaagcccttgttctgtttgaaacagaggagcaggccaccgaagccctcgtgtgtaagcacgctacttctcttggtggatcagttatccggatttccttctcccagcttcaatcaatcagagagaactcgtaaggcagggtaatggatatgaattatgtcaaggttaggattttaatttaacggtgattgcaaatctttgcttgtaacatttgcttacattaacaatgctggatgatttttttattttgctcgtttctgaatcatccttggtctgctcttgatctaaaatttgttgagtaagaataatttgtgagtagggaggtgcttgttagtgttatttatttgcatgaggtatgctcaattttggaaagtagggaggggagagaagagaatattgtataagttgagacttaaagagaaagattaagattgtagcattgctgtatgtatgtatgcattat

SEQ ID NO: 1691 - DNA, 1928 bp, Arachis hypogaea
caatggctgaaccttccaaggtcatccatgtacgaaacgtggggcatgagatatccgaaaatgatttgcttcagctctttcagccttttggagtcataacaaagcttgtgatgttgcgtgcaaaaaatcaggctcttgtccaaatgcaagatgttgcttcagccgttaattctttacaattttatgcaaatgttcagccaagcataagggggaggaatgtttatgtccagttttcctcacatcaagaactaacatcaatggatcaaaatcaagggcgtggagatgagccaaatcgaattctcttagttacaattcaccacatgatgtatcctataacagtggatgtgctatatcaagtattttctccccatggatctgtggaaaagattgtaacatttcagaagtcagctggttttcaggctcttatccagtatcagtcacgtcagcatgctgttgtcgcaagaagtacacttcagggacgcaatatttatgatggttgctgtcagctggacattcagttctcaaaccttgatgaactacaagtgaactacaacaatgaccgttcaagggactttacgaacccaaatcttcctacagagcagaaaggcagaccgtcacaacctggatatggcgatacagttggatatcctcagatggccaatgctgcagccattgcagctgccttcgggggtggtttgcctcctggagtaaccgggacaaatgaccgatgtacaattcttgtctcaaatcttaatcctgacagaatagatgaggataagctgttcaacttgttctccatttatgggaacattgtgaggattaagcttctccggaataaaccagatcatgcacttatccagatgggggatggtttccaagctgaattggcagtgcactttctgaagggagccacgttgtttgggaagcgattagaagtcaacttctcgaaacatcctaacataaccccaggtgctgacacgcatgagtatgccaattcaaacctcaaccgtttcaaccgtaatgctgctaagaactaccgttattgttgctccccgacaaagattatccatttgtcaacactcccgcaagatgtcaccgaagatgagattctgaacctcctggaggagcatggaactattgtgaacagcaaagtctttgagatgaatgggaaaaagcaggctctggttcagttcgagactgaggaactggctaccgatgctcttgtatgcaagcatgcaagctcactttctggttcagtaatccgcatctcattctcacagctgcagaatatatgatgagaatttgttaaagccttgaggacaacccaagtaacagttgttaagcattctgagtttgggaaggatattgttttatgcagatgatgatggtcttctccattatgttgtaatggtgcctttgcttgctatttaacttataacacctgctctgacacttattttttcctctctactcatttgtcttcttatctctattacccttttttgttctttaggttgctaacatgttgtaggcctagaatttgtgattgtggaatggctagttttcaagagaaaagggaagttcagcaccatgcattttttcatagtagctgttgtatctgttttgtaattcattctaaagtaggctttttgtattctcaatcctcgtcaaatttttgttgtgtttagagtatcttggtctactcctttttgtagcttacatatttccttcttactcctctgctatcattctttctcttcatattctattcttccttcttctaccttctcctctgcaagcacatggattgagaagatttcattattctcctactcctctacttactcttctctctgcccttcacctcccttcagtcaatgtgctcggtaggaaatggaaacgcctaatgtcattgaccttaggccttg

SEQ ID NO: 1692 - DNA, 1935 bp, Populus trichocarpa
agagggtccaccattactcgtcactcgaaagtccatccaagggagtgtcatttaaaagtcggagatagggcaatagtcactcacagcagagacggacagcgtgcctgcgtaggtgtcgatctacatagtacttctcctcctccttgttctttatacgaaacgatctttctcccctcccctccccccctcactctctttctctccgagactggttcgaaaatgaccgagccttccaaagttatccatgttcgcaacgtggggcatgagatttctgaaaatgacttgcttcagctgttccagccatttggggttataacgaagcttgttatgcttcgtgctaaaaatcaggctctccttcaaatgcaagatgttccttcagccatcaatgctcttcaatactatacagatgttcagccaactataaggggaaggaatgtttatattcaattctcatcgcatcaagaactgactacaatggatcaaaatactcaagggcgaggagaagagccaaatcgaattctgttaattaccatccatcacatgcaatatcctattacagtggacgtgctgcatcaagttttttccccccatggatttgtggagaagatggtcacatttcagaagtcagctggttttcaagcccttattcaataccagtcacgccagagtgctgttcaggctaggacttctcttcaggggcgcaatatctatgatggctgctgtcagctggacattcagttttcaaacctggatgagttgcaagtgaactacaacaatgacagctcaagggatttcactaatcctaacctgccttcagaacagaaagccagatcttcccaacagccatcatatggcgatgtagttggatatcctcagatgcccaatgcagctgcaattgctgctgcctttggtggaggtttgcctcctggaattagtgggacaaatgataggtgcacaattcttgtctccaatttaaatcctgatagaatagatgaggacaagcttttcaacctgttttctctctatggaaacatagtgcggattaagcttcttcgcaacaagcctgatcatgcacttgttcagatgggggatggtttccaagctgaattggcagtacattttttgaagggtgccatgctttttggaaagcgaatggaggtcaacttttcgaagcatccaaacataactcaaggtgctgatacgcacgagtacatgcactctaatctgaatcgcttcaaccgtaatgctgcaaagaactaccgatactgctgttcaccaacaaagatgattcatctttccactttacctcaggtcatcactgaggatgagattgtgagtcttgtagaggagcatggcaccgttgtgaacaccaagctctttgagatgaatgggaagaagcaggcgcttgttctgtttgaaaccgaggaggaggccacagaagccctcgtgtgcaagcatgctacttcacttgctgggtcgattgtccgaatctcattctcccagctacagtccattagagaaaaccaataaaagaatagcagtgttaaagatttactatggtaataataattcctgaggattcatgcttcacaaggatattcacatgttggtgacagctcttactctcctctcttgtaacggttcattgcttttttactggtggatgatgctccttcatttttatttactgtcttcctcactcacttctgatgtttgtaccaattatttcttaggaatgtttatttaatttcagaggattagatttcttgttttcagatatggtcagttttgaagagtagggagagagaggttttccctccctcatggagagggattactttgtatcattgctgtatattcttgtatttcaggctaattgggccgttactgttgtatttctagcccccctcctaaatttattcttccctatttcct

SEQ ID NO: 1693 - DNA, 1928 bp, Citrus sinensis
aatagatagatagggcagcgcaatcagactctctatatcaggcacaacattaacatgcgaacaagcactcgatctacttcaattcacttctaatttttctccctctctctcctctcttcctctctctctcagtgtgatttaagatgacagagccgtccaaggttattcacgttcgcaatgtgggacacgagatttctgaaaatgatttgcttcagctattccagccatttggagtcataactaagcttgtgatgcttcgtgcaaaaaatcaggctcttctccaaatgcaagatgttccttcagccatcaatgctctgcaattttacacgaatgtgcagccaaccatcaggggaaggaatgtttatgtccaattttcatcacatcaggaactaacaacaatggaacagaatgctcaaggacgaggtgatgagccgaaccgaattctcttagttacaattcatcacatgctttatcctattactgtggaagtgctgcatcaagttttttctcctcatggatttgtggaaaagatcgtcacattccagaagtcagctggatttcaagcacttatccagtatcaattacgtccgagtgctgttgtagctagaagttctcttcagggtcgtaatatttatgatggttgctgtcagctggacattcaattctcaaaccttgatgagttacaagtgaactacaataatgagcgatcaagggacttcacaaatccaaatcttcctgcagaacagaaaggcagaccctcacaatctgggtacagcgaagcaggaggtatgtacgctcctggagcaagggcagttgcatttccacagatggccaatgcagctgcaattgcagccgcctttggcggaggtctacctcctggaataacagggacaaatgataggtgtacagtcttagtttccaatctcaattctgatagaatagatgaggataagctttttaacttgttctccctctatggaaatatcataagaatcaaactcctccgcaataaaccagatcatgctcttgttcagatgggcgatggcttccaggctgaattggcggtgcactttctgaagggagccttactatttgggaagcgattagaggtcaacttctctaagcatcccaatataactcaaggtgctgacacacatgaatacatgaactcgaaccttaaccgcttcaaccgtaatgccgcaaagaactatcgttactgctgctccccaacaaagatgatccacctttccactttaccacaagatgttactgaagaggaaattgtgagccacctggaggagcatggctccattgtgaataccaagctctttgagatgaatgggaagaagcaggccttggtcctctttgaaaccgaggagcaggccactgaagcccttgtgtgcaagcatgctagctcacttggcgggtctataatccgaatctccttctcccagttacagtcaataagggaaaactcgcagtaaaacattgactatttgctaagccacgtgagttaaggattcatataaacaaggacattttgatgtaggtgaacagtctccttcgatgttatctcttgtaacagtagttttgcttattttgcgttggtggatgcgtttttattttctttttatctttatttcatatcatttctagtgcatgtactggctaccctttttttaggtttgtttaatttgaggtagatttttgcagatttggtcaatttgaagagtagaaagagagagagaattgtactaccttttcctgagctagggctttcaaagtttcatgtattattagttgtaaatatctttgtatttcatgctgatggggttggtactgttgtattctgaattcataaaccaaacctcatttgtcccagttgatttatgatctaaaaagaattttgcttccagtaaaaaaaaaac

SEQ ID NO: 1694 - DNA, 1950 bp, Citrus clementina
gtcagtgcgctcgtagggcgagacgacagaaatagatagatagggcagcgcaatcagactctctatatcaggcacaacattaacatgcgaacaagcactcgatctacttcaattcacttctaatttttctccctctctctcctctcttcctctctgtctcagtgtgatttaagatgacagagccgtccaaggttattcacgttcgcaatgtgggacacgagatttctgaaaatgatttacttcagctattccaaccatttggagtcataactaagcttgtgatgcttcgtgcaaaaaatcaggctcttctccaaatgcaagatgttccttcagccatcaatgctctgcaattttacacgaatgtgcagccaaccatcaggggaaggaatgtttatgtccaattttcatcacatcaggaactaacaacaatggaacagaatgctcaaggacgaggtgatgagccgaaccgaattctcttagttacaattcatcacatgctttatcctattactgtggaagtgctgcatcaagttttttctcctcatggatttgtggaaaagatcgtcacattccagaagtcagctggatttcaagcacttatccagtatcaattacgtccgagtgctgttgtagctagaagttctcttcagggtcgtaatatttatgatggttgctgtcagctggacattcaattctcaaaccttgatgagttacaagtgaactacaataatgagcgatcaagggacttcacaaatccaaatcttcctgcagaacagaaaggcagaccctcacaatctgggtacagcgaagcaggaggtatgtacgctcctggagcaagggcagttgcatttccacagatggccaatgcagctgcaattgcagccgcctttggcggaggtctacctcctggaataacagggacaaatgataggtgtacagtcttagtttccaatctcaattctgatagaatagatgaggataagctttttaacttgttctccctctatggaaatatcataagaatcaaactcctccgcaataaaccagatcatgctcttgttcagatgggcgatggcttccaggctgaattggcggtgcactttctgaagggagccttactatttgggaagcgattagaggtcaacttctctaagcatcccaatataactcaaggtgctgacacacatgaatacatgaactcgaaccttaaccgcttcaaccgtaatgccgcaaagaactatcgttactgctgctccccaacaaagatgatccacctttccactttaccacaagatgttactgaagaggaaattgtgagccacctggaggagcatggcaccattgtgaataccaagctctttgagatgaatgggaagaagcaggccttggtcctctttgaaaccgaggagcaggccactgaagcccttgtgtgcaagcatgctagctcacttggcgggtctataatccgaatctccttctcccagttacagtcaataagggaaaactcgcagtaaaacattgactatttgctaagccacgtgagttaaggattcatataaacaaggacattttgatgtaggtgaacagtctccttcgatgttatctcttgtaacagtagttttgcttattttgcgttggtggatgcgttttcattttctttttatctttatttcatatcatttctagtgcatgtactggctaccctttttttaggtttgtttaatttgaggtagatttttgcagatttggtcaatttgaagagtagaaagagagagagaattgtactaccttttcctgagctagggctttcaaagtttcatgtattattagttgtaaatatctttgtatttcatgctgatggggttggtactgttgtattctgaattcataaaccaaacctcatttgtcccagttgatttatgatctaaaaagaattttgcttccagtcca

SEQ ID NO: 1695 - DNA, 1950 bp, Citrus sinensis
gtcagtgcgctcttagggcgagacgacagaaatagatagatagggcagcgcaatcagactctctatatcaggcacaacattaacatgcgaacaagcactcgatctacttcaattcacttctaatttttctccctctctctcctctcttcctctctctctcagtgtgatttaagatgacagagccgtccaaggttattcacgttcgcaatgtgggacacgagatttctgaaaatgatttgcttcagctattccagccatttggagtcataactaagcttgtgatgcttcgtgcaaaaaatcaggctcttctccaaatgcaagatgttccttcagccatcaatgctctgcaattttacacgaatgtgcagccaaccatcaggggaaggaatgtttatgtccaattttcatcacatcaggaactaacaacaatggaacagaatgctcaaggacgaggtgatgagccgaaccgaattctcttagttacaattcatcacatgctttatcctattactgtggaagtgctgcatcaagttttttctcctcatggatttgtggaaaagatcgtcacattccagaagtcagctggatttcaagcacttatccagtatcaattacgtccgagtgctgttgtagctagaagttctcttcagggtcgtaatatttatgatggttgctgtcagctggacattcaattctcaaaccttgatgagttacaagtgaactacaataatgagcgatcaagggacttcacaaatccaaatcttcctgcagaacagaaaggcagaccctcacaatctgggtacagcgaagcaggaggtatgtacgctcctggagcaagggcagttgcatttccacagatggccaatgcagctgcaattgcagccgcctttggcggaggtctacctcctggaataacagggacaaatgataggtgtacagtcttagtttccaatctcaattctgatagaatagatgaggataagctttttaacttgttctccctctatggaaatatcataagaatcaaactcctccgcaataaaccagatcatgctcttgttcagatgggcgatggcttccaggctgaattggcggtgcactttctgaagggagccttactatttgggaagcgattagaggtcaacttctctaagcatcccaatataactcaaggtgctgacacacatgaatacatgaactcgaaccttaaccgcttcaaccgtaatgccgcaaagaactatcgttactgctgctccccaacaaagatgatccacctttccactttaccacaagatgttactgaagaggaaattgtgagccacctggaggagcatggctccattgtgaataccaagctctttgagatgaatgggaagaagcaggccttggtcctctttgaaaccgaggagcaggccactgaagcccttgtgtgcaagcatgctagctcacttggcgggtctataatccgaatctccttctcccagttacagtcaataagggaaaactcgcagtaaaacattgactatttgctaagccacgtgagttaaggattcatataaacaaggacattttgatgtaggtgaacagtctccttcgatgttatctcttgtaacagtagttttgcttattttgcgttggtggatgcgttttcattttctttttatctttatttcatatcatttctagtgcatgtactggctaccctttttttaggtttgtttaatttgaggtagatttttgcagatttggtcaatttgaagagtagaaagagagagagaattgtactaccttttcctgagctagggctttcaaagtttcatgtattattagttgtaaatatctttgtatttcatgccgatggggttggtactgttgtattctgaattcataaaccaaacctcatttgtcccagttgatttatgatctaaaaagaattttgcttccagtcca

SEQ ID NO: 1696 - DNA, 1733 bp, Arachis hypogaea
caatggctgaaccttccaaggtcattcacgttcgaaatgtggggcatgagatatctgaaaatgatttacttcagctatttcagccttttggagtcatcacaaagcttgttatgttgcgtgctaaaaatcaggctcttctccaaatgcaagatgttccgtccgcaattagtgctttacaattttatgcaaatgttcagcctagcattagggggagaaatgtttatgtccagttttcctcacatcaagaactaactacaatggatcaaaatcaaggacgtgaagatgagccaaatcgaattctcttagttacaattcaccacatgctgtatcctataacagtggatgtgctacatcaagtgttttccccccatggatatgttgaaaagattgtaacatttcagaagtcagctggctttcaggctctcatccagtatcaatcacgtcaaagtgctgttaccgctagaagtacacttcagggacgcaacatatatgatggttgctgtcaactggacattcagttctcgaaccttgatgaattacaagtgaactacaacaatgatcgatcaagggacttcacaaacccaaatcttccaacagagcagaaaggccgatcttcacaacctggatatggtgatgcaggaagcatgtatggtgttcaaggttctggaggtagaggagctggaggatattcacagatggccaatgctgcagcaattgcagctgcctttgggggaggcttgcctcctgggataaccggaacaaacgacaggtgtacaattcttgttgcaaatctcaatcctgatagaatagatgaagataaactgttcaacttgttctccatttatgggaacattgtcagaatcaaacttcttaggaacaaaccagatcatgcgcttatccaaatgggggatggtttccaagccgaattggcagtacattttcttaagggagctatgttgttcgggaagcgattggaggtcaacttctcgaagcatccgaatataacccaaggtgccgaaacacacgagtatgtgaattcaaatctcaaccggttcaatcgcaatgctgctaaaaactaccggtattgctgctcgccaaccaagatgatccatttgtcaaccctcccacaagacatcactgaagaggacattgtaagccttgtggaggagcacggaaccattgtcaacagcaaggtctttgagatgaatggaaaaaagcaggctcttgttcagtttgaaactgaggagcaggctaccgaggcccttgtctgcaagcacgcaagcccactttctggctcggtgattcgaatctccttttctcagttgcagaacatttgatcgagactattgctaccgactcgagcgctaccgtcttacggttcttaagcttatttgggacaaggattctgaacttgggaaggataatatttatgcagatgatgccactttcattgtcttgtaatggtcgaattgcttattaatatacagataaaacctgttctcacttctcatttcacttttaatcatttctcttctcatcttcattccctctaatactagatctttaggttctgacataatgggagtggggatagatttgtgattacatagagaggggcaaatctactaccttatgtttatgaaattattgttgtacatgttcttaatttatgttaagtaggcctcttccttttgtattctcaatccatgtcaattttccttctccaacaactg

SEQ ID NO: 1697 - DNA, 1860 bp, Cajanus cajan
ggggagggcaacaaaatcacgacatcgttgaagcacctcctctagttaactttcttctctctctctctctttcactcactctctcgaggtaatttgcaatggctgaaccttccaaggtcattcacgttcgaaatgtggggcatgagatatctgaaaatgatttgcttcagctatttcagccttttggagtcataacaaagcttgtgatgttgcgtgccaaaaatcaggctcttcttcaaatgcaagatattccttctgcagttaatgctttacaattttatgcaaatgttcagccaagcataagggggagaaatgtttatgtccagttttcctcacatcaagaactaactacaatggatcaaaatcaagcacgagaagatgagccaaatcgaattctcttagttacagttcatcacatgctgtatcctataacagcggatgtgctacatcaagtattttctccccatggatatgtggaaaagattgtaacatttcagaagtcagctggctttcaggctctcatccagtatcaatcccgtcaaagtgctgttactgccagaagtactcttcagggacgcaatatttatgacggttgttgtcagctggacattcagttctcaaaccttgatgaacttcaagtgaactataataatgatcgttcaagggacttcacaaacccaaatttgcctacagagcagaaaggtcgatcttcacaaccgggatatggtgatgcaggacccatgtattctggagccagggcaggtggattctcacagatggccaatgctgcagcaattgcagctgcctttggaggaggtttgcctcctggcataactggaacaaatgaaaggtgtacaattcttgtcgcaaatctcaatcctgatagaatagatgaggataaactgttcaacttgttctccatttatgggaacattgtcagaattaaacttctccgaaataagccagatcatgcacttatccagatgggtgatggtttccaagctgaattggcggtacactttctgaagggagccatgttgtttggcaagcggttggaggtcaactattcaaagcatgcaaacattacacaaggtgctgatacacatgagtatgccaattcaaatctcaatcgattcaatcgtaatgctgctaagaactaccgatactgctgctctccaacgaagatgatccacttgtccactctcccacaagacataactgaagaggagatcgtgagcctcttggaggagcatggtaccattgtcaacagcaaggtctttgagatgaatggtaaaaaacaggctcttgttcagtttgagaccgaggagcaggctaccgaagcccttgtgtgcaagcatgcaagtccactttctggatcggtggttcgcatctccttctcccagttgcagaatatatgagaatttgataactgaagggaaacagttttatggttgctacttgctaagcatattagggtcaaggaattctaaatttgggaaggataatttttatgcagataatgtcaccttcattgtcattgtaatggtctctttgcttgctaatttactgataaaacctgcactactttttctctttgaatcatttatcttctcatctccattgcctctgctagatgtttaggttgctaacgtaatgtagtggggcaagctttatgattgcagatggatgaggtcttgaagaacatagaaaagggggaggaaattgcttactattattaccttcttcagagttgagggagggattgccttatggttttataatgattgttgtatatgttctgtaattcaggctaagtaggccgttctgttgtattctctatccatatcaattttcttgtcc

SEQ ID NO: 1698 - DNA, 1813 bp, Glycine max
gtaatttgcaatggctgaaccttccaaggtcattcacgttcgaaatgtggggcatgagatatctgaaaatgatttgcttcaactatttcagccttttggagtaataacaaagcttgtgatgttgcgtgccaaaaatcaggctcttcttcaaatgcaagatattccttctgcagttaatgctttacaattttatgcaaatgtccagccaagcataagggggagaaatgtttatgtccagttttcctcacatcaggaactaactacaatggatcaaaatcaagcacgagaagacgagccaaatcgaattctcttagttacagttcatcacatgctgtatcctataacagcggatgtgctacatcaagtgttttctccccatggatttgtggaaaagattgtaacatttcagaagtcagctggctttcaagctctaatccagtatcaatcccgtcaaagtgctgttactgccagaagtactcttcagggacgcaatatttatgatggttgttgtcagctggacattcagttctcaaaccttgatgaactacaagtgaactacaataatgatcgttcaagggacttcacaaaccctaatctgcctacagagcagaaaggtcgatcttcacaacctggatatggtgatgcagcaggcatgtattcaggagccagggcaggtgggttctctcagatggccaatgctgcggcaattgcagctgcctttgggggaggtttgcctcctggcataactggaacaaatgaaaggtgtacagttcttgttgcaaatctcaatcctgatagaatagatgaggataaactgttcaacttgttctccatttatgggaacattgtcagaattaaacttctccgaaataagccagatcatgcacttatccaaatgggagatggtttccaagctgaattggcagtacattttctgaagggagccatgttgtttggaaagcgattggaggtcaactattcgaagcatgcgaacataacccaaggtgctgatacacatgagtatgtcaattcaaatctcaatcgattcaatcgtaatgctgccaagaactatcggtactgctgctcaccgacaaaaatggtccacttgtccaccctcccgcaagacataactgaagaggaggttgtaagccttttggaggagcatggaaccattgtcaacagcaaggtctttgagatgaatggaaaaaaacaggcacttgttcagtttgagactgaggagcaggctactgaagcccttgtgtgcaagcatgcaagtccactttctggatcagttgttcgcatctccttttcccagttgcagaatatatgagcagactttgataagggctgaagggaaacagttttatggttgttacttgataatcttattagggacaaggaattctgaatttgggaaggataatttttatgcagataatgtcaccttcattgtcattgtaatggtctctttgtttgctaatttactgataaaacctgctctacttttttctctttgaatcatttatcttctcatctccattgcctctactagagatgtttaggtttctaacataatgttgtggggcaagctttattattgcagatggatgtagtcttgaagaatagaaaagtggggagggaagttactaccttcttcagagttgagggattgccttatggtttttataatgattgttgtatatgttctataattcaggctaagtatgcctttctgtagtattctcaatccatttcaattttcttgtccaactaagtaaaaattctacatttttgtttttggcgtatttattcc

SEQ ID NO: 1699 - DNA, 1813 bp, Euonymus alatus
ggtactttagggcaagaaactgcacggacaattggcgaagtgcacatctcgctcagacaatatcagtcccgtacacacatccctcactccctctctctctctctctcagaggttattcagaatgacagaaccttcaaaagtcattcatgttcgtaacgtgggacatgaaatttcagaaaatgatctgcttcagcttttccagccatttggagtcatatccaagcttgtaatgctccgtgcaaaaaatcaggctcttctccaaatgcaagatattccctctgcaatcagtgctttgcaattctacgcaaatgttcagccaaccataagagggaggaatgtgtatgtccagttctcatctcatcaagaactaacaacaatggagcaaaattctcaaggacgaggagatgagccgaaccgaattctcttagttacagtccatcacatgctatatcctattacggtggaagtgctgcatcaagttttctctccgtatgggtttgtggagaaggttgtcacctttcagaagtcggctggatttcaagctcttatccagtatgaagtacgccagagtgctgtttcagctagaacttctctacagggacgcaatatctatgatggttgctgtcagctggacatccaattctccaaccttgacgagttacaagtaaactacaataatgaccggtcaagggatttcacaaaccccaatttgccatctgaacagaaaggcagatcctctcatcctggttacagcgatgcaggaggtatgtaccctgccaatggggcaacagcagctgcattttctcagatggcgaacgctgctgcaatagcaactgcttttggaggaggtttgccccctggaataagtgggaccaatgataggtgtactcttctggtatccaatctcaattctgatagaatagatgaggaccaactctttaatctgttctctctgtatggaaacattgtgagaataaaaattcttcgaaacaaaccagaccatgctcttgttcagctgggtgatggcttccaggctgaattagccgtacactttctgaagggagccatgctgtttgggaagcatttggaggtcaatttctcaaaacatccaaacataactcaaggcgctgacacccatgagtacatgaactcaaatctcaaccgtttcaaccggaatgctgcaaaaaactacaaatattgctgctctccaacaagaatgatccacctttcaactctgcctcaggatatcactgaagaggacattgtgagtcatttggaggaacatggaaccatcaccaatgcaaaggtctttgagatgaatggaaagaagcaagcacttgttcagtttgaaaccgaggagcaagccactgaggcgcttgtttgtaaacatgctagctcacttggcgggtcaataatccgaatttctttctctcagttacaggaaataaaagagaactcgtaggagaaaggtaacaagattatgaaactgagcgacgtattagggttgaatttatgattgcggcttgcgagggatgtttatttgaccccccaccttctgcacttgtaatcatggtttgattgctttcaactataacttatggtgtttgattctctttgggtcatctttcttctacctctgaatggtattatgacaattatttaggttgatagactatttttgttctctttttctgcaaatatgctggctgcttgtaaaataggacgagagtgggttgtctccttttcaaggggaactcctttgtaccattgttgtataactcttgtaatttatgctgatgaggcattctgttgt

SEQ ID NO: 1700 - DNA, 1876 bp, Prunus persica
gtgcgcattggaatctaatcgtctgtacatcgcaaattacatgtcaagcactcgatccctgcagtactgacttgagctctaccccttcactccttcttcgatccctctctctctcagggttttccacgatgacagaaccctctaaagtcattcacgtccgaaatgtggggcatgaaatttctgaaaatgatttgctccagctatttcagccatttggagtcataactaagcttgtgatgcttcgtgcaaaaaatcaggctcttatccaaatgcaagatactcctgctgcagtaagtgcactgcaattctatggaaatgttcaacctgccataaggggaaggaatgtctatgtccagttctcatcacatcaagaattgacaacaatgtatcagaatgctcaaggacgaggagatgagccaaaccgaattctcttagttacaattcatcacatgctatatcctataacagtggaagttctgcatcaagtgttttttcctcatggatttgtagagaagatcgtcacttttcagaagtcagctggttttcaggccctaatccagtatcagtcacgccagagtgccgttgcagctagaactgcgctgcagggacgcaatatttatgatggttgctgtcaactggacattcagttctcaaaccttgacgagttacaagtgaactacaataatgagcgttcaagagatttcacaaaccccaatttgccttcagaacagaaaggaagatccccgcagcctgggtatggtgatgcaggaggcgtgtatggccttcaaggtactggagccagggcagttggatttccgcagatggctaatgcggctgcaattgcggccgcctttggtggaggtttacctcctggtataagtgggacaaatgacaggtgtacagtccttgtctcaaatctcaatcctgataaaatagacgaggataagctttttaacttgttttccatatatggaaacattgtgagaattaaacttcttcgaaacaaaccagaccatgcacttgtccagatgggtgatggcttccagtccgaactggcagtacactttctaaagggtgcaatcctgtttgggaagcgattggaggtcaacttctcaaagcatccgaacataacccaaggtgccgacacacatgaatacatgaactcaaatctcaaccgcttcaatcgtaatgcagcaaagaactaccgctattgctgttcgccaacaaagatgatccacttgtcttctcttccccaggaagtcactgaagaggagattgtgaaccacctagaggaaattggtaccattgtaaacacgaagctctttgagatgaacggaaagaagcaggcgttggttctgtttgaaactgaggagcaggccactgaagctcttgtgtgcaagcatgctacctcgctcggtgggtcaataatccgaatctccttttcacagctacagggaatataataatgttattgttcagaaataacagggacgaggactctagagcataacagggttaaggcctcataattggaaaaatatttgtggagctgacggtgtgttctttgctgtctcttttctttgtaatggtgttttggattgcaattctgttggtgggatctgttcgttgagcatttatggtcttattatctccagtgcttgtatcaaatcatttattaggttccttacatattggagttaggtctcattgcgtagagatgccaagttttgaagcataggaagagggaaagttttacttttttatttttctttttcagaagagggatctctatgtgtatatcgcttgtaattcgggttaatcgggtcatatctgttgtattctcaatccatagccatttatgttccactcaatttgt

SEQ ID NO: 1701 - DNA, 1628 bp, Manihot esculenta
agggtaaaacagcttggaacgggaacaacatgcgtagcagtcgatctcatctctgatcttctcctcctctctctccgtctctctgagttcatactatctcctttctctctctctcgctcattctctctctcaggggggtttaaaatgacagaaccttccaaagttatccacgtacgcaatgttggacatgaaatttctgaaaatgatttgcttcagctattccagccatttggagtcataacaaagcttgttatgcttcgttctaaaaatcaggctctcctgcaaatgcaagatattccttcagccatcaacgcattgcaattctactcaaatgtccagccgaccattaggggtagaaatgtttatgtccaattctcatcacatcaggaactaaccacaatggatcaaaattctcaaggactaggagatgagccgaatcgcattcttttagttacaatccatcacatgctatatcctattactgtggaagtgctgcatcaagttttttctcctcatgggtttgtggagaagatcgtcacatttcaaaagtcagctggtttccaagcccttattcagtatcagttatgccagagtgctgttgcagcaaggactgctcttcagggacgtaatatttatgatggttgctgtcagctggacattcagttttcaaacttggatgaattgcaagtgaactacaataatgatcgatcaagggatttcactaatcctcatctgccttctgaacagaaaggcagaacttcacaaatggccaatgcaactgcaattgctgctgcctttggtggaggtttgcctcctggaatcagtgggacaaatgataggtgtacagtgctcgtatcaaatttaaatcttgatcgagtagatgaggataagctttttaacctgttttcactctatggaaacattgtgaggattaagtttctccgcaataaaccagatcatgctcttgttcagatgggagatggttttcaggctgaattagcagtgcattttttgaagggtgccatgctttttgggaagcgattggaggtcaacttttcaaagcatccgaacataactcaaggtgctgacacgcacgagtatagcaactctaatctcaatcgcttcaaccgtaatgctgcaaagaactatagatactgctgctcaccaacaaagatgatccacctttccactttaccacaagacatttccgaagaggaaatagtaagccatttagaggagcatggcaccattgtcaacaccaaactctttgagatgaatgggaagaagcaggccctcgttctgtttgaaaccgaggagcaagccactgaagccgtcgtgtgcaagcacgcaagctcacttgctgggtcaataattcggatttccttttctcagctgcaatcaataagagaaacttcataaaaggattaatggggggtcaatgatttgcaatggaagtagacttttaaggacacttaatactcagcaaggttatttaatgtgttggtggtggcgttttgcattgcttctctcctctttgtaacagttcactgctttgatgctgatttttcttcttttttttttttccgtttgttaaattcatcatccttaatcacacctctaatatttgt

SEQ ID NO: 1702 - DNA, 1899 bp, Glycine max
gttagcacctcctcttgttaaccttgttctgtttctctcttcccccttctctccgtctctctctcactcaatattttgaggtaatttgcaatggctgaaccttccaaggtcattcacgttcgaaatgtggggcatgagatatctgaaaatgatttgcttcaactatttcagccttttggagtaataacaaagcttgtgatgttgcgtgccaaaaatcaggctcttcttcaaatgcaagatattccttctgcagttaatgctttacaattttatgcaaatgtccagccaagcataagggggagaaatgtttatgtccagttttcctcacatcaagaactaactacaatggatcaaaatcaagcacgagaagatgagccaaatcgaattctcttagttacagttcatcacatgctgtatcctataacagcggatgtgctacatcaagtgttttctccccatggatttgtggaaaagattgtaacattccagaagtcagctggctttcaggctctcatccagtatcaatcccgtcaaagtgctgttactgccagaagtactcttcagggacgcaatatttatgatggttgttgtcagctggacattcagttctcaaaccttgatgaactacaagtgaactacaataatgaccgttcaagggacttcacaaaccctaatctgcctacagagcagaaaggtcgatcttcacaacctggatatggtgatgcaggaggcatgcattctggagccagggcaggtggattctctcagatggccaatgctgcagcaattgcagctgcctttgggggaggtttgcctcctggcataactggaacaaatgaaaggtgtacagttcttgtcgcaaatctcaatcccgatagaatagatgaggataaaatgttcaacttgttctccatttatgggaacattgtcagaattaaacttctccgaaataagccagatcatgcacttatccagatgggagatggttttcaagctgaattggcagtacattttctgaagggagccatgttgtttggaaagcgattggaggtcaactattcaaagcatgcaaacataacccaaggtgctgatacacacgagtacgccaattcaaatctcaatcgattcaatcgtaatgctgctaagaactaccggtattgctgctctccaacaaagatgatccacttgtccaccctcccgcaagacataaccgaagaggagattgtgagccttttggaggagcatggaaccattgtcaacagcaaggtctttgagatgaatggaaaaaagcaggcacttgttcagtttgagactgaggagcaggctactgaagcccttgtgtgcaagcatgcaagcccactttctggatcggttgttcgcatctccttttcccagttgcagaatatatgagccagactttgataagggctgaagggaaacagttttatggttgcaacttgctcggcttattagggacaaggaattctgaatttgggaaggataattttatgcagataatgtcaccttcattgtcattgtaatggtctctttgcttgctaatttactgataaaacctgaactactttttttttctctttgaatcatttatcttttcatctccattgcctctactagatatttaggtttctaacataatattgtggggcaagctttattattgcagatggatgtagtcttaaagaatagaaaaaggaggagggaagttactaccttcttcggggttgagggattgccttagggttttttataatgattgttgtatattttctgtaattcaggctaagtaggccttttctgttgtattctcaatccatttcaattttcttgtccaactaagtaaaatgctactacatttttgtttttggttcatttttattc

SEQ ID NO: 1703 - DNA, 1764 bp, Euonymus alatus
gggcaataaacgaagcactcgatctctcgcccacgcacgatagccccacacacctccctccctccctctctcagtttattcagaatggcggaaccttcaaaagtcattcatgttcgtaatgtgggacatgaaatttcggaaaatgatttgcttcagcttttccagccatttggagtcatatccaagcttgtaatgctccgtgcaaaaaaccaggctcttctccaaatgcaagatattccctctacaatcagtgctttgcaattctatgcaaatgttcagccgaccataagaggaaggaatgtgtatgtccagttctcatctcatcaagaactaacaacaatggagcaaaattctcaaggacgaggagatgagccgaaccgaattctcttagttacagtccatcacatgctatatcctattacagtggaagtgctgcatcaagttttctctcctcatgggtttgtggagaaaattgtcacctttcagaagtcggctgggtttcaagctcttatccagtatcaagtacgccagagtgctgtttcagctagaacttctctccagggacgcaatatttatgatggctgctgtcagctggatatccaattctccaaccttgatgagttacaagtaaacttcaataatgaccggtcaagggatttcacaaaccccaatttgccatctgaacagagaggcagatcctctcatcagtctggttacagcgatgcaggaagtatgtacccagccaatggggccacatcagctgcgttttctcagatggcaaatgctgctgcaatagcagctgcttttggaggaggtttgccccccggaataagtgggaccaatgacaggtgtactgttctggtatccaatctcaattgtgatagaatacatgaggacaaaccctttaatctgttctctctgtatggaaacattttgagaataaaacttcttcgaaacaaaccagaccatgctcttgttcagctgggtgatggattccaggctgaattagccgtacactttctgaagggagccatgctgtttgggaagcgtttggaggtcaatttctcaaaacatccaaacataactcaaggtgctgacacccatgagtacatgaactcaaatctcaaccgtttcaaccgcaacgctgcaaagaactacaagtattgctgctctccaacaagaatgatccacctttcaaccctgcctcaggatatcactgaagaggagattgtgagtaacttggaggaacatggaaccatcaccaacacgaagctctttgagatgaatggaaagaagcaagcacttgttcagtttgaaaccgaggagcaagccaccgaggcgcttgtttgtaaacatgctagctcacttggtggctcaataatccggatttctttctctcagttacaggaaataagagagaactcgtaggagaaaggtactaaagattatggcacttattagggttaagaattcataattgtgaggatgtttatttggccacaccttttcgcacttgtaatcatggtttgattgttttcaactctaatttatgtttgattgtctttcggtcatccttcttctgtcaccgagaatggtttcatgaatattattttggaccttggttgataagacccttttcttttccttcaaatatgctggctgtttgaaaagtagaacgagatgggatcgtcccctttttaagggggaagtccttttgtaccattgttgtataataattcttgaaatctatagggaatttgtaat

SEQ ID NO: 1704 - DNA, 1888 bp, Ricinus communis
gagggagagatagggtaaaataaaaacagcttcgaaccgcaacaacaacatgcgtagcagtcgatctatactagtacatctcttctgattctctctctctctctctctctctcttcagggtgcttcaaaatggcagaaccttccaaagttattcacgttcgcaatgttgggcatgaaatttctgaaaatgatctgcttcagcttttccagccattcggagtgataactaagcttgtcatgcttcgtgctaaaaatcaggctctcctccaaatgcaagatatcccttccgccattaatgctctgcaattttatggaaatgtccagccgaccataaggggtaggaatgtttatgtccagttctcatcacatcaggaactaaccacaatggatcaaaattcccaaggacgggcagatgagccttttgtattagcagttcgatttaagtccaactttgatgggatcaacattattgtggaagtgctacatcaagttttttctcctcatggatttgtggagaagattgtcacatttcagaagtcggctggttttcaagcccttattcagtatcagttacgccagagtgctgttgcagctaggactgctcttcagggacgtaatatatatgatggttgctgtcagctggacatccaattttcaaacttggatgagttgcaagtgaactacaataatgatcgatcaagggatttcactaacccacatctgcctgctgaacagaaaggcagatcttcacaagctggatatggtgatgcaggagttgcatatccacagatggccaatgctgctgctattgctgctgcctttggtggaggtctgcctcctggaatcagtggaacaaatgataggtgtacggttctcgtgtccaatttaaatcctgataaaatagacgaggataaactcttcaacctgttttccttatatgggaacattgtgaggattaaacttctccgcaataaacctgatcatgcacttgttcagatgggggatggctttcaggctgaattggcagtacacttcttaaagggtgcggtgctttttgggaagcgattggaggtcaacttttcaaagcatccaaatataactcaaggtgctgatacgcatgagtatgtcaattctaatctcaatcgcttcaaccgcaatgctgcaaagaactacaggtactgctgctcaccaacaaagatgatccacctttctactctacctcaggacatcacagaagaagagattgtgagccacttggaggagcatggcaccattgtcaacaccaagctctttgagatgaatgggaaaaagcaggcccttgttctgtttgaaacagaagagcaggccactgaagcgcttgtgtgcaagcacgccatatcagttgctgggtcaataatccggatctccttctcccagctacaatcaattagagaatcctcataaaacaatgaatgggggtaaggattcgtcttccagtggaaatcaacttttaaggattggtactcagcaaaggatatttagtatgttggtttcgttgcttgcttctttttgtcttgtaacagttcatttcttctatgactgatggatgctcttgtttcttatttaccatccttcttactctaatatttgtagcaattatttctttaggtttttgttgaatatgaggattccgagtagattccttcgtctgcagcagaaatgctcaattttgaaagtaggaagggagagtgaatgtatcatccttttttttagtcatgcttttgtatcagttttgtaaattttgcttataaattcaggctaattgggcgttttctgatgtttcttaacccaagcccaatttgttctatcgtctgctcagataagctaaactactttgcatgtctttccc

SEQ ID NO: 1705 - DNA, 1722 bp, Medicago truncatula
cttggttaagttaacacatcgtgcgtgcgtgcgtgcttcacttctccctccctctctctctttctctatcaggttaatttatcatggctgaaccttccaaagtcatccacgttcgaaatgtggggcacgaaatatccgaaaatgatttacttcagttatttcaaccttttggagtcattacaaagcttgtaatgttacgtgccaaaaatcaggcacttatccaaatgcaagatgttccttctgcagttagtgctttacatttttatggaaacactcagccaagcataagggggaggaatgtttatgtccagttttcatctcatcaagagctaacaacaatagatcaaagtcaaggacgaggagatgagccaaaccgaattctcttagttacaattcatcacgtgctctatcccataacagtggatgtactgtatcaagttttttctcctcatggatctgtggaaaagatcgtgacatttcagaagtcagctggctttcaggctctcatccagtatcaatcacaacagagttctattactgcaagaactgcacttcagggtcgcaatatttatgatggttgctgtcagctggacattcaattctcaaaccttgatgaattacaagtgaattataataatgaccgttcaagagacttcacaaacccaaatctccctacagaacagaaaggcaggcctccacaacttggatatggtgatgcaggaaacatgtatggtgttcagggttctggacccaggacagatgcccaatgctgcggccattgcagctgcttttgggggaggtttgcctcctggaataactgggacaaatgataggtgtacacttcttgtctcaaatcttaatcctgatagaattgatgaagacaaactgttcaacttgttctccctttatggaaacattgtgagaattaaacttctacggaacaaaccagatcatgcacttatccagatgggagatggtttccaagctgaactggctgtacactttctgaagggagccatgttgtttgataagcgactagaggtcaacttctcgaagcatccaaacataacacaaggtgctgacacacacgactacagcaactcaaatctcaaccgttttaatcgtaacgctgctaaaaactaccgctattgctgctccccaacgaagatgattcatttgtccacactcccacaagacatcactgaagatgagattgtgacccttctagaggagcatggaaccattgtcaatagcaaagtatttgagatgaatgggaagaaacaaggtctggttcagtttgagactgaggatcaggctactgaagcccttgtgtgcaagcatgctacctcactttctggctcggtaattcggatctcctattctcaattgcagaatatatgagcgttaacaatgttaaggatccgtggacaaccgaagtagcagttgttatgctcagtagagacaaggattctgaatttggaaggattttttatatgcagatagatgatgatcttcttcattatcttgtaatggtggctttgcttgctactttactgttgattatcttacactcttcgacttttcccccttaatcatttcttttctcatctccattgctctattatttctttagattactaacataatgtagagtaggggtgtagattttgtgattggtgaaagttgagtcttaggaatagaaaggaggggaaatcactgcct

SEQ ID NO: 1706 - DNA, 2063 bp, Glycine max
acagatggataagttttggtagcggtgtgatgagagaccaaaaaagcgcgagcaaatcttcacacttggaaccttaaattcaattaaggttctctctcttgtaaaatgctccaagggaagggagttttataacatgacctagtaacgattcaccacatcatgcgtgccactcctctttaactctctcatcctttttctctttccgtgtcaccctctttcaggttaatttgcaatgactgaaccttccaaggtcattcacgttcgaaatgtggggcacgaaatatctgaaaatgatttacttcagctgtttcagccttttggagtcataacaaagcttgtcatgctgcgtgcaaaaaatcaggctcttatccaaatgcaagatgttccttctgcagttaatgccttacaattttatgcaaatgttcagccaagcataagggggaggaatgtttatgttcaattttcctcacatcaggaattaacaacaatggagcaaagtcaaggacgaggagatgagccaaaccgaattctcttagtcacagttcatcacatgctgtatcctatgacagtggatgtgctgtatcaagtattttctccccatggatctgtggaaaagattgtaacatttcagaagtcagctggctttcaggctctcatccagtatcaatcacgtcagagtgctgttgcggcaagaagtacacttcagggacgcaatatttatgatggttgctgtcagctggacattcagttctcaaaccttgatgaattacaagtgaactacaataatgaccgttcaagggacttcacaaacccaaatctccctacagagcagaaaggaagaccttcacaacctggatatggtgatgcaggaaatatgtatgctgctcaaggttctggagccagggcagttggatttccacagatggcaaatgctgcagccattgcagctgcctttgggggaggtctacctcctggaataactgggacaaatgacaggtgtacagttcttgtatcaaatcttaatcctgatagaattgatgaggataaactattcaacctgttctctatttatgggaatattgtgagaattaaacttctccgaaataaaccagatcatgcacttattcagatgggagatggttttcaagcagaattggctgtacactttctgaagggagccatgttgtttgagaaacgattagaggtcaacttctccaagcatccgaacataacccaaggtgctgacacacatgaatacatcaattcaaatctcaatcgtttcaaccgtaacgcagccaaaaactaccggtactgctgctccccaacaaagatgatccatttgtccacactcccacaagacatcactgaagaggagattgtgagccttgtagaggaacatggaaccattgtcaacagcaaagtctttgagatgaacgggaaaaaacaggctctggttcagtttgggaatgaggagcaggctactgaagcccttgtgtgcaagcatgcaagcacactttctggctcagtaatccgtatctccttttcacagttgcagaatatatgagtctttattaaggagttgtggacaaccagagcaacggttattgaacacaatggggacaaggattctgaatttgggaaggatattttttatgctgatgatggtcatcttcattatcttgtattggttgcttggctttctaacttatttactcataatatctactctttcatttttcacctttaatcatttatcttctcatctccattgccctgctatttatttaggttgctaacataatgtagtggggaggtgtacatttttgttattgagtataggttcttggggaatagaaggagggggattcactaccttatagccgtttttataaatcattgttgtatatgttttgtaattcaggctaaagtagtaagtaggcttttctgttgcattctcaatcgatgtcaaaattttctattccaattgagcaagaagctactttttgtgattgtttttgaagtatctatcaattggtctactctttccgttttgcagctagata

SEQ ID NO: 1707 - DNA, 1713 bp, Fragaria vesca
caggactctctacaatgacagaaccttccaaagtcattcacgttcggaatgtggggcatgaaatttctgagaatgatttgcttcagctatttcagcccttcggagtcataactaagcttgtgatgctacgcgcaaaaaaccaggctcttattcaaatgcaagacactgctgctgcagtaagtgcattgcaattctatgctaatgttcaacctgctgtaaggggaaggaatgtttatgtccagttctcatctcatcaagaactaacaacaatgtatcaaaatgctcaaggacgaggagatgagccaaaccgaattctcttagttacggtccaccacatgctatatcctataacagtggaagtgctgcatcaagtttttttccctcatggatttgtagagaagattgtcactttccagaagtcagctggttttcaggccctcatccagtatcagtcccgccaaagtgctgttgcagctagaactgcactacagggacgcaatatttatgatggttgttgtcagctggacatccagttctcaaaccttgacgagttgcaagtgaactacaataatgagcgttcaagggatttcacaaatccaaatttgccttcggaacagaaaggaagatccccacaacctggatatggtgatgcgggcggcggcatgtatggcgttcaagctactggagcgaggacagttggattcccacagatggctaacgcagctgcaattgctgccgcctttggtggaggtctgcctcctggaataagtgggacaaatgacaggtgtacggtcctcgtgtcaaatttgaatcccgataggatagatgaagatatgctttttaacctgttctccatctatggaaacattgtgagaattaagcttctccggaacaaaccagatcatgcacttgtccagatgggtgatggcttccaggctgaactggcagtacactttttaaagggtgcaatcctttttgggaagcgattggaggtcaacttctcaaagcatccgaacatcactcagggtgccgacactcatgaatacatgaattcaaatctcaaccgcttcaaccgtaatgctgcaaagaactaccgctattgctgctcacctacaaagatgattcacttgtcatctcttccacaggaagttgctgaagatgagattgtgacccacctagaggaaattggtaccattgtcaacacaaagctctttgagatgaatgggaagaagcaggccttggttctgtttgaaactgaggagcaggccaccgaagccctggtgtgcaagcatgctacctcgcttggtgggtcaataatcaggatctccttttcacagttacaagcaatataataatgttatagttgcagtaataacaaggaggaggtttctgcaatatcaggggtaaggcctcgtaattggaaaaaaaatatttgtggagctgacggtcttctgttgctttctcttttctttgtatggtttcggattgcaaatgaattggtggatctgcattttgatcatttatggtcttatttatctttagtgcttgtatcagatcaattatctaggttttcaactgtttggggtaggtttcattctgagaaaatgccaagttttgaagcataggaatagggaagaattcctttttgttttttagaagagggatttcttagtgtatatctattttaattctggttaatcaagccatcttaat

SEQ ID NO: 1708 - DNA, 2295 bp, Quercus alba
ggggtgagtgcgagtgagattgagatttgagaaacagagagcagacaataaacacaatacacgttgcagttgcgcagttcccctctcaatccctcactcatcaatcatcaccactttctctctctcagccagggtcagggtcagggtcagggtcagggtgagcgtggttcagcttcagcacaatgacagaaccttctaaggtcattcacgttcgcaatgtgggccccgaaatatctgaaaatgatttgcttcagctattccagccatttggagtcataactaagcttgtgatgcttcgagcaaaaaatcaggctcttatccaaatgcaagatattccttcagcagttaatgctctgcaattctatgcaaacgtccagccaagcataagggggaggaatgtttatgtccagttctcatcacatcaggaactaacaacaatggatcaaaacactcaaggacgaggagatgagccaaatcgaattcttctagttacaattcaccacatgctatatccaataacagtggacgtgctgcatcaagtgttttctccgcatggatttgtggagaagatcgtcacttttcagaagtcagctggctttcaagccctcattcagtatcaatcacgtcagagtgctgttgtagctagaactgcacttcagggacgtaatatttatgatggttgctgtcagctggacattcagtactcgaaccttgacgagttacaagtaaactacaataatgagcgttcaagggatttcacaaacccaaatctacctacagaacagaaaggcagatcatcacaacctgggtatggggatgcaggaggcatgtatgcccttcaagctactgggcgggcagttccatttccacagatggccaatacagcagccattgcggctgcctttggaggaggtttgcctcctggaataagtgggacaaatgacaggtgtacagtccttgtttccaatctcaatcctgatagaatagatgaggataagctcttcaatcttttctctttatatggaaacattgtgagaattaaacttctccgcaataaaccagatcatgcactcattcagatgggtgatggcttgcaggctgaactggcagttaactttttgaagggagcaatgctatttgagaagccaatggaggtgaacttttcaaagcatccaaatataacccaaggtgctgacacccatgagtacataaactcaaatctcaaccgcttcaaccgtaatgctcaaaagaattaccgctactgctgctcccccacaaaaatgatacacctatctactctcccccaggatctcactgaggaggagattgtgagccacttggaagaacacggcaccattgtcaacactaagcttttcgaaatgaatgggaagaagcaggccctggttctgtttgaaactgaggagcaggctactgaagcccttgtgtgcaagcatgctacctcagtttctgggtccataatccggatttccttttcccagttacaggctatataagagaacttgtaatagaaggataactgggtaaggatccttaagcctattggggtaaggatattatgtgctgctgatggtttctacacttttcttataatgtggttttgattgcttttgtactggtgggacatactgtttgaatttctttaattatccatctttctcatctacagtccttgtaccaatgattgtttaggttccttcaatagtgggggtagatttctgactgcagataggcacagttttgagagtaggacttaggaagaaagagtgaaagagaatattaccttttcaggtagagggatctcttatgtatctttgttgtatatgtctttgtaattcaggctaatcgggccatgtctgttgtatcttaatgcccctttttcccgtcagttgagggatgagcaactttttgaagtttttccatttcctttatctcccccctgtttgttactcctctctgtgaaagacaaataaaatagtcattgcttgtcttatagtagaggtttatcggtcatctcactgcttcttcttggtccttgtcctcccctctctctctctcaccttgtccaactcttaattttgggatgtctcatttccaatttgagaaatggttaattgcaggtcctcccaatggggaaaggtgaaattatttgcatttggtaatgattttagagctgtattaagcaagaggtgattatattcaaacgtatattgttttttaaaaagcctcagattgtgaaacaaaaaaaaaaagttattaatcgcgatctagaactag

SEQ ID NO: 1709 - DNA, 1647 bp, Cajanus cajan
gggggggatggataagttttgggagtggttgtgtgtgatgagaccaaaagcatgatcaaatcttcagacttggaaccttaaattctctctcatgtaaacccgcactgagttacacatcattagatcatgcgtgccactcctctttaactctctttctctctctttccgtgtcaccctgtttcaggttaatttgcaatgactgaaccttccaaggtcattcacgttcgaaatgtggggcacgagatatctgaaaatgatttacttcagctgtttcagccttttggagtcataacaaagctagttatgctgcgtgcaaaaaatcaggcccttgttcaaatgcaagatgttccttctgcagttaatgctttacagttttatgcaaatattcagccaagcattaggggaaggaatgtttatgttcagttttcctcacatcaggaactaacaacaatggatcaaagtcagggacgaggagaagagccaaaccgaattctcttagttacgattcatcacatgctgtatcctataacagtggatgttctgtatcaagtattttctccccatggatctgtggaaaagattgtaacatttcagaagtcagctggctttcaggctctcatccagtatcaatcacatcaaagtgctgttatggcaagaagtacacttcagggacgcaatatttatgatggttgctgtcagctggacattcagttctcaaatcttgatgaattacaagtgaactacaataatgaccgatcaagggacttcacaaacccaaatctccctacagagcagaaaggcaggccttcacaacctggatatggtgatggaggaaacatgtatgctgctcaaggttctggagccaggacagccggatttccgcagatgggaaattctgcagccattgcagctgcctttgggggaggtttgcctcctggaataactgggacaaatgacaggtgtacaattcttgtatcaaatctgaatcctgatagaattgacgaggaaaaactattcaacttgttctctatttatgggaatattgtgagaattaaacttctgcgaaataaaccagatcatgcacttatccagatgggagatggctttcaagctgaattagctgtacactttctgaagggagcaatgttgttcgagaagcgattagaggtgaacttctccaagcatccaaacataacccaaggtgctgacacacatgaatacgttaactcaaatctcaaccgtttcaaccgtaacgcagctaagaattaccggtattgctgctccccaacaaagatgatccatttgtcaacactcccacaagacatcactgaagaggagattgtgagcctagtagaggagcatggaacaattactaacagcaaagtgtttgagatgaatgggaaaaaacaggctctggttcagtttgagaatgaggagcaggctactgaagcccttgtgtgcaagcatgccagcacactttctggctcagtaattcgtatctccttttcacagttgcagaatatatgagactttggtaagaactaatggtcaacaaccggaacaagggttgttgagcacagtagggacaaggattctgaatttgggaaggatattttttcttacgcagatggtatcatgatagtcatc

SEQ ID NO: 1710 - DNA, 1748 bp, Trigonella foenum-graecum
ggttaatttatcatgactgaaccttccaaggtcattcacgttcgaaacgtagggcacgaaatatctgaaaatgatttacttcagctatttcaaccttttggagtcgtaacaaagctcgtgatgttgcgtgccaaaaatcaggcacttatccaaatgcaagatgttccttctgcaattagtgctttacaattttatggaaattctcagccaagcataagggggaggaatgtttatgtccagttttcctctcatcaagagctaacgacaatggatcaaagtcaaggacgaggagatgagccaaaccgaattctcttagttacaattcatcaagtgctctatcccataacagtggatgtactgtatcaagttttttctcctcatggatctgtggaaaagattgtgacatttcagaagtcagctggctttcaggctctcatccagtatcaatcacaacagagttctattactgcaagaactgcacttcagggtcgcaatatttatgatggttgctgtcagctggacattcaattctcaaaccttgatgaattacaagtgaactacaataatgaccgttcaagagacttcactaactcaaatctccctacagaacagaaaggcaggcctccacagcttggatacggtgatgcaggaaacatgtatggtgttcagggttctggacccagggcagttggatatccgcagatgcctaatgctgcagcagccattgcagctgcctttgggggaggtttgcctcctggaataactgggacaaatgataggtgtacacttcttgtatcaaatcttaatcctgacagaattgatgaggacaaactgttcaacttgttctccctttacgggaacattgtaagaattaaacttttacgcaataaaccagatcatgcacttatccagatgggagatggtttccaagctgaactggcggtgcactttctgaagggagccatgttgtttgataagcgactggaggtcaacttctcgaagcatccaaacataacccaaggtgctgatacacacgattacagcaactcaaatctcaaccgttttaatcgtaacgctgctaaaaactaccgttattgctgctccccaacaaagatgatccatttgtccacgctcccacaagacatcactgaggaggagattgtgacccttctagaggagcatggaaccattgtcaatagcaaagtatttgagatgaatgggaagaaacaaggtctggttcagtttgagactgaggatcaggctactgaagcccttgtgtgcaagcatgccacctcactttccggctcgataattcggatctcctattctcaattgcagaatatatgagccttaacaatgttaaggatccgtggacaaccgaagaaacggttgctaagctcagtagagacaaggattctgaatttggaaggattttttatatgcagatagatgatgatgatcttcattatcttgtaatggtagctttgcttgctaatttactgtttgattatcttacactctttgagttttcccctttaatcatttcttttctcatctccattgctctattatttctttagattgctaacataatgtagagtatgggtgtagattttgtgactggtgaaagttgagtcttaggaatagaaaggaggggaaatcactgccttcttttccccaccttcatttcttttaaatcattgttgtattttggcaaaaggcaccattatgttgtattttcaatccat

SEQ ID NO: 1711 - DNA, 2049 bp, Eucalyptus grandis
ggggaagaaggaccgttaaaaatggcgaatttagggcttttctctcactccgatgtcatcatcttctccttccgcaagagccctccctccccaccagccaagccgtacgtgaccagagcttaacttcgatccactccctccctctccctctccctctccctccctccctctctcgctcgccttcgcatttccaccgagcaccctcaaggaatcgccggtgggtgaaacgatggccgaggcttccaaggtgattcacattcgcaacgtgggtcatgagatttccgagaacgatttgcttcagctctttcagccgtttggagtcattactaagcttgtaatgctccgcgcaaagaatcaggctctcctccaaatgcaggatgtaccatctgctatcaatgctatgcaggtttacagcaatgtccagccaacaatcaggggtaggaatgtgtatgtccaattttcatcccatcaagaattgactactgtggatcagaacactcagggtcgaggagatgagccaaatcgaattgtcttagtaactatacatcacatgctataccctataacggtggaagtgctgcatcaagtgttttctccttatggatttgtagagaagattgtcacctttcagaagtcagctggttttcaagcccttatccagtatcaatcacgacagagtgctgtctcagctataacggctcttcagggacgtaatatttatgatggttgttgtcagctggatatccagtactctaaccttgatgagctgcaagtgaacttcaacaatgaacggtcaagggattttacaaatccaaatctgcctgcagaacagagaggcagatcatcacaacaagctggatatggggatgctggaggtatgtatccttttccagcttctggagccagtacagtcgcatttccacaggtgcccaatgctgcagcaattgcagctgcctttgcaggaggcttaccccccggagttagtgggacaaatgataggtgtactgtcctcgtctccaatcttaatcctgatggaatagacgaggacaagcttttcaaccttttttctctttatggaaatattgtcaggattaaacttcttcgaaataagccagatcatgcgcttgttcagatgggtgatggcttccaggctgaattagcagtacactttctaaagggggccatgctttttgggaagcgattggaggttaatttctcaaagcatccgaacattactcctggtgctgaaacacacgagtatagcaattcgaatcttaaccgcttcaaccgtaatgcggcaaagaactaccggtattgttgctctcctacgaagatgatccacctctccactcttccccaggagattacagaagaggagattgtgacactcctggaggagcacggtgccattgttagtaccaaggtttttgagatgaacgggaagaagcaagccctagttatgtttgaaactgaggagcaagccaccgaagctcttgtgtgcaagcatgccagctctgtggcggggtccataatccgaatttccttctctcagttgcaagctatatgagggaagacagcagttcaaggtgatgatcacgatgtcacgatgcctgcatcgggcttagttttcttaggaccctttatttagaggatctgttaaggttactagctgcgtggactcaatcacgagatgagattttaatggcttcttgcatggaaggttgctccgtccgacgatggctcgggcgaattcttgtcttctctcgtacttgtaccagcatttccattcctgtatttgtgccaatctccatccttttgttgaactgttaaccgtacttttttcgattttggggattttccattgagctcttttgctcttgccttatgatatggaagcaacttgcgtacataatccttgctttggcgagctaaaaattccatgaggctataactagcttttggagacggccagaatggctctttgtatttctggcaacctttgcatttggagattattgaacttgggaaatcggtgattcataaggttta

SEQ ID NO: 1712 - DNA, 1783 bp, Glycine max
gttaatttgcaatgaccgaaccttccaaggtcattcacgttcgaaatgtgggccacgaaatatctgaaaatgacttacttcagctgtttcagccttttggagtcataacaaagcttgtcatgctgcgtgcaaaaaatcaggctcttatccaaatgcaagatgttccttctgcagttaatgctttacaattttatgcaaatgttcagccaagcataagggggaggaatgtttatgttcaattttcctcacatcaggaattaacaacaatggatcaaagtcaaggacgaggagatgagccaaaccgaattctcttagtcacagttcatcacatgttgtatcctatgactgtggatgtgctgtatcaagtattttctccccatggatctgtggaaaagattgtaacatttcagaagtcagctggctttcaggctctcatccagtatcaatcacgtcagagtgctgttgcagcaagaagtacacttcagggacgcaatatttatgatggttgctgtcagctggacattcagttctcaaaccttgatgaattacaagtgaactacaataatgaccgttcaagggacttcacaaacccaaatctccccacagagcagaaaggcagaccttcacaacctggatatggtgatgcaggaaacatgtatgctgcccagggttcaggagccagggcagttggatttccacagatggcaaatgctgcagccattgcagctgcctttgggggaggtctgcctcctggaataactgggacaaatgacaggtgtacagttcttgtatcaaatcttaatcctgatagaattgatgaggataaactattcaacttgttctctatttatgggaacattatgagaattaaacttctccgaaataagccagatcatgcacttatccagatgggagatggttttcaagcaaaactggctgtacactttctgaggggagccatgttgtttgagaaacgattagaggtcaacttctccaagcatccaaaaataaccccaggtgctgacacacatgaatacatcagttcaaatctcaatcgtttcaaccgtaatgcagccaaaaactatcggtattgctgccccccaacaaagatgattcatttgtccacacttccactagacatcactgaagaggagattgtgagccttgtagaggaacatggaatcattgtcaacagcaaagtcttcgagatgaacgggaaaaagcaggctctggttcagtttgaaaatgaggagcaggctactgaagcccttgtgtgcaagcatgcaagtacactttctggctcagtaatccgtatctccttttcgcagttacagaatatatgagtctttgttaaggagttgtggacaaccagagcaacagttgttgtggacaaggattctgaatttgggaaggatatttcttatgctgatgatgatcatcttccttatcttgtatttggttgctttgttttctaacttatttactcttaatatctactctttcatttttcatctttaatcatttatcttctcatctgcattgctctgctagttatgtaggatgctaacataatgtagtggggaggtgtacatttttgtgattgaggataggttcttggggaatagaaaggagggggattcactaccttcttatagtcgtttttataaatcattgttgtatatgttttgtaattcaggctagagtagtaagtaggcctttctgttgtattctcaatccatgtcaaaaatattctattccaattgattaagaagctactttttgt

SEQ ID NO: 1713 - DNA, 1380 bp, Cannabis sativa
ctcagcttgcttaacaatggcagaacctcccaaagtcatccacgtcaggaatgttgggcatgaaatatcagaaaatgatttgcttcagttatttcagccatttggggttataactaagcttgtgatgcttcgggcgaaaaatcaggctcttatccaaatgcaagatgttgcttctgcggttaatgcgctccaatactatgcaaatgttcaaccagccataagggggagaaatgtttatgtccaattctcatcccatccagaattgacaacaatggatcaaaacgctcaaggacgaggagatgagccaaaccgaatcctcttagttacaattcatcacatgctatatcctataacggtggaagtgctgcatcaagtgtttttcccccacggatttgtggagaagattgtcacatttcagaagtcagctggttttcaggccctcattcagtatcaatcacgccaaagtgctgtagcagctaggaccacgctgcagggacgcaatatttatgatggttgttgccaactcgatattcagttctccaaccttgacgagttacaagtgaattacaataatgagcgttcaagggattttacgaaccctaatcttccttcagaacagaaaggaagaccctcacaacctgggtatggtgatgcaggaggcatgtatggcatgcaaccttctggaacaaggggagttccatttccgcagatggcaaacgcggctgcaattgctgccgcttttggtggaggtttgcctccaggtataagcgggacaaatgacaggtgtacagttcttgtctccaacctaaatcccgatagaatagacgaggataagctttttaacctgttctccatctacggaaacattgtaaggatcaaacttctccgcaacaaaccagatcatgccctcgttcagatgggtgatggcttccaggcagaactggcagtgcatttcttgaagggtgcaatgctgttcggaaagcgtttggaagtcaacttctcaaagcatccaaacataacacagggtgccgacacccacgagtacatgaactctaatctcaaccgctttaaccgcaacgcagccaagaactaccgctactgctgctccccaacaaagattatccatctatcctctctcccccaggatgtcaccgaggaagagattgtgaaccacctagaggaacacagtcccatcgtcaacacaaagctctttgagatgaacggtaagaaacaggctctggtaatgttcgaaagtgaggagctggcaactgaggctctcgtcaccaagcatgctagctcgcttggcgggtcaattatccgcatctccttttcccaactacagacatataagagaaagcttgtagctttggaaaaataaca

SEQ ID NO: 1714 - DNA, 1654 bp, Lotus japonicus
gtgtatatatgtaacaacaacatagggtaaagtaaattcatgtgtgccgcggccactctgcgataaagctctctctctctctctctggtttctcactttctctgtctctgtcactctcttccaggtcaatttgccatgactgaaccctccaaggtcattcacgttcgaaacgtggggcacgaaatatctgaaaatgatttacttcagctatttcaaccttttggagtaataacaaagcttgtgatgctgcgtgctaaaaatcaggctcttctacaaatggacgatgtatcttctgcagttactgctatacagttttatgcaaatatgcagccaagcataagggggaggaatgtttatgttcagttctcctcacatcaagaactaacaacagtagatcaaagtcaaggacgaggagatgagccaaaccgaattctcttagttacaattcatcacatgctctatcctatgactgtggatgtgctctatcaagtattttctccccatggatctgtggagaagattgtaacatttcagaagtcagctggctttcaggctctgatccagtatcaatcacgtcagagtgctgttactgctagaagtgcacttcagggtcgcaatatttatgacggttgctgtcagctggacattcaattctcaaaccttgatgaattacaagtgaactacaataatgaccgttcaagggacttcactaacccaaatctccctacagagcagaaaggcaggccttcccaacctggatatggtgatggaggaaacatgtatcctgctcaaggttcaggagctaggggaggaggtattaaatatttaaactgctttaccattgcagctgcctttgggggaggtttgcctcctgggataactgggacaaatgacaggtgtacaattctcgtatcaaatcttaatcctgatagagtagatgaggataaactgttcaacttgttctccatttacgggaacattgtgagaattaaacttctccgaaacaaaccagatcatgcacttatccagatgggagatggtttccaagctgaacttgcagtgcactttctgaagggggccatattgtttgggaagccactagaggtaaacttctccaagcatgctaccataacccaaggtgctgatacgcacgagtactcaaattcaaatctcaatcgtttcaatcgcaatgctgctaaaaactaccgctactgttgctccccaacgagaatgatccatttatccacactccctcaagacgtcactgaggaggagattgcgagccttgttgaggagcacggaaccattgtcaactgcaaagtgtttgagatgaatcagaagaaacaggctctggttcagtttgagactgaggagcaggctactgaagccctcgtgtgcaagcatgccacctcgctttctggctcagtgatccggatctccttttcccagttacagaacatttgagactttgtttaaaggaccagtggattgttaagcttattagagacaaggattttgaatttgggaagaattttcttttatgcagatgatggtcttcttcattatcttgtaatagtttctttactttctgatttgctgatattaagacatgctatttgacttatctcccttgatctatttgttttctcatctc

SEQ ID NO: 1715 - DNA, 1926 bp, Solanum lycopersicum
tcggataaaactaaaaaggaaaaatccccatcatcgtacaccaaaccctagtccccctcaccctttcctccatttctgaaggtataaatgtctgatccttcaaaggtcgttcatgttcgcaatgtggggcatgagatctcggagaatgacttgcttcaactattccaaccatttggcgtcattacaaaacttgtaatgctcagggcgaaaaatcaggccctcttgcaaatgcaagatgtcccttcagctgtaaaggcattgcagttctacttgaatgttcaacccagcataagggggaggaatgtttacgttcaattctcatctcaccaagaattgacaactatggatcaaaatgtacaaggccgtggagatgagcctaatcgaattctcttagtcacaatacatcacatgctataccctataaccgtggatgtgctgcatcaagtgttttctccacatggatttgtagagaagattgtcacatttcagaagtcggctggttttcaagctttgatccagtatcaagtacaacagagttctgtttctgcaaggaactcacttcaggggcgtaatatatatgatggctgctgtcagcttgacatacagttctctaatctagatgaattgcaagtgaactacaataatgaacgttcaagggacttcactaacccaaatctaccatcagaacagaagggcaaatcctctcaacaaggatatggagacatgtattccttccaaggttctggagttcatccaggtggatttcctcagatgggaaatgcagaagcaattgcagctgcgtttgctggtggtctgccacctggaattagcgggacaaatgacagatgcactattcttgtttcaaatttaaattcagatagaataaatgaggacaaactttttaatctgtgctctctttatggaaatattgtcagcattaagattctgcgcaataaaccagatcatgccttagttcagctgggtgatgggttccaggcggagctggctgttcactttttgaagggtgccgtgttatttgaaaagcgtctggaagtcaacttctcaaagtatcccaatattactacaggacctgacacacatgactactcaaattcaaatctaaaccgctttaaccgtaatgctgctaaaaactatcggtactgctgctcccctaccaagatgatccacctatcctccttaccccaggatgtaacggaggcagagattatcgcacatttggaggagcatggtcccatagtcaatagtaagctttttgagatgaacggcaaacagcaggctcttgttctttttgaaaaggaggagcaggcaactgaggcactcgtatgcaaaaatgctacatctcttggtagctcaaccatccggatttcgttttctcagttacagagcatctgagaagtcttctgtgattggattggtaacaagtcaatgccattgtataacacaataattacagctatgtaatgtgctttctctgatttgtggttttagtttctgctttccttatgtacccttttttctctactagtgattgtacttgtttttttctttttgcattgagcgtgtcggtagagagcatattactcttcctctatctctgattattgtaattcaaccttactatgttctgctctgaagatgaaagtatcagaaatgagaatgtgaatgtatgggaggtgaggataagatgattcggaaatgggaagagatgaacaaacctcctagtttgagatatgaggtttgatgtggtgtcataggtgtggcaagttgattcgaccagacctgtaacttattaacggcttgattaaggtagcagtttggtgggtagttgaaagttcccgagtttttccttatcagtattattaatagtgctactattttattctatgtggttttctctacttcatt

SEQ ID NO: 1716 - DNA, 1784 bp, Solanum phureja
atcatatctgtcggttttttatctcgggggcatcgtcgaataaaaataaaaaggaaaaatcctcattgtcgtacaccaaaccctagtccccctctccctttcctccatttctgaaggtataaatgtctgatccttcaaaggttgttcatgttcgcaatgtggggcatgagatctcggagaatgacttgcttcaactattccaaccatttggcgtaattaccaaacttgtaatgcttagggcaaaaaatcaggccctcttgcaaatgcaagatgtcccttcagctgtaaaggcattgcaattctactcaaatgttcaacccagcataagggggaggaatgtttacgttcaattctcatctcaccaagaattgacaactatggatcagaatgcacaaggccgtggagatgagcctaatcgaattctcttagtcacaatacatcacatgctataccctataaccgtggatgtgctgcatcaagtgttttctccacatggatttgtagagaagattgtcacatttcagaagtcggctggttttcaagctttgatccagtatcaagtacaacagagttctgtttctgcaaggaactcacttcaggggcgtaacatatatgatggctgctgtcagcttgacatacagttctctaacctagatgaattgcaagtgaactacaataatgaacgttcaagggactacactaacccaaatctaccatcagaacagaagggcaaatcctctcaacaaggatatggagacatgtactccttccaaggttctggagctcatccaggtggatttcctcagatgggaaatgcagaagcaattgcagctgcgtttgctggtggtttgccacctggaattagcgggataaatgacagatgtactattcttgtttctaatttaaattcagatagaataaatgaggacaaactttttaacctgtgctctctttatggaaatattgtcagcattaagattctgcgcaataaaccagatcatgctttggttcagctgggtgatgggttccaggcagagctggctgttcactttttgaagggtgccatgttatttgaaaagcgtctggaagtcaacttctcaaagtaccccaatattactacagggccggacacacatgactactcaaattcaaatctcaaccgctttaaccgtaatgctgctaaaaactataggtactgctgctcccctaccaagatgatccacctatcctccttaccccaggatgtaacggaggcagagattattgcacatttggaggagcatggtcccatcatcaatagtaagctttttgagatgaatggcaaacagcaagctcttgttctttttgacaaggaggagcaggcaactgaggcactcgtatgcaaaaatgctacatctcttggtagctcaaccatccggatttcattttctcagttacagagcatctgagaagtcttctgtgataggattggtaagaagtcaatgccattgtataacacaataatgacaactatgtaatgtgctttcactgatttgtggttttagtttctgctttccttatgtacctttttttctctactagtgattgtacttatttttttgtttctgcattgagcatgtcggtagagcttgagcatattacttttcctccatctctgattattgtaattcaaccttactatgttgtgctcagaagatgaaagtagcagaaatgaggatgtggagatgaatgtatgggaggttaagatgattcggacatgtgaagagatgtacagatgtcctagt

SEQ ID NO: 1717 - DNA, 562 bp, Brassica oleracea
ggttcgctcagcgccgcgtgctctcgtcttcgatctatcctcaggaaacaatggaagcgattaggaatctgaagataaaaacatcaacttgcaaaaggatcgtcaaagagcttcactcctatgagaaagaggttgagagggaagctgccaagaccgctgacatgaaggacaaaggtgctgacccttacgacctcaaacagcaggagaatgtgttgggggagtcaaggatgatgattcctgattgccacaaacgtctcgagtctgctttagctgacctcaagtccactttggcgggattggaagagacaacaggtccagaagttgaagatgcaaagaagactgtcgcggatgtggagaagcagtttcccactgaagatgcctgatttttatccatcctgtgagtcttgtttggtgtgtgttctaagaatggttaaatgctgagtttgacgattattaattgtaagactctcggttttctttcaatgctacaaatgttttcgtttgctctttgatacattctggtgacttttctttatatatttgtctaattaataagctagat

SEQ ID NO: 1718 - DNA, 626 bp, Brassica rapa
  misc_feature (19)..(19): n is a, c, g, or t
ggaaagctaaagaaagaanaaaaaaaaaggaaaggggaaaggggtctattagtttgtttctggattcttcgatcagcgccgcgtgctctctcgtcttcgatctccctccaggaaacaatggaagcgattaggaatctgaagataaagacatcaacttgcaaaaggatcgtgaaggagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgacctcaagtccactttggcgggattggaagagacgacaggtccagaagttgaagatgcaaagaagactgtcgccgatgtggagaagcagtttcccactgaagatgcctgatttttatccatcctgtgagtcttgtttggtgtgtgtattctgagaatggttaattgctgagtttgacgattattaattgtaagactctcggttttctttcagtgctacaagtgttttcgtttgctcttgatacattctggtgacttttctttatacatttgtctaattaataagct

SEQ ID NO: 1719 - DNA, 600 bp, Brassica napus
gaaaggggaaaggggtgtatttgtttgtttctggattattcgctcagcgccgcgtgctctcgtcttcgatctccctccaggaaacaatggaagcgattaggaatctgaagataaagacatcaacttgcaaaaggatcgtgaaggagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgacctcaagtccactttggcgggattggaagagacgacaggtccagaagttgaagatgcaaagaagactgtcgccgatgtggagaagcagtttcccactgaagatgcctgatttttatccatcctgtgagtcttgtttggtgtgtgtattctgagaatggttaaatgctgagtttgacgattattaattgtaagactctcggttttctttcagtgctacaagtgttttcgtttgctcttgatacattctggtgacttttctttatatatttgtctaattaataagctagata

SEQ ID NO: 1720 - DNA, 581 bp, Brassica napus
ggggaaaggggtgtatttgtttgtttctggattattcgctcagcgccgcgtgctctcgtcttcgatctccctccaggaaacaatggaagcgattaggaatctgaagataaagacatcaacttgcaaaaggatcgtgaaggagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgacctcaagtccactttggcgggattggaagagacgacaggtccagaagttgaagatgcaaagaagactgtcgccgatgtggagaagcagtttcccactgaagatgcctgatttttatccatcctgtgagtcttgtttggtgtgtgtattctgagaatggttaaatgctgagtttgacgattattaattgtaagactctcggttttctttcagtgctacaagtgttttcgtttgctcttgatacattctggtgacttttctttatatatttgtctaa

SEQ ID NO: 1721 - DNA, 572 bp, Brassica napus
ggattgttcgctcagcgccgcgtgctctcgtcttcgatctatcctcaggaaacaatggaagcgattaggaatctgaagataaaaacatcaacttgcaaaaggatcgtgaaagagcttcactcctatgagaaagaagtcgagagggaagctgccaagactgctgacatgaaggacaaaggtgctgacccttacgacctcaaacagcaggagaatgtgttgggggagtcaaggatgatgattcctgattgccacaaacgtctcgattctgctttagctgacctcaagtccactttggcgggattggaagagacgacaggtccagaagttgaagatgcaaagaagactgtcgcggatgtggagaagcagtttcccactgaagatgcctgatttttatccatcctgtgagtcttgtttggtgtgtgttctaagaatggttaaatgctgagtttgacgattattaattgtaagactctcggttttctttcaatgctacaagtgttttcgtttgctctttgatacattctggtgacttttctttatatatttgtctaattattaagctagataaaata

SEQ ID NO: 1722 - DNA, 583 bp, Brassica napus
gcacttaaaatatgcagtccattagtttgtttctgggattgttcgctcagcgccgcgtgctctcgtcttcgatctatcctcaggaaacaatggaagcgattaggaatctgaagataaaaacatcaacttgcaaaaggatcgtgaaagagcttcactcctatgagaaagaagtcgagagggaagctgccaagactgctgacatgaaggacaaaggtgctgacccttacgacctcaaacagcaggagaatgtgttgggggagtcaaggatgatgattcctgattgccacaaacgtctcgagtctgctttagctgacctcaagtccactttggcgggattggaagagacaacaggtccagaagttgaagatgcaaagaagactgtcgcggatgtggagatgcagtttcccactgaagatgcctgatttttatccatcctgtgagtcttgtttggtgtgtgttctaagaatggttaaatgctgagtttgacgattattaattgtaagactctcggttttctttcaatgctacaagtgttttcgtttgctctttgatacattctggtgacttttctttatatatttgt

SEQ ID NO: 1723 - DNA, 599 bp, Brassica juncea
tcttcgattttgtcgctctgcgccgcgtcctcgcaagcttcgtcgtcctcgtcgatctttcctctgtgaaaacaatggaagcgattaggaatctgaagataaaaacatcaacttgcaaaaggattgtgaaagagcttcactcctatgagaaagaggtcgagagagaagctgccaaaactgctgcgatgaaggacaatggtgctgacccttacgacctcaaacagcaggagaatgtgttgggtgagtcaaggatgatgatccctgattgccacaaacgtctcgaggctgccttagctgacctcaagtccactttggcggaattggaagagacgacaggtccagaagttgaagatgcaaagaagacagttgcagatgtggagaagcagtttcccactgaagatgcctgatttctagtatccatatctagtgagtgtcgttgtttgctgtgtatcctgagaattggttaaatgctgagtttgacgataatcaattgtgagaatctccttttttcgttcagtgctacatttgttttcgtttgctcttgatgcattttggtgacttttgtgtcttttatttgtctaattaatatactagataaa

SEQ ID NO: 1724 - DNA, 625 bp, Raphanus sativus
ggaaaggggtggtgtattttggttttggattttgtcgctctgcgccgcgtcctctctcgtaaagcttcgtctctcttcgatcccattcctctgtgaaaccaaaacaatggaagcgataaggaatctgaagataaaaacatcaacttgcaaaaggattgtgaaagagcttcgttcctacgagaaagaggtcgagagagaagctgccaagactgctgctatgaaggacaatggtgctgacccttacgacctcaaacagcaggagaatgtgttgggtgagtcaaggatgatggttcctgattgccacaaacgtctcgaggctgccttagctgacctcaagtccactttggcggaattggaagagacaacaggtccagaagttgaagatgcaaagaagacagttgcagatgtggagaagcagtttcccactgaagatgcctgattttactatccgtgttgtttggtgtgtattattctgagaattggttcgactcttgagtctattaacgatcatcaattgtgagaatctgcgggttttctttctatgctacaactattttcgttttgctcttgataccttctggtgacttttttcttttatttgtctaattaataaaactagatagac

SEQ ID NO: 1725 - DNA, 640 bp, Raphanus sativus
  misc_feature (30)..(30): n is a, c, g, or t
tttttcttttcaaaagggaaagggaaaggnaaagggaaaggggtggtgtattttggttttggattttgtcgctctgcgccgcgtcctctctcgtaaagcttcgtcttccttcgatcccattcctctgtgaaaccaaaacaatggaagcgaaaaggaatctgaagataaaaacatcaacttgcaaaaggattgtgaaagagcttcactcctacgagaaagaggtcgagagggaagctgccaagactgctgctatgaaagacagtggtgctgacccttacgacctcaaacagcaggagaatgtgttgggtgagtcaaggatgatggttcctgactgccacaaacgtctcgaggctgctttagctgacctcaagtccactttggcggaattggaagagacgacaggtccagaagttgaagatgcaaagaagacagttgcagatgtggagaagcagtttcccactgaagatgcctgatttttactatccatcccgtgagctgttgtttggtgtgtgtattattctgagaattggttcaactcttgagtctattaacgattatcaattgtgagaatctccgcttttctttcaatgctacaactgttttcgttttgctctttataccattctggtgacttttctct

SEQ ID NO: 1726 - DNA, 585 bp, Raphanus sativus
attttggttttggattttgtcgctctgcgccgcgtcctctctcgtaaagcttcgtcttccttcgaccccattcctctgtgaaagaaagaaacaatggaagcgaaaaggaatctgaagataaaaacatcaacttgcaaaaggattgtgaaagagcttcactcctacgagaaagaggtcgagagggaagctgccaagactgctgctatgaaggacaatggtgctgacccttacgacctcaaacagcaggagaatgtgttgggtgagtcaaggatgatggttcctgattgccacaaacgtctcgaggctgccttagctgacctcaagtccactttggcggaattggaagaggcgacaggtccagaagttgaagatgcaaagaagacagtggcagatgtggagaagcagtttcccactgaagatgcctgattttactatcccatccagtgactgttgtttggtgtgtattattctgagatttggttcaactcttgactttattaacaattatcagttgtgagaatctccgggtttctttcaatgctacaactattttcgttttgctcttgataccttctggtgactttt

SEQ ID NO: 1727 - DNA, 650 bp, Arabidopsis thaliana
cgagcacacaagtgagtgcatatccagtattaagttttttttttaataattcagaattgaaagcaaaggaaaaagaagaaatcgaaatcggaaactgtatattgttgttcttcgattcctcctcgctctacgccgcgtcctctctctcaaattcatcggaagcaaccttcttctcccatcatcgcctgaatccaatggcaacgataaggaacttgaagataaaaacatcaacatgtaaaaggattgtgaaagagcttcactcttatgagaaagaagttgagagagaagcggctaagactgctgatatgaaggacaaaggtgctgatccctacgaccttaaacaacaggaaaatgtgttgggtgagtctaggatgatgattccggattgccacaaacgtctcgagtctgcattggctgacctcaagtccactttggcggaattggaagagacggatgagaaggaaggtccagagatcgaagatgcaaagaagacagtcgcggatgtggagaagcagtttcccactgaagatgcctgatttagccagcgatgagtgttaaatctgtattctgagaatggttaatcatctgtaagaatctttatatctaaggttgcttgtcgactgtatacactaaaaatatctttctttaac

SEQ ID NO: 1728 - DNA, 653 bp, Raphanus sativus
  misc_feature (427)..(427): n is a, c, g, or t
  misc_feature (582)..(582): n is a, c, g, or t
ggaaaggggtggtgtattttggttttggattttgtcgctctgcgccgcgtcctctctcgtaaagcttcgtctctcttcgatcccattcctctgtgaaagaaagaaacaatggaagcgaaaaggaatctgaagataaaaacatcaacttgcaaaaggattgtgaaagagcttcgttcttatgagaaagaggtcgagagggaagctgccaagactgctgctatgaaggacaatggtgctgacccttacgacctcaaacagcaggagaatgtgttgggtgagtcaaggatgatggttcctgattgccacaaacgtctcgaggctgccttagctgacctcaagtccactttggcggaattggaagagacgacaggtccagaagttgaagatgcaaagaaaacagttgcagatgtggagaagcagtttcccnctgaagatgcgtgatgctaatatccatccagtgactgttgtttggtgtgtgtattattctgagatttggttcaactctcttgactttattaacgattatcaattgtgagaatctccgggttttctttcaatgctgctacaactgttttcgttttnctcttgataccattctggtgacttttctgtcttttatttgtctaattaataaaactagatagacataaata

SEQ ID NO: 1729 - DNA, 681 bp, Eutrema halophilum
agggaaagttgtttttttctcgaaattgtttgtttctcttcgatcgcgttctataaaaaactcaatctcaagactaattcatccgaagcaagcttcttcttcgatcttcgtctggaaccaatggcaacgattaggaacttgaagataaaaacatcaacttgtaaaaggattgtgaaagagcttcaatcttatgagaaagaagttgagagagaagctgctaagactgctgatatgaaggaaaaaggagctgatccctatgaccttaaacagcaggaaaatgtattgggtgaatcaagaatgatgattccagattgccacaaacgtcttgagtctgctttagctgagctcaaatccactttggcggaattggaagagacagatgagaaagaaggtccagaagttgaagatgcaaagaagacaatcgcggacatggagaaacagtttcccacagaagatgcctgatttagccatcgatgaagtgtttggtctgtattttgagactagtgaatgcagataatcaattgttagaatcttcttctctcaatcgctatctaccttgtacactgaaattgtttccagtttgatcattttggtgattgttctttctttcaatatttttgaaacgagttacatttcgcattgctggaactaatagattggaatcatttgacaaactagttt

SEQ ID NO: 1730 - DNA, 664 bp, Thellungiella halophila
  misc_feature (16)..(16): n is a, c, g, or t
  misc_feature (18)..(18): n is a, c, g, or t
  misc_feature (130)..(133): n is a, c, g, or t
ggcacgagggaaagtngnttttttctcgaaattgtttgtttctcttcgatcgcgttctataaaaaactcaatctcaagactaattcatccgaagcaagcttcttcttcgatcttcgtctggaaccaatgnnnncgattaggaacttgaagataaaaacatcaacttgtaaaaggattgtgaaagagcttcaatcttatgagaaagaagttgagagagaagctgctaagactgctgatatgaaggaaaaaggagctgatccctatgaccttaaacagcaggaaaatgtattgggtgaatcaagaatgatgattccagattgccacaaacgtcttgagtctgctttagctgagctcaaatccactttggcggaattggaagagacagatgagaaagaaggtccagaagttgaagatgcaaagaagacaatcgcggacatggagaaacagtttcccacagaagatgcctgatttagccatcgatgaagtgtttggtctgtattttgagactagtgaatgcagataatcaattgttagaatcttcttctctcaatcgctatctaccttgtacactgaaattgtttccagtttgatcattttggtgattgttctttctttcaatatttttgaaacgagttacatttcgcattgctggaactaatagatt

SEQ ID NO: 1731 - DNA, 678 bp, Arabidopsis lyrata
aattcaaaattgaaagcaaaggaagaaaagaaatcgaaatcggaaagtgtatattgttgttcttcgattcctcgctctgcgccgcgtcctctctctcaaattcaacggaagcaaccttcttctccgatcttcgtctgaatcaatggcaacgattaggaacttgaagataaaaacatcgacatgtaaaaggattgagaaagagcttcactcttatgagaaagaagttgagagagaagctgctaagactgctgctatgaaggacaaaggtgctgatccctacgaccttaaacagcaggaaaatgtgttgggtgagtctaggatgatgattccggattgccacaaacgactcgaggctgcattagctgaactcaagtccactttggcggaattggaagagacggatgagaaggaaggtccagagattgaagatgcaaagaagacagttgcgggcttggagaagcagtttcacactgaagatgcctgatttatctgtattctggaaatggtctagttaatcaattgtaagaatcttcgtctactaaaagttgccttctttgaactcttaatacattttggtgatcgttcttgcattcaatatctttcaaatgtaccacaccagctataatgtgttatagctgcaactaaacgattgaaaattgatataacttggacaaccat

SEQ ID NO: 1732 - DNA, 744 bp, Arabidopsis lyrata
cgagcacacgagtgagtgcatatccaataaaataagatttttttttttaaattcaaaattgaaagcaaaggaaaaaaaagaaatcgaaatcggaaagtgtatattgttgttcctcgattcctcgctctgcgccgcgtcctctctcccaaattcatcggaagcaaagcaaccttcttctccgatcttcgtctgaatcaatggcaacgattaggaacttgaagataaaaacatcgacatgtaaaaggattgagaaagagcttcactcttatgagaaagaagttgagagagaagctgctaagactgctgctatgaaggacaaaggtgctgatccctacgaccttaaacaacaggaaaatgtgttgggtgagtctaggatgatgattccggattgccacaaacgactcgaggctgcattagctgaactcaagtccactttggcggaattggaagagacggatgagaaggaaggtccagagattgaagatgcaaagaagacagttgcgggcttggagaagcagtttcacactgaagatgcctgatttatctgtattctggaaatggtctagttaatcaattgtaagaatcttcgtctactaaaagttgccttctttgaactcttaatacattttggtgatcgttcttgcattcaatatctttcaaatgtaccacaccagctataatgtgttatagctgcaactaaacgattgaaaattgatataacttggacaaccattatacgttttg

SEQ ID NO: 1733 - DNA, 653 bp, Cleome spinosa
ccttctgattttggtaatcatggcaacgatcaggaatctaaagatcaagacatctacatgtaagaggattgtcaaagagctacactcctacgagaaggaggtcgagagagaagctgctaagacagctgatatgaaggagaaaggagccgacccttacgatctaaaacaacaggaaaatgtattggctgagtcgaggatgatgattccggattgccacagacgcttggaggcagctttagctgacttgaaggcaactttggcggaactggaagaggcaaacgagaaggaatgcccggaaatcgaagatgcaaagaacactgtcgcggatgtggagaagctcttccacacagaagacgcctgatttatctgttgtcaagcggcgcaattgcaaacgctttttgttgatggatcggttggttttctgttgtaaagacctgatgagttcagtcattgtagctagtggaagtcaagaagaggttctctattacctctgtttctcgattcaatctcatctgttatcgacgctatcaatgaaccgtccggtcctttctcgatggccgttgtccagattgtcgagtccctgttcattctcggagagcaaccttatcttaccatttcagctggttctttaatgttatcccagaagaaacagc

SEQ ID NO: 1734 - DNA, 462 bp, Brassica juncea
gagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgacctcaagtccactttggcgggattggaagagacgacaggtccagaagttgaagatgcaaagaagactgtcgccgatgtggagaagcagtttcccactgaagatgcctgatttttatccatcctgtgagtcttgtttggtgtgtgtattctgagaatggttaaatgctgagtttgacgattattaattgtaagactctcggttttctttcagtgctacaagtgttttcgtttgctcttgatacattctggtgacttttctttatacatttgtctaattaataagctaaaaaaaaaa

SEQ ID NO: 1735 - DNA, 818 bp, Cleome spinosa
acatttcactctccgatctgagtttcgaaggcactccactctctctctagactccatcccttctcaaccctatccgcggagttctcgtccccacccacttatccttccgcctgaaatccaaagggcaaaagctttgcttgttggtaggtaatcatggcaacgattaggagcttgaagatcaagtcatcaacctgtaagaggattgtcaaagagctacactcctacgagaaggaggccgagagagaagctgcaaagacggctgatatgaaggagagaggagctgacccgtacgacctgaaacaacaggaaaacgtgttggctgagtcaaggatgatgattccggattgccacaaacgtttggaggctgcattagctgatctgaaggcaactttggcggaactggaagaggcaaacgagaaggaaggcccggaaatcgtcgatgccaagaacactgtggcagacgttgagaagctcttccacactgaagatgcctgattttgtctgccccttttctggtcgtaaagggatgcaaatgccgaggattcaatctttgcagatgtgtggactgtttttcgggaaagaccgatctttttttgtgtgtgtgtaaaagacctgatgagttcagtcattctagcaagtagcaactaaagtagtgagaagcttttacatgaaccggccatcagactcggtttgtccgtatggatgatccttccagcttaaattgtgacagattgtcttctgcttttcgcatgttcactcttttcggtttctgcatctcatcgagtttcacctttttgtattggattggaccggacgga

SEQ ID NO: 1736 - DNA, 1334 bp, Brassica napus
ctgtcgcgccgccgcccaatatctcaccgagtgatggttaggccagatggagaagaagggatattgctgctcgagtttcacggcaacggtgaccgctcgtggcagctaaacttcgatgattttcaggtttcaccggagcacaaggagaagaaatcgccgagcaagctccataactgtcttggttgcttgggtccggaagacaatgtggcagattactaccagcaacaggtagagatgcttgaaggctttactgaaatggacgaactcgcagaacgtggctttgtccctggaatgtcaaaggaagagcaagacaatctggctaaaagcgagacattagccatcagaatatcgaacattgccaacatggttctctttgctgctaaagtctatgcctccgtcacaagcggctctttagcaatcgttgcttccacgttggactctcttcttgatcttctctctggcttcatcctctggttcaccgccttctcgatgcagacaccgaacccgtatcagtatcccattggcaagaaaaggatgcaaccactgggaatcttagtatttgcatcagtgatggccacacttggattgcaaatcatcttggagtctcttcggacaatgttatccagtcacaaggagttcagcttaacaaaagagcaagagagttgggtggttgggatcatgctctccgttacactggtcaaactgcttcttgtcctttactgcagatccttcagtaacgagattgttaaagcgtatgctcaagaccatttcttcgacgtcatcacaaacatcattggactcattgcagtgatcctcgccaattacttcgataactggatggatccagtcggagctatcattcttgcattgtacacaatacggacgtggtcaatgacggttttggagaacgtgaactcactagttgggaaaacagcaacgccagagtatctgcagaaactgacttacttgtgttggaaccaccataaagccataaggcatattgacacagtgagggcttacacgtttgggtctcattactttgtggaggttgatatcgttctccctgctgatatgcctctgcaagtggctcacgacattggggaatcgctgcaagagaagctggagctgttgcaggagatagaaagggcttttgtgcatcttgattatgagtacactcacaagcctgagcatgctagatcccactgttagctgtttgtttgcttcttgtgtcgtttaaagcagtgaagagatctctctctacgtctaaattcttaagagcatcaaatcgtttagtagacaagcacctttgtaagttgtaactatatttacttttt

SEQ ID NO: 1737 - DNA, 1418 bp, Arabidopsis thaliana
aaatttcccatttccttaccactctctctctctctcaaaaaaaaaaaaaaaaaaatacaaagtctctctccgccgccggaaaaatggttgagccagctagtccagattccgacgaagggatctcgctgctcgagtttcacggtaacggtgaccgttcctggcagttaaatttcgatgatttccaggtttcaccggaacacaaggagaagaaatctccgagtaaactacacaactgtcttggttgtttgggtccggaagacaatgtggcagattattaccagcagcaagtagagatgcttgagggctttactgaaatggatgaacttgcagaacgtggctttgttcctggaatgtcaaaggaagagcaggataatttggctaaaagcgagacattggcgattagaatatcaaacattgcaaacatgcttctttttgctgctaaagtctatgcttctgtcactagtggctctttagctatcattgcctctacattggactctcttcttgatcttctttctggcttcatcctctggtttaccgccttctccatgcagacacccaacccgtatcagtatcccattggcaagaaacgcatgcaaccactgggaatcctagtctttgcatcagtgatggcaacacttggattgcagattatcttggaatctcttcgcacaatgttatccagccacaaggagttcaacctaacaaaagagcaagagagttgggtagttgggatcatgctttctgttacattggtcaaactgcttctggttctttactgcagatccttcactaacgagatcgttaaagcttatgctcaagatcatttcttcgacgtcatcacaaacatcattggactcattgcagtaatcctggccaattacattgattattggattgatccagttggagctatcattcttgcattatacacaatacggacatggtcaatgacggtcttggagaacgttaactctcttgttgggaaatcagctagaccagagtatctgcagaaactaacttacctgtgttggaaccaccataaagccattaggcacattgacacagtgagggcatacacatttggctctcattattttgtggaggttgatattgttctcccagctgacatgcctctgcaagtggctcacgacattggagaatcgctgcaagagaagctcgagctactagaggagatcgaacgggcttttgtgcatcttgattatgagtacactcacaaacctgagcacgctagatcccactgttagctgtttatcctttttaaagatctctacgtttctatatctttacaaattaatcttcactgtattgttgtttagtagacaattgtgagataaaggaatacctttgtaactatttacttttgttttgcgtgtttcatttagcaacaagattat

SEQ ID NO: 1738 - DNA, 1304 bp, Arabidopsis lyrata
cgccggaaaaatggttgagccagctagtcaagattccgacgaagggatctcgctgctcgagtttcacggtaacggtgaccgttcctggcagttaaatttcgacgatttccaggtttcaccggagcacaaggagaagaagactccgagtaaactacacaactgtcttggttgtttgggtccggaagacaatgtagcagattattaccagcagcaagtagagatgcttgagggcttcactgaaatggatgaacttgcagaacgcggctttgttcctggaatgtcaaaggaagagcaggataatttggctaaaagtgagacattggcgattagaatatcaaacattgcaaacatggttctttttgctgctaaagtctacgcttctgtcacaagtggctctttagcaatcattgcctctacattggactctcttcttgatcttctttctggcttcattctgtggtttaccgccttctccatgcagacacccaacccgtatcagtatcccattggcaagaaacgcatgcaaccactgggaattctagtctttgcatcagtgatggcaacacttggattgcagattatcttggaatctcttcgcacgatgttatccagccacaaggagttcagcctaacaaaagagcaagagagttgggtagttgggatcatgctttctgttacattggtcaaactgcttctggttctttactgcagatccttcactaacgagattgttaaagcttatgctcaagatcacttcttcgacgtcatcacaaacatcatcggactcattgcagtaatcctcgccaattacatcgacgattggattgatccagttggagctatcattcttgcattatacacgatacggacatggtcaatgacggtattggagaacgtgaactctcttgttgggaaatcagctagaccagagtatctgcagaaactaacttacctgtgttggaaccaccataaagcaattaggcacattgatacagtgagggcttacacatttggctctcattattttgtggaggttgacattgttctcccagctgacatgcctctgcaagcggctcacgacattggagaatcgctgcaagagaagctcgagctgctagaggagatcgaacgggcttttgtgcatcttgattatgagtacactcacaaacccgagcacgctagatcccaccgttagctgtttctccttttcaagttctctacgtttctaaatctttacaaattaatcttcactgtattgttgtttagtagacaattgtgagataaaggagtacctttgtaactat

SEQ ID NO: 1739 - DNA, 1345 bp, Arabidopsis lyrata
cttaccactctctctctctctccaaaaacaaaaaccggaaaaatggttgagccagctagtcaagattccgacgaagggatctcgctgctcgagtttcacggtaacggtgaccgttcctggcagttaaatttcgatgatttccaggtttcacaggagcacaaggagaagaagactccgagtaaactacacaactgtcttggttgtttgggtccggaagacaatgtggcagattattaccagcagcaagtagagatgcttgagggatttactgaaatggatgaacttgcagaacgtggctttgttcctggaatgtcaaaggaagagcaggataatttggctaaaagcgagacattggcgattagaatatcaaacattgcaaacatgcttctttttgctgctaaagtctatgcttctgtcacaagtggctctttagcaatcattgcctctacattggactctcttcttgatcttctttctggcttcatcctctggtttaccgccttctccatgcagacacccaacccgtatcagtatcccattggcaagaaacgcatgcaaccactgggaatcctagtctttgcatcagtgatggcaacacttggattgcagattatcttggaatctcttcgcaccatgttatccagccacaaggagttcaacctaacaaaagagcaagagagttgggtagttgggatcatgctttctgttacattggtcaaactgcttctggttctttactgcagatccttcactaacgagatcgttaaagcttatgctcaagatcacttcttcgacgtcatcacaaacatcattggactcattgcagtaatccttgccaattacatcgacgattggattgatcccgttggagctatcattcttgcattatacacgatacggacatggtcaatgacggtattggagaacgtgaactctcttgttgggaaatcagctagaccagagtatctgcagaaactaacttacctgtgttggaaccaccataaagcaattaggcacattgatacagtcagggcttacacgtttggctctcattattttgtggaggttgacattgttctcccagctgacatgcctctgcaagcggctcacgacattggagaatcgctgcaagagaagctcgagctgctagaggagatcgaacgggcttttgtgcatcttgattatgagtacactcacaaacccgagcacgctagatcccaccgttagctgtttctccttttcaagttctctacgtttctaaatctttacaaattaatcttcactgtattgttgtttagtagacaattgtgagataaaggagtacctttgtaactatctacttttg

SEQ ID NO: 1740 - DNA, 1380 bp, Ricinus communis
actttctcaaaaaatcaccttagcctccatgttttgacattccccaaatgcccttcacatgccatcaaatttccatacttttaccctttgcttgtaacattaaaagaacacacttttctgtatacacaaaaacttcaactccttctagttcctcaaatcttgggggtagtaaacgaaagtgaacccgtaatggtgcatcccgtggctttccagaacgatgaagagctttcattgttgtctattaacaacaatggtgaccagtcatggaggttaaactttgatgggtatcagttatcgacagagcataaagagaaaaagcagcctagtagcctccatgactgtcttggggttttacgtccggaagatgatgtagctgaatactatcagcagcaggtggagatgcttgaagggtttaatgaaatggatgcattagcagaacgaggctttattcctggaatgtcaaaggaagagcaggaaaatttggccagaagcgagacttttgctattcgaatatcgaatattgccaatatggttctctttgctgctaaggtgtatgcgtctgttagaagtggttcattggccattatagcatccacattagactctttgcttgatcttttatctggctttatcctttggtttactgcattcactatgcaaacacccaatccttatcagtatcctattggaaagaagcgcatgcagccattgggaattcttgtttttgcctcagttatggccactctgggactgcagataatcctggaatcattacgtgcattattatctgatgagagtgaatttgagttgaccaaagagcaagagcgttgggttgtgggcattatgctttcggtgactttggttaaacttcttttaatggtttactgccgctcttttactaatgagattgttaaagcttatgcccaggatcatttcttcgatgttattacgaatataattgggcttattgccgcacttcttgctaactatatggaggattggatggatccagttggggcaataattctggccttgtacaccattcgcacctggtcaatgacggtattggaaaatgtgaactcccttgttgggaaatcagctactccagattatttgaagaaactcacatacctttgctggaaccatcacaaggctgttagacacattgatacagtccgtgcttacacctttgggtctcactactttgttgaagtggacattgtcctgcctgctagcatgcccttgcaagaggctcatgatattggcgaatccttacaggagaagctagagctgctgccagagattgagcgcgcctttgttcatcttgattacgagtacacgcacaagcctgagcatgcacagtcacacccatagcaagga

SEQ ID NO: 1741 - DNA, 1791 bp, Ricinus communis
aataacttcctctattttatgtccctgaacaatttccttcccccactcactttctcaaaaaatcaccttagcctccatgttttgacattccccaaatgcccttcacatgccatcaaatttccatacttttaccctttgcttgtaacattaaaagaacacacttttctgtatacacaaaaacttcaactccttctagttcctcaaatcttgggggtagtaaacgaaagtgaacccgtaatggtgcatcccgtggctttccagaacgatgaagagctttcattgttgtctattaacaacaatggtgaccagtcatggaggttaaactttgatgggtatcagttatcgacagagcataaagagaaaaagcagcctagtagcctccatgactgtcttggggttttacgtccggaagatgatgtagctgaatactatcagcagcaggtggagatgcttgaagggtttaatgaaatggatgcattagcagaacgaggctttattcctggaatgtcaaaggaagagcaggaaaatttggccagaagcgagacttttgctattcgaatatcgaatattgccaatatggttctctttgctgctaaggtgtatgcgtctgttagaagtggttcattggccattatagcatccacattagactctttgcttgatcttttatctggctttatcctttggtttactgcattcactatgcaaacacccaatccttatcagtatcctattggaaagaagcgcatgcagccattgggaattcttgtttttgcctcagttatggccactctgggactgcagataatcctggaatcattacgtgcattattatctgatgagagtgaatttgagttgaccaaagagcaagagcgttgggttgtgggcattatgctttcggtgactttggttaaacttcttttaatggtttactgccgctcttttactaatgagattgttaaagcttatgcccaggatcatttcttcgatgttattacgaatataattgggcttattgccgcacttcttgctaactatatggaggattggatggatccagttggggcaataattctggccttgtacaccattcgcacctggtcaatgacggtattggaaaatgtgaactcccttgttgggaaatcagctactccagattatttgaagaaactcacatacctttgctggaaccatcacaaggctgttagacacattgatacagtccgtgcttacacctttgggtctcactactttgttgaagtggacattgtcctgcctgctagcatgcccttgcaagaggctcatgatattggcgaatccttacaggagaagctagagctgctgccagagattgagcgcgcctttgttcatcttgattacgagtacacgcacaagcctgagcatgcacagtcacacccatagcaaggagcagttctctactatgtccatttggttttcttccatcaaaatctgccttgtatcgcgtcggcaaagcttagggcggacagagggtaagtgcttgcttgcaaatatcatgtctagatgattatttattgtaaattctggtaatgggcaagtttcacatttggattggtggcatacttgtagtaggaaagatgatttaagaaaaaaacatagtagattaaatctgccactgtctcaaggagtccattagtaattagtacagcttcttgggtgtttttcttctgatgctgtgctgatctctaacagtatgtatgctttgttgtgaaagtattgataaaggaatacagattgatggctatctattta

SEQ ID NO: 1742 - DNA, 1517 bp, Carica papaya
gcccctgatttgcagctcggttctctcggcgaagggaaaatggtggagccggtgagaaatgagaaggatgaggaactctcgctacttggtgaacgctgcaatggcgaccggtcatggcggttgaacttcgatggttaccagttgtcgactgagcacaaggagaagccgcctcgagggctccatgactgcctcggagttctaggtccagaagataacgtggctgtatactaccagcagcaggtagaaatgcttgagggttttaatgaaatggatgcccttgcagaacgtggttttattcctggaatgtctaaggaagagagagaaaggttggctaagagtgagacattagccattagaatatcaaatgcagctaatatggttctttttgctgctaaagtttatgcatcagtcagaagtggctcattagcaatcattgcatccacgctggattctcttcttgatcttctatctggcttcatcctgtggtttactgcattttccatgaagacaccaaacccatatcaatatcctattggaaagaaacggatgcagcccttgggaatcctcgtttttgcctctgtcatggcaactctgggtctgcagattattttggaatccttccgcacgatgatatcagatgaagatgaatttgacctgacaaaagagcaagagacatgggttgtgggcattatgctgtcagtgaccctggtgaaattcattctggttatctattgccgctcattcactaacgagatcgtcaaagcctatgcccaggatcatttttttgatgttatcaccaacatcattggccttgtagctgtgcttcttgctaactatattgatgattggatggacccagttggagctatcattctggccttgtacacaatccgcacctggtcaatcacagtgttggaaaatgtaaactcccttgttggaaagtcagctgctccggactatctgcaaaaactaacctacctctgttggaaccaccacaaggccatcagacacattgacacagtccgggcttacacatttggctctcattactttgttgaagttgacattgtcttgccggcaaacatggccttgcaagatgctcatgatattggagaatcattgcaggagaagcttgagctgttgcccgagatcgaacgtgcctttgttcatctggattatgaatacactcacaaacccgagcacgggcgagcacactattagcaggagggaaatatggtcatattttttgtttggttgttcatctttactgcccattaatccatacaccacattaaagaatctaccgagccatgaagggttggggttgaaggcaaacaatctgtaagtgtgtgtgcagatgttcggtaggttcattgaatatggtacttaatagtatatagaaacttatttgttaatcaggatgtatttgtagtttaggtttcctaagcacctttgcttggcttgtaatatgtaaaagttaagagaattggttgggaatgcaaaaatggcttcctagt

SEQ ID NO: 1743 - DNA, 1880 bp, Prunus persica
ggaaatggtggagccggtgacgcccgactgcgacgaggagcgctcgctcctgcaagagtcgagcaatgttgaagggtcgtggcggttgaacttcgacggtttccaggtatcctctgagcacaaggagaaaaggcctccccgtggcctccatgactgccttggggttctaggcccggaagataatgtggcagagtactaccaacaacaggtagaaatgcttgagggctttaccgagatggatgccttagcggagcgtggttttattcctggaatgtcaaaggaagagcaggaaaagttggcaaacagtgagacatttgccatcagaatatcaaatgttgcaaacatggttctttttgcagctaaagtttatgcatctctcagaagtggttcattagccatcatcgcatccacgttagactcattgctcgatcttttgtctggcttcatcctgtggtttactgcattctccatgcaaacccctaacccatatcagtaccctatcgggaagaaacgcatgcagccattgggaatccttgtttttgcctctgtcatggcaaccctgggactgcagatcatcctagagtcaattcgcacactagcttctgatgaggatgggttcagcttgaccaaagatcaagagcgatgggtcgtgggcattatgctatcagtaactttggttaaattgcttctgatgctttattgccgcactttcaagaacgaaattgttaaagcctatgcccaggatcacttctttgatgttataactaacatcattggtctcgttgctgtgctccttgctaagtattttgatgattggatggaccctgttggagctgtcattctggccttgtacaccattcgcacctggtccttgacggttttggaaaatgtgaattccctagttggaaaatcagctgctccagaatatctacaaaaactaacatacctttgttggaaccatcacaaggcggtacggcatatagatactgtgcgggcttacacctttggctctcactactttgttgaggttgacattgtcctgccagcagacatgcccctgcaagtggcgcatgacataggagaaacgctgcaggagaagctcgagctcttgcccgaaattgagcgtgcctttgttcatctagattatgagttcagtcacaagcccgagcacgcacagtcacactcataaagtgaggatttttatttatatattactgttccacgtgaatgctagacattattcggaacgggaggcaaatgaaacgaaaaaatgtgtagatatttggttaggcgtcaagaacaagttggattcttctagtgacaatgggaaacaaacatatgtatggcttgttctcaatctcatgcatcctaaaaaatgagacgcagtaatttcaacttgataggtccagcctacgtgctaatttagactgcctgagcttaggtgggacttggatcttctcaatcaaaaaaaaaacaaagaaatatcatatttggaaactgttttccaattaaataacacggtaatttcaaaactttcactgtcgcattttctttccctctctccaatatgtatatatatatgttaactgctatgtttttatccacctgcaaaaaaatatcagcatttgtaagaattaaagggtgcaaaagacaacccacaagttgacgttactctctgcccttatgtggtggaccaaaatcctgtcagagtcctagtgctttgtgggttttgcccccaaattggtggagagtgcatggaaacataatgaactaggctccattgaaattctaagatttcaatttcttccttgaaattgggaaaattaggaatttgggaagagaagaatggatatggaacaacttcccgtaatcaatttaat

SEQ ID NO: 1744 - DNA, 1517 bp, Tropaeolum majus
cttctattctcttctactcctacccttctctaccactcgatgtactagtactagtgtaccgctataatagtcttcaactctcattgatccggccttttttatttttacacaaaaatggtggagccgattgggaaccgaaacgggagcgaggaggagctatcactgttgggggagcaagacattgttgatcggtcttggcggttaaacttcgatggctttcagttatcaacagagcgcaaggatagagagtctcgtagggatcaacatcatgattgccttggagttttagctccagaagataatgtagcggagtactaccaacagcaggtagaaatgctagagggattcactgaaatggatgctctagcagaacgtggttttgttcctggaatgtcaaaggaagaacgagaaaatttggctaaaagtgagacattggccattagaatatcaaatgtagcaaacatggttctttttgctgctaaagtttatgcatccattagaagtggctcgttggccatcattgcatccacactggactctcttcttgatcttctgtctggattcatcctgtggtttactgcattttctatgcagacaccaaacccttaccaataccctattggaaagaaaagaatgcagccacttggaattcttgttttcgcatctgtcatggctactcttgggctgcagattatcttggagtctgctcgcacaatgctatcggatgagactgaatttcaactgaccacagagcaagagtattgggttgtaggcattatgctttcagttaccctggtgaaactcttcttagttatttactgtcgttcgttcaccaacgagatagtcaaagcttatgcccaggatcacttttttgatgtcatcaccaacatcattggcctcattgctgtacttcttgctaattactttgatgactggatggaccctgttggagctattattctggccatctacacaattcgcacctggtcaatgacggtgttggaaaatgtaaattctcttgttggaaaagcagctgctccagagtttctacgaaaacttacatacctatgttggaaccaccacaaagccattagacacatagacacagtccgagcgtacacctttggttcccattactttgttgaagttgatattgtcttgcctgctgacatgcccttgcaagaagctcatgacattggagaatcattgcaagagaagctagagctgttgccggacattgaacgtgcctttgtacatcttgattatgagtacagtcacaaaccagagcatcaacaagcacatttgtagctcatgggaggtatttatttatatttcccggtaatacacaacttggtcagcaaatgattctataaaatacagattcaatttctgacaattgaatcttattttattgtaattcatactccatttagattttctgttttgggcattgaacattagttgattcaagtttaagaatgttaaaggagaagcttggattcggaagaatgaattga

SEQ ID NO: 1745 - DNA, 1640 bp, Humulus lupulus
agtggtatagtcctacttctctggtgtggtgtgtaaaaccccgactatgctcaccacaataggttctttcctactttcccaaaacgcccttaccctttctgaataatatttacgcttaacaacctctctctcgacggccacggaaaatggcggagctgctcaatcccaaccacgaagaggaactttacctcttgcgacagcccaccaatggcgacctctcttggcgtctaaacttcgaagcctttcagttatctagcgagcacaaagagaagaaacccccgcgtggcctccatgattgctatggagttttaagtccagaagataacgttgctgagtactatcagcagcaggtagaaatgctagaggggtttaatgagatggatgccttagcagagcgcggttttctacctggaatgtctaaggaagagcgagacaagttggcaaaaagcgagacatttgccatcagaatttcaaattttgcaaatatgattctttttgctgcaaaagtttatgcttcaattagaagtggttcattggccataattgcatcaactttggactcacttcttgatcttttgtctggcttcatcctttggtttactgctttctccatgcaaactcccaacccatatcaataccctattggaaagaggcgtatgcagccattgggcatccttgtgtttgcctctgtcatggcaacactaggactgcagatcatcttggagtcggttcgcaccctgtcatctgatgaagctgagttcagcttgactaaagatcaagagagatgggttgttggcattatgctcatggtgactctggtgaaatttgtgctgatgatttactgccgcagtttcactaatgaaattgtaaaagcatatgcccaggatcacttttttgatgtcatcaccaacatcattggcctctttgctgcactccttgctaattattttgatgattggatggatcctgttggagctattatcttggccttgtacaccatccgaacatggtcaatgacagtgcttgaaaatgtcaactcccttgttggaagatcagccgctccggaatatttacagaaactcacatacctctgttggaaccaccacaaggccatacggcacattgataccgttagggcttacacctttgggtctcactactttgttgaggttgacattgtcctaccggcagacatgcccttacaagaggctcatgacattggcgaatccttacaggagaagcttgagttacttcctgaaattgagcgtgcctttgtccatttagattacgagttctcacacaaaccagagcatgctcagtcccactcataaagttagtagtaaaaccaattgttatgtcttgttcttcatcttatctgatcaacaaattcttgcttcgttgtagtatggaatcggtgaatttggacacaactttggaatcaatcaaaaaattgagtccgtgtatataattgtttattatcatttttattttcggacaggactgtccttgctcatcatttcctccttgtaacttatcttgtctctagactccgtttgtaatttagtatttactcaaaattcaaaccgatcgtaactaacctattctaaaaaatgaatgtccaaaaactgattttaaattag

SEQ ID NO: 1746 - DNA, 1531 bp, Manihot esculenta
acagagcttcttgaatcttgtggcgtcctgtgagtgaaacgagaatggtggagccggggacacatgcgaacgaggaggagctttcactgttgtctctcaacaacaatggtgatggctcgtggaggctaaactttgatggatatcagttatctgcagggcataaagagaaaaagccgcctcgaggtctccacgattgccttggtgttttaggtccagaagatgatgtagccgagtactatcagcagcaggtggaaatgctcgagggttttaatgaaatggatgccttagcagagcgtggctttattcctggaatgtcaaaggaagagcaggagagtttggctagaagtgagacctttgctatcagaatatcaaatcttgctaatatggttctttttgctgctaaggtttatgcctctatcagaagtggttcattagccattattgcatccacattggactctctgcttgatcttctgtctggcttcatcctgtggtttactgcattcactatgcaaacaccaaatccatatcagtaccctattggaaagaagcgcatgcagccattggggattcttgtttttgcctctgtaatggcaactctgggactgcagataatcttggaatcagtacgcacattgttatctgatgagaatggatttgatttgaccaaagagcaagagcgttgggttgtggggattatgctttcagtgactttggtaaaacttttgctgatggtttattgccgctcttttactaatgagatcgttaaagcttatgcccaagaccacttttttgatgtcgttacaaatattattggccttattgctgcacttcttgctaattacatggaagaatggatggaccctgttggggcaataattctagccttgtacaccattcgaacatggtcaatgacagtgttagaaaatgtgaactccctcgttggaaaatcagctactccagattatctgaaaaagctcacatacctttgttggaaccatcacaaggccgttagacacatcgatacggtccgggcttacacctttgggtcccactattttgttgaggttgacattgtactgcctgctagcatgccgttgcaagaggctcacgacatcggggaatccctacaggaaaagcttgagctgctgccggagattgagcgcgcctttgttcatcttgattatgaattcacacacaagcccgagcatgcacaatcactcccatagtaagatggaaatctaatccctttgttctgttgttttggtttttcccaaacaaggtctaccacgtaccaagtccatgaagaatatgcaaatggatgatgagtaattgctggcaaagagcatatgcaaatggttgttaactgcagattcactaatttatcgatttgaaatcgcaaagtggtgatcctttccttcagacaaagggaagatggcttggagaaaaaattgtctatagattaagatttgcactatatttgagaagtaatgaattttatggtagaggttgattgctgttttcttctgat

SEQ ID NO: 1747 - DNA, 1747 bp, Glycine max
aaatctgctacggctgttgttataacaagcaccaaccacaacgacttttcttggtctctacttcgcatttccgttctttgcttttctcgggctacgaaaaacgacgtcgttttcccaattttccccggcgaccgggaaatggtggagccggtggagcttcgcggcgaggagcagctctcgttgctgtcagattccagcaatggtgaccggtcgtggcggttgaacttcgacgggtttcagctatcttcggagcacacggagaagcaagtgaaaccccctcgcggactccatgactgttatggggttcttggtcaagaagataatattgcggagtactatcagcagcaggtagaagtgcttgagggctttactgaaatggatgctttagcagagcgtggttttattcctggaatgtcaaaggaggagcaagacaagttagcaagaagtgagacttttgccattagagtgtcaaacgcagcaaacatggttctttttgttgccaaagtttatgcatcagtcagaagtggttccctagccatcattgcatccacgttagactcacttcttgacctcctttctggattcatcctctggttcactgcattttccatgcaaacaccaaacccatatcagtaccctataggaaagaaacggatgcaaccattgggaattcttgtttttgcctctgttatggcgacacttggactgcagataatcttggagtctacccgcacattaatatcttctgaaaatgcattcaacttgaccagggaacaagagcgctgggttgtgagcattatgctttcagtgactttggtgaaattcctgctgatgatttattgtcgttcttttaccaatgagattattaaagcctatgcccaggatcacttttttgatgtgatcactaatgtcattggccttattgctgcacttttggcaaattatgttgatgattggatggaccctgtcggtgctatcattctggctttgtacaccattcgcacatggtcaatgacagtgttggaaaatgttaattccctggttggaagatcagcagcaccagaatatcttcagaaacttacatacctatgctggaaccaccacaaggctgtgaggcacattgatacagttcgggcatacacatttggatctcactactttgttgaggttgatattgtcctgccatcggatatgcccttgcaagaggctcatgatattggggaatcgttgcaagaaaagcttgagcttttgcccgagattgagcgtgcttttgttcatcttgattatgagtacagtcacaaacctgagcatgctcaagcacactcttagcagcaatcaggaaagcactgccttcttgtttatttcagttgccctttcatctcccgtcagttgtaaatttgaaccatttctggttgttcagaatctgaacttaagtgcaagtcactgagaagttgctagctatcaatctcaactttctggcagccctgataatattccaaatgtatatcacgataggcttatcaggcaagaccctttcagattccatttaggggaaatagaatttgctaccttcttttccattcccccttttttgtacagtgcactctttttaccttaattcaggatttaaggtgtgtgtgtgctggtgtttgttaatttctaacatgtgcaagtatataatataatacaatggagtggatttcttattaaaatgtaaggattacataacatactttttacgggtgtc

SEQ ID NO: 1748 - DNA, 1685 bp, Glycine max
gttggtctctactttgccttctttgcttttctcgggctaacaaaagacgacgccgttttgacccggcgaccgggaaatggtggagccggtggagcttcgctgcgaggagcagctctcgcttctgtcagattcgagcaatggtgatcggtcgtggcggttgaacttcgacgggtttcagctatcttcggagcacgcggagaagcaagtgaaaccccctcgcggactccacgactgttacggggttctaggtcaagaagataatattgcagagtactatcagcagcaggttgaagtgcttgagggctttactgaaatggatgctttagcagagcgtggttttattcctggaatgtcaaaggaagagcgagacaagttagcaagaagtgagacatttgccatcagagtgtcaaatgcagcaaacatggttctttttgttgccaaagtttatgcatcaatcaggagtggttccctggccatcattgcatccacgttagactcacttcttgacctcctttctggattcatcctctggttcactgcattttccatgcaaacaccaaacccatatcagtaccctataggaaagaaacggatgcaaccattgggaattcttgtttttgcctctgttatggcgacacttggactgcagataatcttggagtctacccgcacattaatatcttctgaaaatgcattcaacttgaccaaggaacaagagcgctgggttgtgggcattatgctttcagtgactttggtgaaattcctgctgatgatttactgtcgttcttttaccaatgagataattaaagcctatgcccaggatcacttttttgatgtgatcactaatatcattggccttattgctgcacttttggcaaattatgttgatgattggatggaccctgttggtgctatcattctggctttgtacaccattcgcacatggtcaatgacagtgttggaaaatgttaactccctggttggaagatcagcagcaccagagtatcttcagaaacttacatacctatgctggaaccaccataaggctgtaaggcacattgatacggttcgggcatacacatttggatctcactactttgttgaggttgatattgtcctgccatcggatatgcccttgcaagaggctcatgatattggggaatcattgcaagagaagcttgagcttttgcctgagattgagcgtgcttttgttcatcttgattatgagtatagtcacaaacctgagcatgctcaagcacactcttagcagcaatcaggaaaagcaatgcctttgttgttcatttccttttccctttcatctcccgttagttgtatatgcgaaccatttctggttgttcggaatctgaacttaagggcaagtcactgagaagttggctatcaatcccaaatttctggcagccctgataatatcccaaatgtatatcacgataggtttatcaggcaagaccctttcaggttccatttagggtaaatagaatcttactactttcttttccattccccctttttgtacagtgcactctttcggccttaattcatgatgtaaggtgttgtgtgttggtgttggttaatttctaacatgtgcaagtatatataatataattatgtacaatggagtagatttcttattaaaatgtaaggattacataacagacattttcccg

SEQ ID NO: 1749 - DNA, 2382 bp, Cajanus cajan
ggggggggttcaaaaatcttctacggctgttgcttgctataactagcatcaaccacaactactttcttcgattcagcttccgttctttcgcttacgcaaaacggcgccgttttggccaagctctccagcgaccggaaaatggtggagccggtggagcttcgcggcgaggagcagctctcgctgctgtcggattcgagcaatggcgaccggtcgtggcggctgaacttcgacgggtttcagctttcttcgaagcacacggagaagcaagtgaaaccccctcgcggactccatgactgttatggcgttctaggtcaagaagataatattgcggagtactatcagcagcaggttgaagtgctcgagggctttactgaaatggatgccttagcagagcgtggttttattcctggaatgtcaaaggaggagcgagacaagttagcaaggagtgagacgtttgccatcagattgtcaaacttcgcaaacatggttctttttgttgccaaagtttatgcatcaatcaaaagtggttccctagccatcattgcatccactttagactcacttcttgacctcctttctggattcatcctatggttcactgcattttccatgcaaacaccaaacccatatcagtaccctatagggaagaaacgtatgcaaccattgggaattcttgtttttgcctctgttatggctacactgggactgcaaataatcttggaatctgtccgcacattaatatcatctgaaaatgcattcaacttgaccagggaacaagagcgttgggtcgtgggtattatgctttcagtgactttggtgaaattcctgctgatggtttattgccgctcttttactaatgagattatcaaagcctatgcccaggatcacttttttgatgtgatcactaatgtcatcggccttattgctgcacttttggcaaattatgttgatgattggatggatcctgttggtgctatcattctggctttgtataccattcgcacatggtcgatgacagtgttggaaaatgtgaattccctggttggaagatcggcagcaccagagtatcttcagaaacttacatacctatgctggaaccaccacaaggctgtgaggcacattgataccgttcgggcatacacatttgggtctcactactttgttgaggttgatattgtcctgccagcagatatgcccttacaagaggctcatgatattggggaatcattgcaagagaagcttgaacttttgccagagattgagcgtgcttttgttcatcttgattacgagtacagtcacaaacctgagcatgctcaagcacacacttagcagcagtaaggaaaaacaatgccttcttgctttcttcatttgcactttcataactcgtcagttgtaaatgtgaaccatttctgaatgttgagaatctgaacttagtgcaagtcactgagaagttgctagctatattcgtccgcccctagcttcaattccaactttctggcatcctacgaatattttaaatgtatatcactatcacaataggcttatcaggcaagaccctccaggctccatttgggagaagtagaatcttgttgttaccctttccagttgtattatttgtttttgtacagtgcactatttctaccttaattaaggatttaaggtgttgtgtgctggttttgttgtttctaacatgtgcaaatataatttctttttataagatccattacctaattcatcaagattgaggaagttggttaatttagttgataacatactagttagtattgcatgtattttgatatgattcataatatataaaacgatttagtgtaccaatgatgtgaggcacaaggtgaattgtttgtctggatattacatgacgatgaaatgaaagtgtgggccttattgaagaatgagtaaagcaaaaaaggggactgatattacaggacaatgctgtgacagtgttcccccaaataaacttaaagcgaaatgtaagttttgttcacaatctttttggggttgaattgcaaggatgaaacatcatcatgcttgaacaaagatgaacaaagataaatgtgagtacatgtgcaagagttctggatgttaagaacatttgtcaaattattggaaactaaagaaaagaagaaacaagaaaatagttgtgattgttgggaagtagcataggaaaggatgagaaatcaaaatttgtcatatgaaagacaatgagtgaggtgtgtagatatatgaagaactggcagatgtatttatggtaatgtagtatcttataattttgtaagtctaacaatcaagcaagttttgatttactataattcaatcttaatgtaacgagaaaaaaaaacatttaattatcttgatagaact

SEQ ID NO: 1750 - DNA, 1686 bp, Eucalyptus grandis
atggcggaggcggtggcggtggcgtcggagcacgacgaggagcggctgctgctgccggaggccgccagcggcggaggcggcggcgaccggtcgtggcggctgaacttcgaccggttcaagataacgccggagcgcgcgcagaagaagcagcccggcggactccacgactgctgcctgggccttctaggtcctgaggataatgtggctgagtactatcagcaacaagtggaaatgcttgagggcttcaatgaaatggatgctttaaccgaacgtggttttattcctggaatgtcaaaggaagaacaggagaatttggctagaaatgaaacatttgccataagaatatcaaatgttgcaaacatggttctttttgcagcgaaagtatatgcttccattagaagtggatcattggccatcatagcctccacattggactcccttctggatctgttgtccggcttcatcctgtggtttactgcattctctatgcaaacgccaaatccctatcagtatcctataggaaagaaacggatgcaaccattgggaatccttgtttttgcctctgtgatggctactcttggactgcagattatcttggagtcactgcagcaattgttatctgatgaggctgaatttagtctaacaaaagagcaagaacaatggcttgtgggtatcatgctctcagtgactctggtcaaattcctcctagtcctttattgccggacattcacaaatgagattgtcaaagcatttgcccaggatcacttttttgatgtcataaccaatgtcattggtctcattgctgcactcttggctaattatgtcgtcaattggatggatcctgtcggagctattatccttgcgctctataccatccgaacatggtcaatgacagtcttggaaaacgtaaactccctcgtggggaaatctgcagctccagaatacctgcagaaactcacgtatctctgttggaatcatcacaaggcgataagacacattgacactgtcagggcctacacctttggatcccactactttgtcgaggtggacatcgtcctgccggctgacatgcctctgcaactggctcacgacattggcgaatccttgcaggagaagctcgagctcctgccagaaatcgagcgcgcctttgttcatcttgactatgagtattctcacaagccagagcatgctcaagcgcatagttaatggtaatgcttctattatgtttccaagtccctcttctcaggcaaccgtgtattattcaattgttacggaaaatggaaagtgacatgtggctgcagcttttgtagcttttaaatgtaaaattgcttcacatcgagcctactactgcatttcccaaatgactgaatctgggttttaccttagaaggggcgatgtatacggggaaaggtatgaagctctttagatatatattgctacatattttggactcaaaactatttgaattaggcttggagaattctgtattatattatccgtataggggggggggtcttttgatggagactatccattgatgtgaaatgtctatcaaccttattttatccagatacttaaaaccagtgattcgttattagagcagataacgtcgtcgtaccagtggacatgcgtaggacgtgtgtagtaatattttcaatggaattacctttctttaattaaaggaaa

SEQ ID NO: 1751 - DNA, 1955 bp, Populus trichocarpa
gccgccatattttcacattcccaaaatgctctcaccacccgcactgttttttccaccacacaccactacttaagagatcgcacacgttactccaagttacatatcacctttgctagaaaatcaaccggaaaatgttggagccggtgaacaacgagaacgaggaggagctttcactgctgtctccgaacagaaatggtgacgggtcatggcggttaaacttcaactgttatcagttatcaccagaacacaaagagaaaaaaccgcctcgtggaatccatgattgctacggagttttaggtcctgaagatgatgtagctgagttctatcagcagcaggtggagatgctcaagggctttaatgaaatggatgctttggcagagcgtggatttattcctggaatgtcagaggaagagaaggaaattttggctagaagtgagacctttgcgattagaatatcaaattttgcaaacatggttctttttgctgccaaggtttatgcatctgttagaagtggttcattagccatcattgcatccacgttggactctcttcttgatcttctgtctggctttatcctgtggtttactgcattctctatgcaaacaccaaacccttatcagtaccccattggaaagaaacgcatgcagccattgggaattcttgttttcgcctctgtcatggcaactttaggattgcagattatattggaatcagtacgcgcattgcactcagatgagaatgactttaatctgagcaaggagcaagagcgctgggttgtgggtattatgctatcagtgaccttggttaaacttgtgctgatggtttactgtcgctcctttactaatgagatcgtcaaagcttatgcccaggatcacttttttgatgttattactaatatcataggcctaattgctgcacttatggctaattatatggaagaatggatggatcctgttggtgcaataattctggccttgtacaccattcgcacatggtcaatgactgtgttggagaacgtgaattctctagttgggaaatccgctacaccagattatctacaaaaactcacatacctttgctggaaccatcacagggccattagacacattgacacggttcgggcttacacctttgggtctcactactttgtcgaggttgacatagtcctgccttcgagcatgcccttgcaggaggctcatgacattggagaatctttgcaagagaagctcgaattactcccagagattgagcgtgcctttgtccaccttgattatgaatacacccacaagcctgagcacgcacagtcacactcatagtggcaagtgaatatggtctcttcattaccacgttgtggtctgtattttgcgtcaccttctaacacgatccaccgtgtgtatccacgcaagctaatccatttggaggaaagtgattgctgacagggttgcatgcaggatgattggtaaattagtagtatattccactggcccatgggttttcaaatcgggaaacttggaagctcttaaatttgggagaatatagacaaatctagcactgctgtttagtgccagattctctatttgagaatcaaggatttgtatgatatatccagtcggcctactatatccatgtgctgatctttgtatggacgagttaacctgattctaaaactacgaaaaatgaggttctcctattagccaagtgtggagctttgaaatttctatttttttattctgtcaccagttgtggttctcttggacaaaatatttccgtgaatgcttctttagtcttgtcagcccaaattggcaaaacggattccttacaaaagatggtggctcccgtcttgtcgattctgaattcctttcttaatctaaaactggtccaataaatattctttgttgctgtataaattatgattcatccatctcattatatcatgggctacttgcagatttgat

SEQ ID NO: 1752 - DNA, 1638 bp, Vigna unguiculata
  misc_feature (229)..(229): n is a, c, g, or t
gggcttccattctttgctccttcggggctgtccaaaacgacgacgtttagaccagattctcaggcgaccgggaaatggtggagacggtggagcttcaaggcgaggagcagcgttcgctgctctcagattcgagcaatggtgaccggtcctggcggttgaacttcgaggggtttcagatatcttcagagcacacggagaagcaagtgaaaccctctcgcggactctatgnctgttatggcgttctaggtcaagaggataatattgcggagtactaccagcagcaagttgaagtgcttgagggatttactgaaatggatgctctagcagagcgtggttttattcctggaatgtcgaaggaggagcgagacaagttagcaagaagtgagacgtttgccatcagattgtcaaatgtagcaaacatggttctttttatcgccaaagtttatgcatcaatacgaagtggttccctagccatcattgcatcgactttagactcgcttcttgatctcctttctggatttatcctctggttcactgcattttccatgcagacaccaaacccgtatcagtaccctattggaaagaaacggatgcaaccattgggaattcttgtttttgcctctgtcatggctacactgggactgcaaattatcttggagtctatccgcacattaatatattctgacaatgcattcaacttgaccaatgaacaagagcgatgggttgtgggaattatgctttcagtgactttggtgaaattcttactgatgatttattgccgcacttttactaatgagatcattaaagcctatgcccaggatcattttttcgatgtgatcaccaatgtcattggtcttattgctgcacttttggcaaactatgttgatgattggatggatcctgttggtgctatcattctggcgttgtacaccattcgcacatggtcaatgacagtgttggaaaacgtgaattccctggttggaaaatcagctgcacctgagtatcttcagaaactcacatacctatgctggaaccaccacaaggctgtgaggcacattgatacagttcgggcatacacattcgggtctcactactttgttgaagttgatattgtcctgccagcagatatgcagctgcaagaggcccatgatattggagaatcattgcaagagaagcttgagcttttacccgagatcgagcgtgcttttgttcatcttgattatgaatacagtcacaaacctgagcatgcacaatctcactcttagcagcagtaaggaaaacctatgtccttgtttatttcatttgctctttcatctccttaagttgtaaaatgtgaatcgtatatgtagttcagaatctgaacttctgagcaagtcactaagaagttgttagctataccagcagctatcactctactttctggcagacctgataatgttcccaaatgtatatcaagatacccttatcaggtaaagaccttccttccaggttccatttaggggaaacagaatcgttatgttctcatagagtgcactctttctaccttaattaagctttaaggtgttgtgtgctggtcttggttatttctaacttcaccaaatatcataatatatacataacacgcaaagtttttctttt

SEQ ID NO: 1753 - DNA, 1578 bp, Medicago truncatula
cttaccttatacattattcactcacacacatttcccacttttccggttcaaaaaaaaaaccgaaaaaaatcttctacggaacctcggtactataacaaagaacaaacctacctgcattttctcttcttcttcttcttctttgtttagtcaactaaaaacgacgacgtttttagaatgaccgggaaaatggtggagacggtggagcaatctaacgaagaagagctttctcttctttcagtttcagataatggtgaccggtcatggcggttgaacttcgactcttttcagttgaattctcagcatactgaaaagacacctaaaccctcttctggtattcatgactgctatggtgttcttggtcaagaagataatattgctgagtactatcagcagcaggttgaagtgcttgagggctttactgaaatggatgccttagctgaacgtggtttcattcccggaatgtcaaaggaggagcgagacaaattagccaggagcgagacgtttgccatcagaatatcgaacatagcaaacatggttctttttactgccaaagtttatgcatcagtcagaagtggctccctagccatcattgcatctactttagactctcttctggacctcctttctggatttatcttatggttcactgcattttccatgcaaacaccaaacccatatcagtaccctattggaaagaagcggatgcaaccattgggaattctggtttttgcctctgtcatggcaacactagggctgcaaataattttggagtctgcccgcacactaatatacaccgataataccttcagcttgactagggaacaggagcgctgggttgtgggtattatgctttcagtgactttggtgaaattcatgctaatgatttattgccgctcttttactaatgagattgtaaaggcctatgctcaggatcacttttttgatgtgatcactaatgtgattggtctaattgctgcacttttggccaattattttgatgattggatggatcctgttggtgctatcattctggctttgtacacaattcgcacatggtcaatgacagtgttggaaaatgtgaattcacttgttggaagatcagctgcacctgagtatcttcagaaacttacatacctctgctggaaccaccacaaggctgtgaggcacattgacacagttcgagcttacacatttgggtcacactactttgttgaggttgatatcgtccttccagcagacatgcctttacaagaggctcatgatatcggggaatcattgcaagagaagctcgaacttttgcctgagattgagcgtgcttttgttcatctcgattatgaattcagtcacaaacctgagcatgcacaagcacattcttagcagcaatgtgaaaagcaatgctgacttgcgattttcagatgtaaatgtgaaatattttagttagatctgaatctgtactaagtactgcgaaattgttgagagctgtagaatatgctgtgcagcctatcatgtaaggaaaattattctctcctctttcactctattttcgtatttattatgtgtagaagatatttgtaccct

SEQ ID NO: 1754 - DNA, 1611 bp, Populus trichocarpa
caacctacttgtaaagagcacacagacaccacccaggctacaaatcaccttcaccagaaaatcaacccgaaaatggtggaaccggtgaacaacgagaacgaggaggagctttcactgctgtctccaaacaacaaaggtgacgggtcgtggcagttaaacttcgacgggtatcagttatcacccgaacgcaaagagaaaaagcctcctcgcggaattcatgattgttatggagttttaggtcccgaagatgacatagctgagtactatcagcagcaggtggaaatgctcgagggctttaatgaaatggatgctttggcagagcgtggatttattcctggaatgtcaaaggaagagaaggaaattttggctagaagtgagacctttgcaattagaatatcaaattttgcaaatatggttctttttgtagctaagacttatgcatccatcaaaagtggttcattagccatcattgcgtccactttggactctcttcttgatcttttgtctggctttatcctatggtttactgcattctctatgcaaacaccaaacccttatcagtatcccattggaaagaaacgcatgcagcctttggggattcttgtttttgcctctgtcatggcaactttaggattgcagattatattggaatcagtgcgcgcattgctgtctgatgagagtgactttgatctgaccaaggagcaagagcgctggattgtgggcattatgctatcagtgaccttggtgaaacttgtgctgatgatttattgtcgctcctttactgatgagattgtcaaagcttatgcccaggatcatttttttgatgttattacaaataccattggccttgttgcggcacttcttgctaattacttggaggactggatggatcctgttggtgctatagttctggccttgtacaccattcgcacatggtcaatgaccgtgttggagaatgtgaattctcttgttggaaaatcagctacaccagattatctacaaaaactaacatacctttgctggaaccatcacaaggccattagacacattgatacagttagggcttacacctttgggtctcactattttgtcgaggttgacattgtcctgccttcgagcatgcccttgcaggaggctcacgacattggggaatctttgcaagagaagctcgagctactgccagagattgagcgtgcctttgttcatcttgattatgaatacacccacaaacctgagcatgcacggtcgcgctcgtagccatatatggttgtaggtgaatatgatctcttcattgccatgctttggtctgtattttgtttcatcttccaacatgatccaccgtgcatgtatccatgcaagctaagcctaatggagaaagtaattgctgacagagttgtgtgcaagatgtttagtaaattagtatatcccatcagttggcacaaatgtttttcaaattgggaaactttgaagagcttaaacgggagacaatagataagtctagtactgcagtttactgccggattccctgtttgagaatgaaagatttgtaatgatatagccagtcggcctactgtattcttggactggtcattatgtgaacgaacgacctgt

SEQ ID NO: 1755 - DNA, 2160 bp, Cannabis sativa
gcaaatatatatatttattgaaacttgtagttattaaggagagagatatgatgtgattgagaatggtacactatagtatacactcactccggctgtgctccattcattgctcaccacaatattaatagcttctttcacactttcccaaaatacccctaccctttctaaacaattacacttaacaacccctctctttctctctcgaccacggcgacggaaaatggctatggagctactgaatctcaaccacgaagaggaagaactttccctcttgagacaacccaccaccaatggcgacctctcttggcgtttaaacttcgaaagctttaaactttccaacacccacaaagagaagaaaccctcaccccctggcctccatgattgctatggagttttaagtccggaggataacgtggctgagtactatcagcaacaggtagaaatgctcgaggggtttaacgagatggatgcgttagcagagcgcggttttctacctggaatgtcaaaggaagagcaagataagttggcgaaaagcgagacatttgccatcagaatatcgaattttgcaaacatgattctttttgctgcaaaagtttatgcttcgattaggagtggttcattggcaattattgcatcgactttggactcacttcttgatcttttgtctggctttattctttggtttactgctttctcaatgcaaactccaaatccgtatcaataccctattggaaaaaggcgtatgcagccgttgggtatccttgtgtttgcgtctgtcatggcaacactcggtctgcagatcatattggagtcggttcgaaccctgttatctgatgaggttgagttcagcttgaccaaagatcaagaaagatgggttgttggcattatgctcatggtgactctggtgaaattcgtgctgatgatttactgtcgcggttttagtaacgaaattgttaaagcttatgcacaagatcacttttttgatgtcatcaccaacatcattggcctctttgctgcactccttgctaattatttttacgattggatggatcccgtcggagctattattttggcgttgtacaccattcgaacatggtcaatgacggttcttgaaaatgtcaactctctggttggaagatcagctgctcctgaatatttacagaaactcacatacctctgttggaaccaccacaaggccataagacacattgataccgttagggcctacactttcgggtctcactactttgttgaggttgacattgtcttaccggcagacatgcccttacaagaggctcatgacatcggcgaatccttgcaggagaagcttgaacaacttcctgaaattgagcgtgcctttgtccatttagattacgagttctcacacaaacccgagcatgcgcagtctcagtcttagtgttaagctgtaaaaccagttgttattatcttgttcttcatcttatctgagcaacaaattcttgctccattgtagtaactagtatgtaatcgttgacttcggacacaactttggaatcattcagaaagttgagtctgtgtatataattgttcattttaaattctctgacaggactcttcttactcatcattgacacagaaacaaagtactgaactttatataaaatatatgtttatatagttgtattcatccaccttcactgtcacagccatgtgagttcaaaccattaccaacgaaaaaaaaggtgttttgaataaagggggttcgaaagaactcttcaagacgaaggatgcagtgagcgagcctgctaagcttcgatagcagctgcgattgagcttaagtctttccaaaaagaaaagggtaactttagtctatttctttttttacttttctcatcgaaaatttacaattgaaacttcaactgatgccaatgccaaacgagataacttagttggtttagtatttgcaatgatctggaacatcggttcgagtatgatcagtcttcaaaattttggtcagtccaaaatcaaaaatttttgttgtgtatgagtcatctaagaggatgtaccaacaagaggaactaattagattctatgtattcataacattatttattggaaaaagattaaaagatttatttgcatatttgaaagatagtcaaaaaaagtcaaggcatgcttgga

SEQ ID NO: 1756 - DNA, 1654 bp, Phaseolus coccineus
  misc_feature (47)..(47): n is a, c, g, or t
  misc_feature (739)..(739): n is a, c, g, or t
  misc_feature (755)..(755): n is a, c, g, or t
  misc_feature (802)..(802): n is a, c, g, or t
  misc_feature (1123)..(1123): n is a, c, g, or t
  misc_feature (1580)..(1580): n is a, c, g, or t
gatgctttgcccctacgtggctgccccaaacgacgacgtttagaccntattctcagacgaccggcaaatggtggagacggtggagcttcacggcgaggagcagcgctcgctgctctcagattcgaataatggcgaccgctcctggcggttgaacttcgaggggtttcagatatcttcggagcacacggagaagcaagtgaaaccctcgcgcggactccatgactgttatggggttctaggtcaaggggataatattgcggagtactaccagcagcaggttgaagtgcttgagggctttactgaaatggatgcccttgccgagcgtggttttattcctggaatgtcgaaggaggagcgagacaagttagcaagaagtgagacgtttgccatcagattgtcaaatgtagcaaacatggttctttttgtcgccaaagtttatgcatcaatacgaagtggttccctagccatcattgcatcgactttagactcacttcttgatctcctttctgggtttatcctctggttcactgcattttccatgcagacaccaaacccgtatcagtacccgattggaaagaaacggatgcaaccattgggaattcttgtttttgcctctgtcatggctacactgggactgcaaattatcttggagtctatccgcacattaatatattctgacaattcattcaacttgaccaaggaacaagagcaatgggttgtgggaattatgctttcagtnactttggtgaaattcntactgatgatttattgccgcacttttactaatgagattattaaagcntatgcccaggatcatttttttgatgtgatcactaatgtcattggtcttattgctgcactcttggcaaattatgttgatgattggatggatcctgttggtgctatcattctggcgttgtacaccattcgcacatggtcaatgacagtgttggaaaatgtgaattccctggttggaagatcagctgcacctgagtatcttcagaaactcacatacctatgctggaaccaccacaaggctgtgaggcacatcgacacagttcgggcatacacattcgggtctcactactttgttgaagttgatattgtcctcccagcagatatncagttgcaagaggcccatgatattggggaatcattgcaagagaagcttgagcttttacccgagatcgaacgtgctttcgtgcatcttgattatgagtacagtcacaaacctgagcatgcacaagcaaactcttagcagcagaaaggaaaaacaatgtccttgtttattttcacttgccctttcatctcccttcagctgtaaatgaagaaccatttatggtagttcagaatctgaacttttgaaagttgttagctgtagtagctataatcctactttctggcagacctgataatattcccaaacgtatatcaagataggtttatcaggcaacaccctccaggttccattttggggaaatagaatccttatattcttgtacactgcacactttctaccttaattaggtttaagggttatttctaacattaccaactataataatatatacaatggaatngattccttattaaaatgtaagaattacataaacaacactattttttgcatgctaactacttcttttacatcact

SEQ ID NO: 1757 - DNA, 1405 bp, Euphorbia esula
ggttttttactccttgaatctctaggattattgaatgcttcagtattgagtcaacaatggtggagcccgtaactgcgaacaatgaggaactttcacttttgcctctcaacagcaatgtcgaccactcatggcggttaaacttcgacggctaccagttatcgacggagcgtaaaggaaaaacgtcgccgccctgtggacgactccctgattgcctcggcgttttgggtccagatgatgtggccgagtactatcagcaacaagttgaaatgcttgaaggtttcacagaaatggatgtcttagcagagcgaggttttgtcccgggactcacaaaggaagagagggaaaatttggctaaaagcgagacttttgctattagaatatcaaatattgccaatatggttctttttgctgcaaaagtttatgcatctgttagaagtcattctttagccattattgcatctacattggactctcttcttgatcttttatccggttttatcctgtggtttactgcattcactatgaagacacctaacccgtatcaataccccattggaaagaagcgaatgcagccattgggcattcttgtttttgcttctgttatggcaactctggggctacagataatcttggaatcaatgcgcactttgatttctgatgatactgaatttaaattgaccagtgagcaagagcattgggttataggaattatggtttcggtgacagtagtaaaacttctcttaacaatttactgccggacttttaccaacgagattgtcaaagcttatgcccaggatcacttttttgatgttatcacaaatgtaattggccttattgctgcacttcttgctagttattttaaaggttggctggaccctgttggtgctataattctggccttgtacacgatccggacatggtcaatgacagtgcttgaaaatgtgaactcacttgtcggaaaatcggctacaccggattacctgaaaaagctcacatacctatgttggaaccatcacaaagccattagacacatcgatacagtccgggcctacacctttgggtcccactactttgttgaagtggacattgttctaccggctagcatgcacttgcaagaggcccatgatattggggaatccttacaggaaaagcttgaacttttgccggagattgagcgagcttttgttcatcttgattatgagtacactcacaagcccgagcatgcacagtcacactaattgtaagattctaagcagatgggtatggattattaactgtgattattgttatcttttggactttatgaggtaggaattgttggatatttagattagggaaggttaagaatggaactctgttttggagtcactaatgatgaatatagtatgtggcttctgggtgtttt

SEQ ID NO: 1758 - DNA, 1400 bp, Solanum lycopersicum
gtttttctttttcatttttcacgggaaaaatgttggaattagtgcctcccgacggcgatcacggcggagaatgcggcggcgaagagcaactgttgttgatggagacgaacaatgtcgaccggtcatggaggttgaacttcgatgaactacggttatcgtctgagaataaagagaaacctcttcctcatggattacatgattgtctcggtgtattgtgtcaagaagacaacattgccgtgtactaccagcaacaggtggaaatgctcgagggcttcaatgaaatggatgccttggctgatcgtggttttgtacctgggatgtcaaaggaagagagggaaaaattggccagaagtgaaacaactgccattaggatatcaaatattgcaaacatggttctctttgccgctaaagtatatgcatctgtcaagagtggttcattggccatcatagcatccacgttggattcactgcttgatcttctctctggtttcattttatggtttacagctttctctatgcagacaccaaacccgtatcaatatcctatcgggaagaaacgtatgcagcctttgggaatccttgtatttgcttctgtcatggcgactttgggactgcagataattctggagtctatgcgtacactaatatccgatgagtctaatttcagccttaccaaggagcaagagagatgggttattgggattatggtttttgtgactttagtgaaactagttttggtgttgtattgccggtctttcaccaatgagattgttaaagcatatgcccaggatcatttcttcgatgttatcacaaacgttattggactagtcgcggcattgcttgctaactacttcagtggctggatagaccctgttggagctatgattctcgcgttgtataccattcgaacatggtcaatgaccgtgttagagaacgtgaactctcttgtcggtaaggcagctgcaccagaatatctgcagaagctgacttacctctgctggaaccatcacaaagccataaagcatatagatacagtgagagcctatacatttggttctcattactttgtcgaagttgatatcgtcctacctgcagacatgcccttacaagaggcacatgatatcggtgagtcattgcaggagaagctcgaattattgccagagatcgaacgtgcctttgttcatctcgactatgaatacagccataaacctgaacatgcacaagcatacctataatcaaatggatattggtaacatcttctctacctaatattatataccacaagttaactttgtaatgctgtcaatctggtaattgctcttaaaagaaaagctactattatctggtagaacagggattgctttattcatatatataatatatatttgccatgattcctc

SEQ ID NO: 1759 - DNA, 1765 bp, Euphorbia peplus
gtctgtaatcagattagtatttaagctaggtagggagaagagggggagaaaaattgagagtgtctgtattagtttattatcttcttcttctccgtctctgtgtgaaaatttagaagcttttttttttgggagggatggaagggaggagagtatcggctaacccgagaccgtgttcgggaaggaggatattggcgaggaagagacctcgtacttttggatttgttaatactgttaagaagcttcagagacgggagatttcttctaggcgagatcgtgcttttagtatgagtaatgcccaggagcgctttcggaatatgcgtttgagggaagaatatgatactcatgatcccaagggtcattgtcaagtagtgctgccttttctgatgaagagaacgaaagttattgagattgtggctgctcgtgacattgtgtttgctcttgctcattctggtgtttgtgcagctttcagtagagaaacaaatcagagaatatgttttctcaacgtgtgtcctgatgaagttattagaagcttgttttacaataaaaacaatgactcactcatcacagtttcagtatatgcttcagataattttagctccttgaagtgcagatcaactagaattgagtatataaggaggggtaagccagatgccggttttgctcttttcgagtcagaatccttgaagtggcctgggtttgtggaatttgatgatgtcaatgggaaagtcctaacctactcagcacaggacagtgtatacaaggtgttcgacctcaaaaattatacaatgttgtattctatatcagataaacatgtacaagaaatcaagattagtccgggcatcatgttgttgattttcaatagattgactagccatgttcctcttaagattttatcaatagaagatggcacagttctcaaagcgtttaaccatttacttcatcggaataagaaggtagacttcatcgaacaatttaatgagaaacttcttgtcaagcaggaaaacgagaatctccagattcttgatgtgcggaatgcagagctaatggaagttagtagaacggagttcatgactccctctgcatttatcttcctctatgaaaaccaattgttcttaactttcaggaatagaaccgttgctgtatggaatttccgtggggagcttgtaacttcatttgaggatcaccttttatggcaccctgactgcaacacaaataatatatacataacaagcgatcaggatcttattatttcttactgcaaagctgaatctgaagaccagtggatagaaggaaacgctggatctatcaatattagcaacatcttgacagggaagtgtttggctaaaataaatgcgagcaacggtggtccaaagggcgaagggggaagtagcagtagtggtggatcaaggcagagttactcatctatgagaagtacagtaacagaagctttggaagacattacggcgcttttctatgatgaagagcggaatgagatatatactggtaacaggcatgggctagtccatgtgtggtctaactaaagcaaagaggctttatgaccacatcgacttaattgttgtaaatcagcatgtagaagaccagacgtttcgtgaggaggccgataaagctttttttgcactgcaagtccagtttatgtatggattgagttccatcaatgttgtgtagtgcagagacagaagatggttgtggccgaaacgaaagggattatccattgttcaatataaggttgaattagttgagaatg

SEQ ID NO: 1760 - DNA, 1428 bp, Ricinus communis
attgtggatggaaggaaggagaatatcggcgaatccaaggccgtgttcgggaagaagagtattagcaaagaaaaggcaacggtcaaatgggttaatgaacactgttaaaaagcttcagcgacgcgagatttcttctaaaccagatcgcgcttttactatgagtaatgctcaggaacgattccgcaatatgcgtttaaaggaggaatatgatacacatgatcccaaaggccattgttcagtagtactgccttttttgatgaagagaaccaaagttattgagattgtggccgctcgtgacattgtctttgctcttgctcattccggtgtttgtgcagcttttagtagagagacaaatcagagaatttgttttctgaatgtgagtcctgatgaagtcattcgaagcttgttctacaataaaaataatgattccctcatcacagtttcagtttatgcttcagataactttagctcgttgaagtgtagatctactaggattgagtacataaaaaggggcaagccagatgctggttttgctctttttgagtccgagtcattgaagtggccggggtttgtagaatttgatgatgttaatgggaaggttttaacctactctgcccaagacagtgtatacaaggtttttgaccttaagaactacacgatgctgtactctatatcggataaacatgtacaagaaatcaagatcagtccaggtatcatgttattgattttcaatagagcaagtagccatgtacctcttaaaattttatcaatagaagatggcacagttctcaaagccttcaaccatttacttcatcggaataagaaggtggacttcattgaacaatttaatgaaaagcttcttgtcaagcaggaaaacgagaatctccagattcttgatgttcgaaatgctgagctaatggaagttagcagaactgagttcatgactccctctgcatttatctttctctatgagaatcagttgttcttaactttcagaaatagaactgttgctgtctggaacttccgtggggagcttgtcacgtcatttgaggatcacctgttatggcaccctgactgtaacacaaataatatatacattacgagtgatcaggatcttattatttcttactgtaaagctgagactgaagagcaatggatggaaggaagcgcggggtctatcaatattagcaacatcttgacaggaaagtgcttggctaaaattaatgctggcaatggtggtccaaagggtggtgaatgcagcagcagcagcagtattggctgctcgaaacagagttgctcttccatgcgaagtacagttgctgaggcactggaagacataactgctcttttctatgatgaagagcgaaatgaaatctatactggtaataggcatgggctggttcatgtatggtctaactgaagttgcaa

SEQ ID NO: 1761 - DNA, 2137 bp, Ricinus communis
aaaagagacaaggtaggtgtttgctacagtgataccctaatgctattccaattcaactgtttaccgaatttcagatttttatttgtttcagattagggtttggacttgaggttcaagtaggggtctggctttttagagttaatttatatcagtaaacaatcgtaagctcaagagaaaggaataaagattgtggatggaaggaaggagaatatcggcgaatccaaggccgtgttcgggaagaagagtattagcaaagaaaaggcaacggtcaaatgggttaatgaacactgttaaaaagcttcagcgacgcgagatttcttctaaaccagatcgcgcttttactatgagtaatgctcaggaacgattccgcaatatgcgtttaaaggaggaatatgatacacatgatcccaaaggccattgttcagtagtactgccttttttgatgaagagaaccaaagttattgagattgtggccgctcgtgacattgtctttgctcttgctcattccggtgtttgtgcagcttttagtagagagacaaatcagagaatttgttttctgaatgtgagtcctgatgaagtcattcgaagcttgttctacaataaaaataatgattccctcatcacagtttcagtttatgcttcagataactttagctcgttgaagtgtagatctactaggattgagtacataaaaaggggcaagccagatgctggttttgctctttttgagtccgagtcattgaagtggccggggtttgtagaatttgatgatgttaatgggaaggttttaacctactctgcccaagacagtgtatacaaggtttttgaccttaagaactacacgatgctgtactctatatcggataaacatgtacaagaaatcaagatcagtccaggtatcatgttattgattttcaatagagcaagtagccatgtacctcttaaaattttatcaatagaagatggcacagttctcaaagccttcaaccatttacttcatcggaataagaaggtggacttcattgaacaatttaatgaaaagcttcttgtcaagcaggaaaacgagaatctccagattcttgatgttcgaaatgctgagctaatggaagttagcagaactgagttcatgactccctctgcatttatctttctctatgagaatcagttgttcttaactttcagaaatagaactgttgctgtctggaacttccgtggggagcttgtcacgtcatttgaggatcacctgttatggcaccctgactgtaacacaaataatatatacattacgagtgatcaggatcttattatttcttactgtaaagctgagactgaagagcaatggatggaaggaagcgcggggtctatcaatattagcaacatcttgacaggaaagtgcttggctaaaattaatgctggcaatggtggtccaaagggtggtgaatgcagcagcagcagcagtattggctgctcgaaacagagttgctcttccatgcgaagtacagttgctgaggcactggaagacataactgctcttttctatgatgaagagcgaaatgaaatctatactggtaataggcatgggctggttcatgtatggtctaactgaagttgcaacatgttttatcattttgatatggatgttacaaatctgcacctagaggatattccatcatgtctgcaatgagatctatacccctagttgatgtgggctggttcatgtattggcatattgaagagcagaatgaatcatgttgacctgagtgctatgattccacaatttgacggtctgtcatgcctgcacaagctcgaagctgatgtctgcatagcattccattaaattgcttcagaatgaagattgagttgtaccattagataattgtagttcgttgtgtagcaatctgtagattcttacaattggggtttcttagggtatctgtttgagatgccaaagaagggtttaaatttgtcgaagcctgaagactattcagattatgctatatgtaacattactttgtattctgtctgccaagtaaacaagatgtttgcttgttaactatatctctctgccactagtgaggataatgtgctcaaaatttgtggttggcaaggagatctgacaaaaactaaattcatactt

SEQ ID NO: 1762 - DNA, 1833 bp, Prunus persica
cactttttcaagggacattctttttctccttcctctcccaatttcaaccccacacccaaacaccagcgctctccagggaaccaaatttctgaagattagggttctggagggcttgttgtgatctaaaagggttccatttaatctaatagaaaccatcacaaactcatatactgtataatttcaaatatatatatacatatgtgcgatatgcgtttgtatgaaatcagaatctgagagttgagaatggaagtgggaaggaggatatcggcgagtcctcggccatgctcgggtcgcagaatattggcgaagaagaagagggctcgctcggatgggattgtaaacagcgtgaagaagcttcagaggcgtgagatttcttcaaagcgtgatcgagtttttggcctcagcaatgcccaggagagatttcgcaacatgcatctcaaggaggaatatgatactcatgatcccaaggggcattcttcccccatattgtcttttctgatgaagaggacaagggttattgagatagttgctgcacgtgacatcgtatttgctcttgcacactcgggtgtttgcgcagcttttagcagagagaaaaacgagaggatatgtttcttgaatgtaagccctgatgaagtcattcggagcttgttctataataagaacaatgattcgctcatcacagtttcggtctatgcctcagacaacttcagctctttgaaatgcagatccacaaggattgagtatataaggaggggccagccagatgctggatttgctcttttcgaatctgagtctttaaagtggcctgggtttgtagagtttgatgatgttaatggcaaggtgctaacatactctgcacaagacagtatatacaaggtatttgaccttaagaactataccatgctttactctatatcagacaaacatgtacaagaaatcaagatcagtccaggcatcatgctgttgattttcaatagagctagtagccatgttccgctgaaaattctatcaatagaagatggcacagttctcaaagccttcaaccatctacttcatcgaaataagaaggtcgacttcatagaacaattcaatgaaaagcttctcgttaagcaagaaaatgagaatcttcagattcttgatgttcgaaatgccgagctgatggaagttagcagaactgagttcatgactccatcagcatttatctttctttatgagaaccagctattcctgacattcagaaatcgaaacgtggctgtctggaactttcgtggagaacttgtgacttcgtttgaggatcacttgttatggcatcctgactgcaataccaataacatttatataacaagtgatcaggatcttatcatatcttactgcaaggctgattcggatgaccattggatggaagcaaatgctggatctattcatgtcagcaatatcttaaccggtaaatgcctggccaaaataaatgcaggcaatggcggtcccaaggttgatgagtgtgacagcagtgctggctcctcaagcaagcgaagcaacttatctctggtgagaagcaccgttgctggggccttggaagacataactgctcttttctatgatgaagagcgcaatgagatatatactggaaataggcatggtcttgttcatgtgtggtcaaactgaagttgagatcattactttgttttggaagctgctcttagagaaatagtttattttggcaagccttcgtgcatatgggatattaggagtgcgttgtatcattagatgacctggaagtgctcttgcattgtatcataatatgatttttgaaattgttaatgtagccttctgtag

SEQ ID NO: 1763 - DNA, 1870 bp, Fragaria vesca
agagaacactactcttttcttcttctccttacaaatttcaaccccaaaatcacagttggaatcgtctcccgattctgggttttggggcccttgctctgatctcaaaagggttttagttttttttctttgtttggggttgtatgaaatcggagagttgagaatggaagtggggaggaggatatcggcgagtcctcggccgtgctccggccggcgagtgttggcgaagaagaagagggccgccggggatgggttcgtcaacagcgttaagaagcttcagaggcgtgagatttcttccaagcgtgatcgagcttttgggatgagcaatgcccaagagagattccgcaacatgcacttgatggaggaatatgatactcatgatcccaagggtcattcgacccccaaattgccttttttgttgaagaggacaaaggtcattgagatagttgcagcacgtgacatagtcttcgctcttgcacactctggtgtatgtgcagcttttagcagagatacaaatcagaggatctgtttcttaaatgttagtcctgatgaagtcatccgaagcttgttctataacaagaacaatgattcgctcatcacagtttcagtctatgcttcggacaacttcagctctttgaaatgcagatctacaaggattgagtatataaggaggggccagccagatgctggttttgctctttttgagtccgagtccttgaagtggcctgggtttgtagagtttgatgatgttaatggcaaggtcttaacatactctgcacaagatagtatatataaggtgtttgaccttaaaaattataccatgctttactctatatcagacaaaaatgtacaagaaatcaagatcagtccaggtatcatgctactgatttacaatagagctagtagccatgttccattgaagattctgtcaatagaagacggcacagttctcaaagacttcaatcatctgcttcatcgaaacaagaaggtggatttcatagaacaattcaacgaaaagcttctcgttaagcaagaaaatgagaatcttcagattcttgatgtgcgaaatgcggagcagatggaagttaacagagccgagttcatgactccatcagcatttatctttctgtatgagaaccagctatttctgacattcagaaataggactgtagctgtctggaactttcgtggagaacttgtaacttcattcgaggatcacttgttgtggcatcctgactgcaataccaataacatttatataacaagtgatcaagatttgatcatatcgtactgcaaggctgattctgatgaccattggtcggaaccaaatgctggttctattcatgtgagcaatatcttaaccggaaagtgcctagccaaaataaatgctagcaatgccggtcccaaggttgatgagtgtagcagcagttctagcacctcaagaaaacagataaactcatctgtggtgaggagcactgttgctgaggccttggaagacataactgcccttttctatgatgaagagcgcaatgagatatatactggaaacaggcatggtcttgttcatgtgtggtcaaactgaaggtcagatctttacttggccttttggggatatgaagctgctgtttagggaaatagtttattatagaagtttagtgcctgcatgtgggaaatcttcaagctccctgtatacctttagatcccttgccttgtaacattatatgattctgaattgtcaatctagggttctggtcttgtggatgtatgtcttctctttcgtaatacaggctgcttgctcaatgttcaactcaagtgcttttgttgcgagtatccaagaatcttgcaagaactcgtgatatcatctgtctcaaaa

SEQ ID NO: 1764 - DNA, 1920 bp, Malus domestica
caattttcaacccctctcaaaagcgctttccagatgatggacaaaattagggttcttggggaattgttgtgatccaaaaggcttcgatttcatctatattggaagggaggatattgggtgtgtgtatatataatatatatataaaaaatatttgaatttgaatttgaattcgaatatatgttgggtggtgtatgaaccagaatctgagggttgagaatggaagtgggaaggaggatatcggcgagtcctcgaccgtgctcggggcggcgagtggtggcgaagaagaggaggggtggttccgatgggttcgttaacagcgtgaagaagcttcagaggcgtgagatttcttcgaagcgtgatcgggcttttgggatgagcaattcccaggagaggttccgcaacatgcacctcgtggagcaatatgatactcatgatcccaaggggcattcttcggccatattgccttttctgatgaaaaggacaaaggtcattgagatagtttctgcacgtgacatcgtttttgctcttgcacactctggtgtttgcgcagcttttagtagagagaaaaacgagaggatttgtttcatgaatgttagtcctgatgaagtcattcgaagcttgttctataataagaacaatgattcactcatcacagtttcggtgtatgcttcagacaacttcagctctttgaaatgcagatccacaaggattgaatatataaggaggggacagccagaagctggtttttctcttttcgagtctgagtctttgaagtggcctgggtttgtagagtttgatgatgttaatggcaaggtgctgacatactcagcacaagatagtatatacaaggtgtttgatctgaaaaactataccatgctgtactctatatcagacaaacatgtccaagaaatcaaaatcagtccaggcatcatgctgttgatttataacagagcaagtagccatgttcctctgaaaattctgtcaatagaagatggcacagttctcaaagacttcaatcatctacttcatagaaataagaaggtggacttcatagaacagttcaatgaaaagcttcttgtcaagcaagaaaatgagaatcttcagattctggatgttcgaaatgctgagctgatggaagttagcagaacagacttcataactccatcagcatttatctttctgtatgagaaccagctattcctgacattcagaaatcgattggtgtctgtctggaactttcgtggagagcttgtcactgcatttgaggatcacttgttatggcatcctgactgcaataccaataacatttatataacaagcgatcaggatcttatcatatcttactgcaaggccgatactgatgatcattggtcggaaggaaatgctggatctattcatgttagcaatatcttaaccggaaaatgcctggccaaaataaatccgagcaatggtgatcccaaggtcgatgacacagaaggcaacactggctcctcaaggaagctaagcaactcatctctggtgagaagcacagtcgctgaggctttggaagacgtaactgctctcttctatgatgaagatcgcaatgagatatataccggaaataggcatggtcttgttcatgtgtggtcaaactgaagttcagattatctttttgcttttaagggccatgaagctgctcttagagaaatactttagttgggcagcctagtgagtggatgtgcgatatcatcagtggctttgtgtaattaggtttcttggaagtgctcatgctttgtatcataaaatgatttcaaattactaatgttgctttccacaaagctttatttttgggtttgtatctcatcttctcattgttgtggtggaagtattatttgagatggtgacatgaaaatttcagtctcgtttggaagtgctttaaaa

SEQ ID NO: 1765 - DNA, 1921 bp, Malus domestica
ttcacccacgtttttccagacgatgaaatttcacaaaaattagggttttgtggggattcttgtgatcccatcccaaaagggcttccatttcacctaattgtggaacgttgtggaagggaggatttgggtgtgtggatatatatgtattttgaatttgaatttgaatttgaatatatattgggtggtgtatgaaaccagaatctgagagttgagaatggaagtgggaaggagaatatcggcaagtcctcggccgtgctccgtccggcgagtggtggcgaagaagaggggtagctccgatgggttcgtaaacagcgtgaagaagcttcagaggcgtgagatttcttcgaagcgtgatagagcttttgggatgagcaattcccaggagaggttccgcaacatgcacctcgtggaggaatatgatactcatgaccccaaggggcattcttcggccatattgccttttctgatgaaaaggacaaaggtcattgagatagttgccgcacgtgacatcgtctttgctcttgcacactctggtgtttgcgcagcttttagtagagagaaaaacgagaggatttgtttcatgaatgttagtcctgatgaagtcattcggagcttgttctataataagaacaacgattcgctcatcacagtttcggtttatgcatcagacaacttcagctctttgaaatgcagatccacaaggattgaatatataaggaggggacagccagaagctggtttttctcttttcgagtctgagtctttgaagtggcctgggtttgtagagtttgatgatgttaatggcaaggtgctgacatactcagcacaagatagtatatacaaggtgtttgatctgaaaaactataccatgctgtactctatatcagacaaacatgtccaagaaatcaaaatcagtccaggcatcatgctgttgatttataacagagcaagtagccatgttcctctgaaaattctgtcaatagaagatggcacagttctcaaagacttcaatcatctacttcatagaaataagaaggtggacttcatagaacagttcaatgaaaagcttcttgtcaagcaagaaaatgagaatcttcagattctggatgttcgaaatgctgagctgatggaagttagcagaacagacttcataactccatcagcatttatctttctgtatgagaaccagctattcctgacattcagaaatcgattggtgtctgtctggaactttcgtggagagcttgtcactgcatttgaggatcacttgttatggcatcctgactgcaataccaataacatttatataacaagcgatcaggatcttatcatatcttactgcaaggccgattctgatgatcattggtcggaaggaaatgctggatctattcatgttagcaatatcttaaccggaaaatgcctggccaaaataaatccgagcaatggtgatcccaaggtcgatgacacagaaggcaacactggctcctcaaggaagctaagcaactcatctctggtgagaagcacagtcgctgaggctttggaagacgtaactgctctcttctatgatgaagatcgcaatgagatatataccggaaataggcatggtcttgttcatgtgtggtcaaactgaagttcagattatctttttgcttttaagggccatgaagctgctcttagagaaatactttagttgggcagcctagtgagtggatgtgcgatatcatcagtggctttgtgtaattaggtttcttggaagtgctcatgctttgtatcataaaatgatctcaaattactaatgttgctttccacaaagctttatttttgggtttgtatctcatcttctcattgttgtggtggaagtattatttgagatggtgacatgaaaatttcagctcgtttggaagtgctttaaaacctcgtg

SEQ ID NO: 1766 - DNA, 1907 bp, Malus domestica
ctgattaattctctacctcttcctctctaatcgctggctctgacactttttcagagctctcccaattttcaacccctctttccagacgatgaaatttcacaaaaattagggttttgtggggattcttgtgatcccattccaaaagggcttccatttcacctaattgtggaacgttgtggaagggaggatttgggtgtgtggatatatatgtattttgaatttgaatttgaatttaatatattgggtggtgtatgaaaccagaatctgagagttgagaatggaagtgggaaggagaatatcggcaagtcctcggccgtgctccgtccggcgagtggtggcgaagaagaggggtagctccgatgggttcgtaaacagcgtgaagaagcttcagaggcgtgagatttcttcgaagcgtgatagagcttttgggatgagcaattcccaggagaggttccgcaacatgcacctcgtggaggaatatgatactcatgaccccaaggggcattcttcggccatattgccttttctgatgaaaaggacaaaggtcattgagatagttgccgcacgtgacatcgtctttgctcttgcacactctggtgtttgcgcagcttttagtagagagaaaaacgagaggatttgtttcatgaatgttagtcctgatgaagtcattcggagcttgttctataataagaacaacgattcgctcatcacagtttcggtttatgcatcagacaacttcagctctttgaaatgcagatccacaaggattgaatatataaggaggggacagccagaagctggctttgctcttttcgagtctgagtctttgaagtggcctgggtttgtagagtttgatgatgttaatggcaaggtgctgacatactcagcacaggatagtatatacaaggtgtttgaccttaaaaactataccatgctgtactctatatcagacaaacatgtacaagaaatcaaaatcagtccaggcatcatgctgttgatttataacagagctactagccatgttcctctgaagattctatcaatagaagatggcacagttctcaaagacttcaatcatctacttcatagaaataagaaggtggacttcatagaacagttcaatgaaaagcttctcgtcaagcaagaaaatgagaaccttcagattctggatgttcgaaatgctgagatgatggaagttaacagaacagacttcataactccatcagcatttatttttctgtatgagaaccagttattcctgacgttcagaaatcgactggtgtctgtgtggaactttcgtggagaacttgtaactgcatttgaggatcacttgttatggcatcctgactgcaataccaataacatttatataacaagcgatcaggatcttatcatatcttactgcaaggctgattctgatgatcattggtcagaagcaaatgctggatctattcatattagcaatatcttaaccggaaaatgcctggccaaaataaatccaagcaatggtggtcccaaggtcgacaactgtgaaggcaacgctggctcctcaaggaagcaaagcaactcatcagtggtgagcagcaccgtcgttgatgctttgaaagacgtaactgctctcttctatgatgaagatcgcaacgagatatatacaggaaataggcatggttttgttcatgtgtggtcaaactgaagttcaggttatcttttagctttcaagggctatgaagctgctgttagagaaatagtctagtttggcagcctagcttgttagtggatatgggatattgtcagtggctttgtatcattagatttcttgaaagtgctctcgcattgtatcataaaatgatttcaaattgctaatgtagatttcaatagaactggatttttggttttgtaaaaaatgt

SEQ ID NO: 1767 - DNA, 2232 bp, Euonymus alatus
gagagacgactctcttcaccttggcttctcacgatctgacatcgccgattgacgatcgcagggagagaagagatagtctctctatgtgcgcgcaacacgcgcgcattttgctttggtttctctttgtttggtatttgaaggtctagggttagggttttggatttgcggttgatgtggtggaattaggattcgacgaagaggatggaagaatcacgtatataatgtgttagtagtaaaatttagtagtagatggaagggcggaggatatcggcaagccctaggccgtgctcggggaggcgggtggtggcgaagaagagagcccggtcagatgttatattgaatagtgtgaagaagctgcagaggcgcgagatttcctcaatgagagatcgcgctttcactgtcagcaacgcccaggagagattccgcaacatgcgcctgacggttgaatatgacactcatgaccccaaggggcattgttcaatggtactcccctttttggcgaagagaacgaaagtaattgagattgtcgctgcccgcgatattgtttttgctcttgcacattctggtgtttgtgcagcttttagtagagagacaaacgagcggatatgttttttgaatgtgagccccgatgaagtcatccggagcttgttttataataagaacaatgattcccttatcacagtgtcagtttatgcttctgacaattttagctctttgaagtgcaggtccacaaggattgaatacataagaagaggtaagccagatgctggatttgctctttttgagtctgagtcgttgaagtggcccggatttgtggaatttgacgatgttaatgggaaggtgctaacttactctgcacaagatagtatatacaaggtgttcgatctgaaaaactacaccatgctctactctatatcagataaaaatgtacaggaaatcaagatcagtcctgggataatgctgttgattttcaatagagcgagtagccatgttcctcttaagattctatcgatagaagatggcacagttctcaaatctttcaaccatctgcttcatcgcaacaagaaggtggacttcattgaacaatttaatgaaaagcttcttgttaagcaggaaaatgagaacctccagattcgtgatgttcgaacctctgaactgatggaagttagcagaaatgagtttatgactccttcagcatttatctttctatatgagaatcagttgtttctaacattcagaaatagaactgttgctgtttggaactttcgtggcgagcttgtaacttcatttgaggatcacttattgtggcatccagactgcaacacaaacaacatttatataacaagtgatcaggatcttatcatttcttactgtagggctgaatctgactatcaatggggagaaggaaatgccgggtctatcaatatcagcaatatcttgactgggaaatgcctggctaaaataaatgcgacaaatgcaagtcccacagttgaagagtgctgctgcagcagtactggtaattctaaaaagcggattgtcgcagccccaatgagcagcacagtttctgaggctttggaagacataactgctcttttctatgacgaagagcgcaatgagatatacactggtaacagacacggtctggtgcatgtctggtcgaattaatgagaagatgttttgtcattctgacctttgatacagacgggaagaacacggcgggtttttgcgcattgtgtatgtgggacagataactggcactggaacaacagtgagaggatggttattctgccttagtggctcgactgcattttaaccttgggagcactatcattagatttgtttaattgttgtgtagtaatagttactgcatatgtatactgccccactaagaagcagtgacggcaggtaaatggttcacgaagttgttaatgtagcagagatgcgtacgcttgatttttcattgtcgtgttgcttgcagatggaacaaagtttgtcaatgacttcttacttgttccctctgggtttggttttttgcattccatttgttaggaagcattcttattgtgaacatgaacttgtcaatcaagtatttgagagtgtgtgagaagtaaagaagtggaatgagagttagtgtctaaagctttacttcgacattgatattttacaaaagatgggagatgttgagtttgggaggagttcgcgaatccattctttctgataaagggttcaaaa

SEQ ID NO: 1768 - DNA, 2150 bp, Vitis vinifera
ggacgcgaagctcattgaaatctaacatataatatcctctctctctcttccgctctctccctctcttctcctctcttcccctctctttctcagagctctatttaggaggttcggaatcttcggacatcatttgtagtagggattttggtggcggtcttgcttttctctcgtagtcaaaagccctaggctttaatcgtatttaaaaaaaaaaaaaattttggtttttcctgttggaatttgatggtgatgcaccaaagtggtgtgtaatttgaagtgtttgtgaaatgatggaggggaagaggatatcggtgagtcctcgacctggcagtggccggcgggttgtggctaagaagcgacctcgtaatgatggatttgtgaacagcgttaagaagcttcagaggcgtgaaatttgttccaagcgtgaccgttctttcagtatgagcgacgcccaggaaaggttcagaaatatacgcttgcaggaggagtacgatacccatgatccgaagggacattgtaccctggttctgccctttctgaggaagaggtcaaaaattattgagatagtagcagcacgtgacattgtctttgctcttgcccaatctggtgtatgtgcagcatttagccgagaaactaaccagaggatatgctttctgaatgtcagtcctgatgaagttattcgaagcctattttataataaaaataatgattcccttatcacagtttcagtttatgcttcagacaacttcagttctttgaaatgcagaaccacaaggattgaatacataaggaggggcaaaccggatgctggctttgctctctttgaatctgagtcacttaaatggcctggttttgtagagtttgatgatgtaaatgggaaggtactcacttattctgcacaagatagcatatacaaggtctttgacctgaaaaactatacaatgttgtactccatatcagataaacatgttcaagaaatcaagatcagtccaggcattatgttgttaattttcaccaaagctagtagccatgttcctcttaagattctttcaatagaggatggtactgttctcaaatctttcaaccatctgcttcatcggaataagaaggtggatttcattgaacagttcaatgaaaagcttcttgtcaagcaagaaaacgagaatctccagattcttgatgtacgcaattccgagttaaaagaagttagcagaactgaatttatgacaccatctgcatttatatttctatatgagaatcaattattcctgacgtttaggaatcgaacagtggctgtttggaacttcagaggggaacttgtaacttcgtttgaggatcaccttttgtggcatcctgattgcaacaccaacaacatatacatcacaagtgaccaggatcttattatttcttactgcaaggctgattctgatgatcctttgtcagaaggaaatgcgggttctataaacataagcaatattttgactgggaaatgtctagcaaaaataaaagcaagcaacaatttcccgatggaaaatgaatgcagttgcagtagcaatttcagcagcagcagcagcagcatcggtggctcaaggaaacgagctcatgcctctgcctctaggattagaagcacggttgcagaagccctggaagatattactgctcttttctatgatgaagaacgcaatgagatttatactggcaacaggcatggcctggtccatgtatggtccaactgatgtgtgtatttcgttagttctgtgattcttccttccagatggttgaattcattacgctgcaccactgcaggaacttggtggaactgtaccattaaatgcgcttgtcctagttcatttttattcttttgtttatctggtgttcacatttcatgttgttggttgtcatagatgagattataaaatcatattcacttttgtagttgtgcattataattctaggttgctatggggcaccggctgccgtctatctctctctctctctcccttcttccctccctctcacctctctctctctctccctccctccctccctccctctcaccccgctgttgaaattcaagcttggttgctgccgttgttgaaattcaaacttggttgctgatttcgtttagcttagatggtttcaaaggagatatc

SEQ ID NO: 1769 - DNA, 1887 bp, Malus domestica
tccctgagtttttagggtttatgcgatgctgcaaaagataaaaaattgggtaattagagaggaattggaggagtagatatgtgttactctctggttctgggtttgaagtgagtttactggggtttttctgtgagagaaattgatggaagggggaaggagaatctcggcgagtcctcggccttgcaacggtaggagagtggtggcgaagaaacgacctcgtattggtggggttgatgggttcgtcaacagcgttaagaagcttcagaggcgcgaaatcagctccaagcgcgaccgtgctttcactatgagcgatgcccaagagaggtttcgcaatattcgcctccaggatgaatatgatacgcatgatccgaaaggtcattgtgccatggttctgcctttcctgcgaaagaggtccaaaattattgaaattgtagcagcacgtgacattgtgtttgccctcgcacagtctggtgtttgtgcagcatttagccgagaaaccaaccagagaatatgctttctgaatgtcagtcctgatgaagtgataagaagcttgttttacaataaaaacaatgactcacttatcactgtctcggtttatgcttcagacaacttcagttctttgaaatgccgaagcacaaggattgaatacatacgaaggggtaaaccagatgctggatttgctctttttgaatccgagtcactgaaatggcctggttttgtagagttcgatgatgtaaatgggaaggttcttacttattctgcacaggatagtatatacaaggtgtttgatctgaaaaactatacaatgttgtactccatatcggataagcatgtccaagagattaagatcagtcctgggatcatgctgttgatttttactaaagctagcagtcatgttcctcttaagattctgtctatagaggatggtactgttctcaaatcctttaaccatctccttcatcggaataagaaggtggatttcatcgaacagttcaacgagaagcttcttgtaaagcaagaaaatgagaaccttcaaattcttgatgttcgcaattttgagatgacagaagtaagcagaactcaattcatgaccccatcagccttcatatttctatatgagaatcagttattcttgacgtttcggaatcgaacagtggctgtttggaactttagaggagaacttgtgacttcatttgaggatcatcttttgtggcatcccgactgcaataccaataacatatatattactagtgatcaggatcttattatttcttactgcaaggctgattctgatgatccattgtctgaaggaaatgccggatccatcaatatcagcaatatcttgactggaaaatgccttgctaagataagagcaaccaacaacgctgaaaaagaatgcatttgtagtggtgaggcttgtggcagcagttgcaattcgaagaagcggtccctttcctcccgaattaggagtacagttgcagaagccttggaagacattactgccctcttctacgacgaagagcgcaacgagatctacacgggcaataggctcggtctagttcacgtatggtctaactaatagtttctccaagtttattctccatgtccattagattctttcttggtcatctagatgtttgatttgatctcgctgccccccaccgcaacaactcccttgaactgtaccattaattccctcttgtacccttaatccctttgttttaccttaaatccgatttctttcctcgtgtctgttgagcttgagaacttcttgtaccattagtctcttcgttttacctgaattccgatttctttcatggtggtgtaatataaatgtagaattgagtttgcctcggtccttcggacgctctttttatctaatttttg

SEQ ID NO: 1770 - DNA, 1990 bp, Fragaria vesca
aacttcggagaatctagggtttcgctgatgctaaggaattgcgaaattgaagaggaagaggagtgagtgagtatgctttagggagctggaattgaacaagtttggatttttttggagatggaaggcgggaggaggatatcggcgagtccgcggccgtgtagtggccggagagtggtggcggcgaggaaacgaccccgtattggcggcgttgatgggtttgttaatagtgttaagaagcttcagcggcgcgaaatcagctccaagagggaccgggctttcactatgagcgacgcccaggagaggtttcgcaatattcgtctacaggaggaatatgatacccatgatccgaaaggtcattgtgccatggttctgccttttctgcgaaagaggtctaagattattgaaattgtagcagcgcgtgacattgtgtttgctcttgcgcaatctggtgtttgtgcagcgtttagccgagaaaccaatcagaggatatgctttctgaatgtcagtcccgacgaagttataagaagtttgttttataacaaaaacaatgactcacttatcaccgtttcagtttatgcttcagacaatttcagttctttgaaatgtaggagcacgaggattgaatacatacgaaggggtaaaccagatgctggctttgctctttttgaatccgagtcattaaagtggcctgggtttgtagaatttgatgatgtaaatgggaaggttctcacttattctgcacaagatagtatatacaaggtgtttgatctcaaaaactatacaatgttgtactccatatcagataaacacgtccaagaaattaaaattagtccgggcatcatgttgttaattttcaataaagccagtagccatgttcctctcaagattctttctatagaggatggtagtgttctcaaatccttcaaccatttacttcatcggaataagaaggtagatttcattgaacaattcaacgaaaagcttctggtaaagcaagaaaatgagaacctccagatccttgacgttcgcaattttgagatgacagaagttagcaaaaatgaatttatgacaccatcggcttttatatttctgtacgagaatcagttatttttaacgtttcgcaatcgtactgtggctgtttggaattttcgaggggaacttgtgacttcgtttgaagatcatcttttgtggcatcccgactgcaatactaataacatatatattactagtgaccaggatcttatcatttcttactgcaaggctgattctgatgatccattagctgaaggaaatgcaggatccatcaatatcagcaatattttgacagggaaatgccttgctaaaataaaagccagcaaaactgtggaaaatgaatgcagttgtagtggtgactgttgtggaaaaagttgcagttccaagaagcgctcccaggcctctagaattagaagtacagtcgcagaagccttggaagacatcactgctctcttctatgatgaagagcgcaacgagatctataccggcaataggctcggtctcgttcatgtatggtctaactaagggtttcttcagtttgttctacacgaggtcctcagtctacctagcagcgacagcatcctcgtttagccgtgtctgtccattagattcattgttgtgttggtcttgtagatggttgaattcatttgatgccacactgcatcagctacgtcacggaactgtaccatcaattgctcttgtaccattgatctatttgtttacctaaatcagaattccttgtatctgtgcctgggttgagaacatgtttgtaacttttcatggccatgtaatatatcgagatgaatttgtttccgtaagacggtaagtgtgtcaagctaaactgggtggtaagtggtgaaaaccaatgaggacgacagtctacttaatcttctttaactagaaggtagacttaatttaatggattcgatttaaggattatagttccaagaagcaatta

SEQ ID NO: 1771 - DNA, 2293 bp, Glycine max
cgttaaatattgttttattttctctttttttctttttcttttattttcttccgtttcccttccaaaaatttgaaaaccagatcgaaaacttgaactaagagagtcagagtaagcactttgcgaccagcgctctccgaaccctaaattccccgtttttcgcggtaaaattctcgccggatttaggcttttcccgcgctcggtgcggcgtagagtgccggcggcggaggtctccttcgctcgctgagatatggaaggaggcgggaggcggatcacggtgagtccgcggccgtgctgcggccggcgcgtggtggcgaagaagaggccgcgtctggtcgacggcttcgtcaacagcgtcaagaagcttcagcgccgcgaaatcagctccaaccgcgaccgcgctttctccatgacggacgcgcaagagaggtttcgcaacattcgcttgcaggaagaatatgatacacatgatccaaaaggtccttcgtctgctgtattgcaatttctgagaaagaggtcaaagataattgagatcgttgcagcacgtgacattgtttttgcacttgcacaatccggtgtttgtgcagcatttagccgagagaccaatgaaagaatatgcttcttgaatgtcagtcctgatgaagttataaggagtttgttttataataaaaataacgactcacttatcacagtctctgtctatgcatcagacaattacagttctttaaaatgccgaagtacaaggattgaatatataaggagggttaaaccggatgctggctttgctctttttgaatccgagtcattaaagtggccaggttttgtagagttcgatgatgtaaatgggaaggtgctcacatactctgcacaagatagtatatacaaagtgtttgacctgaaaaactattccatgttgtactccatttcagataaaaatgtacaagagattaagatcagcccagggatcatgttgttgatttttactaaatcaagtagccatgtcccactgaaaatcctctcaatagaagatggtactgttttgaaatcgttcaaccatctccttcatcggaataagaaggtggatttcattgaacaattcaatgaaaagcttcttgttaaacaagaaaatgagaatctccaaattcttgatgtaaggacttctgagctaacagaagttagcagaagcgaatttatgacaccatctgcatttatatttctatatgagaaccaattattcctgacatttcgaaaccgaactgtggctgtgtggaacttccgtggagaacttgtaacttcttttgaggatcacctcttgtggcatcctgattgcaatacaaacaacatatatataaccagtgaccaggatcttatcatatcatattgcaaggccgattctgatgattcattgtccgaaggaaatgcaggttctattaatgtcagcaacattttaactggcaagtgtcttgcaaagataagagcaagtaatggcttacccatggtgaaggaatgcagttgcagcgatgacaattgttcaagtagtgcttgcaattcagggaaacgaaagcgttcctccagaattaggagcacagttgcggaagccttggaagacattactgctctcttctacgatgaagagcgcaacgagatctataccggcaataggctcggtctggttcatgtctggtctaactaatgcactgttaagcttattcttgccttgtgttttctcattagcatttatccatggttgcggtgatagtcctcacctgataataataacctttgggagagctgtaaccattaagtgttattgtatcattcgttttttagtttttttgtcatgtcttaggccagtttaatccgtaggtggcaacacccctgtattaaagtgatagtatgttggtacctctccacaatattgaagatgtaatctatatttacatttatggagtcagctctatgtagtgaaatatgtgaataaatgttcacttttctctgttcattccttctttgatactttgccttgttggggcctagagtggattaacctgtttgctctcacatggattgttagagccgtagtgccaaatctgtgtggggataaaaggaaagggagaaagcaatagatagtgttgtattgtagctgttacactctggtttctgatggtacttcaatcaattcaaatttttttgttctgttgtatcttaacttttttctatcgcttttatccaagtcagttgccaagccaaatagaaaaggacattgttataaaatgaatttgctttcagcaagtgg

SEQ ID NO: 1772 - DNA, 1866 bp, Vigna unguiculata
gtagcacttgagagcgctctcccaaccctaagtccccgctctctgtaaattctcgccggattcagggttttccctcgttcggtggcggcggagggatccttcgctcgcttaaatggaaggcggagggaggcggatcacggtgagtccgcggccttgctgcggcaggcgcgtgttggcgaagaagaggccgcggcttgttgacggctttgttaatagcgtcaagaagcttcagcgccgtgaaatcagctcgaatcgttaccgtgctttctccatgaccgacgcgcaagagaggtttcgcaacattcgtttgcaggaagaatatgatacacatgatccaaaaggtccttcgactgctgtattgccatttctgaaaaagagatcaaagataattgagattgtagcagcacgggacattgtttttgcacttgcacaatctggtgtttgtgcagcatttagccgagagaccaatgaaaggatatgcttcttgaatgtcagtcctgacgaagttataaggagtttgttttataataaaaataatgactcgcttatcacagtttctgtctatgcatcagacagttacagttctttgaaatgccgaagcacaaggattgaatatataagaagggtcaaaccagatgctggctttgcactttttgaatctgagtcattgaaatggccaggttttgtagaatttgatgatgtaaatgggaaggtactcacgtactctgcacaggatagcatatacaaggtgttcgacctgaaaaactatacaatgttgtactccatttcagataaaaatgtacaagagattaagatcagtccagggattatgttgttgatttttgctaaatcaagtagccatgtcccactcaaaatcctctcaatagaagatggtactgttttgaaatcattcaatcatctccttcatcggaataagaaggtggatttcattgaacaattcaatgaaaaacttcttgttaaacaagaaaatgagaatctccaaattcttgatgtacggacttctgagctaacagaagttagcagaagcaaatttatgacaccatctgcttttatatttctatatgagaaccaattatttcttacatttcgaaaccgaactgtggctgtgtggaacttccgtggagaacttgtaacttcttttgaagatcacctcttgtggcatcctgactgcaatacaaacaacatatacataaccagtgaccaggatctcataatatcatactgcaaggctgattctgatgattcactttctgaagtaaatgcaggttctattaatgtcagcaacattttaactggcaagtgtcttgcaaagataagggccagtaatgggtttcccgttatgaaggaatgcagttgcgttgatgaaaattgctcttgcagtggttgtaatttagggaagcggaagctttcctccagaattaggagtacagttgctgaagccttggaagacattactgctctcttttacgatgaagagcgcaacgagatttatacgggcaataggcacggtctggttcatgtctggtcgaactaatgtactatcaaaatttattattgttttgtttctgattagcatttatccatggttgtggtgatagttctcacttgatataaagtacctttgtgatagctgtaaccattaagtgtcaattgtatcattcttttttttgggggttgttttgtcatccatcccttggtggcaacaaccctgtatcaagtgatactgtatgttggtagctcaccacctgtttaagctgtaatctatatttgcattgatgaaatcaggtctatgtagtgaaatatatgtgaataatgttcaattttctctacccatttctttttggt

SEQ ID NO: 1773 - DNA, 1889 bp, Glycine max
cgaaaagagtttagagtaagcactttgcgaccagcgctctccgaaccctaaatccccgcacgcggtaaaattctcgccggatttaggggtttcccgctctcggtgcggcggaggtttccttcgctcgctgagatatggaaggcggagggaggcggatcacggtgagtcctcggccgtgctgcggccggcgcgtggtggcgaagaagaggccgcgtctggtcgacggattcgtcaacagcgtcaagaagcttcagcgccgcgaaatcagctccaaccgcgaccgcgctttctccatgacggacgcgcaggagaggtttcgcaacattcgtttgcaggaagaatatgatacacatgatccaaaaggtccttcgtctgttgtattgtcatttctgagaaagaggtcaaagataattgagattgtagcagcacgtgacattgtttttgcacttgcacaatccggtgtttgtgctgcatttagccgagagaccaatgaaagaatatgcttcttgaatgtcagtcctgatgaagtcataaggagtttgttttataataaaaataatgactcacttatcacagtctctgtctatgcatcagacagttacagttctttaaaatgccgaagcacaaggatcgaatatataaggagggttaaaccagatgctggctttgctctttttgaatctgagtcattgaaatggccaggttttgtagagtttgatgatgtaaatgggaaggtactcacatactctgcgcaagatagcatatacaaggtgtttgacctgaaaaactattcaatgttgtactccatttcagataaaaatgtacaagagattaagatcagcccagggatcatgttgttgatttttgctaaatcaagtagccatgtccctcttaaaatcctctcaatagaagatggcactgttttgaaatcattcaaccatctccttcatcggaataagaaggtggatttcattgaacaattcaatgaaaagcttcttgttaaacaagaaaatgagaatctccaaattcttgatgtaaggacttttgagctaacagaagttagcagaagtgaattcatgacaccgtctgcatttatatttctatatgagaatcaattattcctgacatttcgaaaccaaactgtggcggtgtggaacttccgtggagaacttgtaacttcttttgaggatcacctcctgtggcatcctgattgcaatacaaacaacatatatataaccagtgaccaggatcttatcatatcatactgcaaggctgattctgatgattcattgtccgaaggaaatggttctattaatgtcagcaacattttaactggcaagtgtcttgcaaagataagagcgagtaatggcttccccatggtgaaggaatgcagttgcagcgatgacaactgttcaagtagtgcttgtaattcagggaaacaaaagcattcctccagaattaggagcacagttgcggaagccttggaagacattactgctctcttctatgatgaagagcgcaacgagatctatacaggcaataggcatggtctggttcatgtctggtctaactgatgcattgttgagtttattcttgtctcgtgttttctcattagtattgatccatgggttgcagtcatagttctctcctgatgtaagaacctttgggagagctgtaaccattaggtgttattgtatcatttatgttttggttgttttgtcatctatgtcttaggcaagtttaatccgtaggtggcagcaaccctgtatcaaagtgatactgtatgttggtacctcaccacaatgtttaagatgtaatctatatttacatttatggagtcggctctatgtagtgaaatatgtgaataaatgttcacttttctctgttca

SEQ ID NO: 1774 - DNA, 1789 bp, Citrus clementina
agaaaatccaaaaaagaaaggaaaaaataaaaaatctcccccgctgcatactaactcacagtggatcgacggagaaaggattcaaattgagtatgaaattgagtgagtgttaagtagaagactcaattttgaggagttgttatagagagagagagagagagggaggaaggggaaatggagggcggcggaggaggagggagaaggatatcggcgagcccaaggccttgtagtggaagaagggttttggcgaagaaacggcgtcgtaattgggccggctttgacggcttcgttaacagcgttaagaaacttcagcgacgcgaaatcagttccaaacgtgaccgtgcgttcactatgacggatgcccaggaaagatttcgcaacattcgtttgcaggaggaatatgatacacatgatccaaaaggccattgttccatggttctgccatttctgaggaagagatcaaagattattgagattgtggcagcacgtgacattgtgtttgcccttgcgcagtctggtgtctgtgcagctttttgtcgagagactaaccagaggatatgctttttaaatgtcactgctgatgaagtcataagaagcttgttttataataagaacaacgactcacttatcacagtttccgtttatgcttcagacaatttcagttctttaagatgcagaagcacgagaatagaatacatacggagaggtaaacctgatgctggttttgccctctttgaatcagagtcactgaagtggcctggttttgtagagtttgatgatgtaaatggaaaggtactcacatattctgcacaggatagtatatacaaggtgtttgacctgaaaaattatacaatgttgtactccatatcagataaaaatgttcaggagattaaaatcagtcctgggatcatgttattgatttttactaaagctagcggccatgttcctcttaagattctttcaatagaggatggaactgttctcaaatcttttaatcaccttcttcatcggaataagaaggtggattttattgaacagttcaatgagaagcttcttgttaagcaagaaaatgagaatctccagattcttgatgttcggaattttgagctgactgaagttagcagaactgaatttatgaccccatcggcatttatatttctatacgagaatcagctattcctgacctttaggaatcgaacagtggctgtttggaactttcgaggcgagcttgtaacgtcgtttgaggatcatctcttgtggcatcctgactgtaacacaaataacatatatataacaagcgatcaagatcttataatctcttactgcaaggctgattccgacgatccattagccgaaggaaatgctgggtcaatcaatatcagcaatatcttgactggaaaatgccttgctaaaataagagcaagcaatggcctccctgcagaaaatgaatgtagttgcagtggtgattatagcagtggcagttgcaacgtgaagaagcatagccatgcctccagaattaggagcacggttgcagaagccttggaagatattactgctttgttctacgatgaagatcgtaatgagatttatactggcaataggcatggcctagttcatgtatggtcaaactgatgattctgatttgttcttgttttgacgaaaagcttatttcaccaatagttcaaatggttgtgctgccgccctggatcaatttcctgaaactgtaccattgaacactcttctaccaatttgttgttctttttgtttatttgatggcctgttcatcttc

SEQ ID NO: 1775 - DNA, 1792 bp, Citrus sinensis
agaaaatcaaaaaagaaaggaaaaaataaaaaatctcccccgctgcatactaactcacagtggatcgacggagaaaggattcaaattgagtatgaaattgagtgagtgttaagtagaagaatcaattttgaggagttgttatagagagagagagagagagagagggaggaaggggaaatggagggcggcggaggaggagggagaaggatatcggcgagcccaaggccttgtagtggaagaagggttttggcgaagaaacggcgtcgtaattgggccggctttgacggcttcgttaacagcgttaagaaacttcagcgacgcgaaatcagttccaaacgtgaccgtgcgttcactatgacggatgcccaggaaagatttcgcaacattcgtttgcaggaggaatatgatacacatgatccaaaaggccattgttccatggttctgccatttctgaggaagagatcaaagattattgagattgtggcggcacgtgacattgtgtttgcccttgcgcagtctggtgtctgtgcagctttttgtcgagagactaaccagaggatatgctttttaaatgtcactgctgatgaagtcataagaagcttgttttataataagaacaacgactcacttatcacagtttcagtttatgcttcagacaatttcagttctttaagatgcagaagcacgagaatagaatacatacggagaggtaaacctgatgctggttttgccctctttgaatcagagtcactgaagtggcctggttttgtagagtttgatgatgtaaatggaaaggtactcacatattctgcacaggatagtatatacaaggtgtttgacctgaaaaattatacaatgttgtactccatatcagataaaaatgttcaggagattaaaatcagtcctgggatcatgttattgatttttactaaagctagcggccatgttcctcttaagattctttcaatagaggatggaactgttctcaaatcttttaatcaccttcttcatcggaataagaaggtggattttattgaacagttcaatgagaagcttcttgttaagcaagaaaatgagaatctccagattcttgatgttcggaattttgagctaactgaagttagcagaactgaatttatgaccccatcggcatttatatttctatacgagaatcagctattcctgacctttaggaatcgaacagtggctgtttggaactttcgaggcgagcttgtaacgtcgtttgaggatcatctcttgtggcatcctgactgtaacacaaataacatatatataacaagcgatcaagatcttataatctcttactgcaaggctgattccgacgatccattagccgaaggaaatgctgggtcaatcaatatcagcaatatcttgactggaaaatgccttgctaaaataagagcaagcaatggcctccctgcagaaaatgaatgtagttgcagtggtgattatagcagtggcagttgcaacgtgaagaagcatagccatgcctccagaattaggagcacggttgcagaagccttggaagatattactgctttgttctacgatgaagatcgtaatgagatttatactggcaataggcatggcctagttcatgtatggtcaaactgatgattctgatttgttcttgttttgacgaaaagcttatttcaccaatagttcaaatggttgtgctgccgccctgtatcaatttcctgaaactgtaccattgaacactcttctaccaatttgttgttctttttgtttatttgatggcctgttcatcttc

SEQ ID NO: 1776 - DNA, 2116 bp, Glycine max
aacaaaaataaaaaataaatcaaaataataaacacataaagaagaaagcgatgatgacttgattaaaataaaaagaaaaaacaccaagacctggtaagatattcaatttctctttattttaatttacatatttataagcgctcgcaaagcagtgagactcgagagacaaagagagagaatccaaattcggatttttgaaacgggatcgactccatttctcttcttcttcttcactgtcacacacactcacacactccttttccatcgtttctccccaccgattcacgaaaccctaatttttttggttcctcttccggggagcgaagatttagggttagattgagctgaggtggcagatgcagcagcatctcctctgagaaaaatggaaggtggcaggagaattacggtgagtcctcgaccttgctgcggccgcagaatcgttgccgcaaagaagagaccgcgtgcgaacgatggcttcgtcaacagcgtcaagaaactccagagacgcgaaatcagctccaagcgtgatcgcgctttcaccatgagcgatgctcaggagagattccggaatattcgcttgcaggaagaatatgatacacatgatccaaaaggtccttcatctatggtgttgcaatttctgagaaaaagatcaaagattattgagattgtagcagcacgcgatattgtttttgctcttgcacaatcaggtgtttgtgcggcatttagccgagagaacaatcaacggatatgctttttgaacgtcagtgctgatgaagttataagaagtctgttttataacaaaaataacgactcacttatcacagtttctgtatatgcttcagacagttacagttctttgaaatgcagaagcacaaggatcgaatatataaggaggggtacaccagatgctggctttgctctttttgaatctgagtctctgaagtggccaggttttgtagagtttgatgatgtaaatgggaaggtattaacatactctgctcaagacagcatatacaaggtatttgacctaaaaaactatacaatgctgtactctatttctgataaaaatgtccaagagattaagatcagcccgggaatcatgttgttgatttatgctaaagcaagtagccatgttccgcttaaaatcctttcaatagaagatggtactgttttgaagtcattcagccatctcctttatcggaataagaaggtagattttattgaacagttcaatgaaaagctactcgtaaagcaagaaaatgagaatctccagattcttgatgttcggacttttgaacacacagaagtttgcagaagtgaatttatgacaccatctgcatttatttttctatatgagaaccaattgttcctgacatttcgaaatcgaactgtggctgtgtggaacttccgtggagagctggtaacttcttttgaggatcacctcttgtggcatcctgactgcaacaccaacaatatatatataaccagtgaccaggatcttatcatatcctactgtaaagctgattctgatgattcattgtctgaaggaaatgcaggttccatcaacgtcagcaacatcttaactggcaagtgtctggccaaaataagagcaagcaacagctttccagtggataacaattgcagttgcagtgacaaaccttctcgtagctattgttgtaattcaaagaagagaaaacatggctccaagatgaggagcacagttgcagaagctttggaagacattactgctctcttctatgatgaagagcgcaatgaaatctatacaggcaacaggcttgggctagttcatgtctggtctaactgatgaatgtagtattgaatttactgttgccctgtgttattcttattggattttcatagtgggtacattgattattctgatctgctattgagaacttttgggggatgtaactataagtgactttgaatcattcaattttttttccttgtcatttacgccttaggcgagtttgttctgtagttgtaagagttgtatgaaaatatgtcggtaactcaccggatgttgcttctgctgtaatctatattttacattaatggagcggcttcgatggaatgtagcatgtgaattatgcca

SEQ ID NO: 1777 - DNA, 2337 bp, Ricinus communis
ggttaatttgggtaggatagaatagtactctctagactcttccatttccttgagttcgggtaattttagttgtactaaaaatttcagggaccaaagggaaatttttaattttctaaattgttccattaatcagttgatttttgacaaagacagacgaatggactatttagcataacgaattcagaatgtagaaatataacagcataatagggcactagttctggaataatatgccaatctgtcatttacgcttcaaataattcatggcttcctcctctagacatgggccaccctgtttttgcagtgttggggctggaaagaatatgggttttgggccgattgcgggaaagagggaattgggaggaatgggccacagctaagccgaaataaagcagtcgatcattgcaatttcatcagcttctttcctgaaaaaataaaaaatcagctttgggtgtaagtggggatttttgaaaacagatcgaaatcgggccatgaaaattctgagtttgaacaagtaggaattattgacaagtagagggtagactagcattttcagttcctaacgactccagtagttaaaagttacagtgcaataagtatcatctgctgttattcctgcgtcgtggagaccagctgcgagaaaaaagcctgaagctttttgatcttgtttgagcaattgcttatgtgattgggtaaaaaagacagaaagaccgatgggtctgatttagtgtttgaaaaagagggaaacggagatggacggaagtaggaagataagcgtgagcccaagaccatgcagtgggaggagggtattagcaaagaaaagaggaataggaggaattgataataagttcgtcaacagtgttaacaaacttcacagaagggaaatctgctccaagcgtcatcgtgccttcaccgtcaccgacgcccaggatcgtttccgtaatatccgtttgcaggaggaatatgatactcatgatccaaaaggtcattgttccatggtattacctttcttgagaaaaaggtcaaagattattgagattgtagcggcacgtgacattgtctttgctcttgcacaatctggtgtttgtgcagcctttaaccgagagaccaatcaaaggatatgctttctgaatgttactcctgatgaagttatacggagcttgttttacaataaaaacaatgactcgcttattacagtttcagcttatgcttcagataattttagttccttgaaatgcagaagcacaaggatcgaatacatacggaggggtaaaccagatgctggctttgctctttttgaatctgagtcactgaaatggccaggttttgtagagtttgatgatgtaaatgggaaagtactcacttattctgcacaggatagtatatacaaggtgtttgacctcaaaaattacacaatgttatattccatatcggataaaaatgttcaagagattaagatcagtccagggatcatgttattgatttttaccaaagctagcagccatgttcctctgaagattctttccattgaggacggtactgttctcaaatctttcaaccatcttcttcatcggaataagaaggtggattttattgaacagttcaatgaaaagcttctagttaagcaagaaaatgaaaatctccagattcttgatgtccgcaactttgagctaacagaagttagcagaactgaatttatgacgccatcagcatttatatttttgtatgagaaccagttatttctaacatttagaaatcgaactgtggctgtgtggaacttccgaggagagcttgtaacttcctttgaagatcaccttttgtggcatcctgattgcaacactaataacatatatattacaagcgatcaagatcttattatttcttactgcaaggctgattctgatgatcacttgtctgaaggaattgcgggttccattaatatcagcaatattttgactggaaaatgccttgctaaaataaaagcaagtaatagcttttccagtgaatgcagttgcagtggaaattttagtggatgctgtaacaaatcaaacaagcatatgcataactcaagaattaggagcacagctgcagaagctttggaagatattactgctctcttctatgatgaggagcgcaatgagatctatactggcaatagacacggcctagttcatgtatggtctaattgatgagttgggttttcctttgtttataaagatgaaaatgagatgattgaatgctccatggatgtaagaattacgtgaagttgtatcattagacgctcttgtaccaattcattgttttttttttttttgccaatttgaattcattgtgttt

SEQ ID NO: 1778 - DNA, 2147 bp, Artemisia annua
tactccgacggggacttttaaaatctcatttcaaattcatcactcacaaccaaaagaccaacaaaacccatgataatctcattctcaacactaggtcccgaaaattagcagacccttttattgcaaacacaaaaaaaatcaaatcttgattgaaattaggctcctttttcttgtttcaagaaattgaatcttgattgcaatttttcataaaaatttctcaaattaatcactcaagatcactagcaatcaaaaacccacatcatttctaatctgggtttcttgaattagggtttcaattgccaaaaaaatcaaatcttgatcaaaattagggtttcagttcaaaattttcatttccaaaattggtcaaattaatcagtcaagaacactcacaatcaaaaacccagatagaatctgatctgggtttttgttaattaggggttttattgcataaaagttgaattttgagtgaaattagggttttgaatttgggggaaatggatgggaggaggataacagcgagtccacggccgtgtaacggacgccgaatagtggcgaagaaacgacgtcgtagtgatgggttagtgaatagtgttaagaagctttataagagggagattagttctaagagagaccgcgggtttagaatgtgtgattctcttgaaaggttcagaaacatcagattgcaggaggagtacgatactcatgatccaaaggggcattgcactatggtattaccgtttcttaagaagcggtcaaaaatcattgaaattgttgccgctcgtgatatagtttttgctctggcacaatctggagtctgtgctgcattcagccgagagactaatcagagaatatgctttctaaacgtcagccctgatgaagttataagaagcttgttttacaataagaacaatgattcactcattacggtctctgtctatgcatcagacagctttagctccttgaaatgcagaacaacacgaatcgaatacatacggagagctcaacctgatgctggttttgctctcttcgagtcagaatctttgaaatggcctggttttgtggagtttgatgatgtgaatggaaaggtgctgaccttctcagcacaggatagtgtttacaaggtgtttgatctgaaaaattatacgttgctatactccatatcggataaaaacgtacaagagatcaaaattagtcctggaatcatgttgttgatatacaacaaagctgttagttatgtccctctcaagattctctcgattgaagatggaactgttttaaaatcattcaatcatctccttcaccgaaacaagaaggtggatttcattgagcaatttaacgagaagcttcttgtcaaacaagaaaatgagaatcttcagattcttgatgtacgcaattttgatgtaactgaagttagcaggacagaatttatgactccatcagcatttatctttttgtatgagaaccaattgttcctaacattcagaaatcgaacagtagctgtatggaacttccgtggggaacttgtgacttcatttgaggatcatttgttgtggcatcctgactgcaacactaacaacatatacatcacaagtgatcaggatcttatcatttcctattgcaaaactgagtctgatgatcccttaacagaaggacatgaaggttctataaatatcagtaacattttgactggaaaatgccttgctaaaatcaaagcaaagaatggtgttcctttggatgagtataattgcggtgagtgtagtggcagaagctgcaaatgcacctcaagaaagcgagtacgagcttccaggattacaagttctgtaacagaagcacttgaggacataacggcccttttctatgatgaagagcgtaatgagatttatactggtaataggtttgggttagttcatgtatggtgtaactaaaagtttggttctaattccccgtgtatgatttgttggtggggatagggtagagccagaatgtgctattattgtaactgttaagtctgtttttttagattttttcctttgggtagacatgttaattgattggttgagtttgttcttgtaaaatgtaaccaggatatgaatttgttatcttttacttgttgaattgaagtgtaaaaggcaaagggtatttatcag

SEQ ID NO: 1779 - DNA, 549 bp, Brassica rapa
gactcacaaacacaagaacacactttttataaactctcaaaccaaacaaaagaagaacaagaagaagaaaaatgctgatggtcaaggccacatgggtgtccattttggccctcgctgcgtttctcctagtggttctagtcccggcggcagaagcggtgacgtgctcgccaatgcagctaagcccatgtgcggcggcgataacctcgtcttctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactatgtgtcgtttgaatcctgcttttcgtatgcgtttgaggatgttaattaaaaatcatacccttaagaataacaacgtgtgatcgatgatacttttatacatcttattttcaatatttttgttgcacgtgacaagggctcatcgtta

SEQ ID NO: 1780 - DNA, 547 bp, Brassica napus
aagagtggtatcaacgcagtagttacgcggggactcacaaacacaagaacacactttttataaactctcaaaccaaacaaaagaagaacaagaagaagaaaaatggtgattgtcaaggccacatgggtgtccattttggccctcgctgcgtttctcctagtggttctagtcccggcggcagaagcggtgacgtgctcgccaatgcagctaagcccatgtgcggcggcgataacgtcgtcatctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactatgtgtcgtttgaatcctgcttttcgtatgcgtttgaggatgttaattaaaaatcatacccttaagaataacaacgtgtgatcgatgatacttttatacatcttattttcaat

SEQ ID NO: 1781 - DNA, 1436 bp, Brassica napus
tggcctatgcattttagactcacaacgtcattgtaagcgaccgatggaaagcaatacaaatgatcttataattattgtatatttgttacatttactgatggcgtcttgaagctgtgtgcccttttccagacttgcaatggctgactcttcttcaaaattttcatttgatcttgctcacgttcctaaaacgttaaccaacatttgatcttgatcattttcctaaacattaaaccaatgtttgatctgcaccttgactgccttgtctctaacatattcaacacagttcccttcagaattagagtatcctctgtctctttctgtcctgactaaagcttcaatctggtccatcattctcataagtcttcatcatcaataaagatctcagcagtattttgattgcaaatcacgggcttggcggtgaactacagtctcttccactaattgtacattgttgcatctcttcttagcttgatatgcaacacttctcatcttatacacaacttccgccaacaaattcattctggtgaagtcgtctcgctgcgaaattgttaaaagcggctttgacggtgatgaatctgcagtaaggaatgatcaagaacccaagcgatatgataacgtaggatgaagacgtcgactgcagctgatcaagatccgtcgtagcagactcgggagctagatgagaaaaattacaaactgtttttaataaaacatgggaactgactatcttctgggttctcaacacctccaccctataaagacagaagtaaaaacagcttcgtcaacctcatcagcaacccttaactcgatagagtatcaagattcaaccttttttaatcaataaacggaaccaaaataatcgtacactcacaaacacaagaacacactttttataaactctcaaaccaaacaaaagaagaacaagaagaagaaaaatgctgatggtcaaggccacatgggtgtccattttggccctcgctgcgtttctcctagtggttctagtcccggcggcagaagcggtgacgtgctcgccaatgcagctaagcccatgtgcggcggcgataacgtcgtcatctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactttgtttgaatcctgcttttggtatgcgtttagggatgttaattaaaaatcatacccttaagaataacactgtgtgatcgatgatgcttttatacatcttattttcaatatttttgttgcacgtgacaagggctcatcgttactaccagcgtctagattcatccttggttcat

SEQ ID NO: 1782 - DNA, 497 bp, Brassica oleracea
agaacacactttttataaactctcaaaccaaacaaaagaagaacaagaagaagaaaaatggtgatggtcaaggccacatgggtgtcccttctggccctcgctgcgtttctcctagtggttctagtcccggcggcagaagcggtgacgtgctcgccaatgcagctaagcccatgtgcggcggcgataacgtcgtcatctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactttgtttgaatcctgcttttggtatgcgtttagggatgttaattaaaaatcatacccttaagaataacactgtgtgatcgatgatgcttttatacatcttattttcaat

SEQ ID NO: 1783 - DNA, 594 bp, Brassica napus
gactcacaaacacaagaacacactttttataaactctcaaaccaaacaaaagaagaacaagaagaagaaaaatggtgatggtcaaggccacatgggtgtcccttctggccctcgctgcgtttctcctagtggttctagtcccggcggcagaagcggtgacgtgctcgccaatgcagctaagcccatgtgcggcggcgataacgtcgtcatctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactttgtttgaatcctgcttttggtatgcgtttagggatgttaattaaaaatcatacccttaagaataacactgtgtgatcgatgatgcttttatacatcttattttcaatatttttgttgcacgtgacaagggctcatcgttactaccagcgtctagattcatctttggttcatgttatttcaccactacagg

SEQ ID NO: 1784 - DNA, 3665 bp, Eutrema parvulum
cccagaatacttttctccttcctcctcctctgttctgttcgactctcaggattgtgataatcgcgatcatcggcatgaaaaaccctcgaattcgatctccggaatctctctgcgaaactatttcgttcatgcctcgtttcagattccgatcataaacctcaactatcccactatccagattcgttctcattttcttcaatggcgtcttcaaattcgcttatggacaccttgttccagcgcagcctcgaggatctgatcaaaggtctacgactccagctactcggagaatcctctttcatttctaaatccctagaagaaatccgccgcgagattaaactgacggatctctccaccaaatccatcgccctccagaaactatcctacctcgccgcactccacggcgtcgatatgacttgggcagcgttccacgccgtggaggtcgtgtcctcatctcgattcgcgcataagaggatcggttaccacgccattgctcagtcgttcaacgatcagactccggttctgcttttgatcacaaaccagctccggaaggatttgaacagttccaacgagtacgaggtgagtctcgctctggaatgtttgtctaggattggaactgatgatctagctagggatttaacctcagaggtttttacgctattgggtagcagtaaagctttcgttaggaaaaaagctatcggtgtggttttgagagttttcgataagtaccctgatgctgtcaaggtatgtttcaagcgtcttgtcgagaatctggagagctctgatccgcagtttctgtcagctgtagtcggagtgttttgtgaactcaccacaaaagatccacgatcttatcttcccttagctcccgaattttacaagcttctggtagattcgaggaacaattgggttctgatcaaggttcttaaaatattttctaatatggctctgatcgagcttaggttggcgaagaaggtggctgatccgatctgtgaacatatgaggaagaatgtgggaaagtctttggcgtttgagtgtatcagaaccgtagttagtagcttgagcgatcaggaaacagctttgaaacttgcggttgcaaagattagggagtttcttgtggacgatgatccaaatctcaagtatctcggtcttcatgccttatcaatggttgctccaaagcatttgtgggcagttttggagaacaaagaagctgtcgtcaaggctctgagcgatgaggatccaaatgttaaactcaaggctttgcatcttttaatggctatggtgaatgaagataatgtgactgagatctctcggattcttatgaattatgcgattaagtctgagcctttgttctgcaacgagattataggttccattctactggcatgctccaggaactcatatgagatcatagttgacttcgattggtatttgtctcttctaggtgaaatcgctagagtcccacattgtcaaagagggaaagatattgagcatcagttaattgatattggtaccagggtcaaagatgctagactggagctcgttcgtgtttctcgagcgctgcttattgatcctgcattgcttggcaatcagttcttgcacccgatattgtcggcagctgcttgggcttcaggagaatatgtcgagttctctaaaatcccttatgagattgcagaggcgcttctgcaaccacgtacttgtctcttaccgccttccattagagcaatctacatacattccgctttcaaagttcttgtcttcagtcttggggcatacttctcaacccaggagcccacttcctctccgttgtctcaggagtctactagctctggcttttcaccagtgaatggtttcacatacaaatctatctcgagtctggtgaatatgattgagttgggattgtgctctttatccggaacccttgacgtggaggtgcaggagagagctaagaacgttctaggattcattggtatgataaagcatgaaatagctgagaaagcaacctcccaagacagtgaaacagaagctcctagagccatagcattcatggaagatgtcttctcagaagagcttgtccctgtttcttcaactgcacaggaaaagattcctctaccagacgggttagagctgaaagagaatcttgaagatctgcaagagatttgcagagaagttctcgaaccaattgccgaatcaaattcaacttttttctcttcctcagacaaaatcatcttctctgttgctaacctcagaataagagatcaacaagaagcctcatcttcattatctcctccgcctgaatccgcatccttactagcagaactcagaaaacgccatggcctgtactatctgtcctctcagaagagcgatgaccacaatgatagcgatggcaacattaacaacacaccaagcgaatacccaccagcgaatgagatatctgtggactcgttcaaacccaagaaaaagatgaaccaatcaaaaccaagacctgtagtggtgaaactggacgaaggagatgaaccaaagagaaagccagactctagtagtaacgatgagcctctgtcacgtgcgatccaaaccgctcttatggggaaagggaaggagaaggaaagagaaaaagacaaccacgagataactcttgaatcgaggatcacagaacagagctcgaaaagagagaagaagacgaagaagaagaatggggagagtagtagtaagcatagatcacgacgacgaagagatgaagaagtaagtgcaacgaaacctgtcgaaataccagatttactcttatgaatactagttggagtttgtgtttctgaccaaacaagatggtgtgctcttgtacagtgattgtcatgtacccataagtgattcttttgtgtttatcaaatatattttcttatattatatcatctcaatgattacaccatcatatacttataacacctctacattgatcataaaccagaacaagacagcaaaacaaagttgaaacaagatgcatacaagcaccatcacacattgttattctcaagggtaccagttactttaactactactcaatgatcattattaacatccttaatcacacaccaaaagtaggattcaaacatatataagatgaccaatatataaataaatagcagacgcttttttttatttcgagttttcttttcaacaccttgggatggggagcttgcagcggttagagactttacgagcgttgggagagctgacgaaccgacggaggctagggtttctcatgtacccacaaaggcaaggcttttgctccttaagcttcgcgcaacacaaagccgatggtggagaagacgacgttatcgccgccgcacatgggcttagctgcattggcgagcacgtcaccgcttctgccgccggaactagaatcacaagaagaactgctgcaatggcgaatatggaaacccatgtggccttgatcatcaccatttttcttcttcttcttcttcttttgtttagtttgagagtttatggaagtgtgttttggtgtttgtggtctttgatatgtctatctcttttctatttatagagagggaaagtgaaagcttttttccttgcaatgttctactttattagtattttttaaagttgttattaagaaatatggattgaaaataattttcaaaatattaatctattaa

SEQ ID NO: 1785 - DNA, 521 bp, Brassica juncea
aagaagaaaaatggtgatgatcaaggcttcatgggtgtcccttttcgccatcgcggcgatcctcctagtgatcctagtcccagcggcagaagcggtgacgtgctccccaatgcagctaagcccatgtgcggcggcgataacgtcgtcttctccaccgtcagcgttgtgctgcgcgaagctgaaggagcagaagccatgcctatgtgggtacatgagaaaccctagcctccgtcgcttcgtcagctctcccaacgctcgtaaagtctctaaccgctgcaagctccccatcccaaggtgttgaatactcaaaaaagcgtttgctatttatggatcatcctatacatgtttgaatcctacttttgttgtgtgtctaaggatgttcattatgatcatgaactagcagttaaagtaagtgttacccttgagaataacaatgtgtgatgatgcttgtatgcatcttttgttgctgtctttattctggtttgatatcaatgtagagagttgtaatcactgagatgata

SEQ ID NO: 1786 - DNA, 662 bp, Brassica rapa
acaaataccagagcacacttccataaactttcagaacaaacaaaagaagaagaagaagaagaaaaatggtgatgatcaaggctacatgggtttccatcttcgccatcgcggcggttctcctagtgattctagccccggcggcagaagcagtgacgtgctcgccaatgcagctaagcccatgtgcgcaggcgataacgtcgtcttctccaccgtcagcgttgtgctgcgcgaagctgaaggaacagaagccatgcctatgtgggtacatgagaaaccctagcctccgtcgcttcgtcagctctcccaacgctcgtaaagtctctaaccgctgcaagctccccatcccaaggtgttgaaaactcaaaaaaccaaacagcgtttgctatttgcgatcatcctatacgtgtttcaatcctacttttggtgtgtgtgtctaagattgttcattatgatcatgaagtagtagtctaaagtaagtgttacccttaagaataacaatgtgtgatgatgcttgtatgcatcttatttcaacttttgtttttgctgtcttattctggtttattatcaactagttttggccccatgctacgcatgggaatattgttttgttacagaaataccaaatttcagttttatataaattgtataatataacttgattt

SEQ ID NO: 1787 - DNA, 622 bp, Brassica napus
gacaaataccagaacacacttccataaactttcagacaaacaaaagaagaagaaaaatggtgatgatcaaggctacatgggtttccatcttcgccatcgcggcggttctcctagtgattctagccccggcggcagaagcagtgacgtgctcgccaatgcagctaagcccatgcgcgcaggcgataacgtcgtcttctccaccgtcagcgttgtgctgcgcgaagctgaaggaacagaagccatgcctatgtgggtacatgagaaaccctagcctccgtcgcttcgtcagctctcccaacgctcgtaaagtctctaaccgctgcaagctccccatcccaaggtgttgaatactcaaagagctaaacagcgtttgctatctgcgatcatcctatacgtgtttcaatcctacttttggtgtgtgtgtctaagtagtagtttaagcaagtgttacccttgagaataacaatgtgtgatgatgcttgtatgcatcttatttcaaccttttgtttttgctgtcttattctggtttaatatcaatgtagagacgtgtaatcaatcattgagatggtatgatataagaaaaaaatattttcataaacacacaaaaaaaaaaaaaaaaaaa

SEQ ID NO: 1788 - DNA, 404 bp, Brassica juncea
acacacttccataaactctcgctgaaaccaaacataagaagaagaaacatggaaatgatcaaggccacatgggtttccattttcgcctttgcggcgattctccttgtgattctagtaccggcggcagaagcggtgacgtgctcgccaatgcagctaagcccatgtgcatcggcaataacgtcgtcttctcaaccttcagcgttgtgctgcgcgaagctgaaggagcagaagccatgcctctgtgggtacatgagaaaccgtagcctccgtcgctttgtcagctctcccaacgctcgtaaagtctctaaccgctgcaagcttcccatcccaaggtgttgaaaactatatatatatatgtgtgtgtgtttgaatcctacttttggtttgtgtttaaggatgttaat

SEQ ID NO: 1789 - DNA, 1306 bp, Raphanus sativus
  misc_feature (680)..(681): n is a, c, g, or t
  misc_feature (1278)..(1278): n is a, c, g, or t
tgataaaaattctttaatgttttcttaggtcgaatgagtcgcgagagttcttaatacacaaacctcgagtttatttaatgtaataatatgaagtttttgatcaaccattcgacgatagaaaatacttattaggctatattatgttattccaatgctaattaactaaaatgataagacgccgcactataagcaagtgcactgcactaagggcgtcattattggttgtccatgatgttgagtccttatgttattatattaatttttttatgttaaggaaaaaattaaggacaacacaaatctatagattattggttagacttctaagaagaggaaagatgatgagaggataaagaaagaaataaataggagaatagtgacgcttcatcacaagccgacaggtagcaagaaggacgagcaaaaaaagaccttaattaagatccgtcccaaaacattacaagcctttttgatttatttttgagcccagaaatgctaaggaccctgcatttggaccccgctaatgttggtctaatagactaatctgtttgaaaattatgttcaatccatatattcttatctgaaattagaaaatactatatagtaaagtagaagtagaacaatgtaacacaaaaacttttaactttccctctctataaatagaaaagagatccacatatcaaaannaacacaaacaccagaacacactccatagactctctctcttaaaccaaacagaagaagaagaaacatggtgatgatcaaggccacatgggtttctattttcgccctcgcggctattctcctagtgatcctagtcccggtggcagaagcggtgacgtgctcgccaatgcagctaagcccatgtgcgtcggcaataacgtcatcttctcaaccttcagcgttgtgctgcaagaagctgaaggagcagaagccatgcttatgtgggtacatgagaaatcctagcctccgtcgcttagtcagctctcccaacgctcgtaaagtctctaaccgctgcaagctccccatcccaaggtgttgaaaactataaaaaggcgttttactatttattatgatcatcctatatatatgtttgaatcctaattttggtttgtgtttaaggatgttaattatgattagtaagcagttgttaaagtaagtgttacccttaagaatgtgtgatgatgcttgtatgcatcttatttcaacttttgtttgttgtcttattctggtttttgatcagtgtagaggtgttataagaatatgatgatgtaatcattgagncaatatgatataaaatatatatttcaca

SEQ ID NO: 1790 - DNA, 563 bp, Raphanus sativus
ggataaacaccacaacacacttctacaaacacactctcaaaccaaacaaaagaagaaaaatggtgatgatcaaggcttcatgggtgtcccttttcgccatcgccgcggttctcctagtgatcctagtcccagctgcagaagcggtgacgtgttcgccaatgcagctgagcccatgtgcccaggcgataacgtcgtcttctccaccgtcagcgttgtgctgcgcgaagctgaaggagcagaagccatgcctatgtgggtacatgagaaacccaagcctccgtcgcttcgtcagctctcccaacgctcgtaaagtctctaaccgctgcaagctccccatcccaaggtgttgaatactccaaaaagccaaaaaccttttgctatttgtaatcatcctccatacgtttgaatcctacttttggtgtgtcataatgatcatgaagttgtagtttaagtaagtgttaccccttgagaataacaatgtgtgatgatgcttatatgcatcttatttcaacttttgtttttgctgtattattctggtttattatcaatgtagaatcgtgtaa

SEQ ID NO: 1791 - DNA, 530 bp, Brassica napus
aaagaagaaaaatggtgatgatcaaggcttcatgggtgtcccttttcgccatcgcggcggttctcctagtgattctagccccggcggcagaagcagtgacgtgctcgccaatgcagctaagcccatgtgcgcaggcgataacgtcgtcttctccaccgtcagcgttgtgctgcgcgaagctgaaggaacagaagccatgcctatgtgggtacatgagaaaccctagcctccgtcgcttcgtcagctctcccaacgctcgtaaagtctctaaccgctgcaagctccccatcccaaggtgttgaatactcaaagagctaaacagcgtttgctatctgcgatcatcctatacgtgtttcaatcctacttttggtgtgtgtgtctaagtagtagtttaagcaagtgttacccttgagaataacaatgtgtgatgatgcttgtatgcatcttatttcaaccttttgtttttgctgtcttattctggtttaatatcaatgtagagacgtgtaatcaatcattgagatggtatgata

SEQ ID NO: 1792 - DNA, 3501 bp, Eutrema halophilum
ctttctccttcctcctcctctgtcccgttcgactttcaggattcagtattgtgaaaatcgcgatcatccgcatggaaaaccctcaattctgatctccgatttcgctctgccagactatttcgaccacgcctcgtttcagcttccgatcataacttcaactctagcagtatccgattcgctctcattttcctcaatgtcgtcgacttcaaattcgctcatggacagcttgttccagcgcagcctcgaggatctgatcaaaggtctacgtctccagatactcggagaatccactttcatttctaagtccctagacgaaatccgccgcgagattaaacagacggatctctccaccaaatccatcgccctccagaaactgtcatacctcgccgcactccacggcgtcgatatgtcctgggcggctttccacgccgtggaagtcgtttcctcatctcgattcgcgcataagaggatcggttaccacgccattgctcagtcgttcaacgatcagacgccggttctgcttctgatcacgaaccagctccgaaaggatttgaacagttccaacgagtacgaggtgagtctcgctcttgaatgtttgtctaggattggaactgatgatctagctagggatttaacccccgaggtttttacgctcttgggtagtggcaaggctttcgttaggaaaaaagctatcggtgtggttctgagagttttcgataagtaccctgatgctgttaaggtatgtttcaagcgtcttgtcgagaatctcgagagctctgatccgcagcttctctcagctgtagtcggagtcttctgtgaactcaccacaaaagatccacgatcttatcttcccttagctcccgagttttacaagattctggtagattcgaggaacaattgggttttgatcaaggttcttaagatattttctaagttggcttcgattgagcctaggttggctaagaaggtggctgatccgatctgtgaacatatgaggaggactgtgggaaagtctttggtgtttgagtgtgttagaaccgtagttagtagcttgagcgatcaggaaacagctttgaaacttgcggtggcaaagattagggagtttcttgtggaagatgacccgaatctcaagtatcttggtcttcatgccttgtcgattgttgctccaaagcatttgtgggcagttttggagaacaaagaagctgttgtcaaggctctgagcgatgaggatccaaatgttaaactcgaggctttgcatcttctaatggcaatggtgaatgaagataatgtgtctgagatctcccggattcttatgaattatgcgctcaagtctgaccctttgttctgcaacgagattattggttccattctactggcatgctccaggaactcatatgagatcatagtagattttgattggtacttgtctcttcttggtgaaatggccagaatcccacattgtcaaaaagggaaagagattgagcatcagttgattgatattggtacgagggtcaaagatgctagactggagctagttcgtgtttctcgagctctgcttattgatcctgcattgcttggtaatcagttcttgcacccgatattgtccgcagctgcttgggctttaggagaatatgtcgagttctctaagaccccttatgagattgcagaggcgcttctacaaccacgtacttgtctcttaccaccttccattagagcaatctacatacattccgctttcaaagttcttgtcttcagtctcggggcatacttctcagccaaagagcccacttcctcgcccttggttcctgagtctactacctctggcttttcatcggtgaatggtttcacatacaaatctatctcgagtctgttgaatatgattgagctgggattgtgctcattatccggaacccttgacgtggaagtgcaggagagagctaagaacgttctaggattcattggtatgataaagcatgaaatagctgagaaagtaacctcccaagacagtgaaacagaagcttctagagccatagcattcatggaagatattttctcagaagagcttggtcctgtttcttcaactgcacaggaaaaaattcctttaccagaggggttagagctcaaagagaatcttgaagatctgcaagagatttgcagagaagttctggaaccaattgacgactcaaagtcaacttctttctctccctcagacaaaattagcttctctattgctaaactcagaatcagagatcaacaagaagcctcatcttcttcatctcctgagcctaaatctgcatacttactcgcagaacacagaaaacgccatggcctgtactatctctcctcccagaagagcgacgaccacaatgatagcaatggcaacaacaacaacaacaacacgctaaacgaatacccaccagcgaatgagatatcggtggactcatttaaccccaagaagaagatgaaccaatcaaaaccgagacctgtagtggtgaaactggacgagggagatgaatcaaagacgaagccagacgctagtagtaacgatgaacctttgtcacgtgcgatccagaccgctctaatggggaaaggaaaagagaaggaaagagaaaaagataaccacgagagagatcttgattcaggggtcaatgaacagagcttgagaagagataaaaagaagaagaaaaacggggagaaacgtagtaaacatagatcaagacgacgaagagatgaagaagtaagtgcaacgaaaccagtcgaaataccagattttctcttatgaatactaagtttggagtttgcgtttctggccaaattaactggatggtgtgtttcttgttcagtgattttcatgtacccataattgattcttttgtgtttatgaaatatatatattctttcttacattatatcgtctcaattattacaccatcatataatattgatcataaaccagaataagaaagcaacaaaaaactgaaataagatgcatacaagcatcatcacacattgttattctcaggggtaccactatcttaaacccctacttaatgatcgtgattaacatccttaaacacaacacacaccaaattaaaagtaggattcaaacataaatagcaaacggtttctgttttttcaacaccttgggatggggagcttgcagcggttagagactttacgagcgttggaagagctgacgaagcgacggaggctagggtttctcatgtacccacacaggcatggcttctgctccttgagcttcgcgcagcacaacgctgatggtggagaagacgacgttatcgccgacgcacatgggcttagctgcattggcgagcacgtcaccgcttctcccgccgggactaggatcactaggagaaccgccgtgagggcgaaaactgaaacccatgtggccttgatgatcatcgccatttttcttcttcttcttcttcttcttcttcttttgtttgtttgagagtttatagaagtgtgttttggtgtgtg

SEQ ID NO: 1793 - DNA, 591 bp, Arabidopsis lyrata
acaccaaaacacatttctataaactcagaaacaaacaaaagatcaagaagaaacatggtgatgatcaagaccacatgggtttccctttttgctctagcgacggttctcctaatgattcttgccccggcggcagaagccgtgacatgctcgccaatgcagctaagcccatgtgcagcggcgataacgtcgtcttctccaccatcggctttgtgctgtgcaaagctgaaggaacagaagccatgcctatgtggttacatgagaaaccctagcctccgtcgcttcgtcagctctcccaacgctcgtaaagtctctaaccgttgcagactccccatcccaaggtgttaaaaaacagaaaagtgtttgctgtttatgatcatcctatatatgtctcaatcctacttttggtgtgtgtttaaggatgtttatttattatctctaagtaatagagctactcttgcgaataacaatgtgtggtgatgctttgtatgcatcttatttcaatttttgctatcttattctggttgttgttgacatatattgtatgatggtgtaataattagtaaaaagaaaatatatttcataaacacaaaa

SEQ ID NO: 1794 - DNA, 550 bp, Brassica napus
caaacataagaagaagaagaaacatggaaatgatcaaggcctcatgggtttccattttcgcctttgcggcgattctccttgtgattatagtaccggcggcagaagcggtgacgtgctcgccaatgcagctaagcccatgtgcatcggcaataacgtcgtcttctcaaccttcagcgttgtgctgcgcgaagttgaaggagcagaagccatgcctctgtgggtacatgagaaaccgtagcctccgtcgctttgtcagctctcccaacgctcgtaaagtctctaaccgctgcaagcttcccatcccaaggtgttgaaaactatatatatgtgtgtgtttgaatcctacttttggtttgtgtttaaggatgttaattatgatcattaagcagtgttatccttgagaataataatgtgtgatgaactgatgatgcttgtatgcatcttatttcaacttttgttcgctgtcttattctggtttttgatcagtgtagaggtgttataagtatgatgatgtaataactgagactatgatataaaatatatatttcat

SEQ ID NO: 1795 - DNA, 560 bp, Brassica napus
actctcgctgaaaccaaacataagaagaagaagaaacatggaaatgatcaaggcctcatgggtttccattttcgcctttgcggcgattctccttgtgattatagtaccggcggcagaagcggtgacgtgctcgccaatgcagctaagcccatgtgcatcggcaataacgtcgtcttctcaaccttcagcgttgtgctgcgcgaagttgaaggagcagaagccatgcctctgtgggtacatgagaaaccgtagcctccgtcgctttgtcagctctcccaacgctcgtaaagtctctaaccgctgcaagcttcccatcccaaggtgttgaaaactatatatatgtgtgtgtttgaatcctacttttggtttgtgtttaaggatgttaattatgatcattaagcagtgttatccttgagaataataatgtgtgatgaactgatgatgcttgtatgcatcttatttcaacttttgtttgctgtcttattctggtttttgatcagtgtagaggtgttataagtatgatgatgtaataactgagactatgatataaaatatatatt

SEQ ID NO: 1796 - DNA, 246 bp, Brassica juncea
gccacatgggtgtccattttggccctcgctgcgtttctcctagtggttctagtcccggcggcagaagcggtgacgtgctcgccaatgcagctaagcccatgtgcatcagcaataacgtcgtcttctcaaccttcagcgttgtgctgcgcgaagctgaaggagcagaagccatgcctatgtgggtacatgagaaaccctagcctccgtcgcttcgtcagctctcccaacgctcgtaaagtctctaac

SEQ ID NO: 1797 - DNA, 1890 bp, Triticum aestivum
cccaatcatcccctccgatttcctcctcgtgtgcccaatctgcacctgctgccgctgctcctccttccacagcttgggattcgtcggattgggctccgttttcccatttcaggcaattagactcgcagagatggacactactgctggctaatagtaaaacgattatatggccaaagatattaaggcaatgcgcaagggaggaaacggtttctacttcatcaataaggagacaagcgctgattcaatcagggaaaacaattccaaaaattctcatcggatggctgatacagcaagaataactaaaacagagacatcaaagttgaagaacgtcatttcagcatcattcaaacccttgtctcttaccattcccataggagacggattccacgaatcgttccattcgagccattgctatttatagtatctactaaggttcataaataagccaaaggttttcagtactattggctaagaaggggaggcaaacattgagctgcttgctgccacattttgcaatggttacaatcgttggtacacgggaacagtttgttcaaccacagacattcctgcgtgctacaatgcagctcaagtccccaacaaggccaaaactttccttctgctttacgccacaaggggattgtgatcaatactgtgctttaatccctggcttgccagaagacctggcaaagatatgtcttgcccttgttcctcgaactcatttccctgtcatgggtggagtttccaagaggtggatgtcattcctggagagcaaagaattaattgctgtaaggaaagaggttcagaagcttgacgagtgtgtgtatgtcttgaccgctgatgctcaagcaaagggttctcattgggaggttttgggatgtcaggggcaaaagaacacccctcttccgcctatgcctggaccaaccaaagctgggtttggtgtggttgtccttgatgggaagctcatcgtcattgctggctatgctgctgaccatggcaaggaatgtgtttctgatgaggtttaccagtatgattgtttcctcaacaggtggaccgccctttctaagatgaatgtcgctcgttgcgacttcgcgtgtgcagaggtcaacggtgtgatatatgtcgctggtggatttggtcccagtggtgatagtttatcaagtgtcgaagtttatgacccagaacaaaataaatggacgttgattgagggccttcgcaggccgagatggggttgctttgggtgtagctttgaaggcaagatgtacgtcatgggtggccgttcgagcttcacaattggtaactcccgttacattgacgtgtacgatacaaatagcaatgcctggggtgagtttaggaatggctgtgtaatggtcacggctcatgctgttcttggtgagaagctcttctgcatcgagtggaagaaccagaggtctctggcgatttttgagccagcagacaattcctggaagaaggttccagtgccgcttactggtagttctagcacgcggttttctctcggtatacatgatgggaagctgctgctcttctcactggaggaagaacccgggtaccagacgctgatgtatgatcctgccgcgccaacaggctctgaatggtgcacgtctaacctcaggccgtcgggacgatgcttgtgtaccgtgaccatcaaagcctgatgctctagctcgggggtcgctgaaggatgataccgaagtttactacctgcctcatcttccgcagttaagatcaggctttgtttggtttatcgtttgctcctacttgctagggtttatatccgcttgttgctccacccaataatagaatgttcatgcttcagttcattcggttgcttgctgacagcggaccttgccataatgtacctctgttctcagt

SEQ ID NO: 1798 - DNA, 2027 bp, Triticum aestivum
ctagtctgagtctcacacggttccacccaccgcctccccaacccaatcatcccctccgatttcctcgtctgcccaatctgcagctgctgccgctgccgctgatccttccgcagcttgggattcgtcggattggcctcctttttccatttcaggcaattagactcgcagagatggacactactgctggctaatagtaaaacgattatatggccaaagatattaaggcaatgcgcaagggaggaaacggtttctacttcatcaataaggagacaagtgctgattcaatcagggaaaacaattccaaaaattctcatcggatggccgatacagcaagaataactaaaacagagacatcaaagttgaagaacatcatttcagcatcattcaaacccttgtctcttaccattcccataggagacggattccacgaatcgttccattcgagccattgctatttatagtatctactaaggttcataagtaagccaaaggttttcagtactattggctaagaaggggaggcaaacattgagtgcaatggttacaatcgttggtacacgggaacagtttgttcaaccacagtcattcctccgtgctacaatgctgctcaagtccccaacaaggcaactttccttctgctttgcgccacaaggggattgcgatcaatactgtgctttaatccctggcttgccagaagacctggcaaagatatgtcttgcccttgttcctcgaactcatttccctgtcatgggtggagtatccaagaggtggatgtcattcctagagagcaaagaattaattgctgtaaggaaagaggttcggaagcttgacgagtgtgtgtacgtcctgaccgctgattctcgagcaaagacttctcattgggagattttgggatgtcaggggcaaaagaacacccctcttccgcctatgcctggaccaaccaaagctgggtttggtgtggttgtccttgatgggaagctcatcgtcattgctggctatgctgctgaccatggcaaggaatgtgtttctgatgaggtttaccagtatgattgtttcctcaacaggtggaccgccctttctaagatgaatgtcgctcgttgcgacttcgcgtgtgcagaggtcaacggtgtgatatatgtcactggtggatttggtcccagtggtgatagtttatcaagtgtcgaagtttatgacccagaacaaaataaatggacgttgatcgggggccttcgcaggccaagatggggttgctttgggtgtagctttgaaggcaagatgtacgtcatgggtggccgttcgagcttcacaattggtaactcccgtttcattgacgtgtacgatacaaatagccatgcctggggtgaatttaggaatggctgtgtgatggtcacggctcatgctgttcttggtgagaagctcttctgcatcgagtggaagaaccagaggtctctggcgattttcgacccagcagacaattcctggcagaaggtcccagtgccgcttactggtagttccagcacgcgtttttctctcgggacacatgatgggaagctgctgctcttctcactggaggaagaacccgggtatcagacgctgatgtatgatcctgccgcgccaaaaggctctgaatggtgcacgtctaagctcaggccatcgggattatgcttgtgcactgtgaccatcaaagcctgacgctctagctcgggggtcactgtaggatgatacctaagtttactacctgcctcatcttccgcagttaagatcaggctttgtttggtttatcatttgctcctacttgctggggtttatatccgcttgttgctccacccaataatagaatgttcatgcttcagttcattcggttgcttgctgacagcgggccttgccataatgtactctgttctcagttgtattgaaatactatctgattatatttttttagactttgaaatagtaggaggggctcctactatgctatattaaattttaatagaatgagtgtgggatatgtatcctcacattggttc

SEQ ID NO: 1799 - DNA, 2129 bp, Brachypodium distachyon
cggatccacattcatctcctccaggcgactcgacgacagctctccgccgtcccgtacctctctcctcttcctctcagtctgacctaccccaacgcggctccaatctctctcctatatagtagtacctcctacacctgccgcctagccgtaccacagcgtctccgccatcaccattcccgttcttcttcgtcgcgacttcgcgttcctgctgcctctatccatccgcaaatctttggcaattgggctttgaggtaattacacttgcagaaatggatgctactgctggctaatagtaataaaatttatatggccaaaggtattaaggaaatgtgtaagggagggaacggtttctacctcatcaataaggaaacaagccttgattcaatcaggataaatcattccaaagcccctcattatcggatggcatttgatacagcaagaataactaaaactgagacatccaagttgaagaacataatttcagcatcattcaaacccttgtctcttaccattcccataggagacggattccacgaatcgttccattcgagccactgccatttatagtagataagatctctaagtaagtcaaaggttttcgtttccattggttacaaggggaggcaaaaattgagctgcttggtgccacattttgcaatgcttacacttgttggtacaagagaacaatttgttcaaccacagacgtgcctgcgtgctaaaatgctgctcaaggctccaacaaggccaaaactttcctcatgctttatgccacaagaggaatgtgatcaatactgtgctttaatacctggcttgccagaagacctggcaaagatatgtcttgcccttgttcctcgatgccacttccctatcatgggtggagtgtccaagaggtggatgtcattcctagagagtaaagaattaattgctgtaaggagggaggttgggaagcttgaggagtgtgtgtatgtcctgaccgctgatgctgaagcaaaggggtctcattgggaggtattggggtgtcctgggcaaaagcacacccctcttccacctatgcctggaccaaccaaagctggctttggcgtggttgtccttgctgggaagctctttgtcattgctggctatgctgctgaccatggcaaggaatgtgtttctgatgaggtttaccaatatgattcttgcctcaacaggtggaccgccctttcgaagatgaatgtggctcgttgtgactttgcatgtgcagaggtcaatggtatgatatatgttgctggtggatttggccccggtggtgatagtttatctagcgtcgaagtttatgacccagaacaaaataaatggacattcattgagaaccttcgcaggccaagatggggctgctttggatgtagctttgatggcaatatgtacgtgatgggaggtcgttcgagcttcacaattggcaattcacgtttcattgacatctacaatactaataaccacacttggggtgaggtcaagaagggctgtgtaatggtcatggcgcatgctgttcttggtgataagctcttctgcatcgaatggaagaaccagaggtcactagcaattttcaacccagaagataattcttggcagaaggtctcagtgccgcttactggtagttctagcactcgttttaatctcgggatacatgatgggaaactgctgctgttctcactggaggaagagcctggatatgagacactgatgtatgaccctgctgcaccaagaggagctgaatggggcacatctaagctcaagccatcaggattatgcctgtgcagtgtgacaataaaagcttgatgatctggcttgtggtcctgaaaggatgtcagtgtatgcttaattgctgttaataccaggtttaccttttgtgtttgctccctacttgctggaatttataccagctttatattccacccaataaaaggatatgaagttcattcttccgttcattcgatttgctgaaagtgagccatgtcataatgtactctgttttcacttgtactgaactatttgatcaaagaacatttcagttttcatttcatgttctcttgctactgcatcacaacaacatgcgtagtagatgtcctggcagtcaagtcagtttacttatc

SEQ ID NO: 1800 - DNA, 2057 bp, Cenchrus ciliaris
  misc_feature (183)..(183): n is a, c, g, or t
  misc_feature (900)..(900): n is a, c, g, or t
  misc_feature (972)..(972): n is a, c, g, or t
  misc_feature (1716)..(1716): n is a, c, g, or t
ccaccgttcgctcaccaaccgtgcccccaagtttcttgtcggctctccttctccaccgccctcctccccctcccctcgatccagatccctccatttcgccgccgccgccgcagcgcctctcccctctcctcccgtggccgtcctcacccccagggacgccgctggtacgtccaggcgggcgtnggtcggttcctcatctcgccgctgattagacttgtataagaaatggatgctactgctggctaattgtgatacagatttatatggacataggtactggggccatgtgtgagggaggaaactgtttctaccttgtcaataaggagagtactgttgattctaccaggaaaatccattccacagactctcgctatcggatggcatttgatacagcaagggtaacgaaaacagagacatcaaagttgaagaacatcatttcggcatcattcaaacccttgtctctgaccattcccataggcgacggattccacgaatcctaccctttcagccattgccatttatagtagacaaggtctttaagtaagccaaggattttattcctattggtttgcaaggaggcaaacattgaggtgcttcctactgcatctcataatgcttgcaattgttgggtcacaagaacacttttctcagtcacagacgtgcctgcgtgcaaggatgcagctcaagcctccaacaagacccaaactttattcagggcttatgccccatgaggatcatgattcatactgtgatctaataccaggcttgcctgaagacttggcaaagatatgtcttgcccttgttcctcgtagtcattttcctgttatgggtgcagtttctaagcggtggatgtcatttcttgagagcaaggaactaatagctgtaaggaaggaggttggnaaacttgaggagtgggtgtatgtcttaactccagaagctggcacaaaggggtcgcactgggagattttggantgttcagggcagacgcaaagccctcttccacgtatgcctggactaaccaaggcaggatttggtgtggttgttattggtgggaagctctttgttattgctggctatgctgctgaccatgggaaggaatatgtttcggatgaggtttaccagtttgatacttgcctcaacaggtggactttgcttgctaagatgaatgtggctcgatgtgacttcgcctgcgcagaggtcaatggtgtgatatatgttgctggtggatttggtccgaatggtgacagtctgtctagtgttgaagtttatgacccagaacagaatagatggacattgattgagagcttgcgcaggccaaggtggggctgctttgggtgcagttttgaagggaagctttatgtcatgggtggccgttcaagcttcacaataggcaactctcgttttgttgacgtgtacaatcctatcaaccatgcctggggagagtttaagaatggctgtgtgatggtcacggctcatgccgttcttggtgagaagctcttctgcattgaatggaagaaccagaggtctctggcaatctttaacccagccgataactcgtggcagaaggtcccggtgccccttacaggaagctcaagcactcgtttttcattgggtatacatgatgacaagctgctgctcttcccattggacgaagagcccggctatcagacactgatgtatgatcctgctgcgccgacggggtctgagtggtgcacntcaaagttgaaaccctcggggtcttgcctgtgcagcgtgaccgtcaaagcctgatgatgccctagagcgtgtaggtggtagcagattactatccttataggatggatcctgcttttgcttccttgtttagtgttcagatgaggctgtctttggttggcctcatgtgcactcttgtttgctcactacttttattcactcgttgcactcttagataataatttgacatttatgtgtcagttaattgaattccgtcatttcgcctgtattgaactctggttctggctatggagccttcaattgatatggtctttttgctgttcaaacacattgttacagctgca

SEQ ID NO: 1801 - DNA, 2045 bp, Setaria italica
gccgctggtccgtccgggccggcttgggttggttcctcctctcgccggtgattagacttgtataagaaatggatgctactgctggctaattgtgatacaaacttatatggacataggtattggggccatgtgtgagggaggaaactgtttctaccttgtcaataaggagagtactgttgattctaccaggaaagtccattccacagactctcactatcggatggcatctgatacagcaagggtaacgaaaacagagacatcaaagttgaagaacatcatttcggcatcattcaagcccttgtccctgaccgttcccataggcgacggattccacgaatccttccctttcagccattgccatttatagtagacaaggtctttaagtaagccaagggtttttattcctattggtttgcaagaggaggcgaacattgaggtgcttcctactaaatctcataatgcttgcatttgttgggtcacaagaacagttttctcaatcacagacgtgcctacgtgcgaggatgctgctcaagcctcctacaagacccaaactttattcagggcttatgccccaagaggaacgtgattcatactgtgatctaataccaggcttgcctgaagacttggcaaagatatgtcttgcccttgttcctcgtagtcattttcctgttatgggcgcagtttccaagcggtggatgtcatttcttgagagcaaggaactaatagctgtaaggaaggaggttgggaaacttgaggagtgggtgtatgtattaactccagaagctggcacaaaggggtcgcactgggagattttggagtgttcagggcagacgcaaagccctcttccgcgaatgcctggactaaccaaggcaggatttggtgtggttgttattggtgggaagctctttgttattgctggatatgctgctgaccatgggaaggaatatgtttcggatgaggtttaccagtatgattcttgcctcaacaggtggactttgcttgctaagatgaatgtggctcgatgtgacttcgcctgtgcagaggtcaatggtgtgatatatgttgctggtggatttggtccaaatggtgacaatttgtctagtgtcgaagtttatgacccagaacagaatagatggacactgattgagagcctgcgcaggccaaggtggggctgctttgggtgcagttttgaagggaagctttttgtcatgggtggccgttcaagcttcacaattggcaactctcgtttcgttgacgtgtacaatcctatcaaccacgcctggggagaggttaagaatggctgcgtgatggtcacggctcatgccgttcttggtgagaagctcttctgcattgaatggaagaaccagaggtccctggcgatctttaacccagctgataactcgtggcagaaaatcccggtgccgcttacaggtagctcaagaactcgtttttcattgggtatacatgacgacaagctgctgctcttcccattggaggaagagcccgggtatcagacgctgatgtatgatcccgctgcgccaacgggttctgagtggtgcacgtcaaagctgaagccctcggggtcttgtctgtgcagcgtgaccatcaaagcctaatgatgccctggagcgcacatgtggtggcagtttactatccttataggatgggatcctgcttctttcctcgcttagtgttcagatgaggcccgtctttggttggcctcatgttcactcttgtttgcttataactttcattcactcgttgcactcttaaacaataatttgacatttatgcgtcagttcattgaattgctgtagcgccatgatgtattctcatttcacctgtattgaactctgattctggccatagggccatcaattgataaggtctcttttgctgttcacccacattctgacagtagatagctgtgttcatagctgctgctcagttagtcggttgtaatggttcatggttgcattgtggctagcaaactggtttgcttatatcaagtctacgctatttcttgtgctaatttcacgggcctg

SEQ ID NO: 1802 - DNA, 2237 bp, Setaria italica
gccgttttcactcctggcggcagctctcctataaatttattatccagctcaacccgtgccaacccggcccgtgttcatccaccgttcgctcaccaaccgtgccccaagtttctcctccaccgccctcccctcgatccagatccctccatttcgccgccgccgcgcctctcccctctcctcccgtggccgtcctcatccccggggcgccgctggtccgtccgggccggcttgggttggttcctcctctcgccggtgattagacttgtataagaaatggatgctactgctggctaattgtgatacaaacttatatggacataggtattggggccatgtgtgagggaggaaactgtttctaccttgtcaataaggagagtactgttgattctaccaggaaagtccattccacagactctcactatcggatggcatctgatacagcaagggtaacgaaaacagagacatcaaagttgaagaacatcatttcggcatcattcaagcccttgtccctgaccgttcccataggcgacggattccacgaatccttccctttcagccattgccatttatagtagacaaggtctttaagtaagccaagggtttttattcctattggtttgcaagaggaggcgaacattgaggtgcttcctactaaatctcataatgcttgcatttgttgggtcacaagaacagttttctcaatcacagacgtgcctacgtgcgaggatgctgctcaagcctcctacaagacccaaactttattcagggcttatgccccaagaggaacgtgattcatactgtgatctaataccaggcttgcctgaagacttggcaaagatatgtcttgcccttgttcctcgtagtcattttcctgttatgggcgcagtttccaagcggtggatgtcatttcttgagagcaaggaactaatagctgtaaggaaggaggttgggaaacttgaggagtgggtgtatgtattaactccagaagctggcacaaaggggtcgcactgggagattttggagtgttcagggcagacgcaaagccctcttccgcgaatgcctggactaaccaaggcaggatttggtgtggttgttattggtgggaagctctttgttattgctggatatgctgctgaccatgggaaggaatatgtttcggatgaggtttaccagtatgattcttgcctcaacaggtggactttgcttgctaagatgaatgtggctcgatgtgacttcgcctgtgcagaggtcaatggtgtgatatatgttgctggtggatttggtccaaatggtgacaatttgtctagtgtcgaagtttatgacccagaacagaatagatggacactgattgagagcctgcgcaggccaaggtggggctgctttgggtgcagttttgaagggaagctttttgtcatgggtggccgttcaagcttcacaattggcaactctcgtttcgttgacgtgtacaatcctatcaaccacgcctggggagaggttaagaatggctgcgtgatggtcacggctcatgccgttcttggtgagaagctcttctgcattgaatggaagaaccagaggtccctggcgatctttaacccagctgataactcgtggcagaaaatcccggtgccgcttacaggtagctcaagaactcgtttttcattgggtatacatgacgacaagctgctgctcttcccattggaggaagagcccgggtatcagacgctgatgtatgatcccgctgcgccaacgggttctgagtggtgcacgtcaaagctgaagccctcggggtcttgtctgtgcagcgtgaccatcaaagcctaatgatgccctggagcgcacatgtggtggcagtttactatccttataggatgggatcctgcttctttcctcgcttagtgttcagatgaggcccgtctttggttggcctcatgttcactcttgtttgcttataactttcattcactcgttgcactcttaaacaataatttgacatttatgcgtcagttcattgaattgctgtagcgccatgatgtattctcatttcacctgtattgaactctgattctggccatagggccatcaattgataaggtctcttttgctgttcacccacattctgacagtagatagctgtgttcatagctgctgctcagttagtcggttgtaatggttcatggttgcattgtggctagcaaactggtttgcttatatcaagtctacgctatttcttgtgctaa

SEQ ID NO: 1803 - DNA, 2150 bp, Oryza sativa
acgtcagagatcagacacccacctctccacctccctcctctcctctcctatcgtccccacgcgcactccaacttgcgggcgatttgttttcccccgatttcctctcgtccgatccctccccatcacgaggccggagcgccaccccacactgcctccgctgctcccaaggtgattaaaaacacagaaaatggatggaactgctggctaacagtcgtcaaaatttatatggccatagataattgtgcgatgtgtgtgggaggtaaaggtttctacctcaacagtaaggagacttccgacccttcaaggaaaaaccattccaaagtctctcagtatcggatggcatttgatgcaccaagaattactaaaacagagacatcaaagttgaagaacctcatttcagcatcattcaaacccttgtctcttaccatccccataggcgacggtttccatgaattgtttcctgtgggtcactgtcatttatagcagataaagtcttatagataagccaaagtttttcatttctgttggctaacaaggggaggcaaaaattgagttgcgctctcaagagtgtacaatgcttacacttgttggcacaagagattcttttgctcagtcacaggcacaactttgtgctggcatgcagctcaaggctccaacaagggcgaaatattcccaaggctttatgcccataggagaatccgacgcatactgtgctctaatacctggcttacctgaagatctcgcaaagatatgtcttgctcttgttcctcggagccagttccctgttatgggttcagtgtccaagaggtggatgtcattcctcgagagtaaggaattcattgctgtaaggaaagaggttgggaagcttgaggagtgggtgtatgtcctgactgctgatgctggatcaaaggggtcccattgggaagttttggggtgttcagggcaaaagcacagccctcttccacccatgcctgggccaaccaaagctggttttggtgtggttgttctagatggaaagcttttcgttattgctggctatgctgctgatcatgggaaggagtgtgtttctgatgaggtttaccgatacgattcttgcctaaacaggtgggttgagctttctaagatgaatgtggctcgttgtgactttgcttgtgcagaggtcaacggtatgatatatgttgctggtgggtttggtcccaatggtgatagtttatctagtgttgaagtttatgacgcagaacagaataagtggacattgattgagagccttcgccgtccaaggtggggctgctttgcgtgcagctttgaaggcaaattgtatgtcatgggcggtcgttcgcgcttcacaattggtaacacgcgttttgttgacgtgtacaatcctaatgacaactcctggggtgaggtgaagaatggttgtgtaatggtcacagcccatgctgttcttgacaaaaagctcttctgcatcgagtggaagaaccagaggtcactcgcagtcttcaacccggctgataattcttggcagaaagtcccagtgccactcacaggtagttctagtactcgtttttgtttcggcatacatgatgggaagctgctgctgttctctctggatgaagagccctgctataagacactgatgtatgatcccgctgcaccaacgggatcagagtggttcacatctgagctcaagccaccaggattatgtctgtgcagtgtgaccatcagagcctgatgctttctggcttgtatcgccttaccatcatccttgtaggatgccatccgataccactatttactgcttacaatcagagttgaactctcatttccagtgtcgtttgctcaggtattttgatatcaaataatgctccagggtgcttatgctgcattcattcgattgcagcgttgtgccaggatgcactttgtttcatgtattttactgctagttgtagttcacatggttgttgtcgttgtactggacgatgaatagctgataggctgatatgcaactgtagtgtttgtggcgggcaaagaggctaattgtcagaaaagatttgtcagctcttgctgtatgtaaaccttgttgtctgaaacattgtcattcgctatttctgatgctctgtttttccatatgaaaagtgggttcttgcttc

SEQ ID NO: 1804 - DNA, 2158 bp, Panicum virgatum
cctcaccaaccgtgcccatcgaacccccaaagtttctgtcggctctcctccatcgccctcccctcgatccagatccctccatttcgccgccgccgccgcgcctctcccctcccgtgggcgtcctcatccccgggacgccgctggtccatccgggcggccttgggtcggttcctcctcacgccgctgattagacttagaaaatggatgctactgctggctaattgtgatacagatttatatggacataggtattggggccatgtgtgagggaggaaactgtttctaccttgtcaataaggagagtactgttgattctatcaggaaaaaccgttccacagtctctcaatatcggatggcatttgagacagcaagggtaacgaaaacagagacatcaaagttgaagaacatcatttcggcatcattcaagcccttgtctctgaccattcccataggcgacggattccacgaatccttccctttcagccattgtcatttatagtagacaagatcttttaagtaggccaagggttcttattcctattggtttgcaagaggaggcgaacattgaggtgcttcctagtgcatctcataaagtcataatgcttgcatttgttgggtcacaagaacagtttgctcaacgtccgacgtgcctccatgctaggatgctgctcaagcctcctacaagacccaaactttactcagggctaatgcccgaagaggaacacgattcgtactctgatttaataccaggcttgcctgaagatttggcaaagatatgtcttgcccttgttcctcgtagtcattttcctgttatgggtgcagtttccaagcggtggatgtcatttcttgagagcaaggagttaatagctgtaaggaaggaggttgggaaacttgaggagtgggtgtatgtcttaactccagaagcaggcacaaaggggtcccactggcagattttggagtgttcagggcaaacacaaagccctcttccgcgtatgcctggactaaccaaagctgggtttggtgtggttgttattggtgggaagctctttgttattgctggctatgctgctgaccatggaaaggaatatgtttcagatgaggtgtaccagtatgattcttgcctcaacaggtggactttgcttgctaagatgaatgtggctcgatgtgacttcgcctgcgcagaggtcaatggggtgatatatgttgccggtggatttggtccaaatggtgacaatttgtctagtgtcgaagtttatgacccagaacagaatagatggacactgattgagagcctgcgcaggccaagatggggttgcttcgggtgcagcttcgaagggaagctttatgtcatgggtggccgttcaagcttcacaattggcaactcccgtttcgttgacgtgtacaatcctatcaaccatgcctggggtgagtttaagaacggctgtgtgatggtcacggctcatgccgttcttggtgagaagctcttctgcatcgaatggaagaaccagaggtctttggcaatctttaacccagccgataactcgtggcagaagatcccggtgccgcttacaggtagctcaagcactcgtttttcattgggtgtacatgacgacaagctgctgctcttcccgctggaggaagagcctgggtatcagacgctgatgtatgatcccgctgcgccgccggggtctgagtggtgcacgtcaaagctgaagccctcaggatcttgcctatgcagtgtgaccatcaaagcatgatgatgccctagagtgcgaaggtggtggcagtttaccgtccttgaggatggaatcctgcttggttcctcttcagtattcttggtgaggcccggctttggttggcctcatgtgcaatcttgtttgcttacaacttttattggctcgttgcatcccaaacaataatttgacagttatgtgtcggttcattgaattgccatagcaccatgatgtgttcttacctcacttgtattgaactctagttctggccatagggccttccattgataattgtcattttgctgttcacccacgttataacagcaggcagctgtgttcgtagctgctgctcagttgtaatagttcatggttgcattgtggcaagcaaaatggttatcagtctatgttatttgttgtgccaagtt

SEQ ID NO: 1805 - DNA, 1664 bp, Pennisetum glaucum
gtaacgaaaacagagacatcaaagttgaagaacgtcatttcagcatcattcaaacccttgtccctgaccgttcctataggcgacggattccacgaatccttccctttcagccattgccatttatagtagatagggtctttaagtaagccaagggtttttattcctattggtttgcaagaggagaacattgaggtgcttcctcctgcatctcagaatgctcgcatttgttgggtcacaagagcaatttgctcaatcacagacgtgcctacgtgcgaggatgcatctcaagcctccaacaaaacccaaactttattcagggcttatgccccacgaggaacacgattcatactgtgatctaataccaggcttgcctgaagacttggcaaagatatgtcttgcccttgttcctcgttgtcattttcctgttatgggtgcagtttccaagcggtggatgtcatttcttgagagcaaggaactaatagctgtaaggaaggaggttgggaaacttgaggagtgggtgtatgtcttaactccagaagctggcacaaaggggtcgcactgggagattttggagggttcagggcagacgcaaagccctcttccacgaatgcctggattaaccaaggcaggatttggtgtggttgttattggtgggaagctctttgttattgctggctatgctgctgaccatgggaaggaatatgtttcggatgaggtttaccagtatgatacttgcctcaacaggtggactttgcttgctaagatgaatgtggctcgatgtgacttcgcctgcgcagaggtcaatggtgtgatatatgttgctggtggatttggtctgaatggtgacagtttgtctagtgttgaagtttatgacccagaacagaatagatggacattggttgagagcttgcgcaggccgaggtggggctgcttcgggtgcagttttgaagggaagctttatgtcatgggtggccgttcaagcttcacaattggcaactctcgttttgttgacgtgtacaatcctaccaaccatgcctggggagaggttaagaatggctgtgtgatggtcacagctcatgccgttcttggtgagaagctcttctgcattgaatggaagaaccagaggtctctggcaatctttaacccagctgataactcgtggcagaagatcccggtgccacttacaggcagctcaagcactcgtttttcattgggcgtacatgatgacaagctgctgctcttcccgttggcggaagagcccgggtatcagacactgatgtatgatcccgctgcaccagtgggttctgagtggtgtacgtcaaagctgaagccctcgggatcttgtctgtgcagcgtgaccatcaaagcctaatgatgccatatagcatgtgtggtggcactttacgatccttacagggtggggtcttgctttcctcgtttagtgttcagatgaggcctgtctttggatggcctcatgtgcactctttttttgcttacaacttttattcactcgttgcactcctgaagaataattgacattcgtgtcagttcattgaattgttgtagcgccatgatgtattctcgccatgatgtattctcatctcacctgtattgaactctggttatagccatagggccatcaattgataaggtcttctttgctg

SEQ ID NO: 1806 - DNA, 2228 bp, Sorghum bicolor
atcagacaagtctctacagcctccatccagcacggaccccgcggcctgcctccctctccttcttctcccacccccagcccagcgtgcgcattctctctctctctctctccctcaatctcggcggcgactgggcgaccgaccaaccgtcgctgccctacgccaggtgccaccaaggtcttcttcgggcccttcgccggcgacgagcaccaccaggcaattagacttgcgtgagaaatggatgctactgctggttaattgtgatacggatttatatggacatagatattggggccatgtgtaagggcggaaactgtttctaccgcgtcaataaggagagctctgctgattctacaaggaagatccattccgcagtctctcacgatcggatggcatttgatacagcaagggcaacgaaaacagaggcatcaaagttgaagaacctaatctcggcatcattcaaacccttgtctctgaccattcccatcggcgacgggttccacgaatccttccctttcagccattgtcatttatagtagagaagggtctataagtaagccaaggttttttgttcttgttggcttgcgagaggaggccaaggttgaggtgctttctgctgcatctcataatgcttgctgtgtcacaagaacatcttgctcattcacagacgtgcttccgagcaaggatgcaactcaagcctcctacaagacccaaactctattcagggctcatgccccaggaggaattcgattcatactgtgatctaataccaggcttgcctgaagacttggcaaagatatgtcttgcccttgttcctcgtactcattttcctgtcatgggtgcagtttccaagaggtggatgtcatttcttgagagcaaggaactcatagctgtgaggaaggaggttgggaaacttgaggagtgggtgtatgtcttgactccagatgctggcgcaaaggggtcgcactgggagatcctagagtgttcagggcaaaagcagagccctcttccgcgtatgcctggactaaccaaagctgggttcggtgtggttgttattggtgggaagctctttattattgctggctattccgctgaccatgggaaagattgtgtttcagatgaggtttatcaatatgattcttgccttaacaggtggactgttcttgctaagatgaatgtagctcggtgtgactttgcctgtgcagaggtcaatggggtgatatatgttgctggcggatttggtccaaatggcgagagtttatctagcgtcgaagtttatgatctagaacagaataaatggacactgattgagggcctacggagaccacggtggggctgcttcgggtgcagctttgaagggaagctctatgtcatgggtggccgttcaagcttcacaattggcaactcccgttttgttgacgtgtacaatcctaataaccatgcctgggaccaggtcaagaacggctgtgtgatggtcacggctcatgcagtcctcggcgagaagctcttctgcatcgagtggaagaaccagaggtctctagcaatcttcaacccggctgacaactcctggcagaaggtccccgtgccgcttactggtagctcaagcactcgtttttcctttggggtacatgaggacaagctgctgctcttccctctggaggaagagcctgggtatcagacgctgatgtatgatcctgcagctccgatggggtctgagtggtgcacatcgaagctgaagccatcaggttcttgcctgtgcagcgtgaccatcaaagcctgatgatgcccttgaatgcgtgggatgcggcagttttagagttcttcatataggatggaatcccgcttgccttcatattttagagttcagatgaggctggctttgtttggtctcaagtgcaatcttgtttcttcaaattttagtttgtgtgtcgcatcgacaaataatgaataggacatttatgtttcagttcattgagttgctgaagcgtcatgatgtattctcatttcacctgtattgaactctggccgtttgggtcttgggttgatttgatcttttttgctggcactcacatgataacgacagcgtggtgttgtcaactgatgctcagtagaaaggtttatgttgttggacatgattaagtagttgccttttcttatttgcagctgaaagtatagcccgcgctcaaatttcattaatgagatgcaggattaagattctggagcagacagtt

SEQ ID NO: 1807 - DNA, 5478 bp, Avena sativa
tctctctcttctccatcgtcccttgcaccttagcttaaacccgtatcctctatccattttcctaactgttggagtggagcgagggtagcagcaataatggcccccaaggccggccgcggcaagggcaggggcggcggcaagggcgaccgcaagaagaaggaggagaaagtggtgccgagtgtgctagacgtcacggtcaccaccccctacgaatcccaggtgacactcaaggggatatcgacggatcgcgtgctggacgtgaggaagctgctggggtcgaacgtggagacgtgtcacctcacaaactattcactctcccacgtggtgcgcggtcatcggctggacgacggcgtggaaatcgtggcgctgaaaccctgcgctctgaccatcgccgaagaggagtacgcgacggaggaggccgcggtggcgcacgtccgccgcctgctggacattgtcgcctgcaccaccgcgttcgccaagcagaagcacaaaacatcggccaagcacgcccgccccgcgacgcctccgtctccccccacagcctcttcccccgcggccaatggcggcaaaggcgccggcgatgcgcccgcgatatcggaggcgcacgacatggcggccatcgggccgccgccgaagctcggcgagttctacgacttcttctccttcgcccacctcacaccgcccctccactttatcaggaggaaggagaggaatggcgctacccaggaaggagatttcttcgaaatcgaggtgaaggtttgcaacgggaagctactgcacatagttgcttcggtcaagggtttctatctggtggggaagccgcacaccgtgagccgatccttggttgaccttctacagcagcttagcaccggatttgccaatgcatacgaggcactgatgaaagcttttgtggatcacaacaagttcgggaatctaccgttcggcttccgtgcaaacacatggcttgttcctcctgtatatgtggatgctgctacaaagagcccagcattgcctgttgaggatgagaactggggtgggcatggaggtggttgcggacgagatggaaaatatgacaggagacggtgggcaaaagaattttctattctggctagaatgccatgtaaaacagaggaagagagggtgatcagagaccgcaaggctttccttttacacaatctatttgtagatacagcgattttcagagctgcttcgacaatacggcgactggttgatactagtccacaaaccggttctgatggttcgttagtatttgaggaacgtgttggggacatgcatatgactgtaaagaaggatgaggctgatgccagtttgaagttgggggataaagttgatggagctgccgtctaccagacggattctatggatatatcacaaaggaatcttctgaaaggtttaacttctgatgagagtgttgttgttaaggactcttccacgctaggtgtggtgattgttaagcattgtggatatacggcaacagtgagggtttcgggacgtacaaaaattatcggtgatagcaaacaagccagtgatatctctgatcatcttgatggaatgcttagcatcgatgtagatgatcaacccgatggaggttcaaatgccttgaatgttaacagtctaagaataccactgccaaaaattatgaacccagaagtggctgccagtaaccagcatcttacctctaaatctcatgttgataattatgcgagaaaactagcacggacagtacttaaagccagcttgatgaagctagagaacttgccgaacaagaatcctagacatatcagatgggaacttgggtcttcctggctgcaacacttgcagaaaaaagattcttcagtttctgaggatagtgagaagagcgcaaaaaaagtagaaaaagattcatctgtcaaaggtcttggcaagcacttcgaacagttaaggaaaattaaaaagaatgctgaagatgctaagtctgagaaggaagaatctgatagcaactgctcgctgacaaatggtatggaagaatcagataatttagcacttaacgaaaccagtgaggctgaaataaggaagctgattccagaagatgctttctgtcgcctggagagtttgggagctggctttcatcagaagacccttgatgagctcacaaagatggcccataagttttatgatgatactgcactcccaaagctggtggctgattttgcttcccttgaactttctccagtagatggaagaaccatgactgatttcatgcacacaaggggacttaatatgtgttcattaggccgtgtggtagagctagcagagaagctcccacacatccagtcaatatgcatacatgaaatggtcattcgatcatttaagcatgtcattcgagctgttattgcagctgtcgatgacatgcaaaatatgtctgcagttatagctgagactttaaacattttactgggatctccaagattagacaataatcttgatacagatgcccataatgagcataacttaaagctgaaatggatagagagcttcctatctaaaagatactgttggaaattgaaagatgaatttgaacacttgcggaagtccatcattttgagaggcctttgcggcaaggttggccttgagttggttgcaagagattatgatatgaatagcccaaacccatttgacaaatctgacatcgtcaacctagttcctatatgcaagcatgtcgtctactcatctattgatagtagaaacttactagaatcatcaaagatggctttggataaaggaaagcttgatgatgctgttaactatggagcaaaagcactgtccaaagttatagcagtttgtggtccataccaccggctaactgctaatgcctacagtcttcttgctgtggttctttaccatactggagattttaatcaggcaacaatatatcagcaaaaggcacttgatatcaatgaaagggagcttggtcttgaccatccggaaacaatgaagagctacggggatttatctgttttctactaccgtctccaacacattgagatggctctgaagtatgtcaaccgtgcactttatctacttcaattctcctgtgggctttctcatccaaattcagctgccacatacataaatgtggctatgatggaagaaggtatgggaaatgttcatgttgctctaaggtatttgcatgaagcgctaaagtgcaataaaagattgcttggagctgatcacatacagactgctgcaagctaccatgccatagccatagccctctccatgatggatgcatactccctaagcgtgcaacatgaacaaaccaccttacagatacttcaggacaagctaggagaagatgaccttcgaactcaggatgctgctgcttggctggagtattttgattcaaaagcattagaacaacaagaggctgctcggagaggcattccaaaacctgattcttctattgcaagtaaaggacatcttagtgtatcagatctacttgactacataagcccggaccaggaaagaaaagagagggatatgcaaaggaagtgcaggcgtgcaaagaataataccagagcccaacagggtgaatcagttgacgaaaaggagaacttccagcatgactcagtatttcttcttgaagcagacaaaaatgatatccaagaagcaaaactggaagtgcaggctcctgtagtagcagcagtaacagaagcaatttatgctgtccatgatgagctgaaacaggtagatgctttgtcacctgaagagtattctgatgagggttggcaagcagctactttgagagggaggtctgcaaatgtgcggaagaaaagcatccgcagaaggccagctctcactaaattagtcgttgatcacatagaagatggccgcactgcttctgccaccaggactggtgtacagcaacaaacaaaagagcacaaagaggaagctatatactcccctagccaactgtcatttggcaacttcttgaaaagtgacaagttgaatggggatccttccattactgaagacaagtctagtaatgctatgtcgaagccagaaaggagcataaaacctgcaggaattaacaggccaaccagcatagcttccaagttggtatcatacaaagatgtggcagcgtcaccgcctggcaccgtatggaaaccaattttggaacagaaggaagcaaaggagaaggatattgaacaagatactgatgtaacaccctcatctgaggaagaagataggaagcttacagatgaagttgagaagtctagtgaagagggcagcaaagagatagtctcaagtcagccagagggaggcagtcattcagagaaagcttctgacagcaatagtgacggaagcacatctccacacaagaaaacaagtggaagcaaactttcagcttcagcacctccattcaatcctggatcactcttatcagtgtcccatccttacagcacagtggcaatctatgatgctagtgttgttcttcagccaatcccaagtcaagcaatggagattcttcctcatgctgttgatactagagtacctcgtggtcctcgatccaccttgtactatcgtactgggcattctttccaaaggaagcagggctatacacagagccagagcactattctgaggggtagcacctcccctccagccatgaatccccatgctgccgagtttgtgcctggaaaaactgcgcaacaaactgattcggctaacggggaacatgtcactgattcagcagagcagcagttggcaccacagacttcagaggaagtgaaagtcgatattcatgccgcagagaaagcaggacaattggagaagacaacttcaggtaaagggaaggaaaacagagggagagacacgatgcgagattcatacaaagcagagctagcaaggcagattcttctcagtttcattgtcaagtcagtgcatgacagtctaggttcgacccgagctcaaccggatagaaagccaagtgtactggatgaagccagtattgaacagagcagcaacgtgactaagtctacctcaggtggtcgcaaggagttcgataaacaaccgaaggccgccgaggtgccaaaaagcgacaaggatacagagggctttacagtagtttcgaaacgcagaagaagcaagcaacacttcgtgaatcccataaatggcctctactctcagcagtcaatctgcacttcggtcagctgagggatgctgcatttcctgagacgtgcaatatgttgggagatagtattgcttactttgctcttaggcgcttggtagcagatttttgtcctatccagaggagcgagcatctagtcaaaactgtacaaagttttctgtaatctccttttctaataattttttgtaacatggggtagcagtggtgctgaataaaatgttttatttccccttcttatgtatgctgtacatgacagaatcatatactagcatatataatagaaaaat

SEQ ID NO: 1808 - DNA, 5523 bp, Avena sativa
cctcctcctcctcctccttcttcctcatcccccctctctctcttctccatcgtcccttgcaccttagcttaaacccgtatcctctatccattttcctaactgttggagtggagcgagggtagcagcaataatggcccccaaggccggccgcggcaagggcaggggcggcggcaagggcgaccgcaagaagaaggaggagaaagtggtgccgagtgtgctagacgtcacggtcaccaccccctacgaatcccaggtgacactcaaggggatatcgacggatcgcgtgctggacgtgaggaagctgctggggtcgaacgtggagacgtgtcacctcacaaactattcactctcccacgtggtgcgcggtcatcggctggacgacggcgtggaaatcgtggcgctgaaaccctgcgctctgaccatcgccgaagaggagtacgcgacggaggaggccgcggtggcgcacgtccgccgcctgctggacattgtcgcctgcaccaccgcgttcgccaagcagaagcacaaaacatcggccaagcacgcccgccccgcgacgcctccgtctccccccacagcctcttcccccgcggccaatggcggcaaaggcgccggcgatgcgcccgcgatatcggaggcgcacgacatggcggccatcgggccgccgccgaagctcggcgagttctacgacttcttctctttcgcccacctcacaccgcccctccactttatcaggaggaaggagaggaatggcgctacccaggaaggagatttcttcgaaatcgaggtgaaggtttgcaacgggaagctactgcacatagttgcttcggtcaagggtttctatctggtggggaagccgcacaccgtgagccgatccttggttgaccttctacagcagcttagcaccggatttgccaatgcatacgaggcactgatgaaagcttttgtggatcacaacaagttcgggaatctaccgttcggcttccgtgcaaacacatggcttgttcctcctgtatatgtggatgctgctacaaagagcccagcattgcctgttgaggatgagaactggggtgggcatggaggtggttgcggacgagatggaaaatatgacaggagacggtgggcaaaagaattttctattctggctagaatgccatgtaaaacagaggaagagagggtgatcagagaccgcaaggctttccttttacacaatctatttgtagatacagcgattttcagagctgcttcgacaatacggcgactggttgatactagtccacaaaccggttctgatggttcgttagtatttgaggaacgtgttggggacatgcatatgactgtaaagaaggatgaggctgatgccagtttgaagttgggggataaagttgatggagctgccgtctaccagacggattctatggatatatcacaaaggaatcttctgaaaggtttaacttctgatgagagtgttgttgttaaggactcttccacgctaggtgtggtgattgttaagcattgtggatatacggcaacagtgagggtttcgggacgtacaaaaattatcggtgatagcaaacaagccagtgatatctctgatcatcttgatggaatgcttagcatcgatgtagatgatcaacccgatggaggttcaaatgccttgaatgttaacagtctaagaataccactgccaaaaattatgaacccagaagtggctgccagtaaccagcatcttacctctaaatctcatgttgataattatgcgagaaaactagcacggacagtacttaaagccagcttgatgaagctagagaacttgccgaacaagaatcctagacatatcagatgggaacttgggtcttcctggctgcaacacttgcagaaaaaagattcttcagtttctgaggatagtgagaagagcgcaaaaaaagttagaaaaagattcatctgtcaaaggtcttggcaagcacttcgaacagttaaggaaaattaaaaagaatgctgaagatgctaagtctgagaaggaagaatctgatagcaactgctcgctgacaaatggtatggaagaatcagataatttagcacttaacgaaaccagtgaggctgaaataaggaagctgattccagaagatgctttctgtcgcctggagagtttgggagctggctttcatcagaagacccttgatgagctcacaaagatggcccataagttttatgatgatactgcactcccaaagctggtggctgattttgcttcccttgaactttctccagtagatggaagaaccatgactgatttcatgcacacaaggggacttaatatgtgttcattaggccgtgtggtagagctagcagagaagctcccacacatccagtcaatatgcatacatgaaatggtcattcgatcatttaagcatgtcattcgagctgttattgcagctgtcgatgacatgcaaaatatgtctgcagttatagctgagactttaaacattttactgggatctccaagattagacaataatcttgatacagatgcccataatgagcataacttaaagctgaaatggatagagagcttcctatctaaaagatactgttggaaattgaaagatgaatttgaacacttgcggaagtccatcattttgagaggcctttgcggcaaggttggccttgagttggttgcaagagattatgatatgaatagcccaaacccatttgacaaatctgacatcgtcaacctagttcctatatgcaagcatgtcgtctactcatctattgatagtagaaacttactagaatcatcaaagatggctttggataaaggaaagcttgatgatgctgttaactatggagcaaaagcactgtccaaagttatagcagtttgtggtccataccaccggctaactgctaatgcctacagtcttcttgctgtggttctttaccatactggagattttaatcaggcaacaatatatcagcaaaaggcacttgatatcaatgaaagggagcttggtcttgaccatccggaaacaatgaagagctacggggatttatctgttttctactaccgtctccaacacattgagatggctctgaagtatgtcaaccgtgcactttatctacttcaattctcctgtgggctttctcatccaaattcagctgccacatacataaatgtggctatgatggaagaaggtatgggaaatgttcatgttgctctaaggtatttgcatgaagcgctaaagtgcaataaaagattgcttggagctgatcacatacagactgctgcaagctaccatgccatagccatagccctctccatgatggatgcatactccctaagcgtgcaacatgaacaaaccaccttacagatacttcaggacaagctaggagaagatgaccttcgaactcaggatgctgctgcttggctggagtattttgattcaaaagcattagaacaacaagaggctgctcggagaggcattccaaaacctgattcttctattgcaagtaaaggacatcttagtgtatcagatctacttgactacataagcccggaccaggaaagaaaagagagggatatgcaaaggaagtgcaggcgtgcaaagaataataccagagcccaacagggtgaatcagttgacgaaaaggagaacttccagcatgactcagtatttcttcttgaagcagacaaaaatgatatccaagaagcaaaactggaagtgcaggctcctgtagtagcagcagtaacagaagcaatttatgctgtccatgatgagctgaaacaggtagatgctttgtcacctgaagagtattctgatgagggttggcaagcagctactttgagagggaggtctgcaaatgtgcggaagaaaagcatccgcagaaggccagctctcactaaattagtcgttgatcacatagaagatggccgcactgcttctgccaccaggactggtgtacagcaacaaacaaaagagcacaaagaggaagctatatactcccctagccaactgtcatttggcaacttcttgaaaagtgacaagttgaatggggatccttccattactgaagacaagtctagtaatgctatgtcgaagccagaaaggagcataaaacctgcaggaattaacaggccaaccagcatagcttccaagttggtatcatacaaagatgtggcagcgtcaccgcctggcaccgtatggaaaccaattttggaacagaaggaagcaaaggagaaggatattgaacaagatactgatgtaacaccctcatctgaggaagaagataggaagcttacagatgaagttgagaagtctagtgaagagggcagcaaagagatagtctcaagtcagccagagggaggcagtcattcagagaaagcttctgacagcaatagtgacggaagcacatctccacacaagaaaacaagtggaagcaaactttcagcttcagcacctccattcaatcctggatcactcttatcagtgtcccatccttacagcacagtggcaatctatgatgctagtgttgttcttcagccaatcccaagtcaagcaatggagattcttcctcatgctgttgatactagagtacctcgtggtcctcgatccaccttgtactatcgtactgggcattctttccaaaggaagcagggctatacacagagccagagcactattctgaggggtagcacctcccctccagccatgaatccccatgctgccgagtttgtgcctggaaaaactgcgcaacaaactgattcggctaacggggaacatgtcactgattcagcagagcagcagttggcaccacagacttcagaggaagtgaaagtcgatattcatgccgcagagaaagcaggacaattggagaagacaacttcaggtaaagggaaggaaaacagagggagagacacgatgcgagattcatacaaagcagagctagcaaggcagattcttctcagtttcattgtcaagtcagtgcatgacagtctaggttcgacccgagctcaaccggatagaaagccaagtgtactggatgaagccagtattgaacagagcagcaacgtgactaagtctacctcaggtggtcgcaaggagttcgataaacaaccgaaggccgccgaggtgccaaaaagcgacaaggatacagagggctttacagtagtttcgaaacgcagaagaagcaagcaacacttcgtgaatcccataaatggcctctactctcagcagtcaatctgcacttcggtcagctgagggatgctgcatttcctgagacgtgcaatatgttgggagatagtattgcttactttgctcttaggcgcttggtagcagatttttgtcctatccagaggagcgagcatctagtcaaaactgtacaaagttttctgtaatctccttttctaataattttttgtaacatggggtagcagtggtgctgaataaaatgttttatttccccttcttatgtatgctgtacatgacagaatcatatactagcatatataatagaaaaatattcatttga

SEQ ID NO: 1809 - DNA, 5042 bp, Triticum aestivum
tggcgtcggcgccggcgaggcgcccgcgatttcggaggcgcacgacatgcaggccatcggcccgccgcccaagctcggcgagttctacgacttcttctccttcgcccacctcaccccgcccctccactttatcaggaggaaggagaggaacggcgctgcccaggacggcgattacttcgaaatcgaggtgaaggtttgcaacgggaagcttctgcacataatttcctcggtcaagggattctacctggtggggaagccgcacaccgtgagccggtccctggtggacctgctacagcagctcagcagtggatttgccaatgcgtacgaggcactgatgaaagcttttgtggaccacaacaagtttgggaatctaccgttcggctttcgtgcaaacacatggcttgttcctcctgtatatgtggactctgctacaaagagcccagctttgccggctgaggatgagaactggggtggcaatggaggtggctgcggacgagatggaaaacatgaccggagacggtgggcaagagaattttctattttggctagaatgccatccaagaccgaggaagagagggtgatcagagaccggaaggctttccttttacacaatctgtttgtagatacagcgattttcagagctgcgtcgacaatacggcggctggttgatactagtccacaaactggtccggatggttcgttagtacttgaggaacgtgttggggacttgcatataactgtaaagaaggatgaggctgatgctagtttgaagttggaggacaaagttgacagagttgccatctaccagacggatgctatggatatatcacaaagaaatcttctgaaaggcttaacttctgatgagagtgttgttgctaaggactcttccacgctaggtgtggtgattgttaagcattgcggatatacggcaacagtgaaggtttcgggacgcacaaagaacagcagcgatggcaaacaaaccagtgatatctctgatcatcttgatgaaatacctaacatcgatgtggatgatcatcctgatggaggttctaatgccttgaatcctcacagtctaagaataccactgccgaaaattatcaacccagaaatcgttgccagtaaccagcaccttgcatctaaaccacatgttgataattatgcgaggaaactagcatgtacagtacttgaaaccagcttgaggaaactggagaacaccccgaacaaaaatcctagacgtatcaggtgggaacttgggtcctcctggctccagcacttccagaaaaaagatgcttccatttctgaggacagtgagaagaatgcaaaaaaatctgaaaaagattcatctgtcaaaggtctcggcaagcactttgaacaattaagaaaaattaataagaaagaaagcactattgaagatgctaagactgttaaggaagaatctgatagcaactgcctgctgacaaatggtacggagaagtctgaaaatgtagtatttaccgaaataaggaacctgattacagaggatgctttctgccgcttgaagagtttggaagctggccttcatcaaaagtcccttgaagagctcacaaagatggcccataagttctatgatgatactgcactcccaaagctggtggctgattttgcttcccttgaactttctccagtggatggaagaacgatgactgatttcatgcatacaaggggactaaatatgtgctcattaggccgtttggtagagctaggagagaagctcccacacatccagtcaatatgcatccatgaaatggtcattcgagcctttaagcacgtcattcgagctgttattgcagctgttgatgacatgcaaaatatgtctgcggttatagccgagactttgaacattttactgggatctccaagattagaaaatgatcttgatacagatgctaatgagcataacttgcggctgaaatgggtagagagcttcctttctaaaagatactgctggacactgaaagatgaatttgcgcacttgcggaagcccatcattctgagaggcctttgcagcaaggttggccttgagttagtcgcaagagattatgatatgaatagcccaaacccgtttgacaaatccgacattgtcaacatagttcctatatgcaagcatgtcgtctactcatctattgatagtcgaaacttactagaatcatcaaagatggctttggataaaggaaagcttgatgatgctgttaactatggagcaaaggccttgtccaaagttatagctgtttgtggtccataccatcggctgactgctaatgcatacagtcttcttgctgtagttctttaccatactggagattttaatcaggcaactatatatcaacagaaggcacttgatatcaatgaaagggagcttggtcttgaccatccggaaactatgaagagctatggtgatttgtcagttttctactaccgtctccaacacattgagatggctctgaagtatgtcaaccgtgcactttatctacttcaattttcttgtgggctttcacatccaaattcagctgccacctacataaatgtggctatgatggaagaaggtatgggaaatgttcatgttgctctaaggtatttgcatgaagcgctaaaatgcaacaagagattgcttggagctgatcacatacagactgctgcaagctaccatgccatagccatagccctctccatgatggatgcgtactccctaagcgtgcaacatgaacaaaccaccttacagatacttcaggagaaactaggagacgatgaccttcgaactcaggatgctgctgcttggctagagtatttcgattcaaaagcattagaacaacaagaggccgctcgcagaggaatcccaaaacctgattcttctattgcaagtaaagggcatcttagtgtatcagatctacttgactacataagcccggatcaggaaagaaaagagagggatatgcaaaagaagtgcaggcgtgcaaagaataataccagagcacaccaaggtgaaccagttgaagagaaggagaactttcagcatgactcaggatctcttcttgaagcagacaaaaaggattttcaagaagcaaaactggaagcaaaccctcgtgtagtagcagcagtagcagaagaaacttatgctgtccatgatgagctgaagcaggtagatactttgtcacctgaagagtattctgatgaaggttggcaagcagctacattgaaagggagatctgcaaatgtgcggaagaaaagcatccgcagaaggtcatctctcaccaaattagtggttgatcgtacagaagatggccgcactgcttctgctcataggagtggtgtacaaccacaagcaaaagagcataaagaggaagctgtaaactcccctagccaactatcatttggcaactttatcagaagtgacaaattgaatggggatcccgtcattaccgaagagaagtcttctaagggtacgtctaaatcggaatggaaggtaaagcccacaggaatcaagaggccaactagcatagcttcaaagctggtatcatacaaagatgtggcagtgtcaccgcctggcacagtgtggaaaccaattttggaacagaaggaaacaaaggagaaggataacgaacaagatactgatgtagcaccttcatccgaggaaggagatagaaagcttatagatgaagagaaggagaagtcaagtgatgagagcagcaaagagaatgtctcaactcagccagagggaagcagtcccccagagccagagaaagcttctgacagcaatagtgacggaagctcatctccgggcaagaaaacaagtggaagcaaactttcagcctcagcacctccattcaaacctggatcactcttatcagtgtcccatccttacagcacagtggcaatatatgatgccagcgttgtgcttcagccaatcccaagtcaagcaatggagattctccctcatgctgtcgatactagagtaccccgtggtcctcggtccaccttgtactatcgtactggacattctttccaaaggaaacagggttatacacagagccagagcactattctgaggggcagcacctcccctccaaccatgaacccccatgctgctgagtttgtgcctggaaaaactgtgcaacaaactgatttggctgcaggggaacaaactaattctgtaagtgatccagcagatcagcagttggcatcacatgcctcagatggagtgaaagtcgatgttcgtgaggcagacaaggcaggtcaagtggagaagacaactccaggtaaagtgaaggaacgagcgaaagaggcgacgagagattcatacaaagcagaacttgcaaggcagattctgctcagcttcattgtcaagtcggtccatgacagcttaggttcgactcgacctcaaccggacagaaaaccaagcgggtcagatgaagctagtaacgaacagagcagcaacgtaaccaagaccgccgtaagtccgaaagagttcgacaaacaaccgaaggccgccgaggtgcccaagagcgagaaggatacagaggggtttacagtagtctcaaagcgtaggaaaagcaagcagcacttcgtgaaccccataaacggtctctactctcagcagtcaatctgcacttcggtcagctgagaggttgctgcgctccctgagacctgcaagcagtgcaatgtgttggaagatggtattgcttactttgctcttattaggcgcttggtagcagagttttgccctatattcagatgaacgagcatgttgtcaaactgtacaaagttttccgccgtccccttttccaataatttttttgtaatttgaggtagcagaataaaatggtttcccctccttcctatggatgtactatgttattatgacagaattataggatatagtagcaaacattcatttctttcaacactccaatggtgctcctgaatttgctttgatgatttgcacttgtcaagttgccgctgcagaaagttttgccctatccagatgaacgagcatagtcaaactatac

SEQ ID NO: 1810 - DNA, 5468 bp, Brachypodium distachyon
gcaatggcccccaaggccggccgtggcaagggcaagggcggcaaaggcgacaggaagaagaaggaagagaaagccgtgccgaatgccatagacgtcacggttacaaccccgtatgagtcccaggttacactcaaggggatatcgacggatcgcgtgctggacgtgaggaggctgctgggctcgaacgtggagacttgtcacctgacaaactattcactctcccatgtggtaatgcttctcgaccgtccccttctttttcccttcgtgctaacactgaacggtccaggcgcgagggcatcggctggaggacggcgtggaaatcgtggcgctgaagccttgcgctctcacgatcgtggaagcccaaagagaactattaattcggccatggtgctaactgggcccaacaattgcttttacgcagatgagtacgcgacggaggaggccgcggtggcgcacatccgccggctgctggacatcgtcgcctgcaccaccgcgttcgccaagccccgcgacggcgccaagcacaagcagtccaagcacgggcccccggcgacgccgccatcaccccccgcggccaatggcgacagcggcgccgccgtcgccgccgcggcgtccgcgatatcggaggcgcacgacatggcggccatcgggccgccgccgaagctcggcgggttctacgatttcttctccttcgcccacctcaccccgcccctccactttatcaggaggaaggagatgaatgcttctgctcaggaaggcgattacttcgatatcgaggtgaaggtttgcaacgggaagcttctgcatgttgtgtcttcagtcaagggtttttacctggcagggaagcctcacaccgtaagccgatccttggtggacttgctgcaacagctcagcagtggatttgccaatgcatacgaggcactgatgaaagcttttgtggatcacaacaagtttgggaatctaccatacgggtttcgtgcaaacacatggcttgttcctcctatatatgtcgactctgctacaaagtccccagcattgcctgttgaggatgagaactggggtggacatggaggtggctgtggacgagacggaaaatatgacaggagacggtgggcgaaagagttcactattttggctaggatgccatgcaaaactgaggaagagagggtgatcagagaccggaaggctttccttttgcacaatctttttgtggatacagcgattatcagagctgcatcgacgatacggcgactcattggtactagtccgcaaactagtcccgatggtttgttagtacttgatgaacgtataggggacttgcatataactgtaaacaaggatgaggctgatgctagtttgaagttggaggacaaagttgatggagttgccgtctaccaaacgggtgatatggatatatcacaaagaaatcttctgaaaggtttaacttctgatgagagtgtcgttgcaaaggattcatccacacttggagttgtgattgttaagcactgtggatatacagcaacagtgaaggtttcaggacgcacaaagaactgtagtgatgacaaacaaaccagtgatatctctgatcatctggatggatttctgaacatcgatgtagatgatcatccagatggaggttctaatgcccttaatgttaacagtctaagaataccactgccaaaaattgtcaacgcagatattgctgccagtaatcagcatcttgcctcaaagtcccatgccgataattatgcgaggaaactagcacgtacagtacttgaatccagcttgatgaagcttgagaacacaccgaacaaaaatcctagacttatcagatgggaacttgggtcctcctggctgcaacacttgcagaaaaaggattcttctgtttctgagaacggtgaaaagaatgctaaaaaggctgaaaaagatccatctgtcaaaggtctcggcaagcactttgaacagttaaggaaaattaaaaagaaagaatgcattgttgaaggtgcgaagtccgataaggaagaatctgacagtaattactcgctagcaaatggtatggaagaatcagataatgtagcatttagcaaaaccaataaggaggctgatatgagaaagctgattccagaggacgccttttgtcgcttgaagagtttgggagctggtttccatcaaaagtcccttgaagagctcacaaagatggcccacaagttttatgatgacactgcactcccaaagctggttgctgattttgcttcccttgaactttctccagtggatggaagaaccatgaccgatttcatgcatacaaggggacttaatatgtgctcattaggccgtgtggttgagctagcagagaagctcccacacatccagtcaatatgtatccatgaaatggtgattcgatcctttaagcatgtcattcgagctgttattgcagctgttgatgacatgcaaaatatgtctgccgctatagccgagactttgaacattttactgggatctccaagactagaaaatgatcttcattcagatgcccataatgagcataagttgcgattgaaatgggtagagagcttcctttctaaaagatactgttggaaattgaaagatgaatttgcacacttgcggaagtccattattctgagagggctttgcagcaaggctggccttgagttggttgcaagagattatgatatgaatagcccaaacccgtttgacaaatccgacattgtcaacatagttcctgtatgcaagcatgttgtctactcatctatcgatagtcgaaacttactagaatcatcaaagatggctttggataaaggaaagcttgatgatgctgtcaactatggagcaaaggctttgtcgaaagttatagcagtttgtggtccataccatcgtctgactgctaatgcatacagtcttcttgctgtagttctttaccatactggagattttaatcaggcaactatatatcaacagaaggcacttgatatcaatgaaagggagctaggtcttgatcatcccgaaactatgaagagctatggggatttatcagttttctactaccgcctccaacacattgagatggctctgaagtatgtcaaccgtgcactatatctacttcaattttcttgcgggctttcacatccaaattcagctgccacctacataaatgtggctatgatggaagaaggtatgggaaatgttcatgttgctctcaggtatttgcatgaagcactgaagtgcaacaagagattactcggagctgatcacatacagactgctgcaagctaccatgcaatagccatagccctctccatgatggatgcatacaccctaagcgtgcaacatgaacaaaccaccttacagatccttcaggagaaacttggagaagatgaccttcgaactcaggatgctgctgcttggctggagtatttcgattcaaaagcattagagcaacaagaggctgctcgaagaggcatccccaaacctgattcatctattgcaagtaaaggacatcttagtgtatcagatctacttgactacataagcccggaccaggaaagaaaagagagggatatgcaacggaagtgcaggcgtgcaaagaataataccagagcccatcagggtgaatcagttgaagaaaaggagaattcccagcatgattcaggatctcttcaagcagacaaaaaggatttccaagaaacaaaactggaagtgcacactcctgtagtagcagaacaaattcaaattcatgctgtgcatgatgagctgaagcaggcagatactttgtcacctgaagaatattctgatgaaggttggcaagcagctactttgagaggaagatctgcaaatgtacggaagaaaagcatccgcagaaagccatctctcagtaagttagtggttgatcgcgttgaagatggtcatactgcttctgcttataggactggtgtacagccacaaacaaaaggagataaagaggaggccataaactcccctagccaactctcatttggtaacttcttcaagagtgacaagttgagcggggatactgccactattgaagacatgctttgcaaagctaaatctaaaccagaacggagcataaagcctccaggaatcaacaggccaactaacatagcttccaagttggtgtcatacaaagatgtggcagtgtcaccccctggcacagtgtggaaaccaattttggaaaagaaggaagcaaaggagaaggataatggacaatgtactgatgtagtactgccatctgagaaagaagataagaagcttacagatgaagagaaggaaaagctaggtagtgagagcagcaaagaggttgtctcaagtcagactgagggagttggccatgcagagaaagcgcctgacagcaacagtgatgaaagcccatctccacagaagaaagcaaatggaagcaaactttcagcttcagcgcctccattcaatccgggatcgctgttatcagtgtcccatccttacagcacagtggcaatatatgatgcaagtgttcttcttcagccaattccaagtcaagcaatggagattctccctcacgctgttgatactagagtacctcgtggtcctcggtccaccttgtactaccgtactgggcattctttccagaggaaacagggttatacacagagccagagcactattcagaggggtagcacctcaccaccagccatgaatcctcatgctgccgagtttgtgcctggaaaatctttgccacaaactgatgtggctaatggagagcatacttccacaactgattcagcagatcagcacttggcatcacaggcctcagatgaagtgaaggttgatattcctgccgcagataaggcaggggaaacggagaacacaactccaggtaaagggaaggaaaacagggggagagatgcgatgagagattcatacaaagcagagctggcgaggcagattctgctcagtttcatcgtcaagtcagtgcatgatagtttaggttcaactagagctcaaccagacagaaaaccaattgggtcagaggaaggtagtaaagaacaaatcagcaacataaccaagacagtctcaggccgcaaggaagtcgacaaacaaccgaaggccgccgaggcaccaaaaagcgagaaggatacagagggttttacagtagtttcaaaacgtagaagaagcaagcagcacttcgtgactcccattaatggtctctactctcagcagtcgattgccacttcagtcagctgaggttgctgcacttttgtgagatctgcagtatgttggaagatggtgttgcttactttgctcttaggtgcttggtagcagagttttgccctatccagatgagcaaccattcatgttgccaaactgtacaaagttttccgtaatccccttttctaataaacttttgtaatttgaaatagcagtagtgctgaataaaatgtttttttttctgcttc

SEQ ID NO: 1811 - DNA, 2606 bp, Brassica napus
tcttcctcttcttcttcttctccctcgtctctcctcttaccgaacatcaatttccattccacaaccactcgttccgtttcaatccctggaatcttcctgcctagaaaccgcttgagatacagtcacaatctcccgcttcgaatcagagcctccagagacgataatgtcgcagtggaagatcgtggaaacgcagtgatcaacggaaacggaagcgtacgtctaaacggcaacggagctacgagaaaatccatcaacaacggagacttaaacggaaacggccgtttaaacggtaacggtagtttggtgaagtacgtgaacggaagcgtaacggaggaagtgtcgaagaagagagaagaagaaaagaggcagaagagagtagaagacatcggtcaagaggatgcttggtttaagaaaactcaacagaaacaacaagtcgaggtttctgttgcacctggtggtcgatggagtaggttcaagacttactcaacgatccaaagatcattggagatttgggggtttgttataacgtttatcttcaggacatggttaagcggtcaaaagttttcttacaaagggggaatgactgaggagaagaaggttttgagaaggaaggttttggctaagtggttgaaggaaaacatattgagattaggtcctacttttattaaaattggtcagcagttctctaccagagtggacattcttcctcaagaatatgttgatcaattgtctgaacttcaggatcaagttcctccgttctcttctgctacggctttatcaattgttgaggaggagcttggagcatctgttgatgacattttcgaccgttttgattatgaacccatagctgctgctagtcttggccaagttcaccgtgcaagattgaagggtcaagaggttgtcattaaagtacagagacccggtctcaaggatctttttgatatcgatcttaaaaattgagggtgattgctgagtatctccaaaaggtggatccaaaatcagatggtgcaaagagagattgggttgcaatttacgatgaatgtgccagtgtcctgtaccaggaaattgattacacaaaggaggcagcgaattcggagttgtttgctaataacttcaaaaacttagagtatgttaaagttccatccatctactgggagtacaccacacctcaggtcctgacaatggagtatgtccctgggattaaaattaacaaaatacaagccttagatcagttaggtgttgatcgaaaaaggctagggagatatgctgttgaatcttaccttgagcagatcttgtctcatggattctttcatgccgaccctcaccctgggaatattgcggttgatgatgtcaacggtgggcggctgatattttacgactttggaatgatgggaagtatcagcccaaatattagagaaggtttactggaggccttctatggtgtttatgagaaggaccccgataaggtcattcaagcaatggttcaaatgggtgtgcttgtacctactggagatttgacatctatcagaagaacagcactgttttttctcaacagtttcgaagagcggcttgctgcacaaagaaaggagaaagaagaactagcagcagcagaagagcttgggttcaagaagccactaaccaaagaggaaaagcaagagaaaaagaagcaacggttggctgcaatcggagaagacttattagccatttcagctgaccaacctttccggttccctgccacattcacatttgttgttagagccttttcagtattggatggcatcggcaaaggtcttgaccctcgctttgatataacggagattgcaaaaccatatgctttggaattgctacggttccgggaagctggagtagaagttgtagtgaaggacctgaggaagagatgggacagacaatcacaagcattctacaatgtatttagacaagctgatagagttgaaaagctagctttaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgctttcttcagcctccaggttctgattggagttataaaagtcaagaagttcgaccaacgtgaaaaactgatcactgggacagcttaaaagaaatcttgtttgatgtattaaaaaaacttcttcagtctccataaaatcttttgtgctaagaagccacaaaggtttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattgggcattttatcaacagagccacttgtaatggtgtgtagagatgtagacattaggtcaactttttcgtcaaaatatatgtatatatactactcgttacatgcctcgaaaaaaaaaaaaaactagaga

SEQ ID NO: 1812 - DNA, 2790 bp, Eutrema halophilum
tgggttcctccagagcctctaaacctctatgcaaagtgccaacaaacaaagtcttcttcttcaaatctcttcttaccttccacgcaaataatccatgaaaaagttgtaggctttgattagagatctcttccgcgcgactacaatcaatggcgacttcttcttcttcctcctcatcgtcgtctctcctcttaccgaacatcaatttccattccagacaatctacaatcactcgttccatttcaatccccggaatttttctgcccaggaatcgcttgagatacaatcacaatctcccgcttcgaatcagagcttccaaagacgataatgtcgcagtggaagatcgagaaaatgcagtgatcagacaagttaacggaaacggaagtgttcgtttaaacggtaacggagctgcgagaaaacccgtcaacggagattataacggaagtgcccgtgtaaacggtagcggtaacggtagcttagtgaagtatgtgaacggaagcgtaacggtggaaacggaggaagtctcaaagaagagaaaagaggaagtgaggcaaaagagagtagaagatattggtcaagaagatgcttggtttaaaaacactcaacaaaaacaacaagttgaggtttctgttgcacctggtggtcgatggagtagattcaagacttattctacgatacagaggacattggagatttggggatttgttttgacgtttattttcaggacatggttaagcaatcagaaattttcatacaaagggggaatgactgaggagaaaaaggttttaagaaggaagattttggctaagtggttgaaggaaaacatattgagactaggtcctacttttattaaaattgggcaacagttttctaccagagtggatattcttcctcaagagtatgtcgatcaattgtcagaacttcaggatcaagttcctcctttctcttctgctacagctctatcgattgttgaagaggagcttggaggatctgttgatgatatattcgaccgttttgattatgaacctattgctgcagctagtcttggccaagttcaccgtgcaagattaaagggtcaagaaattgtcattaaagtacagagacctggtctcaaggatctcttcgatatcgatcttaaaaacttgagggtgatcgctgagtatctccagaaggtggatccaaaatcagatggtgcgaagagagattgggttgcaatctatgatgaatgtgccagtgtattgtaccaggaaattgattacacaaaggaagcagctaactcggaactatttgctaataacttcaaaaacttagagtatgtaaaagttccatccatctactgggaatacaccacacctcaggtcctgacaatggagtatgtccctgggattaagattaacaagatccaagccttagatcagttaggtgttgatcgaaaaaggctagggagatatgctgttgaatcttacctggagcagatcttgtctcatggattcttccatgccgacccccaccctgggaatattgcggttgatgatgtcaatggcggacggctaatcttttacgactttggaatgatgggaagtatcagcccaaatattagagaaggtttattggaggcattttacggcgtctacgaaaaggacccagataaggtcattcaagctatggttcaaatgggtgtgcttgtaccaactggagatttgacgtcagtcagaagaacagcactgttttttctcaacagtttcgaagagcgtcttgctgcacaaagaaaggagaaagaagaaatagcagcagcagaagagcttgggtttaagaagccactgagcaaggaggaaaagcaagagaaaaagaagcaacgtttggctgccatcggagaagacttattagccattgcagctgatcaacctttccggttcccagccacattcacatttgttgttagagccttttcagtattggatggcatcggcaaaggtcttgacccccgttttgatataacggagattgcaaaaccatatgctttggaattgctacggttccgggaagctggtgtagaagttgtagtgaaggacctgagaaagagatgggacaggcaatcacaagcattctacaatctatttagacaagctgatagagttgaaaagctagctgtcatcatccaacgacttgagcaaggtgatttgaagcttagagtccgagctttagagtctgagagggcgtttcaacgcgtagcagctgttcaaaaaacagtaggaagtgctgttgctgcaggaagtttagtcaatcttgcaacgattttgtatctgaattctttaaaaacaccagctactatagcatatacggtgtgtgctttcttcagcctccaagttctaatcggagttataaaggtcaagaaattcgatcaacgagaaaaactaatcactggaacagcttaataaacttgcttgatgtatgtagtaaagctactccagtctccataaacgcttttgtgcttagaagcaaaacaaattctcccataaagattttcacaggagtggtaaccattttcttaggtctacaaaagaaaagacatcttattgagaggcaagagatgataaactcgtcaacggccagactctctcttctgaaagtttgatttttttttttttttgggtattggatcataagaaatggagaggagactctataatttttatcaacagagtggttgtgttaagccacatgttaatgtgtatagagacgtagaaattaggaaaatctttcgtaaaaatttactacttgttccttcagtaa

SEQ ID NO: 1813 - DNA, 2783 bp, Eutrema parvulum
tcctccttctccagagcctctaaccctctctgcaaagtgccaacaaacaagtcttcttcttcttcaaaatctcttcttaccttccacgcaaatgaaaatcaaggtgtaatctgggatctcttctgtattagaaaatcaatggcggcttcttcttcctcctcctcttcgtcgtctcttctgttaccgaacatcaatttccattccagacagtcttcaacaatcactcgttccgtttcaatccccggaatttttctacccagaaatcgcttgagctacaatcacaaccttacgcttcgaatcagagcttccaaagacgataatgtcgcagtggaagatcgagaaaacgcagtgattaaacaagttaacggaaacggaagtgtccgtttaaacggcaacggagctgcgagaaaacccatcaacggcgattacaacggaagcgcccgtttaaatggtaacggtaacggtagcttggtgaagtatgtgaacggaagcgtaacggtggaaacggaggaagtcacaaagaagagaaaagaagaagtgaggcagaagagagtagaagatattggtcaagaggacgcttggtttaagaaaagtcaacgaaaacaagtcgaggtttctgttgcacctggtggtcgatggagtagattcaagacttactcaacgatacaaagaacattggagatttggggatttgttctaaagtttattttcaggacttggttaagcaatcagaaattttcatacaaagggggaatggctgaggagaaaaaggttataagaaggaagattttggctaagtggttgaaggagaacatattgagattaggtcctacatttattaaaattgggcaacagttctctaccagagtggatattcttcctcaagaatatgtcgatcaattgtcagaacttcaggatcaagttcctcctttctcttctgctacagctctatcaattgttgaagaggagcttggagcatctgttgatgacatattcgaccgctttgattatgaacctatagctgcagctagtcttggccaagttcaccgtgcaagattaaagggtcaagaggttgtccttaaagtacagagacccggtctcaaggatctctttgatatcgatcttaaaaatttgagggtgattgctgagtatctccaaaaggtggatccaaaatcagatggtgcaaagagagattgggttgcaatctatgatgaatgtgccagtgtattgtaccaggaaattgattacacaaaggaagcagctaattcggaattgttcgctaataacttcaaaaacttagagtatgtaaaagttccatccatctactgggagtacaccacacctcaggtcctaacaatggaatatgtccctgggattaagattaacaaaatacaagccttagatcagttaggtgttgatcgaaaaaggctagggagatatgctgttgaatcttacctggagcaaatcttgtctcatggattctttcatgccgaccctcaccctgggaatattgcggttgatgatgtcaatggtgggcggctgatattctacgactttggaatgatgggaagtatcagcccaaatattagagaaggtttgttggaggcattttacggtgtctatgagaaggaccccgataaggtcattcaagcaatggttcaaatgggtgtgcttgtacctactggagatttgacatcagtcagaagaacagcactgttttttctcaacagtttcgaagagcggcttgctgcacaaagaaaggagaaagaagaaatagcagcagcagaacagcttgggtttaagaagccactaagcaaggaggaaaagcaagagaaaaagaagcaacgtttggctgcaatcggagaagacttattagccattgcagctgatcaacctttccggttccccgccacattcacatttgttgttagagccttttcagtattggatggcatcggcaaaggtcttgacccccgatttgatataacagagattgcaaaaccctatgctttggaattgctacggttccgggaagctggagtagaagttgtagtgaaggatctgagaaagagatgggacagacaatcacaagcattctacaatctatttagacaagctgatagagttgaaaaactagctgcaatcatccaacgacttgagcaaggtgatttgaagcttagagttcgagcactggagtctgagagggcatttcaacgtgtagcgactgttcaaaaaacagtaggaagtgctgttgccgcaggaagtttagtcaatcttgcaacgattttgtatctgaattctttaaaaacaccagctaccatagcatatacagtctgtgctttcttcagcctccaggtccttatcggagttataaaggtcaagaaattcgatcaacgtgaaaaactgatcactggaacagcttaaaaacttgtttgatatagtaaagcttcttcagtctccataaacatttttgtgcttagacgcaaaagatttctcccataaagttttttcacaggagtgataataatttctctggtctccaaaaaaagttcttatggaagctttagacgcaagagatggtaaactagtcaacgaccagtctccttatctcttttcttctgaaagtttgattattaattttgggtattgaatcataagaaaaggagaagagactttgagatttatcaacagagtggttatcttgagccacatgtaatgtgtatagagatgtagaaattaggaaactctttcgtgaaaaaatatactacttgttccctcaataa

SEQ ID NO: 1814 - DNA, 2262 bp, Brassica napus
tgaggaccggtccggtttcccgggtcgaacacgcgtccgcttcttcttcttacattctacgcaggtttgtaatctgctgattctcttctgcaaatcacctttcaatggcggcttcttcctcttcttcttcttctccctcgtctctcctcttaccgaacatcaatttccattccacaaccactcgttccgtttcaatccctggaatcttcctgcctagaaaccgcttgagatacagtcacaatctcccgcttcgaatcagagcttccagagacgataatgtcgcagtggaagatcgtggaaacgcagtgatcaacggaaacggaagcgtacgtctaaacggcaacggagctacgagaaaatccatcaacggagacttaaacggaaacggccgtttaaacggcaacggtagtttggtgaagtacgtgaacggaagcgtaacggaggaagtctcgaagaagagagaagaagaaaagaggcagaagagagtagaagacatcggtcaagaggatgcttggtttaagaaaactcaacagaaacaacaagtcgaggtttctgttgcacctggtggtcgatggagtaggttcaagacttactcgaccatacaaagaacattggagatttgggggtttgttataacgtttatcttcaggacatggttgagcggtcagaagttttcatacaaagggggaatgactgaggagaagaaggttttgagaaggaaggttttggctaagtggttgaaggaaaacatattgaggttaggtcctacgttcattaaaattgggcagcagttctctaccagagtggacattcttcctcaagaatacgttgatcaattgtcagaacttcaggatcaagttcctcctttctcttctgctacggctttatcaattgttgaagaggagcttggagcatctgttgatgacattttcgaccgttttgattatgaacctatagctgctgctagtcttggccaagttcaccgtgcaagattgaagggtcaagaggttgtcattaaagtacagagacccggtctcaaggatctctttgatattgatcttaaaaacttgagggtgattgctgagtatctccaaaaggtggatccaaaatcagatggtgcaaagagggattgggttgcaatttatgatgaatgtgccagtgtattgtaccaggaaattgattacacaaaggaagcagctaattcggaactgttgctaataacttaaaaaacttagaatatgtaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttacctggagcagatcttgtctcatggattctttcatgccgaccctcaccctgggaacattgctgttgatgatgtcaacggcgggcggctgattttttacgactttggaatgatgggaatatcagcccaaatattagagaaggtttattggaagcattctatggtgtttatgagaagaccccgataaggtcattcaagcaatggttcaaatgggtgtgcttgtacctactggagatttgacatcgatcagaagaacagcactgttttttctcaacagtttcgaagagcggctgctgcacaaagaaaggagaaagaagaactagcagcagcagaagagcttgggttcaagaagccactaaccaaagaggaaaagcaagagaaaaagagcaacggttggctgcaatcggagaagacttatagccatttcagctgaccaacttcggtccctgccacattcacatttgttgttagagccttttccagtattggatggcatcggcaaaggtcttgacctcgcttgatataacgagattgcaaaccatatgctttggaattgctacgttccgggaagctggagtagaagttgtagtgaaggacctgaggaagagatgggacagacaatcacaagcattctacaatgtatttagacaagctgatagagttgaaaagctagctgtaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgct

SEQ ID NO: 1815 - DNA, 2649 bp, Arabidopsis lyrata
tctctcttccgaaatataaccatcaatggcgacttcttcttcatcgtcgtctctgcttttaccaaacatcaatttcaactccagacaatctacaacagtcgccggaattttcttacccagaaaccgattaagctacaatcacaatctccagcttcgtacgagaataatcagagcttctaaagacgataatgtcgcagtggaagatcgtggcaatgcagtgatcaatggagattataataacggaagtgcccgtttaaacggtaacggctctgcgagaaaatctgtcaacggtgattataacggaagtgctcgtttaaacggtaacggtaacggtagtttggtgaagtatgtgaacggaagtgtaacggtggaaacggaggaagtgacaaagaagaggaaagaagaagtgaggaagaagagagtagaagatattggtcaagaggacgcttggtttaagaacactcaacaaaaacaagttgaggtttctgttgcacctggtggtcgatggaatagattcaagacttactcaactatacaaagaacattggagatttgggggtttgttgtacagtttattttcaggacatggttaagcaatcagaagttctcatataaagggggaatgactgaggagaagaaggttttaagaagaaagattttggctaagtggttgaaagaaaacattttgagattaggtcctacatttatcaaaattgggcaacagttttctactagagtggatattcttcctcaagagtatgttgatcaattgtctgaacttcaggatcaagttcctcctttcccttctgctacagcattatccattgttgaagaggagcttggaggatctgttgaggacattttcgaccgttttgattatgaacctattgccgcagctagtcttgggcaagttcaccgtgcaagacttaagggtcaagaggttgtccttaaagtacagagacctggtctgaaggatctctttgatattgaccttaaaaatttgagggtgattgctgagtatctccaaaaggtggacccaaaatcagatggtgcaaagagagattgggttgcaatctatgatgaatgtgccagtgtattgtaccaggaaattgattacacaaaagaagcagctaattcggagttgtttgcgaataacttcaaaaacttagagtatgtaaaagttccatccatctactgggaatatactacacctcaggtcctgacaatggagtatgtccctgggattaagattaacaagatacaagccttagatcagttaggtgttgatcgaaaaaggctaggtagatatgctgttgaatcttacctggagcaaatcttatctcatggattcttccacgccgaccctcaccctggaaatattgcggttgatgatgttaatggtggacggctgatattttatgactttggaatgatgggaagtattagcccaaatattagagaaggtttattggaggcattctatggcgtctatgaaaaggacccagataaggtccttcaagctatggttcaaatgggtgtgcttgtaccaactggagatttgacggcagttagaagaacagcattgttttttctcaacagtttcgaagagcggcttgctgcacaaagaaaggagaaagaagaaatagcagcagcagaagagcttgggttcaagaagccactaagcaaggaagaaaagcaagagaaaaagaagcaacggttggctgcaatcggagaagacttattagccattgcggctgatcaacctttccggttccccgccacattcacatttgttgttagagccttttcagtattggatggcataggcaaaggtcttgacccccgatttgatataacggagattgcaaaaccctatgctttggaattgctacggtttcgggaagctggagtagaagttgtagtgaaggacctgagaaagagatgggacaggcaatcacaagcattctacaatctatttagacaagctgatagagttgaaaagctagctgtagtcatcgaacgacttgagcaaggtgatttgaagcttagggtccgagctctagagtctgagagggcatttcaacgggttgcagctgttcaaaaaacagtaggaagtgctgttgctgcaggaagtttagtcaatctggcaacaattttgtatctaaattctttaaaaacacctgcaactatagcatatacagtatgtgctttcttcagcctccaagttctaatcggagtcataaaggttaaaaagttcgatcaacgggaaaaactgatcactggaacagcttaaaagaaatcttgtttgatgtattaaaaaaacttcttcttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattgggcattttatcaacagagccacttgtaatggtgtgtagagatgtagacattaggtcaactttttcgtcaaaatatatgtatatatactactccttacctgcctcagtatatgtgtgttcggc

SEQ ID NO: 1816 - DNA, 2467 bp, Brassica napus
cttcctgcctagaaatacgcttgagacacagtcacactctcccgcttcgaatcagagcttccagagacgataatgtcgcagtggaagatcgtgaaaacgcagtgatcaacggaaacggaagcgtacgtctgaacggcaacggagctgcgagaaaatccatcaacggagattaacggaaacgccctttaaacggcaacggagtttggtgaagtacgtgaacggaagcgtaacggaggaagtctcgaagaagagagaagaagaaaaaaggcagaagagagtagaagacatcggtcaagaggatgcttggtttaagaaaactcaacagaaacaacaagtcgaggtttctgttgcacctggtggtcgatggagtaggttcaagacttactcgaccatacaaagaacattggagatttggggtttgttataacgtttatcttcaggacatggttgagcggtcagaagttttcatacaaaagggaatgactgaggagaagaaaggtttgagaaggaaggtttggctaagtggttgaaggaaacatattgaggttaggtcctacgttcattaaaattgggcagcagttctctaccagagtggacattcttcctcaagaatacgttgatcaattgtcagaacttcaggatcaagttcctcctttctcttctgctacggctttatcaattgttgaagaggagcttggagcatctgttgatgacattttcgaccgttttgattatgaacctatagctgctgctagtcttggccaagttcaccgtgcaagattgaagggtcaagaggttgtcattaaagtacagagacccggtctcaaggatcttctttgatattgaatcttaaaaacgttgagggtgattgctgagtatctccaaaaggtggatccaaaatcaggatgggtgctaaagagggattgggttgcaatttatgatgaatgtgccagtgtattgtaccaggaaattgattacacaaaggaagcagctaattcggaactgtttgctaataacttcaaaaacttagaatatgtaaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttacctggagcagatcttgtctcatggattctttcatgccgaccctcacccgtgggaacattgctgttgatgatgtcaacggcgggcggctgattttttacgactttggaatgatgggaagtatcagcccaaatattagagaaggtttattggaagcattctatggtgtttatgagaaggaccccgataaggtcattcaagcaatggttcaaatgggtgtgcttgtacctactggagatttgacatcgatcagaagaacagcactgttttttctcaacagctggattttatcacagtttcgaagagcggcttgctgcacaaagaaaagagaaagaagaactagcagcagcagaagagcttgggtcaagaagccactaaccaaagaggaaaagcaagagaaaaagaagcaacggttagctgcaatcggagaagacttattagccatttcagctgaccaaccgttccggttccctgccacattcacaatttgttgttagagtccttttcagtattggatggcatcggcaaaggtctagatcctcgctttgatataacggagattgacaaaacctatgctttggaattgctacgggttccggaagtctggagtagaagttgtagtgaaggacctgaggaagagatgggacagacaatcacaaagcattactacaatgtatttagtacaagctgatagagttgaaaagactagcgtttaatcatccaacgacttgagcaaggtgattggaagcttagagtccgagcattggagtctgagagggcggtttcaacgtgtagcagctgttcaaaaaacaagtaggaagtgctgttgctgcaggaagcttagtcaatctcgcaacgattttgtatctgaattctttaaaacaccagctactatagcatacacagtatgtgctttcttcagcctccaggttctgattggagttataaaagtcaagaagttcgaccaacgtgaaaaactgatcactgggacagcttaaaagaaatcttgtttgatgtattaaaaaaacttacttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattggacattttatcaacagagccacttgtaatggtgtgtagagatgtagacattaggt

SEQ ID NO: 1817 - DNA, 2856 bp, Arabidopsis thaliana
gtggttcgtcatgaacctcaaaaaacctctcactgcaaagtgccaacaaacaacaagtcttcaccttcttcttcttcttcttcttcaaaatctcttgtacgcaaataatccatgagaaactagggtttaacttgagatctctcttccgaagtattaccatcaatggcgacttcttcttcttcatcgtcgtctctgcttttaccaaacatcaatttcaactcaagacaatctccaacaatcactcgttccgtttcaatcgccgggatcttcttacccagaaaccgattaagctacaatcacaatctccggattcgtacgagattaatcagagcttctaaagacgataatgtcgctgttgaagatcgtgataatgcagtgaagatcaacggtgattacaacggaagtgcacgtttaaacggtaacggctctgcgagaaaatccgtcaacggagattttaacggaagtgctcgtttgaacggtaacggtagtttggtgaagtatgtgaacggaagtgtaacggtggaaacggaggaagtgacaaagaagagaaaagaagaagtgaggaagaagagagtagaagatattggtcaagaggatgcttggtttaagaacaacactcaacaaaaacaagttgaggtttctgttacacctggtggtcgatggaatagattcaagacttactcaactattcaaagaacattggagatttggggttttgttgtacagtttattttcaggacttggttaagcaataagaagttctcttataaagggggaatgactgaagagaagaaggttttaagaaggaaggttttggctaagtggttgaaagaaaacattttgagattaggtcctacatttatcaaaattgggcaacagttctctactagagtggatattcttcctcaagagtatgttgatcaattgtcagaacttcaggatcaagttcctcctttcccttctgctacagctttatccattgttgaagaggagcttggaggttctgttgaggacattttcgaccgttttgattatgaacctatagctgcagctagtcttgggcaagttcaccgtgcaagacttaagggtcaagaggttgtccttaaagtacagagacctggtctgaaggatctctttgatattgaccttaagaatttgagggtgatcgctgagtatctccaaaaggtggacccaaaatcagatggtgcaaagagagattgggttgcaatctatgatgaatgtgccagtgttttgtaccaggaaattgattacacaaaagaagcagctaattcggagttgtttgctaataacttcaaagacttagagtatgtaaaagttccatccatctactgggaatacactacacctcaggtcctgacaatggagtatgtccctgggattaagattaacaagatacaagccttagatcagttaggtgttgatcgaaaaaggctaggaagatatgctgttgaatcttacctggagcaaatcttatctcatggattcttccacgccgaccctcaccctgggaatatagcagttgatgatgtcaatggcgggcggctgatattttacgactttggaatgatgggaagtattagcccaaatattagagaaggtttgttggaggcattttatggcgtctatgaaaaggatccagataaggtccttcaagctatggttcaaatgggagtgcttgtaccaactggagatttgacggcagttagaagaacagcattgttttttctcaacagttttgaagagcggcttgctgcacaaagaaaggagaaagaagaaatagcagcagcagaagagcttgggttcaagaagccactaagcaaggaagaaaagcaagagaaaaagaagcaaaggttggctgcaatcggagaagacttattagccattgcggctgatcagcctttccggttccccgccacattcacatttgttgttagagccttttcagtattggatggcatcggcaaaggtcttgacccccgatttgatataacggagattgctaaaccctatgctttggaattgttgcggtttcgggaagctggagtggaagttgtagtaaaggacctgagaaagagatgggacaggcaatcacaagcattctacaatctatttagacaagcggatagagttgaaaagctagctgtagtcattgaacgacttgagcaaggtgatttgaagcttagggtccgagcgctagagtctgagagggcatttcaacgcgttgcagctgttcaaaaaacagtaggaagtgctgttgctgcaggaagtttagtcaatctcgcaacaattttgtatctgaattctataaaaacacctgcaactatagcatatacagtatgtgctttcttcagcctccaagttctaatcggaatcataaaggttaagaagttcgatcaacgggaaaaactaatcactggaacagcttaagaacttgcttgaagaaatgtattaaagcttcttcaatctccataaacccttttgtgcatttcacaggagtgttaacaatttcactggtctgcaaataaaattatcttatggaagcttgagaggcaagagatggtcaactagtcaaaccaccaccactctctcatctctgtcttcttaaagttcgataataatttttggagaggagactctggttgttcatcaacagagtggtcatgagccacatgtattgcttgtgtatagagagatttagaaattaggaactttttcgtataaatatactcattgtactcagctactcactagactcatctctgttttagtaatattttgaatactgtatctcaaataaattaatcttatcaaatagaaaccatagttgaaaagtca

SEQ ID NO: 1818 - DNA, 2539 bp, Brassica napus
ctcctcgtaaccgaacactactaacttcctactccagacactctacaatcctacccggtaccggaatcttcttacgtaacgaaccgctgagatacagtcaacaatcctcccgtctacgaatcagagtcctccagagacgaataatgtcgcagtacaaagatcggtaggaaacgcagtgatacgaaacggaaaacggaagcgtacgtacgtaaacggacgaacggagctgacgaagaaactccaccaacgaacggaacggccgtttaaacggtaacggtagtttggtgaagtacgtgaacggaagcgtaacggaggaagtctcgaagaagagagaagaagaaaagaggcagaagagagtagaagacatcggtcaaggaggatgcttggtttaaagaaatctcaacaagaaacaacaagtcggtaggtttctgtcgccacctgggtgggtcgagtgggaggttaggttacaaagtacttacctacaaacgactaccaaaagaactagttggagtagtttgggggtttgttataacgtttatcttcaggacatggttaagcggtcaaaagttttcttacaaagggggaatgactgaggagaagaaggttttgagaaggaaggttttggctaagtggttgaaggaaaacatattgagattaggtcctacctttattaaaattggtcagcagttctctaccagagtcgacattcttcctcaagaatatgttgatcagttgtctgaacttcaggatcaagttcctcctttctcttctgctacggctttatcaattgttgaagaggagcttggagcatctgttgatgacattttcgaccgttttgattatgaacccatagctgctgctagtcttggccaagttcaccgtgcaagattgaagggtcaagaggttgtcattaaagtacagagacccggtctcaaggatctttttgatatcgatcttaaaaatttgagggtgattgctgagtatctccaaaaggtggatccaaaatcagatggtgcaaagagagattgggttgcaatttatgatgaatgtgccagtgtattgtaccaggaaattgattacacaaaggaagcagctaattcggaactgtttgctaataacttcaaaaacttagaatatgtaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttaccttgagcagatcttgtctcatggattctttcatgccgaccctcaccctgggaacattgctgttgatgatgtcaacggcgggcggctgatattttacgactttggaatgatgggaagtatcagcccaaatattagagaaggtttactggaggccttctatggtgtttatgagaaggaccccgataaggtcattcaagcaatggttcaaatgggtgtgcttgtacctactggtgatttgacatcgatcagaagaacagcactgttttttctcaacagtttcgaagagcggcttgctgcacaaagaaaggagaaagaagaactagcagcagcagaagagcttgggttcaagaagccactaaccaaagaggaaaagcaagagaaaaagaagcaacggttggctgcaatcggagaagacttattagccatttcagctgaccaacctttccggttccctgccacattcacatttgttgttagagccttttcagtattggatggcatcggcaaaggtcttgaccctcgctttgatataacggagattgcaaaaccatatgctttggaattgctacggttccgggaagctggagtagaagttgtagtgaaggacctgaggaagagatgggacagacaatcacaagcattctacaatgtatttagacaagctgatagagttgaaaagctagctgtaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgctttcttcagcctccaggttctgattggagttataaaagtcaagaagttcgaccaacgtgaaaaactgatcactgggacagcttaaaagaaatcttgtttgatgtattaaaaaaacttcttcttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattgggcattttatcaacagagccacttgtaatggtgtgtagagatgtagaca

SEQ ID NO: 1819 - DNA, 2637 bp, Cleome spinosa
tgttctccttcactgtcctgcttcgtcgctcacacgccgcagaattctttgcaagttcctcactcactttgtcgcgagaacttcaatttccttcttccgcgcagagaagccatggaaattagggtttaatcttgatcttctctgagaaacccaccaatggcggcttcttcttcttctctgttgctgccggacatcaattttctctcccggcaatctacgatcgttcgtcgtcgcgtctctctctctggaattctgctttctagaaatcgcttgaggtgtcgtaatcttccacctcttacgaggattagggcttccaaagcggatagtgtcgctgttgaggatcgggaaaatgcggtgatcaaacaagttaacggaagcgtgggtttgaatggaaatggcgctgcttctagtcggagcgttaatggagattatcgatacgaaagctcgatcgagaagtatacaaacaataatcttaacggtaacggcagttcggtgaagtatgttaacggcggcgtcagtacggtgccgaaggtggagcctgaggaggtcttggagtcgagaaaggaggaagtgaggaagaagaggatagaggatattggtaaagaagatgcatggttcaagaaaagccaacaagaacaagtcgaggtttctgtggcgcctggtggtcgctggagcagattcaagacctactcaacgatacaaaggacagtggaaatatggggatttgttctaactttcatcttcaggacctggctaagcaatcagaaattctcctacaaaggggggatgactgaggagaaaaaggttctgagaaggaagaccctggcaaagtggttgaaggagaacattttaagattgggtcctacattcatcaaaattggtcaacaattctctactcgagtggacatccttccccaagaatatgttgatcaactgtcagaacttcaggatcaagttcctcctttcccgtctgagactgctctgtctattgtggaagaagagcttggagcacctgttggcgaaatcttcgacagttttgattatgaacctattgctgcagctagtcttggccaagttcatcgtgcaaggttaaagggtcaagaagtagttgtcaaggtgcagagacctggtctgaaggatctctttgatattgatcttaaaaatctaagggtgattgcagaatatctccaaaaggttgacccaaaatcagatggtgcaaagagagactgggttgcaatatatgatgaatgtgctagcgtgttgtatcaggaaattgattacacaaaggaggcagctaatgcagaacagtttgctagtaactttaaaagcttggactacgtgaaagttccagccatcttctgggattatacgacaccacagatcttaaccatggagtatgttcctgggataaagataaacaaaatacaagccctggaccagttgggtgttgatcggaaaaggttggggcgttatgctgttgaatcttacctcgaacaaatcttgtcccatggattctttcatgccgaccctcatcccgggaatattgctgtggatgatgtcaatggtgggaggctgatattttatgactttggaatgatgggaagtatcagtcccaacatcagagaaggtttattggagacattctatggtgtttatgagaaggacccagataaggttctcgaagctatggttcagatgggtgtgcttgtacctaccggagatatgactgctgtcaggagaacagctcaattctttctcaacagttttgaagagcggcttgttgcacagagaaaggagagggaaatggcaacagcagagctcggttttaaaaagcctctgaccaaggaagaaaagatagagaaaaagaagcaacggttggctgctattggggaggacttattgtctattgcagctgatcaacctttccgtttcccggccacattcacgttcgttgttagagcattttcagtgttggatggcatcggaaagggtcttgatcctcgtttcgatataacagagatcgccaaaccctatgctttggagttgctaaggttccgagaagctggagtagaagttgtactgaaagacctgagaaagagatggaacaggcaatctcaggcattttacaacctgtttaggcaggctgacagagtggaaaagctagctgaaaccatccaacgactggagcaaggcgacctgaagcttagagtccgaactctagaagcagagagggcattccaacgcgtgggagctgttcagaagactgtaggaagtgctgtagctgccggaagtttaatcaatcttgccactattttatacctcaattctgtaaaagtgccggcgactatagcatatacgttatgcgctttcttcagcgtccaagtccttgtgggaatcataaaggtgaagaagttggaccaacgtgaaaagctgattaccggaactgcttagcctcctcgattatgaataagagctcccccccccccccaactcttcagaagcccttttgaaagcaaagagcccgttgctgtcaactcccagttcctcgtggacaggtaaaaagttctgtcctgaaatcgtcatcttcactccgaccccagtattagtctcgggctcgacccaaaacacccggttacc

SEQ ID NO: 1820 - DNA, 823 bp, Brassica rapa
ctcttcctcctcctaaaagagaccgaacacatccaagatggtcttgtgggtgttcggatatggatctttgatatggaacccaggtttcgattttgatgagaaactcattggctatatcaaagactacaaacgtgtattcgatctcgggtgcattgatcatagaggcacgcctgaacatcctgcaagaacttgcacgttggaggaatccaccggagcaatatgctggggtgcagcttattgtgttcgtggaggacccgagaaggagaagctagcgatggagtacttggaaggaagagagtgtgaatacgactcaaaaacactcgttgagttttacacggaaactgacaccaccaaacagtccaaaccaatcttgaccggagttatagtattcacgtcaaccccagacaaattgtcaaacaaatactacttgggccctgctccattggaggagatggcgatgcaaatcgccacagcttctggaccttgtggaaacaaccgggagtatctttttaagctggagaaagcaatgcacgacatagagcatgaggatgagtatgtgattgaattggcaaatgaggtcaggaaacatctcgacttaccaaaggaagtcaaggcattgctgaagcctgtggtttctcgtgtatccatcaaatctcattctcaagctcatgcttccactcttcaacgagtctttgcatcatgagagtcaagcaaagtcatggagctaaccaacacgttgatgaagagtttttacggatgtgacttttaatttatagctccacttttatttgttttcacatttgaactttcaaaagtttcgact

SEQ ID NO: 1821 - DNA, 975 bp, Brassica napus
cactgggggattctcttcccacaactgaaactctggtctctctctcaactcttctgtattaatatccgattctctcttcctttaaaaaaatatcacaattccttttttctaagctcctcctagcttcttcttcctccaaaaagagaccgaacacatccaagatggtcttgtgggtgttcggatatggatctttgatatggaacccgggtttcgattttgatgagaaactcattggctatatcaaagactataaacgtgtcttcgatctcggctgcattgatcatagaggcacgcctgaacatcctgcaagaacttgcacgttggaggaatccaccggagcaatatgctggggtgcagcttattgtgttcgtggaggacccgagaaggagaagctagcgatggagtacttggaaggaagagaatgtgagtacgacttaaaaacactcgttgagttctacacggaaactgacaccaccaaacagtccaaaccaatcttgaccggagttatagtattcacgtcaaccccagacaaattgtcaaacaaatactacttgggccctgctccaatggaggagatggcgatgcaaatggccacagcttctggaccttgtggaaacaaccgggagtatctttttaagctggagaaagcaatgcacggcatagagcatgaggatgagtatgtgattgaattggcaaatgaggttaggaaacatctcgacttaccaaaggaagttaaggcattgctgaagcctgtggtttctcgtgtatccatcaaatctcattctcaagctcatgtttccactcttcaacgagtctttgcatcatgagagtcaagcaaagtcatggagctaactaacaagttgatgaagaatttttacgaatgtgacttttatagttccacttttatttgtttcacatttgaactttcaaaagtttgaattcagaaaacagacctttatatatttctttactctg

SEQ ID NO: 1822 - DNA, 1020 bp, Eutrema parvulum
gatactttgtctgtctctactcttcctctgtattaatatccgattctctcttccaaaaaagtatcacaatttcttttttttgctaattcatcgcttcttcttcttctccttcttctttgtaaaacgaagctgaaataatcaagatggttttgtgggtattcggttatggatctttaatctggaacccaggtttcgattttgacgagaaactcattggctatatcaaagactacaaacgcgtcttcgatctcgcgtgtattgatcatagaggcacgcctgaacatcctgcaagaacttgcacgttggagcaatctactggagcaatatgctggggtgctgcttattgtgttcgtggaggacccgagaaggagaaactagccatggagtacttggaacgaagagagtgtgaatacgactcaaaaacacttgtagagttttacactgaaactgacacatccaaaccaatcctgaccgaagttatagtcttcacgtcaacaccagacaaagtgtcgaacaaatactacttgggaccagctccattggaggagatggcgaagcaaatcgccacagcttctggaccttgtggaaacaaccgggagtatcttttcaagctggagaaagcaatgcacgacattgagcacgaggaagagtatgtgattgaattggcgaacgaggtgaggaaacatctggacttaccaaatgaagtgaaggcattgttgaagcctgtggtttctcgtgtatccatcaaatctcaatctcaagctcatgtttctcctcttcaacgggtctttgcatcatgagagagacaagccacaagtcatggagccaactaacaacgttggtggtgatgaggaatttgcggatttagaattcttcttatccttcgatttttattttgatatcacattttaactttcaaatgtttgaactagaaaaccgaaccttcctctgtattcaattagaattcatgactatatatgagatttaatttatgcgaataacaacaaatctttcgctcac

SEQ ID NO: 1823 - DNA, 878 bp, Brassica juncea
cacaattccttttttaaaaatctcctcctagcttcttcctcttcctcctcctaaaagagaccgaacacatccaagatggtcttgtgggtgttcggatatggatctttgatatggaacccgggtttcgattttgatgagaaactcattggctatatcaaagactacaaacgtgtcttcgatctcgggtgcattgatcatagaggcacgcctgaacatcctgcaagaacttgcacgttggaggattccgccggagcaatatgctggggtgcagcttattgtgttcgtggaggaccagagaaggagaagctagctatggagtacttggaaggaagagaatgcgaatacgactcaaaaactctcgttgagttttacacggaaactgacaccaccaaaccaattttgactggagttatagtattcacgtcaacccctgacaaaaggtcaaacaaatactacttgggccctgctccattgaaggagatggcggtgcaaatcgccacagcttctggaccttgtgggaacaaccgggagtatcttttcaagctggagaaagcaatgcacgccatagagcatgaggatgagtatgtgattgaactggcaaatgaggttaggaaacaactcgacttaccagaggaagttaaggcattgttgaagcctgtggtttcacctgtatccatcaaacctcgctctcaggctcatgtttccaatctccaacgggtctttgcatcatgagagaaaagcaaagtcatggagccaactaacacgttgatgaaatttttttacggatgtgactcttatggttccacttctattttttttattatcatattttaactttcaaaagtttgaattcagaaaatagaccttagagcatctcc

SEQ ID NO: 1824 - DNA, 941 bp, Raphanus sativus
  misc_feature (905)..(905): n is a, c, g, or t
ggatcacaattcctttctctaaaactcctcctatagcttcttcttcttcctcctcctaaaagagaccgaatacatcaaagatggttttgtgggtgttcggatatggatctttgatatggaacccaggtttcgattttgatgagaaactcattggctatatcaaagactacaaacgtgtcttcgatctcgcgtgcattgatcacagaggcacgcctgagcatcctgcaagaacttgcacgttggagcaatccacgggagcaaaatgctggggtgcagcttattgtgttcgtggaggaccagagaaggagaagctagcgatggagtacttggaaggaagagaatgcgaatacgactcaaaaacccttgttgagttttactcggaaactgacaccaccaaaccaatcttgaccggagttatagtattcacgtcaaccccagacaaagtatcaaacaaatactacctgggccctgctccattggaggagatggcgatgcaaatcgctacagcttctggaccttgtggaaacaaccgggagtatcttttcaagctggagaaagcaatgcacgacatagagcacgaggatgagtatgtgattgaactggcaaatgaggttaggaaacatctcgacttaacaaaggaagtcaaggcattgttgaaccctgtggtttctcctgtatccatcaaacctcagtctcaagctcatgtttccactctccaacgggtctttgcatcatgagagataagcaaagtcattgagccaactaacacgttgatgaataaattttacggatgtgactcttatggttccacttctatttttttttgtcacattttagctttcaaaagtttgaattcagaatacagacctttagatatttttactcttgtcgccagtgagcatttntaacaccatgatatttaattgttgagaataactcga

SEQ ID NO: 1825 - DNA, 932 bp, Arabidopsis thaliana
aaaatatcacattctttcttcttctcattttctctaaagattgttgtttgtgtgtgaggctaaggatcaaagatggttttgtgggtatttggatatggttctttgatctggaacccaggttttgattttgatgaaaaactcattggttatatcaaggactataaacgtgtcttcgatctagcgtgtattgatcatagaggtactcctgaacatcctgctaggacttgtacgctggagcaatccaccggagctatttgctggggtgctgcttattgtgttcgtggaggaccagagaaagagaaactagcaatggagtacttggaacgaagagagtgtgaatacgactcaaaaacacttgttgagttttacactgaaaatgacacttccacgccaatcgttaccggagttattgtcttcacgtcaacaccagacaaagtgtcgaacaaatactacttaggtccagctccattggaagaaatggcgaggcaaatcgctacggcttcgggaccttgtgggaacaaccgagagtatcttttcaagctagagaaagcaatgttcgacattgagcatgaggaagagtatgtgattgagttagcgaatgaggttaggaagcaactcgatttaccggaggaagtgaaggcattgttgaagcctattgtttctcatgtatccgtcaagtctcaagctcatgtttccactcgtcaacgggtctttgcatcatgaagacagcaaaagttatggagctaacttaaaaaagcattgtggtgacgaggctaatgttaactctttatctttcagcttaatatttgatcacatcttgaccttgagatgttttgttttgctctgcatttattgagaattcataacattgtatgatatgagatgcaatttatgagaataataaccgatctttagctctgccaattgttata

SEQ ID NO: 1826 - DNA, 960 bp, Eutrema halophilum
gtctcatcacaatttgatttcttcttcttcttcttttttttgtctttcttaaagagaacgagagaagtcaaaatggttttgtgggtattcggatatggatctctgatctggaacccaggcttccaatttgacgagaagctcattggctacatcaaagactacaaacgcgtcttcgatcttgcgtgtatcgatcatagaggcacccctgaacatcctgctagaacttgcacgttggagcaatccactggagctatatgctggggtgctgcttattgtgttcgtggaggacccgagaaggagaaactagcaatggagtatttggaacggagagagtgtgaatacgactcaaaaacccttgtggagttttacactgaaaccgaaacctccaagccaatcttgaccggagttattgtcttcacttcaactccagacaaagtgtcgaacaaatactatttgggtcctgctccattggaggaaatggcgaagcaaatcgccacagcttctggaccttgtgggaacaaccgggagtatcttttcaagcttgagaaagcaatgcacgacattgagcacgaggaagagtatgtgatcgaattggctaacgaggtgaggaaacagctcgacttaccaaaggaagtgaagtcattgttgaagccttcggtttctcatgtacccatcaactctcaagctcaagctcaagctcatgtttccactcttccacgggtttttgcatcatgagtgacaagcaaaagtcatcgagctaacttaacaacatttgttgtgatgaggaatttacggatgtagctctttatctttcgacttcaaatttgatatcagtttttaacttttagaattttgaatcctgaaaaccgagcttcatatgtttttttgtttcctctgtattctcagtgagaattttttaacttaatgacatatgaagattcgattttttagaatatcaat

SEQ ID NO: 1827 - DNA, 792 bp, Arabidopsis lyrata
aaaatatcacattccttcttcttctttttcttttctctaaagattgttgcgtgtgaggttaagggtcaaagatggttttgtgggtatttggatatggatctttaatctggaacccaggttttgattttgatgaaaaaatcattggttacatcaaagactacaaacgtgtctttgatcttgcctgtattgatcatagaggcactcctgaacatcctgcaagaacttgcacgttggagcaatccacgggagctatttgctggggagctgcttattgtgttcgtggaggaccagagaaggagaaactagcaatggagtacttggatcgaagagagtgtgaatacgactccaaaacacttgttgagttttacactgaaaatgactcctcaacgccaacgccaatcgtaaccggagttattgtctttacgtcaacaccagacaaagtgtcgaacaaatactatttaggtccagctccactggaagaaatggccaggcaaatcgctacagctactggaccatgtggtaacaaccgagagtatcttttcaagctggagaaagctatgtacgatattgagcatgaggaagagtatgtgattgagttagcgaatgaggttaggaaacaactcgatttaccggaagaagtgaaggcattgttgaagcctgtggtttctcgtgttcccgtcaagtctcaagctcatgtttccactcgtcaaagggtctttgcatcatgaagatagcaaaagtcatggagctaccttaaaacattggggtgatgaggctaatgttaactcttat

SEQ ID NO: 1828 - DNA, 1067 bp, Raphanus sativus
ggatcacatatcattttctaacttcctgttttcttctatttcttctatttttccttcctaaaacagaccataacaattcaagatggtattgtgggtgttcggatatggatctttaatatggaacccaggtttcgattttgaagagaaactcattgggtatatcaaagactacaaacgcgtcttcgatctcgcgtgtattgatcatagaggcacgcctgaacatcctgcacgaacttgcacgttggagcaatcccccggagctatatgctggggtgctgcttattgtgttcgtggaggacctgagaaggagaagctagccatggagtacttggagcgaagagagtgtgaatacgactctaaaacccttgtcgagttttacacggaaactgacacatccgaaccagtcttgaccggagttttagtctttacgtcaactccagtctccagataaagtgtcgagcagatactacttgggcccagctccactggaggagatggccaagcaaatcgccacagcttctggaccttgtgggaacaaccgggagtaccttttcaagctggagaaagcaatgcacgacattgagcatgaagaagagtttgtgataaacttggcgaacgcggtgaggaaacagctagacttaccaaaggaagtgaaggcattgttgaagcctgttgtttctcgtgtacccatgaagtctcagtctcaagctcatgtgtttccactcttcataaatgaccaaagaaaaactcaatctattcgcaattaaagatgcttccctaaacgacatcaccggcaaataacttgggaagactgattctctcagaaatagattaaagtgaactcagtgaacgaaagcaacttaaacaaattgacaacgggatttgaatgaagggcaagtggagagcaatttatttcaatcttcatcgaagataaaacaaaaacttttagtactaagatgtacaataagatgtgtatgtatagccgacaaaatatttactggttttcaacaaagaaagtttgaaaataaggagaagtttgaagaagaagtttatagctttgaatatga

SEQ ID NO: 1829 - DNA, 3594 bp, Eutrema parvulum
ttgattctgatgcgattcgatttttttttcatcatggttatgattagggcatggaggctgtgttgatttgatgaatgtggatgcctgttatggaaagagtcggtgaagaaacagtggctagcaacagcatacaattgaaaggacgaggagatgatgttccttgtaagcttgatgctcgtcatatggtgactgaatcagaagctggcaacgattctttgaggagcgattgtcctggaagctcagctcacaggaatgtagatatgaacaagcctcccgaggaatctgcaggagcaaagctttctgttgaagagctgacattggggaactataggatggttcaagggagtaataataatagtaataataataataataataatattgatagttctagggctgggaagtttgagcatctttatcgtctggctagagggtctccgtttagggcaggagatggagatcttgattctcaacctcgtgatatggatcagatgttgtcaagaatcagacaacagcttgccggagctccttctgaaaggcaaaacttgaaacctttgatgaataggaggagcgatcagaatcttgaagcgttttctgaacgtttaagagcagctggcgaaaacagtcttatgaacgctcctgcatggatcaacgaaggtgtccacttgaaaacgccattgagttcttccagtttttctcagatgatacttaaaagagctatgaaggggaaaggggtagtagggaaaaaccaggaaactcctcctgaatttgtctctgagcaagatataggatgtaaggagaaaaaggtggataacagcaagtcgcctattcctcacaatgtgttaactttaaaatcgagtcccaaaggaaatgggatcgtatcacatggtagtactaaatcttcttttggaatcagtttgagggagtttattagatcaagttatgctaaacgagagaaacgacacagcctttgtctatttaggcagctggtggagctggttgactcagcccattcacaaggatcatttttgctggacttgagaccatcccttttcactttggtcccctcgaagaaacttagatatattggtacctttgggaagaacagtttaggctcagaagttgacgaagattcgaataggaagaggcctgtggttcaggaatcatatattgtgggtagggatttgaagaaaagaaaactggactggcatgttcattctccagggaatcaacttcaggctacttcaactgggagacctttcaaaaggaaaagccctgtaattgatttaaacgtggttgatgcacgtaatccagacagttgtgaacttcagcagcaaaactatatcaaaaatttaggagtggcttcgatgaccaaaaaacagtctatgtccacatggctagaagagcaatggtatacttgtccagatgaaataaatggagaagatagcggagaaaaatcaaatatatatgcccttggtgttcttctgtttgagttgctatgccattgcgagtccagtgagatgcatgctgcaatgatggcagatttacatcatcggattcttccaccaacatttctctctaaatatccgagggaagctggattttgtctttggctactacatcctgaaccctctgcccgaccaacagcgagaggaatactaaaatctgagctgatatgcgaggatgattcagttatgtcgactgctgctgatgaggagatatcggagctgttacttcattttttatcttcactagaagagcagaagaagaaaaatgcatctaagcttttgcaagacatccagactttggaggatgatattaaggaggccgaacgaagatattcttcaaaagcatctctggtgagatctcatggagctattgaaagtagagtgcaatcatctcccctagacgagcgctgtacgacttcttctggcgccttgtttgtaccaactgctaatacggacaggcttatgagtaatatccgtcaacttgaagatgcatatttcttcatgagatcacacatgaagttatcggattctgcagctagtgcccgttctgacaaaagccttctaaaggatagggacaggtgctctgaaaaccaaattgaaaatcaggatacgaaaaccaaaggaaaatcttcagatcaactggaagtgtttttcgaggggctgtgcaaatttgctcggtatagcaagtttgaaacctgtgggacgataagaagtggagaccttttaaactctgctagtgtggtatgctcattgagttttgaccctgatgaggaacacatagcagcagctgggatatcaaagaaaatcaagatttttgacttcaatgcatttatgaatgagtccgtcggtgttcattatccactagtagagatggtcaacaaatccaaactaagctgtgtttgctggaatagttacatcaaaaattacttggcctcgactgactacgatggtgtagttcagatttgggatgcggggaccggacaaggattttcacagtacacagaacaccagaagagagcctggtcagttgatttttctccatctgacccgacaaaatttgtcagtggaagtgatgactgttctgtaaagctgtggagcgtcaatgagaaacggtcattaggcacaatctggagtccagcaaatgtgtgttgcgtgcaattctctgcatattccaatcacttaatggcatttggatcagctgattacaaggtctattgctatgatcttcggtatgtcaaaactccttggtgcacattggctggccatgagaaagccgttagctatgttaaatttatggattcggataccattgtttctgcttccacggataattctctcaagctgtggaatcttaacaagacaaattcctctggtttgtctcctggtgcttgttcattgacttataaaggacataccaatcagaagaattttgtgggattatcggtcttggatggatatatagcctgtggttcggagaccaatgaggtatatagttactatagatccttaccgatgccaatgacttcatacaagtttggatcggtggatcccatttctggaaacgaatactttgatgacaatggacagtttgtatcgagcgtctgttggagaaaaaagtcgaatatgcttgtagctgcaaattctactggaaacatgaagctactaaaactggtttgacattgtggcactggactcctccactaagttctttggaaaaagaatctcaaaaacctgatctctggatctgaatctaggacaaagcaacgtttttgtcctcgaaacagtgagatcctatatgactctgacatcttggcccaaacaaaacaaattgaaaatcttggagaggttgaagcaaaaaaagttgtctgtctgtggtaatatttgattcttcctcatgtaactcttttatatgatatataatttgagattagattctcagattcttcggaagtgattcagatttggtctttggacaaggtcggcgtcaatgtgtaatgatgagaggtatataactgtacaagtgtgttcgcatagctcatattttgtaattgttcttggagatttacagttagagagaaaagaggtc

SEQ ID NO: 1830 - DNA, 3389 bp, Eutrema halophilum
atgcctgttatggaaagagtcggtgaagaaacagtggcgagtaacaacataaaattgaaaggacgagtggatgatgttccttgtaagcttgatggtcgtcaaatggtgactgaatcagaaactgggaacgattctttgaggagcgattgtcctggaagctcagctcacaggaatgtagatataaacaagccttcggaggaatctgcaggagccaagatttctgttgaagagctgacattgggaaactatagggtagttcaagggattaataataacatggatagttctagggctggcaagtttgagcatctctatcgtctcgctagaggttctgcgtttaaggcaggagaaggggaacttgattctcaacctcgtgacatggatcaaatgttgtcaagaatcagacaacagctcgcgggagctccttccgagaggcaaaacttgaaaccttttacgaataggaggagcgatcagaatctcgaagccttttctgaacgtctaagagcagctggcgagaacagcattatgaacgctcctgcttggattaacgaaagtgtccacttgaaaacgcccttgacttcttccagtttttctcagatgatacttaaaagagctatgaaggggaaaggagtagtagggaaaaaccaggaaactcctcctgaatttgtcttcgtgatggggaatgggattgtatcacatggtgatgggaataatactaaatcttcttttggaatcagtttgagggagtttctaaaatcaagttatgctaaacgagagaaacgccacagcctttgtctatttaggcagctggtggagctggttgactcagtccattcacaaggattatttttgctggacttgagaccatcccgtctcaccttggccccatcgaagaaacttagatatattggtactttgggaaagaacagtttagactcagatattgacgaagacttgaataggaataggcccgtggttcaggaatcatctattgtaggaagggatctgaagaaaagaaaaatggacttgcgtgtgcattctccagggaatcaacttcaggccacttcaactgggagacctttcaaaaggaaaagccctgtaattgatttaaatgtggtggatgcacgtaatccagacagttgtgaacttcaacagcaaaactatatcaaaaatttaggcgtggcttcaatgacgagaaaacaatctacgtccacttggctagaagagcaatggtatacttgtccagaggagataaatggagaagatatcggagaaaaatcaaatatatatgcccttggtgttcttctgtttgagttgctatgccattgtgagtccagtgagatgcatgctgcaatgatggcagatttgcgtcaacggattctccctccaacgtttctctcaagatacccgaaggaagctggattttgtctttggcttctacatcctgaaccctcctcccgaccaacagctagagaaatactgaagtctgagttgataagcgaggatgattcagttatatcgactgctgctgatgaggagatatctgagctcttacttcattttctatcttcactggaagagcagaagcagaaaaaagcatctaagcttttgaaagacatccagactttggaggatgatattaaggaggccgagcgaagatattcttcaaatgcatctctggtgagatctcatggagctattgaaagaagagtgcaaacatctcctttagacgtgcgctgtacaactacttctggcgccttatttgttccaactcctaatacagagaggctgatgagtaatatccgtcaacttgaagatgcatatttcttcatgaggtcacaaatgaagttatcggattctgccgccagtgcccgttctgacaaaagccttttaaaagacagggacaggtggtctgaaaaccaaaatgagaatcataatacgagaaccaaaggaaaatcttcagatcaactggaagtttttttcgaggggttgtgcaaatttgctcggtatagcaagtttgaaacctgtgggacaataagaagtggagaccttttaaactctgccagtgtggtctgttcattgagttttgatcctgatgaggaacacatagcagcagctgggatatcaaagaaaatcaagatttttgacttcaatgcatttatgaatgaatctgccggtcttcattatccactagtagaaatggtcaacaaatccaaattaagctgtgtttgctggaatagttacatcaaaaattacttggcctcgactgactacgatggtgtagttcagatatgggatgcggggaccggacaaggattttcgcagtacacagaacaccagaagagagcctggtcagttgatttttctccatctgacccgacaaaatttgtcagtggaagtgatgactgttcggtaaagctttggagtgtcaatgagaaacggtcgttaggcacgatctggagtccagcaaatgtatgttgcgtgcaattctctgcttattccaatcacttattggcatttgggtcagctgattacaaggtgtattgctatgatcttcggtatgtgaaaactcccttgtgcacattggctgggcatgagaaagctgttagctatgtcaaatttatggattcagagaccattgtctctgcttccactgataactctctcaagctttggaatcttaacaagacaaattcctctggtttatctcctggtgcttgttcattgacgtataaaggacatacaaatcagaagaattttgtcggattatcagtcttggatggatacatagcatgtggttccgagaccaatgaggtatatagttactataggtccttaccgatgccaatgacttcatacaagtttggatcggtggatccgatttctggaaacgaatactttgatgacaacgggcagtttgtgtcaagcgtatgttggaggaagaaatcgaatatgcttgtagctgcaaattctactggaaacatgaagctgcttaaactggtttgacactgggcactggactctttgagtaagtacgttctatggactaatctcaaaagctgatctatgagtctgaatcgaggacaacaatttgacttgaagaagcaaagtttgtcctggaaactatgatgatagatgaccatgacaagttggaaacgtagggaaaaaaagggttacgaatcttggagagattgaatcaagaaagttgtctgtgtctgtgataatatttgattcttcttcgtgtaattctatatatgatataaattgagataaagttctcagattctttggaagtgatccagatttggtcttgcacaaggtcggcatcaatgtgtaatgaggagagggtatataactgtacaagtgagcttgattatgtaattgttgtt

SEQ ID NO: 1831 - DNA, 3799 bp, Arabidopsis thaliana
gaagaacgaattgtgcaaaagtctatagagaaagagagattcatttgtgtttcttcgactatacacagaatacaaaagagatattatatgtaattatcaatagtatatgacaaatttatagcctcacctttcttcttcttcttcttcttcttctgtgtgtttttgaatttgctttcttcaagaggtttcttctccacaccgcttcggtgtatgatctgattgtgatctctctcgatatctgggatcttcggggtatggaggctgtagattattattattattacgtgtggtgctgatgcaatgagtgttgatgcctgttatggaaagagtagctgaagaaactgtggcgactaacaacatacaattgaaagcacgagtggatgatgttccttgtaataagcttgatgctcgtcataacgatatggtgattcaatcagaaactgcaaacagtgattgtcctggaagctcagctcacaggaatgttgatttgactaagccgccgcctcctgaggaagccgcaggagctaagctttctgttgaagagttgacattggggaactacaggattgttcaagggagtaataatactaatgtggatagtcctagggctggcaagtttgagcatctttatcgtttggctagagggtctgcttttagggcaggagatggggatcttgattctcaacctcgtgatatggatcaaatgttgtccagaatcagacaacagcttgctggagctccttctgagaggcaaaacttgaaaccttttatgtctaggaggagcgatcagaatcttgaagctttttctgaacgtctaagagcagctggtgagaatagtattatgaatgctcctgcattgatcagtgaaggtgtccaaatgaaaacgccggtgagttcttcgaatttttctcagttgttacttaaaagagctatgaaagggaaaggggtagtaggaaagaaccaggaaactcctcctgaatttgtctctgatcaagatttaggaagcaaggaaaaaaagttggatattagcaagtcgcctactcctcacgatgtgttacctctaaaatcaagtcccaaaggaaatggtatggtatcacatggtgatgggaatcatagtaaatcttctattggaatcagtttgagggagtttcttagatcaagttatgctaaaagagaaaaaagacatggcctttgtctatttaggcagctggtggaactggttgactcagcccattcaaaaagattattcttgctagacttgagaccatcccttttcactttagttccatcaaagaaacttagatatattggtaattttggaaagaacgatctagaatcagatgttgacgaagatttgaataggaggaggcctgttgttgaggaatcatctagtggaggtagggattcgaagaaaagaaaaatggacttgcatttgaattctccagggaatcaacttcaggccacttcaaccgggcgacctttcaaaaggaaaagccctgtgattgatttaaacatggttgatgcacgtaatccagacagttgcgagcttcaacagcaagactacataaaaaatttaagcgtgtcttcagtgtcgagaaaacagtctatgtccacatggctagaagagcaatggtatacttgtccagaggagataaatggagaagatattggagaaaaatcaaatatttatgcccttggtgttcttctgtttgagttgctatgccattgcgagtcaggcgagatgcatgctgcaatgatggcagatttacgccatcggattctcccaccaacatttctctcgaaatacccgaaggaagctggattttgtctttggcttctacatcctgaaccctcctcccgaccatcagctagagatatactaaagtcagagttgatatgcgaggatgattcagttaaatcgactgctgctgctgaggagatatctgagctgttacttcattttttgtcttcattagaagtgcagaagaagaaaaaagcatctaaacttttgcaagatatccagaccttagaggatgatattaaggaggccgagcgaagatattcttcaaatgtatctctggtgagatctcatggagctattgaaaaaagggtgcaatcatctcccctagacgagcactgtacaacttccagtgccttgtttgtaccaactgctaatacagacaggctgatgagtaatatccgtcaacttgaagatgcatattttttcatgcgatcacaaatcaacttatcgagttctgctgctactgcccgttctgacaaaacactaaaggacagggacagatgctctgaaaaccaaaatgaaaatcaggatatgagtaccaaaggaaaatcttcagatcaactcgaagtgtttttcgaggggttgtgcaaatttgctcggtatagcaagttcgaaacctgtgggacaataagaagtggggaccttttaaactctgcaagtgtggtctgctcgttgagttttgaccctgatgaagaacacatagcagcagctgggatatcaaagaagatcaagatttttgacttcaatgcatttatgaatgaatctgtcggtgttcattatccactagtagagatggtcaacaaatctaaattaagctgtgtttgctggaatagctacatcaaaaactacttggcctcgactgactacgatggtgtagttcagatatgggatgccggcactggacaaggattttcgcagtacacagaacaccagaagagagcctggtcagttgatttttctccatctgacccgacaaaatttgttagtggaagtgatgactgctcggtgaagctttggagcatcaatgagaaacgttcattaggcacaatctggagtccagcaaatgtgtgttgcgtgcaattctcttcttattccaatcacttattggcatttgggtcagctgattacaaggtctattgctatgaccttcggtatgtcaaaacaccttggtgcacattggctggtcatgagaaagcggtgagttatgttaaatttatggattcagaaaccattgtttctgcttccactgataactctctcaagctttggaatcttaacaagacaaattcctctggtttatctcctggtgcttgttcattgacatataaaggacatacaaatcagaagaatttcgttggattgtcggttttggacggatacatagcttgtggttcagagaccaatgaggtatatagttactataaatctttaccgatgccaatgacttcatacaagtttggatccgtcgatcccatttctggaaacgaatactttgatgacaatggacagtttgtgtcgagcgtctgttggaggaaaaaatcgaatatgcttgtagctgcaaactctactggaaacatgaagctactaaaacttgtttgacaacttggccttttcgctactactgcgggcattggactttttgagtctgaaactaggacaaagcaggtctgactttgaagcaaacgtttttgtcctggaaactatgatcccatatgaccagaagagaaaaaaagttcgaaatcttggagaagttgaagaagcaaaactgtctgtgataatatattatttgattcttcttcctgtaattctatatatatgagatataatttgagataaacttctcagattcttcagaaatgattcatatttggtcggcataacgtgtaatgatgagaggtatataacttgtacaagtgtgttatatcgttagctcggttatgtaattgttgttggagattctctataagagagaaaatatatatatcatccattcatttc

SEQ ID NO: 1832 - DNA, 3660 bp, Arabidopsis lyrata
tattatcatcaatatatgacaaatttatagcctcacctttcttcttcttctttttgaatttgctttcttcaagaggtttcttcttcttggaaccgtttggattcaccgcttcggtgtatgatcttgattctgatgagattcgatttgttttttgtataaggtatggaggctgtagattgttatcattccatgtggcaatgaatgtggatgcctgttatggaaagagtagctgaagaaactgtggcgagtaacaacaacatacaattgaaaggacgagtggatgatgttccttgtaagcttgatgctcttcatagtaatatggtgattcaatcagaaactagaaacagtgactgtcctggaagctcagctcacaggactcttgagatgactaagccgccgcctccggaggattctgctggagctaagctttctgttgaagagttgacattggggaactataggattgttcaagggactaataatactaatatggatagttctagggctgggaagtttgagcatctttatcgtcttgctagagggtcttctctaaggccaggagatggggatcttgattctcaacctcgtgacatggatcaaatgttgtcacgaattagacaacagcttgctggagctccttccgaaaggcaaaacctgaaaccttttatgactaggaggagcgatcacaatcttgaagctttttctgaacgtctacgagcagctggtgagaacagtattatcaaagctccttcattgatcagtagtgaaggtgtccaattgaacgcgcctgtcaatttttctcagttgttacttaaaagagctatgaaggggaaaggcgtagtaggaaagaaccaggagtctcctcctgaatttttctctgaccaagatttaggaagcaaggaaaaacagttggatagtagcaagtcgcctactcctcaccatgtgttacccctaaaatcaagtcccaaaggaaatgggatggtatcacatggtgatggaaatcatactaaatcttcttttggaatcagtttgagggagtttcttagatcaagttatgctaaacgagagaaaagacatggcctttgtctatttaggcagctggtggagctggttgactcagcccattcaaaaggattattcttgctagacttgagaccatcccttttcactttagttccatcgaagaaacttagatatattggtacttttggaaagaacgatctagactcaggtgttgacgaagatttgaataggaggaggcctgttgttcaggaatcatctattggaggtagggattcaaagaaaagaaaaatggacttgcatgtgcattctccagggagtcaacttcaggccacttccaccgggagacctttcaaaaggaaaagccctgtgattgatttaaatgttgttgatgcacgtaatccagacagttgcgagcttcaacagcaagactatatcaaaaatttaagcgtgtcttcaatgacgaaaaaacagtctatgtccacatggctagaagagcaatggtatacttgtccagaggagattaatggagaagatatcggagataaatcaaatatttatgcccttggtgttcttctgtttgagttgctatgccattgcgagtccggtgaaatgcatgctgcaatgatggcagatttacgccatcggattctcccaccaacatttctctcaaaatacccaaaggaagctggattttgtctttggcttctacatcctgaaccctcgtcccgaccaacagctagagatatactgaagtcagagttgatatgtgaggatgattcagttaaatcgactgctgctgctgaggagatatctgagctcttacttcattttttgtctactctagaagtgcagaagcagaaaaaagcatctaagcttttgcaagatatccagaccttagaggatgatatcaaggaggccgagcgaagatattcttcaaatgtatctctggtgagatctcatggagctattgaaagaagggtgcaatcatctcccctagatgagcactgtacaacttctggcgtcttgcttgtaccaagtactaatacagacaggctgatgagtaatatccgtcaacttgaagatgcatatttcttcatgcgatcacaaatcaacttgtcgagttctgctgctagtacccgttctgaaaaaatcgtactaaaggacagggacagatgctctgaaaaccaaaatgaaaatcaggatatgagtaccaaaggaaaatcttcagatcaactggaagtgtttttcgaggggttgtgcaaatttgctcggtatagcaagttcgaaacctgtgggacaataagaagtggggaccttttaaactctgcaagtgtggtctgctcattgagttttgaccctgatgaggaacatatagcagcagctgggatatcaaagaagatcaagatttttgacttcaatgcatttatgaatgaatctgtcggtgttcattatccactagtagagatggtcaacaaatctaaattaagctgtgtttgctggaatagctacatcaaaaactacttggcctcgactgactacgatggtgtagttcagatttgggatgccgggactggacaaggattttcgcagtacaccgaacaccaaaagagagcatggtcagttgatttttctccatctgacccgacaaaatttgtcagtggaagtgatgactgctcggtgaagctttggagcatcaatgagaaacgttcattaggcacaatctggagtccagcaaatgtgtgttgcgtgcaattctcttcttattccaatcacttattggcatttgggtcagctgattacaaggtctattgctatgatcttcggtatgtcaaaacaccttggtgcacattggctggtcatgagaaagcggtgagttatgttaaatttatggattcagaaaccattgtttctgcttccactgataactctctcaagctttggaatcttaacaagacaaattcctctggtttatctcctggtgcttgttcattgacatataaaggacatacaaatcagaagaattttgtcggattgtcggttttggacgggtacatagcttgtggttcagagaccaatgaggtatatagttactataaatccttaccgatgccaatgacttcatacaagtttggatccgtcgatcccatttctggaaacgaatactttgatgacaatggacagtttgtgtcgagcgtctgttggaggaaaaaatcgaatatgcttgtagctgcaaactctactggaaacatgaagctactaaaacttgtttgacaacttggcgttttcactactacgggcattggactctttgatctgaatctaggacaaaccagtttgactttgaagcaacgtttttgtcctggaaattagatcctatatgaccagaacagaaaaaaaaatcgaaatcttggagaagttgaagaagcaaaactgtctgtggtaatattatttgattcttcttcctgtaattctatatatatgagatataatttgagataacttctcagattcttcagaagtgattcagatttggtcggcataatgtgtaatgatgagaggtatataacttgtacaagtgtgttatatcattagctcaattatgtaattgttgttggagattctctgttaagagataaa

SEQ ID NO: 1833 - DNA, 2230 bp, Brassica napus
agtgggcgatgtgtggaggaatcagagaggagagtgatttggggtctgtgattggactctctttctctagtcatgtttgattgggacgacgaagagcttactaatatgatatggggtgacgagggagaggcaggcgaacatattgtgccttttaaagtaagaaacaggaaggaacaaggcgatgaatctaataaggcagttaagccagctgaaagtaaaactcaccttcatgatagtaagctggggggagcagttcagggcaaaatattgagtgtatgagctcatggcctgactcatcagtatctaatgctagaaaagctgatccaggaccaggttcgagtgagccagctagatatgattcaacaagaagtgagaaagcgtctgaacttgggaaaggccctgatatttttcatagcactgatgagagtaaagagcaaggtgatttcgatgagtatggatgggctaacattggtagctttgatgatcttgatcgaatgttcagtagtgatgtccctatatttggcgatggcactctcagcggtgcagatgagttatggtcttcttctaaagatgtatccaagccgttaccatccattttggactctcaagatctaggattggatattagaactgagtttgaacaacaagagaaccagcagtttccattgactggagaaaccaatggtggtccatcatcccaaagtgcgcctagagttcgtgtaaccccaaaagctgagcaatatcatgagcataagagacaatcctcagttgatgaccagccatatcaacaaaacaaaatgttgaagttttcagaaatgttggggactcatgaggcaggggcatctcaagatccgtacggtcagaggactctgtccaggagaaaatttgtaaaccagttgggaccgtcacgatcatctatgatgggtgtcaatctgcagagtgagtctcaagggtctgggacatcacattatccacatatgccaaaccaatacatggctacttctggttttggtaatccatattctgctgtgcctgtagtttcagccttccaacgtcctgatgttaacaagaatcagctgatgcatccttcctacaatcctactactgccatctctgcaaacatggtaacggatgctgcctctgcacgaccttcaacaatgacgccgcaggaaaaactagaaaaacttaggcgcagacagcaaatgcaggcgatgcttgctattcagagacaacagcagcaatttcgtcaccaagttcctgtagcagatcagtccattactcagcttgtcgacaaaactagtcttcaagggctaaccgcaataccttcctttgatcccaattcatctctggaactagatgattctggaaactttgctgctgctgctgttgataatccatcagaattctcggttctttatcggcttcaagatgttgtagcaaagttagatatggaaacaaggacttgtataagggatagcttattccgtttggctgatagcgcaggtcagagacatcacactagtgatacaccccacagtaataagactagccaggatgaccaggaggttattcctcaagaaaaatccagatatagatatgcagggatgctagacacagaaacggtgaccaatcccacagacagaactgtggctcatttgctctttcataggccttttgatatgtctgcggcaaagcatacggaaggactagaatcaccatcttcttcgaagatgggagctgaagtaaaagggagttttcctagcacaagagagagtcacatgaataagcagaaggcaaaagaggaagatgtacctgcaggttcagttgctttagggtatgcatccaacttaggatccagtagcactgttggtgagagggttaatgaagcatcccaaggaaacaaaagaaagttgtgaagtatagaaaggtttaggtttgcggtgctagagaggagcctgaggaaatctgcagcgtaggcaacatctctctgcattgctagaaacaatctcctgttcactcctttcatgtaattagatgttttttttttaattgttgaataccctttcttattacacatatttccatgagaaaacattttggaaaactcatgtagtttgctcttacaattttcttttcaaaaccagatttgatctctgatttaaaaaaaaaaaaaagggcggccggtgctagagttatcaatctaagcggtggtaagaggcagttcaattca

SEQ ID NO: 1834 - DNA, 949 bp, Brassica rapa
  misc_feature (906)..(906): n is a, c, g, or t
ccaggggttctctctattggcaggtcccttgttttgacacacacacgcacacatagaccaacaacaacaacaatggctatatcaagaacattcatgtcctttaatctcttcatcttcttcctcgttattgctacaaccaatggtcaggctccagctccaaccccttcaggtccaaccaacataaccgcagtcctagaaaaagccggtcaatacacaatgttcataagactcctcaagagcacccaagcagcagaccaaatcaacactcagctaaattcttcctcgagccaaggcctaaccgtgtttgccccgaccgataacgcctttagcagcctcaaatccggaaccttaaactcattatccgaccagcaaaaagttcagcttgttcagttccatgtccttcctacactcttaaccatgcctcagtttcaaactgttagtaaccccttacgcacgcaagctggtgatggacaaagcggtaagttccctcttaacatcacgagctccggtaaccaagtcaacatcaccaccggagttgtgagcgccaccgtggctaactccgtctacagcgataagcagctcgccgtgtaccaagtggatcaagttttgctgccattagcaatgtttggttcaagctcggcggctcctgctccggcgcctgagaaaggcggctcggttacgactggttcagcttccggtagcgacggtggaggagattctactgattcatctgatgcagagaggatcagatacgggataatcgccaccgtggcagccattgctgcttcttctctgtggatataactcgagagagagagagagagagctattcaagagtctacatattgaattttaagaataacgatgagtttaagttttgttgtaatttgagatttgttaatgctntgattcaaactttttgatgaaaaaacaatgcacacgtgtttcg

SEQ ID NO: 1835 - DNA, 1339 bp, Raphanus sativus
  misc_feature (433)..(434): n is a, c, g, or t
gggcaaagtatcatcaaacaattatgttctcttgcatcatatatatttctttttagtttttttctttctttcttacaacacataatgataggcacacatgtcacataaatcattatgagtaatatgattagaaatctcacatttcttgaataacacttcttcacagcctttgaaagatcacacgtaactcttttcagtttcattcttaattttcaatcctcacctacccaacctcccttcaaagcaatctctctccctctcactcactttcgtaagttcagcctaaaaacatttccaatctctcttaactggattaattgaaagaatttgttaaagttaacaagtaataatcttcatactaactagagaatcctactcttcaccttactacatctctctatataacaaatcctaaaacctctcacaatacacnnaccacataacaacaacaatggctattttgagaaaatttatttcctcaaacctcttcatcttcttcctggttatagctacaaccaatggtcaggctccagctccaaccccttccggtccaaccaacataaccgcagtcctagaaaaggctggtcaattcacaatgttcataagactcctcaagagcacccaagccgcagaccaaatcaacactcagctcaattcatcctcgagccaaggcctaaccgtgtttgccccaaccgataacgcctttagcagcctcaaatccggaaccttaaactcattatctgaccagcaaaaagttcagcttgttcagttccatgtccttcctacactcttaaccatgcctcagtttcaaactgtcagtaaccccttacgcacgcaagctggcgatggacagaacggtgaattccctcttaacatcactagctctggtaaccaagtcaacatcaccacgggtgttgtgagcgccaccgtggctaactctgtctacagcgacaagcagctcgccgtgtatcaagtggatcaagttttgttaccattagcaatgtttggttcaagctcggcggctcctgctccggcgcctgagaaaggcggctcggttacgacaggttcagcttccggtagcgacggtggtggagatacgtctactgattcatctgatgcagagaggatcagatacgggataatcgccaccgtggcagccatcgctgcttcttcactgtggatataactcgagagagagagagagagagagagcttttcgagagtctccacgttggcttttaagaataatgatgagtttaagtttggttgtaatttgagattgtgttatcatgttaatgtttttgatttaaaatgagacaacgagttgcgattgcacaaa

SEQ ID NO: 1836 - DNA, 1078 bp, Brassica juncea
acaatggcgacttcaagaacattcatgtcctctagtctcttcatcttcttccttgtcatggctacaaccaatggtcaggctccagttccaaccccttcaggtccaaccaacataaccgcagtcctagaaaaggcgggtcaatacacaatgttcataagactcctcaagagcacccaagccgcagaccaaatcaacactcagctcaattcttcctccagccaaggcctaaccgtgtttgcccctacagacaacgcatttagcagcctcaaatccggaacattaaactccttatccgaccagcaaaaggttcagcttgttcagttccatgtccttcctacactcttaaccatgcctcagtttcaaactgttagtaaccccttacgcacgcaagctggtgatggacaaaacggtaaattccctcttaacatcactagctccggtaaccaagtcaacatcaccaccggagttgtgagcgccaccgtggctaactccgtatacagcgataagcagctcgccgtgtatcaagtggatcaagttttgctgccattagcaatgtttggttcaagctcggcccctgctccggcgcctgagaaaggcggatcggttacgacaggttcaccttccggtagcgacggtggaggagattctactgattcatctgatgcagagagggtcagatacgggataatcgccaccgtggtagccattgctgcttcttctctgtggatataactctagagagagagcttttcaagatggatttcaagaataacaatgagctttaagtttggttgtaatttgagattgtgttatcatgttaatgttttggttcaaaatgagacaacgagttgcgattgcccaaaacttttttttatgaaaaaatgcaacatgtgtttcgattttgatttgcatgtttcaagtgtaacgatagtaacaacacgttactctatccaatcattattctccacgtggacactgtcttaagtaggtcccgtttttgtaaacgcttaccaatgaatggcagacacacatgattagctatttacacgctggtctgataatgagttcaaggctccgg

SEQ ID NO: 1837 - DNA, 1401 bp, Eutrema halophilum
gcaatgtattatcatccaattatgtttttctttcgtcatttttttaaaagtttttttgttttcttacatcacatgatgatacacatgacacataaatcataatgagtagtatgatttgcaatcccatattacttgaataacacttcttcacagcttttgacagatcgcaataaccctttttcagtttattcttcattttcaatcctcaaccactcaacctctcccttcaaagcaatctctctctcactctcattttaaacaaacttttgtaagtttaacctaaaaacatttctaatcactgttggattgattgaaagaatttgttttagttactaagtaataatcttcagactagcaagagagtcatactcttcaccaaactacatatctctatataacaaagcccaaaacctctcaacacacacacacacacacacacacacacacacacaaaaaagaacaatggctgcttcaagaacattcatttcctctaatctctttatcttcttccttgtgatggctacaaccaatggtcaggctccagctccagccccttcaggtccaaccaacataaccgcagtcctagaaaaagccggtcaattcacaatgttcataagactcctcaagagcacccaagccgcagaccaaatcaacactcagatcaattcttcttcgagccaaggcctaaccgtgtttgccccgaccgataacgcctttagcagcctcaaatccggaaccttaaactcattatctgaccagcaaaaggttcagcttgttcagttccatgtccttcctacactccttaccatgcctcaatttcaaaccgttagtaatcccttgcgcacgcaagctggtgatgggcaaaacggtaaattccctcttaacatcactagctccggtaatcaagtcaacatcaccaccggtgttgttagcgccaccgtggctaactctgtctacagcgataagcagctcgccgtttatcaggtcgatcaagttttgctgcccttagcgatgtttgggtcaagctcagctcctgctccggcgcctgagaaaggtggctcggttacgactggttcagcttctggcagcgacggtggaggagattctactgattcatctgatgcagagagatttggattcgggttaatcgccacagtggctgccattgctgcttcttcttctctgtggatatgacccgagagagagagagagcttttctcgggtctccacattggattataagaataacgatgagagctttaaattttgttgtaatttgagattgtgttatagaattgtgttatcatgttattgttttgattcaaaatgagacaacattacgattgcgattgcacaaaatttttcttgatgaaagaaagcaaaatgtgttttgagtataat

SEQ ID NO: 1838 - DNA, 2720 bp, Eutrema halophilum
aaatcaaaatcaaaagcttcaaattcgatcgaggacgataataatccgaaaacacgaattcgtgtgagcttgaatcaaaagattcgtcttcttctctcgtctctctgattctgaatattccatatatgtggacgtaacttagcatatacacacaagtgtaaagtatatgtgttgaaatcgaggatggatctgttccgagtctggtcaggtatggatttcttagcttggagaggaatggcgtacacacttcttctgctcaactttgtcttcgcttgccaacttcttcttcttcaacctctcgtatccgctttagatggccaatctgtagatgctgctgagttatttgagagagcttcacagagtatcaaggtcaagcgtttcagcgatgccctcgatgatctaaatgcagccatagaagtagaccctgcactttcagaagcttattttaggcgtgcatctgtgcttcgtcatttttgcagatacgaagactctgaaaatagctaccagaaatatttagaactgaatccaggagatccaaatgcggagaaagagctatctcagcttcatcaagctaagagtgcattggagaccgcgtcgactctctacgaatcaaaggacattgggaaggctctggaatttgttgacaaagttgttcttgtcttctccccagcttgctctaaggcaaagcttcttaaagtcaagctccttatggtgtctaaagactactcagctgcaatttccgagactggttatattctcaaggaagatgaaaataaccttgaggctctgctccttcgtggccgtgcctactactatttagcagatcatgatgtcgcccaaagacattaccaaaaagggcttcgtcttgatccagaacacagtgaactgaagaaagcatatttcggattgaaaaaactgctcaagaagacaaaaagcgcagaagataatgcaaacaaaggaaaattgagagtttcaacagaggactataaagcagctatagctctagaccctgaacacactgcacataacgttcatctctatcttggactatgcaaggtctcagttaggctcggccgcggaaaagacggcttaaatagctgtaatgaagcgcttaacattgatccagaactgattgaagctatacatcagaggggagaggctaaactgttgctagaagattgggaaggcgctgtggaggatttgaaacaagccgctcaaaactctcaggacatggaaattcacgaggcacttggtagagcagagaaagcactgaagatgagcaaacgaaaagactggtataaaattcttggagtttccaaaaccgcctcaatctctgaaattaaacgagcctacaaaaagctcgctttgcaatggcatcctgataaaaacgtcgacaatagagaagaagctgagaacaaattccgagaaatcgctgcagcttatgaggttcttggagacgacgataagcgggcgagatttgacagaggagaggatcttgaagatatgggtcgaggtggcggccatggaggatttgatccattcggtggtggcggtggtggtgggtacactttccattttgagggcggtttccccggtggtggtggtggttttggcggtttcggtttctaacttggacatgaagtaatcatgtaacttaagactaaactttctttcagattatactcaaaacacattttgctttctttcatcaagaaaaattttgtgcaatcgcaatcgtaatgttgtctcattttgaatcaaaacaataacatgataacacaattctataacacaatctcaaattacaacaaaatttaaagctctcatcgttattcttataatccaatgtggagacccgagaaaagctctctctctctctcgggtcatatccacagagaagaagaagcagcaatggcagccactgtggcgattaacccgaatccaaatctctctgcatcagatgaatcagtagaatctcctccaccgtcgctgccagaagctgaaccagtcgtaaccgagccacctttctcaggcgccggagcaggagctgagcttgacccaaacatcgctaagggcagcaaaacttgatcgacctgataaacggcgagctgcttatcgctgtagacagagttagccacggtggcgctaacaacaccggtggtgatgttgacttgattaccggagctagtgatgttaagagggaatttaccgttttgcccatcaccagcttgcgtgcgcaagggattactaacggtttgaaattgaggcatggtaaggagtgtaggaaggacatggaactgaacaagctgaaccttttgctggtcagataatgagtttaaggttccggatttgaggctgctaaaggcgttatcggtcggggcaaacacggttaggccttggctcgaagaagaattgatctgagtgttgatttggtctgcggcttgggtgctcttgaggagtcttatgaacattgtgaattgaccggctttttctaggactgcggttatgttggttggacctgaaggggctggagctggagcctgaccattggttgtagccatcacaaggaagaagataaagagattagaggaaatgaatgttcttgaagcagccattgttcttttttgtgtgtgtgtgtgtgtgtgtgtgtgtgtgtgtgttgagaggttttgggctttgttatatagagatatgtagtttggtgaagagtatgactctct

SEQ ID NO: 1839 - DNA, 872 bp, Brassica juncea
accaacaacaacaacaatggctatatcaagaacattcatgtcctctaatctcttcattttcttcctcgttatggctacaaccaatggtcaggctccagctccaaccccttcaggtccaaccaacataaccgcagtcctagaaaaggctggtcaatacacaatgttcataagactcctcaagagcacccaagcagcagaccaaatcaacactcagctaaattcttcctcgagccaaggcctaaccgtgtttgccccgacagataacgcctttagcagcctcaaatccggaaccttgaactcattatccgaccagcaaaaggttcagcttgttcagttccatgtccttcctacactcttgaccatgcctcagttccaaaccgttagtaaccccttacgcacgcaagctggtgatggacaaaacggtaaattccctcttaacattactagctccggtaaccaagtcaacatcaccacgggagttgtcagcgcaacggtggctaactctgtctacagcgataagcagcttgcagtttatcaagtggatcaagttttgcttccattagcaatgtttggttcaagctcggctcctgctcctgcgcctgagaaaggtggcttggtttcgaaaggctcagctccaagtggggacgatggaggagattctactgattcatctgacacagagaggatcagatacggtttaatctccaccaccatggcagccattgctgcttattttctgtggatataacatcaagtcagtccatattgattattggattttaaagagctttaaattttgttgtaattgagacttgtgttatcgtgttattgttttgattcaaaatgagacaaattacgattgaggttgcgca

SEQ ID NO: 1840 - DNA, 930 bp, Brassica napus
ctcagtcacgtatcgatagctgaatcaagtcgtatcggcattacggccggggacacaacaacaacaataacaacaatggctacttcaagaatattcatgtcctctaatctattcattttcttccttgtcatggctacaaccaatggtcaggctccagcaccaaccccttcaggtccaaccaacataaccgcagtcctagaaaaggctggtcaatacacaatgttcataagactcctcaagagcacacaagccgcagaccaaatcaacactcagctcaattcttcctcgagccaaggcttaaccgtgtttgccccaaccgataacgcatttagcagcctcaaatccggaaccttaaactcattatccgaccagcaaaaggttcagcttgttcagttccatgtccttcctacactcttgacgatgcctcagttccaaaccgttagtaaccccttacgcacgcaagctggtgatggacaaaacggtaaattccctcttaacattactagctccggtaaccaagtcaacatcaccacgggagttgtcagcgcaacggtggctaactctgtctacagcgataagcagcttgcagtttatcaagtggatcaagttttgcttccattagcaatgtttggttcaagctcggctcctgctcctgcgcctgagaaaggtggcttggtttcgaaaggctcagctccaagtggggacgatggaggagattctactgattcatctgacacagagaggatcagatacggtttaatctccaccaccatggcagccattgctgcttattttctgtggatataacatcaagtcagtccatattgattattggattttaaagagctttaaattttgttgtaattgagacttgtgttgtcgtgttattgttttgattcaaaatgagacaaattacgattgaggttgcgc

SEQ ID NO: 1841 - DNA, 909 bp, Brassica napus
gaatatcggcatggtctttaattctcatcaggacacaacaacaacaataacaacaatggctacttcaagaatattcatgtcctctaatctattcattttcttccttgtcatggctacaaccaatggtcaggctccagcaccaaccccttcaggtccaaccaacataaccgcagtcctagaaaaggctggtcaatacacaatgttcataagactcctcaagagcacacaagccgcagaccaaatcaacactcagctcaattcttcctcgagccaaggcttaaccgtgtttgccccaaccgataacgcatttagcagcctcaaatccggaaccttaaactcattatccgaccagcaaaaggttcagcttgttcagttccatgtccttcctacactcttgaccatgcctcagttccaaaccgttagtaaccccttacgcacgcaagctggtgatggacaaaacggtaaattccctcttaacattactagctccggtaaccaagtcaacatcaccacgggagttgtcagcgcaacggtggctaactctgtctacagcgataagcagcttgcagtttatcaagtggatcaagttttgcttccattagcaatgtttggttcaagctcggctcctgctcctgcgcctgagaaaggtggcttggtttcgaaaggctcagctccaagtggggacgatggaggagattctactgattcatctgacacagagaggatcagatacggtttaatctccaccaccatggcagccattgctgcttattttctgtggatataacatcaagtcagtccatattgattattggattttaaagagctttaaattttgttgtaattgagacttgtgttatcgtgttattgttttgattcaaaatgagacaaattacgattgaggttgcg

SEQ ID NO: 1842 - DNA, 868 bp, Raphanus sativus
acacaacaacaacaacaacaatggccacttcaagaacattcatgtcctctactctattcattttcttccttgtcatggcaacaaccaatggtcaggctccagctccaaccccttcaggtccaaccaacataaccgcagtcctagaaaaggctggtcaattcacaatgttcataagactcctcaagagcacccaagccgcagaccaaatcaacactcagctcaactcttcctccagccaaggcctaaccgtgtttgcccctaccgacaacgcatttagcagcctcaaatccggaaccttgaactcgttatccgaccagcaaaaggtccagcttgttcagttccatgtccttcctacgctcttgaccatgcctcagttccaaaccgttagtaaccccttacgcacgcaagctggtgatggccaaaacggtaaattccctcttaacatcactagctccggtaaccaagtcaacatcaccacgggagttgtcagcgcaacggtagctaactctgtctacagcgataagcagcttgctgtgtatcaagtggatcaagttttgctgccgttagcaatgtttggttcaagctcagcacctgctcctgcgcctgagaaaggtggcttggtttcgaaaggttcagctccaagtggtgatgatggaggagattctactgattcatcagatacagagagaatcagatattggttcatctccaccatggcagccattgctgcttcttctatgtggatataacaccatatttgattttaagaataacgaatgagctttaaattttgttgtaatttgagttttgtgttatcatgttattgttttggttcaaaaaattacgattgagattgcacaattttttt

SEQ ID NO: 1843 - DNA, 2715 bp, Eutrema parvulum
cgtgttacacttaaaacatgcaaatcaaaatcgatagcttcaaattcgatcgaggacgataatccggaaacacgaattcgtgtgagcttgaatcgaagattcgtcttcttcttcttcttgtttcgtttctctgattctgaatatatcccaaattcgcgggtgtaactttgcatacacacttgtatgtatatgtattgaaatcgagaatggatctgttccgagtctggtcaggtatggatttcttagcttggagaggaacggcgtacactcttcttctcctcaactttgtcttcgcttgccaacttcttcttcttcaacctctcgtatcctctgtagatggtcaatctgcagatgctgctgagttatttgagagggcgtcacaaagtatcaaggtcaagcgttttagcgatgccctggatgatctgaatgcagccatagaagtagaccctgcactttcagaagcttattttaggcgtgcgtctgtgcttcgtcttttttgcagatacgaagacgctgaaaatagctatcacaaatatctagaactaagtcctggagattccaatgctgagaaagagctctctcagcttcatcaagctaagagtgctttggagactgcatggactctctatgaatcgaaagacattgggaaggctcttgaatttgttgataaagttgttcttgtcttctccccagcttgctctgaggcaaaggttctcaaagtcaagctccttatgtcgtttaaagactactctgctgcaatttccgagtctggttatattcttaaagaagatgaaaataatcttgaagctctgctccttcgtggccgtgcgtactactatttagcagatcatgatgttgcccaaagacattaccaaaaagggcttcgtcttgatccagaacacagtgaactgaagaaagcttacttcggattgaaaaaactgctcaagaaaacaaaaagcgcagaagataatgccaacaaaggaaagttaagggtttcaacagaggactataaagcagctatagctctagaccccgaacacactgcacataacgttcatctctatcttggactatgcaaggtctctgtcaggcttgggcgtggaaaagatggcttagatagctgcaacgaagcacttaacatagatccagaactgaccgaagcatttcatcagaggggagaagctaaattgttgcttgaagattgggaaggagctgtggaggatttgaaacaagccgctcaaaactcccaggacatggaaatccatgaagcacttggtagggcagagaaagcactgaagatgagcaaacgaaaagattggtataaagttcttggaatttccaaaaccgcctctatctctgaaatcaaacgagcctacaagaagctcgctctgcaatggcatcccgataaaaacgtcgggaatagagaagaagctgagaacaaattccgagaaatcgctgcagcttatgaggttcttggagacgacgataagcgggcgagatttgacagaggagaggatcttgaagatatgggtggaggtggcggccgtggaggatttgatccatttggtggtggtggtggtggtgggtacactttccatttcgagggcggttttcccggtggtggtggcggcggttttggtggttttggtttctaacttaggcatgaaggaatcatgtaacttaagactaagcttttttttttctcaaaatatactcgaaaacacattttgcattctttcatcaaaaaagttttgtgtaatcgcaatcgtaatggtatcattccgaatcaaaacgataacatgataaaacaatctataacacaatctcacattacaaacaaaatttaaagttctcattgttattcatacgatccaatatggaaactcgagaaaagctctctcgaattacatccaaagaaaagaagcagcaatagttgccacagttgagattaacccgaatccgagtctctctgcatcagatgaatcagtagaatctcctccaccgtcgctaccagaagctgaacctgtggtaaccgagccacctttctcaggcgccggagcaggagccgcggttgacccaaacatagctaacggcagcaaaacttgatcgacctgataaacagcgagctgcttatcgctgtagacagaattggccacactggcgctgacaactccggttgtaatgttgacttggttaccggagctagtgatgttaagaggaaatttaccgttttgtccatcaccagcttgcgtgcgtaaggggttactaactgtttgaaactgaggcatggttaagagtgtaggaaggacatggaactgaacaagctgaactttttgctggtcagataatgagttcaaggttccggatttgaggctgctaaaggcgttatcagtcggggcaaacatggttaggccttggctcgaggaagaattgagctgagtgttgatttggtctgcggcttgggtgctctttaggagtcttatgaacattgtgaattgaccggctttttctaggattgcggttatgttagttggaccggaaggggctggagctggagcctgaccattgcttgtaaccataacgaggaagaagatgaagagaccagaggaaatgaatgttcttgaagttgccattgttgttgttgtgtgtgtatgttgagaggttttgaggtttgttatatagagagatgtagtttggtgaagagtaagaatctct

SEQ ID NO: 1844 - DNA, 1379 bp, Eutrema parvulum
gcaaaatattatctcagccaattatgttttcttacatcatattttttttttcttttcttacatcgcatgatgatacggacacatgacacataagtcataatgaatagtatgattagcaatcctatatttcttgaataacacttcttcacagcttttgacagatcacaaaaccctttttcagtttcattcttcattttcaatcctcacccacccaacctctcccttcaaagcaatctctctcctctctctctctcactctcactttaaacaaatctttttgtaagtttaacctaaaaacatttctaatctctctcgattgattttaattgaaagaatttgttttagttaacaagtaataatcttcacactaggaagagattcttactcttcaccaaactacatctctctatataacaaacctcaaaacctctcaacatacacacacaacaacaacaatggcaacttcaagaacattcatttcctctggtctcttcatcttcttcctcgttatggttacaagcaatggtcaggctccagctccagccccttccggtccaactaacataaccgcaatcctagaaaaagccggtcaattcacaatgttcataagactcctaaagagcacccaagccgcagaccaaatcaacactcagctcaattcttcctcgagccaaggcctaaccatgtttgccccgactgataacgcctttagcagcctcaaatccggaaccttgaactcattatctgaccagcaaaaagttcagcttgttcagttccatgtccttcctacactcttaaccatgcctcagtttcaaacagttagtaaccccttacgcacgcaagctggtgatggacaaaacggtaaatttcctcttaacatcactagctccggtaaccaagtcaacattacaaccggagttgtcagcgccagtgtggccaattctgtctacagcgataagcagctcgctgtttatcaggtcgatcaagttttgctgccgttagctatgtttgggtcaaccgcggctcctgctccggcgcctgagaaaggtggctcggttaccacaggttcagcttctggtagcgacggtggaggagattctactgattcatctgatgcagagagactcggattcgggttaatctcaactgtggcaactattgctgcttcttttctttggatgtaattcgagagagcttttctcgagtttccatattggatcgtatgaataacaatgagaactttaaattttgtttgtaatgtgagattgtgttatagattgttttatcatgttatcgttttgattcggaatgataccattacgattgcgattacacaaaacttttttgatgaaagaatgcaaaatgtgttttcgagtata

SEQ ID NO: 1845 - DNA, 992 bp, Arabidopsis lyrata
ccaggggttctctctattggcaggtcccttgttttgacacacacacgcacacatagaacaataactacaacaatggctacttcaagaacattcatttcttctaatcttttcatcttcttcctcatcgtggctactaccaatggtcaggctccagctccaggcccttcaggtccaaccaacataaccgcaatcctagaaaaggcgggtcaattcaccttgttcataagacttcttaaaagcacccaagcctcagaccaaatcaacactcagctcaattcttcctcgagtaatggcttaaccgtgtttgccccgactgataacgccttcaacagcctcaaatccggaaccttgaactcattgtctgaccaacaaaaagttcagcttgttcagttccatgtcctacccacactcattaccatgcctcagtttcaaaccgttagtaaccccttacgcacgcaagctggtgatgggcaaaacggtaaattccctcttaacatcactagctccggtaaccaagttaacatcaccaccggagttgtcagcgccaccgtggctaactctgtctacagcgataagcagctcgctgtttatcaggtcgatcaagttttgttgccattagccatgtttggatcaagcgcggctcctgctccggcgcctgagaaaggcggctctgtttcaaaaggctcagcttccggtggcgatgatggaggaggttctactgattcatctgatgcagagagaactcgattcgggtttggggtcagaatcgctatcgtcgcagccattgctgctgcttcttctctgtcgatataactcgagagagagctttccttgagtctccacattgggaattttaataacaacgagagctttaaaatttgtcgtacattgagattgtgttatagatggtgttgttatgtgttattgttttggatttaagattgcacaaaacttttttgatgaaagaaaggaaaatgtgattttgagtataa

SEQ ID NO: 1846 - DNA, 940 bp, Arabidopsis thaliana
acacacacaacaactacaacaatggctacttcaagaacattcattttctctaatctcttcatcttcttcctcgttatagccactacttatggtcaggctccagctccaggcccttcaggtccaacgaacataaccgcaatcctagaaaaggctggtcaattcacattgttcataagacttcttaaaagcactcaagcctcagaccaaatcaacactcagctcaattcttcctcgagtaatggcttaaccgtgtttgccccgactgataacgccttcaacagcctcaaatccggaaccttaaactcattgtctgaccaacaaaaagttcagcttgttcagttccatgtcttacctacactcataaccatgcctcagtttcaaaccgttagtaaccctttacgcacgcaagctggagatggccaaaacggtaaattccctcttaacatcactagctccggtaaccaagttaacatcaccactggagttgtcagcgccaccgtggctaactctgtctacagcgataagcagctggccgtttatcaggttgatcaagttttgctgccattagccatgtttggatcaagcgtggctcctgctccggcccctgagaaaggcggctctgtttcaaaaggctcagcttccggtggcgatgatggaggagattctactgattcatctgatgcagagaggactggattcgggtttgggatcagaatcactaccgttgcagccattgctgcttcttcttctctgtggatataactcgagagagagcttttcttgagtctccacatttggaattttaagaataacgagagctttaagtttttgttgtactttgagattgttttatagatgtgttattacgtgtgattgttttgattaagattgcacacaactttttttgatgaaagaaaggaaaatgtgatattgagtataa

SEQ ID NO: 1847 - DNA, 844 bp, Brassica rapa
atattcatgtcctctaatctattcattttcttccttgtcatggctaccacctaatggtcaggctccagcaccaactccttcaggtccaaccaacataaccgcagtcctagaaaaggctggtcaatacacaatgttcataagactcctcaagagcacacaagccgcagaccaaatcaacactcagctcaattcttcctcgagccaaggcttaaccgtgtttgccccaaccgataacgcatttagcagcctcaaatccggaaccttaaactcgttatctgaccagcaaaaggttcagcttgttcagttccatgtccttcctacactcttgaccatgcctcagttccaaaccgttagtaaccccttacgcacgcaagctggtgatggacaaaacggtaaattccctcttaacattactagctccggtaaccaagtcaacatcaccacgggagttgtcagcgcaacggtggctaactctgtctacagcgataagcagcttgcagtttatcaagtggatcaagttttgcttccattagcaatgtttggttcaagctcggctcctgctcctgcgcctgagaaaggtggcttggtttcgaaaggctcagctccaagtggggacgatggaggagattctactgattcatctgacacagagaggatcagatacggtttaatctccaccaccatggcagccattgctgcttattttctgtggatataacatcaagtcagtccatattgattattggattttaaagagctttaaattttgttgtaattgagacttgtgttatcgtgttattgttttgattcaaaatgagacaaattacgattgaggttgcgcaga

SEQ ID NO: 1848 - DNA, 843 bp, Brassica juncea
ctccaaccccttcaggtccaaccaacataactgcagtcctagaaaaggctggtcagttcacaatgttcataagacttctcaagagcacccaagccgcagaccaaatcaacactcagctcaattcttccacgagccaaggcttaaccgtgtttgccccaaccgataacgcctttagcagcctcaaatccggaaccttgaactcattatccgaccagcaaaaagttcagcttgttcagttccatgttcttcctacactcttaaccatgcctcagtttcaaactgttagtaaccccttacgcacgcaagctggtgatggacaaaacggtaaattccctcttaacatcactagctccggtaaccaagtcaacatcaccaccggagttgtcagcgcaacggtggctaactctgtctacagcgataagcagctcgcagtgtatcaagtggatcaagttttgctaccattagcaatgttcggttcaagctcggctcctgctcctgcgcctgagaaaggtggcttggtttcgaaaggttcggctccaagtggtgatgatggaggagattctactgattcatctgatacagagaaaatcagatactggttaatatccaccgtggcatccattgctgctgcttctctgtggatataacaccaagtcagtccatattggattttaaagagctttaaattttgttgtaatttgagacttgtgttatcgtattattttgttttgattcaaaatgagaaaaattacgattgagattgcatgaaaaatgagtataatttgataaaacaaaaaaactttatcagttgataaaaccgttggggttatgaaaaaaaaaaaa

SEQ ID NO: 1849 - DNA, 2555 bp, Gossypium hirsutum
ctcgcttgccttctgcgctacgaacggagcttgatcgcctggaccctaaaatagcttccgatagtgatgacggtatcgatttagatgttggaaacgatgtttatgagtatgaggaagaagttccacaagaagagtcccggaagaaccgccgtttcgatcctgtcgagaactatgagtatgagctacctgaggattttgaggatgagaatgtaccatcagatgacgatgacgatgatggtgactttggtgttggtgggaacaagggtagtctaaatgatgatgttgatgcgagtgatggggatgaagaggagatgatgaaaggcacttgaggatgttgcaaggggtcactggaatgtcaactgatgcctttggaggcaagaagaagaggaatagtgtggttatatccgaggcacatcctgagtcagaatacaaccctactcgtgatgttcttgagggtgacagccacattacacttcaagatcttttggatcctattcaaggaaaagcggggtatagcaaacttagaaaaagagtgcaacacatggacagaaagtctacatctgttcaagctccattgcgaaggtagatagagagaaattggagaggatggcagtttatgaacattcaaagaaagatattactaagtgggagcatctggtcaaaggaatagagaagctctactgttttttggtggagatgtagactggggttttcaactgtagggcaatagcttctgatttgagcctagaactgagtttgagaagaaaattgcttctttggtttatgatgacaaagttatggaagctcacaaagcagatggttccaaacttctggagttaaataagatatctgaggaagattatatgaagcaccgggatcatgttgctaaaatgcgcagccttcttttccgccatgaaatgaagcagaagcgcataaaaagatcaagtccaaaacctatcatcgtttaaagaataaagataaactgaaagtggaatctgcagaaatgctgatggatccagaggctgccaaagagcaggctaggaagcaagagttcaaacgggctgaggagcgattgactttgaagcacaaaataagtcaaagtgggcaaggcgtatcttagaacgaggtttgaatgcccaggatgaaggcactcgagcggctttggctgaacagcttcaccaacatgctcttttgacaagaaaaattaacactgttaaggacagtagtagtagcagtgatagtagtagtgacgatgatgatgagggttcaaacgaggatagggcatctgagttgctagaaaaagcaaaagagaaaacgctgaaagtattagaagacgatgaagaattgcctaattctggagttctttccttacctttcatggttcgtggactgaagaaaagaagggaagaagcgattgaagaagctaagcttgctcttcaagagtatgagcaattggagggtacaaatgatgcagaaaattcaaaaccagccactgcaagtggtagaagggtctttggcagggcaaataatgaagttccagattctaacaagaagaccaaaactgataataagatgaaaatggataattattatggtaatagtgatagtgaagacgatttggaagccaaagcgaatgttaacattgagggcggcaaaagaaatgatgttgagaaggatgttggccctaattatgatcgtaaagaagcagctgatgtttccatattcaagaattttgatgacaatggagaccctggttcaaaaacaacatatgaagttgctatttttgcttctgactcgtggagaaagatgaaaagtgagaatggagttgataaaaatgcgaaaaagttgcaacaagtgaaggaagctattgtgcataataaagacatggaggagggagaagaggatagtgattcggagagcgaacaaatggtggatgggattttgtcctcagcccccaaggaatcatatgaactcccttctcagtcagaactcattcgacatgcttttgctggggacgatgtggaagaagaatttgaaaaggataaacaggaaatcctgaatgaggaaaaccctgaaccggataaacctgttttgctccccggttggggccaatggactcatgtacagcaaaaaaaaggtttgccttggtggatgcttaaggaacacgaagacgctaagcgaaagagggaagaaagtcttaagaaaaggaaggatgcacagctcaagcatgtcattatctccgaaaaggtggataaaaaagctgagaaattgcagacaaaatctttgccctacccgttcacatccaaggaactttttgaacaaagtatgcggatgcctattggatcagaatctaacccggagacagcaatcagaagtcttaatcgaccagaagtggtgaagaaacctggggtaattataaaaccaataaagtttgtggagatgcatcatcacgaaaaatccgaggataacaaacggagtgggcagaaacagaagaaaaataaaagcaaaggtgccagtggcaagaacaagaaacagagcaactaaatctcataaat

SEQ ID NO: 1850 - DNA, 3179 bp, Gossypium hirsutum
ggagaggaggcggcattaatcaaaaaaggcattttcacctcaaagaaacactgttttcaagacgtaaccatcgttgagatctgaagacatgagttagtaatacatcacttttaatcactccgccccctaaataataaggttggagtgccttccaagcacaacttccaaatgccaattacgtcatcggcgctggttttccctttttttcttgttgggttcagggtgaaacttaagtgaaaccactcagatgggatctggtgggagcaagggttgttgtagagtaggagtaggcggaagagacactgcacctgctgcttcctcgtctaacagcggttggcggaggggaagatccaagggtaagaatagagttttccggtcctcttgtctgggagcgttatctagatctgcttctcctaaaccccactttgatcaccggaaacaacctgcgtcggaatcggatctggtgaaaagagaaagtaacagaaaggttgaaggcgaagcggcatctaatgatgaaatgcaattgccattgccaaccccatgcatatcttccggtggtagcacctctggtgcagctgtgacagctgctcgtcgctctccttctcgctgcctctccggcattagcttccttcctggtaatttgagcttccggttcagcagagctaatagtatgcggtcctccgcggagatgttgaaccctgatgacgattctgagacacttgaacctcaacaacctccccgcaattcttgttctccgattatcttcaatgattcagatggaagtggagagactctcgaaagcaacgctcgttttagcagagccttaagtgttggaaggcttcgtgatcgtgttcttggtagagctcccacattctgccctttgcagcaggacatacaaattactcagcagcaattagctacctctccatccaccactgcttccactcatgattcctccgttatttcccacgatgaaattgaaacttctcgatccagagaagcccggtatcatgatttgcttcaccatagatccaatttccttgaaaggcggagaagaatacgatctcaggttcgagctcttcaacggctaggaagccgttttgagaacttttcagggcatgaaagatcctgcattttatctggccaacatagaagtggtcgatgcacatgtcgtgtaaataatcgagattctagttcaaatgatgacaccactggtgctaggtctagtgtatccagaatcgttatgttagctgaggctttatttgaggtcctggatgaaattcaccagcagtctatggttttatcttcgcgaccgtccgtgtctccaattggttctgttcctgcacctaacgaagttgtggaatcacttcctgtgaaagtgtacaagtcacctaaacttaagaatgatgaggctgtgcaatgttacatatgtcttgtggagtatgaggagggggatagcattcggagattgccttgtaatcatgaatttcatagaacatgtatagacaagtggctcaaggagattcacagggtctgccctctttgtcgtggggatatatgcggacctgatttgatgcctggggagaagtagagcttctggtttttataagagaggagcattggcaactgactttggttacaaaaaggaaaaagaaagagaagagaagtgataattatatactattattattgaggatgaatgtgaaagagtttgtttaatatgccatctgtgatcagggtgatcaccttttggctgcacaataaaataatacaggaatgggttgggagtagtaaggggctattgaactttgtgatttgcagtgtaaggctgtgtgtaagccttcttgccttggagccacaactcagctcgaagaaaggaaggagaagaaatttgattgttcatcttcaatgttgttaccaaagaaatattattaccaactccctctctctacagccactccacttaacaaatttgatgcagatgcagatggcacgttgtccttcaagattgggtttgcccaattcatatattaagattaccatatggatgccgcccaatatcatacgacacaatcaggctacaattaatgaatgtatcaagcattcggatgataaatgtgccaaaacaattaataataaaggaaaaagcttggtgataccaccagttaatatcttggtcatactagagagtaatatagatagatagaaaaggttaaggtactgcaaactagaattccattattcgtcacgacattacatcccatctctttaatttcatgcaactccgattctctctcattttgcattatcggttatatgatcagatgttgcaactggagtctgacacaacgatctctgcaacttgcttccaacaattagtccgtttctgacatttggccctagtcatttctcattaccaaagttaaacaatgccacctagataaataaatagagtcagatatagcacagaggcagcccaaccttttagcaccgaaacttacaataatcttttctttttttttatatatgtggaagccaggctcaaaggttctttcgattcagctgccaaacaagttgatccacagatgccatagcacgagatgctaagccaattgacccatcatacagcgcaaccaacagaaacactgatgtcagcatcacaatggcaccttccccagcagattttgacgcgttcaggcacctcgcacagaaccaattttcatgaattgatgtaaccatgtctgtcatccatttatcagcttcaaaaactggttattcccaatcatgaaagtctctttctgcagtttattgcacttgacgaaattgacaaattgactcaactcaattgggctgatctttattccttcctgttcggctatagtagacaacagccgagaaggcctgaatgggtcatagttaatcagcatagcagccttcaacggcagaccagaagaaccaatattggaggaagcccatttctcccaagatttttgcacaaaagcccaatccattgcacaccttaacttcttataaaacaggaacaagtgctgtgattcctagcaagaaactggaagaaagaatctcctcacagaaggcgtcaacccaaattctgaacaacgtaaaaatgagcgatgctttcagtttcagttgccccttcttatttgggggttttctcatcg

SEQ ID NO: 1851 - DNA, 2706 bp, Theobroma cacao
tgaaaagaattatgtatatttttattttcagaacttgtagaataagcaatttacttttaattagtattataagagctgcgtaataagcagagacacgcgctctctccatctgccgggcacatcgcgcacacatcctctggcaatcaagccccgcttcgcctacttgcttcaggccgccttttactttttggcttacatttcatcaaaatttagccgcatcacagcaaccattaccttttctccttaacgggtatttctccaatctttgatagtgaatgaaattaatccgtttaccgtgtctgtccacatagaaaagacaatcagggttttctgcgtaaacttcccgacagtttctacctcgatcctggctttattgacaatccgccccatcccctctttcgaaccccgtcactctggatctggatagctatacttttgattatctggtgctgttccttttgcgcaaacagattacgtgatgcaaattgaatttgggcacttctcaagaaatttttaaagcctacccctgaacaagatgagtatcgagccatttaacagttggaaaaacaggttggtgaaacttgcagctcgtgcgttttatgatgatgtgacaactaaaggagataatcagccgaagacgggtcggggagataatagagggattgctgtagtagtacttgatgctcttacaaggagacaatgggttagggaagaagatttggcaaaggagttgaaactacattcaaagcaacttcgccggactctacggctatttgaggaagaaaaactagtcacccgtgatcataggagagagacggctaaaggagcaaagatatatagtgctgcagtagctgcgacagttgatgttcaacatggtggaaaagagggagaggagaagattaaattgcacactcactcttactgttgtctggattatgcacagatatatgatgttgttaggtatagactgcatcgtatgaagaaaaaactaaaggatgaacttgaggacaagaatactgtacaggagtatgtgtgccctaactgtgggaaaagatacaatgctttggatgcattgcgattggtttctttggaggatgaatattttcactgtgaaagatgtaatggagaattggtggcggagagcgacaagttagtagcacaagatgtaggagatggagatgacaatgcaagacgacggcgacgtgaaaaattgaaggacatgcttcaaaaaatggaggtacagcttaaacctctaatggaacaactcagcagagtaaaagatttgcctgttccagaatttggaagtctacaagcatgggaagctcgagcaagtgctgctgggcgtgcaataaatggtgattctggttctaatgatctttccagatcttctcagggttatggtggaacacctatgccatttcttggggagacaaaggttgaagttgctttttctggtcttgatggcaaggaagaagatgccaaatctgaaagtgcaggcacatccttgaaagtattgccaccttggatgataaagcaaggaatgaacctgacaaaagaacaacgtggagaggtcaagcaggagtcaaagacagatggcacttcagcacaaccagatttttcagatgacaagaagtcgactattggaactgatgataagaagaatttacaggacgagtatcttaaagcctattatgctgctttgtacaagaaacaacaagaactagaagaagctgctaagaaacaagaagaattatcagacattcctctctccagtagtcattctgacccttccaagcgtcaagttggcatgaaagttaaacgtgatgacgatgagggagatgatgatattgattgggaagaagcccctcttgcaggcaatacaactgagagttataaggttaatgacttgaatgttgaagcggaagcttctggagatgatgaggatgatgtagattgggaggaaggctaaagagagcaaagattttcctaagtgaatggttcagcttctcttggtcttcatggcgttagcaacgttgggaacgggtggtgtaaatgttgctctctacttgcaattcttcacatcttcatgtgctcttacaactgaagcccctccaattggatcattggtatcaaatttatttgtgatcgctagactttgtgccattagtttgctgtgagaagtcaaaaacaatgtttgtagtcttagaaattgattttcatgagcttgccttgtagacaaagcagtataacaaagacatttatcacaattgtaatttctgtttccatcagttggagcttgtgttcttgagcaaggtactgaatagagttaatttcaacagcgttatgtaaaaaaacagcagcgagaatcacaagtatcttcgttgccatctgttttttaatgtttgcaaagtatcaagacttgaagacagggcatatgtgcctcgaaaactacggataccaagaggtcataggtcacaaccccactattgctccaagtgtaaggcttaaattttaaagaccagctttggagtagagttttatacctgtaaatcgttggaaaattgtaatccaaacttgtatttgaacaatattttcttctatatttttttaaacgactaattttcaacttaatctcaatgtcaaaccagacctagaaatgtatgaacatttccctaacaaaatgctgtataaatagtatcagccgtt

SEQ ID NO: 1852 - DNA, 1919 bp, Citrus clementina
acggagggaatccaatgtctctctaaaccgaactggtcgattaaagattaagactaaaatctcactataactctaaacctcgtctggaaattgactcaagaaaatgagcagtatcgaaccttttaatcgattagtgaagcttgtggcgagggcgttctacgatgatataacaacaaaaggagataaccagccgaaatccgggaggagtgacaacagagggattgcggtagtggtgcttgatgcgctcacgagacgacagtgggttagagaagaagatttagcaaaggatttgaaactacactcaaagcagcttcgacggactttgcgatttttggaagaagaaaaactagttgctcgagatcataggaaagagactgctaagggtgcaaagatatatagtgctgctgttgctgccacagctgacggtcagccgtttgcaaaagagggagaagaaaagattaaactgcacactcactcttactgctctctagattatgcacagatctatgatgttgttaggtatagaatacaccgtatgaggaaaaaactgaaggatgagctggaatgcaaaaacacagttcaagagtacatatgccctaattgtcagcgaagatataatgctttggatgcgttgaggttggtttctctagaagacgattcttttcactgtgaaaattgtaatggagaacttgtggcagagagtgacaagttagcagctcaagaagggggagatggggatgacaatgcaagaaggcgacgacgtgaaaaactaaaggacttgcttcaaaaattggaggttcagctgaagccattgatggaacaaatcaaccgagtaaaagacttggatgttcctgaatttggaacgcttcaagcatgggaagctcgagcaagtgctgctggacgtgctgcaaatggagattctagttccaatgatccaaacaagtcttctcagggttatggtgggacaccaatgccgtttcttggagatacaaaggttgaagttgccttttctggcgctgaaggaaagcaggtggatgtcaaatcagaaactgatagtacaccccagaaagtcttaccaccttggatgatcaagcaaggaatgaaccttacaaaggaacaacgaggagaggttaagcaggagtcaaagatggatggaagctcagcaacaggaggattatcagatgacaaaaagtcaactgttgaagatgataaagcgagtttacaggatgagtatattagagcatattatgctgctctgttgaagaaacaacaagaactagacgaagctgctaagaatcaacaagaatcttcaaatacacctatctctgatggtctttctggggcatcttctaatcgtcaagtgggcatgaagtcaaaacgtgaggaggttgagggagatgatgatgttgattgggaagaggctcccgttgcaggtaccacatctgaaagtttcaaggtacatgatttgaatgttgaagctgaggcttctgcagaagatgaggacgatatagactgggaggaaggttgaagaggaatgagataatgttttgataaaatgaacacccacatcgcgtcacctataaaatacatcattattaaatatgagcctgagcgcaggtttcctcgagttgcagtctcgagtcatcttgggaggtattgtattagttgaaccaaagcctcattttgattaatgaattgcttgtttacgctggtcttaggtgtgggaaagcaacaacagagaatgggcatactccattgtatttttgtaaagtgctttcataaatcttgtaatggataatctttaaaagggcagcctcagtaaatgacaaaatcctcatgaacattggagttgtcttcattttctcttcacaaaatgtatgcctgcaggtgggttgctatttgctgttggtctaacaggg

SEQ ID NO: 1853 - DNA, 1821 bp, Citrus sinensis
attttttttcatttctgtttctgaaaacagattagtgaagcttgtggcgagggcgttctacgatgatataacaacaaaaggagataaccagccgaaatccgggaggagtgacaacagagggattgcagtagtggtgcttgatgcgctcacgagacgacagtgggttagagaagaagatttagcaaaggatttgaaactacactcaaagcagcttcgacggactttgcgatttttggaagaagaaaaactagttgctcgagatcataggaaagagactgctaagggtgcaaagatatatagtgctgctgttgctgccacagctgacggtcagccgtttgcaaaagagggagaagaaaagattaaactgcacactcactcttactgctctctagattatgcacagatctatgatgttgttaggtacagaatacaccgtatgaggaaaaaactgaaggatgagctggaatgcaaaaacacagttcaagagtacatatgccctaattgtcagcgaagatacaatgctttggatgcgttgaggttggtttctctagaagacgattcttttcactgtgaaaattgtaatggagaacttgtggctgagagtgacaagttagcagctcaagaagggggagatggggatgacaatgcaagaaggcgacgacgtgaaaaactaaaggacttgcttcaaaaattggaggttcatctgaagccattgatggaacaaatcaaccgagtaaaagacttggatgttcctgaatttggaacgcttcaagcatgggaagctcgagcaagtgctgctggacgtgctgcaaatggagattctagttccaatgatccaaacaagtcttctcagggttatggtgggacaccaatgccatttcttggagatacaaaggttgaagttgccttttctggcgctgaaggaaagcaggtggatgtcaaatcagaaactgatagtacaccccagaaagtcttaccaccttggatgatcaagcaaggaatgaaccttacaaaggaacaacgaggagaggttaagcaggagtcaaagatggatggaagctcagcaacaggaggattatcggatgacaaaaagtcaactgttgaagatgataaagcgagtttacaggatgagtatattagagcatattatgctgctctgttgaagaaacaacaagaactagacgaagctgctaagaatcaacaagaatcttcaaatacacctatctctgatggtctttctggggcatcttctaatcgtcaagtgggcatgaagtcaaaacgtgaggaggttgagggagatgatgatgttgattgggaagaggctcctgttgcaggtaccacatccgaaagtttcaaggtacatgatttgaatgttgaagctgaggcttctgcagaagatgaggacgatatagactgggaggaaggttgaagaggaatgagataatgttttgataaaatgaacacccacatcgcgtcacctataacatacatcattattaaatatgagcctgagcgcaggtttcctcgagttgcagtctcgagtcatcttgggaggtattgtattagttgaaccaaagcctcattttcattaatgaattgcttgtttacgctggtcttaggtgtgggaaggcaacaacagagaatgggcatactccattgtatttttgtaaagtgctttcataaatcttgtaatggataatctttgaaagggcagcctcagtaaatgacataatcatgatgaacattagagttattttcattttctacttcacagaatgtatgcatgcaggtgggttgctattcgctatgggtctaacaggg

SEQ ID NO: 1854 - DNA, 2007 bp, Quercus alba
gagtaaacaatttttttccaaaaaatctctctcaaacctccctctctcgctttctctctctctaccaactcacccccaagcggagaactcgtcatcggagacgccgctactcgtcggcggcgccaccgcccgctatatgaccgttgaagtcgtcgccgcccacaagtagatctctctctctctctctctcacgaatcaaccagcaacccccaagaacatgagcgtcgagcctttcaacaagttggtgaagctagcggcgagggctttctacgatgacataacgacgaaaggagataatcaacccaaaactggccgcagtgacaacagaggaatcgccgtcgtggtcctcgatgccctaactagacgacaatgggtaagagaagaagatttggcaaaggacttgaaactgcactcgaagcagcttcgtcgaactctgagattcttcgaggaagaaaaactagttactcgagatcatagaagagagacagctaagggtgcgaagatatatagtgctgctgttgctgccacagctgatggtcatcctctaaaagagggggaagaaaaggttaagatgcacactcactcctactgttgtctggattatgctcagatctatgatgtcgtcaggtacagattgcaccgtatgaagaaaaaactgaaagatgaattggacaacaagaatacagttcaggagtatatatgccccaactgtgggaaaaggtacactgcattggatgcattacggttgatttctatggaggatgaatttttcattgtgaaagttgtaatggagaacttgtggctgagagtgacaagttagctgctcaagaaggaggagatggagatgacaatgcaagaaggcgaaggcgtgaaaagttaaaggacatgcttcaaaacttggaggtacagcttaagccattaatagatcaactcactagagtaaaagacttacctgttcctgaatttggcacgcttcatgcatgggaagctcgagcaagtgctgctgtgcgtgcagcaaatggtgattccggtgctattgatccttccaaatcttcccagggattgggttatggtggaacgtcattgccttttgttggagacaccaaggttgaagttgacttttctgggactgaaggcaagggagagaatattaaatctgaaactgaaacttcatctctgaaagttttgccaccatggatgatcaaggaaggaatgaacctcacaaaggaacaacggggagaggtcaagcaggagttgaggatggatggcagttcagcagctgtagaattttcagatgacaaaaaggcaacaattgaaaatgatgataagaagaatatacaggatgagtatatcaaagcatattacgctgctttgctcaagaaacagcaagaattggacgaagctgctaagaaagaacatgaattgtcaaatacacactccttgaacggtgtttctgacacgacttctaatcgccaagttgggataaagtcaaaacgtgacgaggatgagggagatgatgatgtggaatgggaagaggctccagttgctggcaattcaaatgaaaattacaaagtgaatgacttgaatgttcaagctgatgcttcaggagatgatgaggatgatatagactgggaggaaggttaaagagcacagcttttctcccctcgtagatggattagcatgacttccttttaccagtaaagtttttgggaaattgaagttgtgatcaatgcaaatttttcttctaacttggcacttttctgaatgttgttatcttatagccatatgttatgtttaccctcgattcatgaaatacaatgtgttcttgatcttggtcttcttgcaatgccttttattaatgcagatggagtctgcgctaagcaccaaagaatgcatggcattgttataaattatgattcaatggatgtaatactcatatttttgttttgtttttgtcggtaatggcatgttttgtgtagacataactgtagaaaaaagcagcggtaa

SEQ ID NO: 1855 - DNA, 1992 bp, Setaria italica
aatgaagggaagttggagggtccatccgcaaaacctcgcgcaaccgactctatttatacgcgccccctccttgattcgcgaagcagatagccatcttgccattcccctcccaaatcataacacgagctctaatctcgcttcactttgatcgggaaaaaaaaatcaatttagaatagcgaaaaaaattcagcaaagaaagaagagaagaagaatttccataagaaatcgccaaatccccccttcctcttcttctcacgcttcggaacgtgcgggaatttagccaggatggtggcgatcgagaaccagagccaggtcgcgcgggcggtggcggcggcggaggtggcgccggtggcggggccgcggatccccaaggaggcgcggcggctactgcacgagctggcggcggcgtgggcggacgtggcggactgccgcgcgctccaggtcgtgccgctcaagggcgccatgaccaacgaggtctaccaggtgcgctggctcaccggggtcccctccgcgggcggcgaggcgggggagccccgcggggagagggaggtcaggaaggtgctcgtgcggatatacggcgacggcgtcgacctcttcttcgaccgcgaggacgaggtgcgcaccttcgagtgcatgtcccgccacggccagggcccccgcctcctcggccgcttccccaacggccgcgtcgaggagttcatccacgcaaggacactgtcagctgctgaccttcgcgatcctgagatttcagctcttgttgcttccaaactgagggaattccacaacctcgacatgcctggtcccaaatctgtgctcatttgggacagactaaggaactggctcaaaactgctaagaacttatgctcaactgatgaagccaaagaatttcggttggacagcctggagagtgagattactgcattgcagaacgaagtttcaggtgattaccactggattggattttgtcacaacgatcttcagtacggcaacatcatgattgatgaagagaccaacatgctgaccatcattgattatgagtatgcaagctttaacccagttgcatacgacattgctaaccatttctgtgagatggcggctgactatcattcagaaaagcctcatatcctggactacaacaaatatccagatattgatgagcagaagcgtttcgtcaagacctacctgagcatttctggtgaggaacctgatgcggaagaggtggagagcctgctccaaagcattgagaagtacacgctagccagtcatctagtatggggcctctggggaataatctcagatcatgtcaacgacattgacttcgactacaaggagtatgcaaggcagagatttgagcagtactggcagaagaagcctgcaaatctgcaatcttgacttcttgaacatgtgaataaaacacccgtggcctcaggggatccttgagggcctatgctgcgcgcacaaggtgtgcaatgtcactgacaaagagagaagctgcgaaagaaaatactgacaacgacgatgacggagaaccccgtcttgggatcagggagctcttgttctacaacttgattggtttggcttcggcttcatgaaggaagaagctaggggttttggttgctcgtttgtacagtacgaaggcaaggcaacgatgataaaagccccggggttgcgtgctgtatgttgttcagtttgggtagcactgccgtggggcgtcgtgctgttgctgttgtgtggacgtggttctgtttctgtatgcttgatgctaatatagtggagattttggctgagctttgaggcaatgcgtactttgtatagtgtgtacacagctaaaggtagaataattgttggtatgacagctaatatgtattgtgccattgtgtgttgtgtctttgaactaatgagttggatagttgcactatttcctatacaaattttcaaatatgttatggattatggttatgagtggctttcactggatgagctatatagtca

SEQ ID NO: 1856 - DNA, 1885 bp, Setaria italica
ccattcccctcccaaatcataacacgagctctaatctcgcttcactttgatcgggaaaaaaaatcaatttagaatagcgaaaaaaaattcagcaaagaaagaagagaagaagaatttccataagaaatcgccaaatccccccttcctcttcttctcacgcttcggaacgtgcgggaatttagccaggatggtggcgatcgagaaccagagccaggtcgcgcgggcggtggcggcggcggaggtggcggggccgcggatccccaaggaggcgcggcggctgctgcacgagctggcggcggcgtgggcggacgtggcggactgccgcgcgctccaggtcgtgccgctcaagggcgccatgaccaacgaggtctaccaggtgcgctggctcaccggggtcccctccgtgggcggcgaggcgggggagccccgcggggagagggaggtcaggaaggtgctcgtgcggatatacggcgacggcgtcgacctcttcttcgaccgcgaggacgaggtgcgcaccttcgagtgcatgtcccgccacggccagggcccccgcctcctcggccgcttccccaacggccgcgtcgaggagttcatccacgcaaggacactgtcagctgctgaccttcgcgatcctgagatttcagctcttgttgcttccaaactgagggaattccacaacctcgacatgcctggtcccaaatctgtgctcatttgggacagactaaggaactggctcaaaactgctaagaacttatgctcaactgatgaagccaaagaatttcggttggacagcctggagagtgagattactgcattgcagaacgaagtttcaggtgattaccactggattggattttgtcacaacgatcttcagtacggcaacatcatgattgatgaagagtccaacatgctgaccatcattgattatgagtatgcaagctttaacccagttgcatacgacattgctaaccatttctgtgagatggcggctgactatcattcagaaaagcctcatatcctggactacaacaaatatccagatattgatgagcagaagcgtttcgtcaagacctacctgagcatttctggtgaggaacctgatgcggaagaggtggagagcctgctccaaagcattgagaagtacacgctagccagtcatctagtatggggcctctggggaataatctcagatcatgtcaacgacattgacttcgactacaaggagtatgcaaggcagagatttgagcagtactggcagaagaagcctgcaaatctgcaatcttgacttcttgaacatgtgaataaaacacccgtggcctcaggggatccttgagggcctatgctgcgcacacaaggtgtgcaatgtcactgacaaagagagaagctgcgaaagaaaatactgacaacgacgatgatggagaaccccgtcttgggatcagggagctcttgttctacaacttgattggtttggcttcggcttcatgaaggaagaagctaggggttttggttgctcgtttgtacagtacgaaggcaaggcaacgatgataaaagccccggggttgcgtgctgtatgttgctcagtttgggtagcactgccgtggggcgtcgtgctgttgctgttgtgtggacgtggttctgtttctgtatgcttgatgctaatatagtggagattttggctgagctttgaggcaatgcgtactttgtatagtgtgtacacagctaaaggtagaataattgttggtatgagagctaatatgtattgtgccattgtgtgttgtgtctttgaactaatgagttggatagttgcactatttcctatacaaattttcaaatatgttatggattatggttatgagtggctttcactggatgagctatatagtca

SEQ ID NO: 1857 - DNA, 1712 bp, Oryza sativa
cccgagggtgaatcgtagcgatagcggatcagattggaggaaaactcgctagtacgcttgttacttgcaactctttctctaatcttgcttcggaaagatatccaaatcgaagaaaaagaaaaaaaaattagaaagcgtgattagccattcctcttctcatctctagccacttcgcttcagcttttcttctttcttgatcgcgagcaaaaagggagagagaaaaaaaaacggtaaaaggacgtgattagcaaggatggtggcgatcgagaaccagagccagggccagcgggcggcggaggcggcggcgcagccacggatccccagggaggcgcggcggctactgcacgagatggcggcgtcgtgggcggacgttgccgactgccgggcgctgcaggtgattccgctcaagggcgccatgaccaacgaggtgtaccaggtgcgctggctcaacggcgccccggccaccgccgacggcggcgaggtggaggcggaggcggccgcaagggagagggaggtgaggaaggtcctcgtgcggatatacggcgacggcgtggagctcttcttcgaccgcgaggacgaggtgcgcaccttcgagtgcatgtctcgccatggccaaggcccccgcctcctcggccggttcaccaacggccgcgtcgaggagttcatccacgcaaggacactatctgcagcagaccttcgtgatcctgaaatttcagctctggtggcgtcaaaactgagggaattccacaaccttgacatgcctggcccgaaatctgtactcatttgggaccgactgaaaaactggctcaaaactgcaaggaacctgtgctcatctgatgaatccaagaaatttcggctgggtagcctggagaacgagattgctgcattggagaaagaattttcaggggattaccacgggattggtttttgccacaacgatcttcagtatggcaacatcatgattgatgaagacaccaacatgttgactatcatcgattatgaatatgccagcttcaatccagttgcgtatgacatcgctaatcatttctgcgagatggcagcagactatcattcagagaagccacatagactggactacagtaaatatccagacactgatgagcagaagcgttttgtgaagacgtacctaagcaattctgtaagtgaagaacctgatgcggaagaggtggagaaccttctccaaagcattgagaaatacacgctcgccagtcatctagtttggggcctctggggaataatatcggatcatgtcaatgatattgacttcgactacaaggagtatgcaaggcagagattcgagcagtattggcagaagaagcaagcacttttaacttcatgaattgcctgaaggcgtcaggtcgtacctgaaggcctgtgctgcacataacttgtgcgatgttactgacacataactccctgtgaaaagaagaaagatgaagatgataatgaagaagaaaccctttcgggatcaggagttctcatcccgaaatttccgtaaggttcagcttcaggaggaagctgtgggctttggttgctttgtttatagtctgaaaggcagcgaagaaaaagcccctggttgcgtgtttgtttgctcgacaaactagaggccgcttgtggggctagtagtgccgtcgtgtttcatgtgtatgtatacctaaatatatgttacataatggatcttgctttcgtcg

SEQ ID NO: 1858 - DNA, 1527 bp, Brachypodium distachyon
gatggtggcgatcgagaaccagagccaggcggtgcaggcgcaggtgcagcgggcggcggaggcggctcggatccccaaggaggcgaggcggctcctgcacgagctggcggcggcgtggccgaacgtggcggactgccgggcgctggaggtggtgccgctcaagggcgccatgaccaacgaggtgtaccaggtgcgctggctcaccgcccctgcggcggccgcgggcggcgagaaggagaaggaggcgctcaaggagcgggagatcaggaaggtgctggtgcggatttacggcgacggcgtggagctcttcttcgaccgcgaggacgagctgcgcaccttcgagtgcatgtcccgccacggccagggaccccgcctcctcggccgtttccccaacggccgcgtcgaggagttcatccacgcccggacactgtcagctgccgacctacgcgatcctgaaatttcagctctggtggccacaaaattgagggaatttcacaaccttgatatgcctggtccgaagcatgtgctcctttgggacagactgaagaactggctcaaaactgccaagaacctgtgcccaactgatcaagcgaacgaactacgcttggattgcttggaggacgagatcgccacattggagaaagaattttcaggggattaccaccactggatcggtttctgccacaacgatctccagtatggcaacatcatgattgatgaagagaccaacatgctgaccatcattgattacgagtatgcaagcttcaacccagttgcatacgacatcgctaaccatttctgcgagatggcagctgactaccattcagaaaagcctcatgtactggactacagtaaatatccagacattgatgagcagaggcgtttcgtgaagacttacctgagcacttctggcgaggaacctgaagcggaagaggtgcagaatctgcttcagagcattgacaagtacacactcgccagtcatctggtttggggtctctggggaataatatcggatcatgtcaacgatatcgacttcgattacaaggagtacgcaaggcagagattcgagcagtactggcagaagaagcctgtggtcctaacttcatgaaaaaactatgaaataagcccatggcgatcagtgactccctgatggcctggggctgcacataatcatgtgcagtgttactgacgcacacacacatcccctggctgggtcaggacaggaaggatcgatgtgaaagaagcagatgacgaagaagtagaagccggtttcgggatcaggagttctcaacttctcatgccgaaacttcataaggctcagctatctatgggagattttgatttgcttgtctataacgtgaacgcagcgaggatgaatccccggagttgcatttttgtatgttcagtttcgctaagcgccgctggtggtgcactggtgctagtcctgttgttgctacttgctaggttctgtacacttaacagagaatatatatatataaatagatctcctaaaaaaaagtaaaatag

SEQ ID NO: 1859 - DNA, 1682 bp, Avena sativa
acatcccaaaacaacgccagacagagaagaaacttcttgttacgcttagcgttgcaacgcttctccagcatcatcaggccagaaaagaacacgcaaataccaggaacaacaggcgaaagcgccaaatcctctgtttccactctatccttccgtccaagattggatcgaacacccgcgcaggcgcgaaaagaaagaaaagagacgtgattgttagcgactgacgatggttgcgatcgagaaccagagccaggcgcagagggccgcggagacggcgccggcgaggatccccaaggaggcgcggcggctcctgcacgacctggcggcggcgtggcccaacgtggcggactgccgggcgctggaggtggtgccgctcaagggcgccatgaccaacgaggtgtaccaggtgcgctggctcacggccgccccgggcgccggcgccggcgaggcgctcaaggagagggaggtgaggaaggtgctggtgcggatatacggcgacggcgtggagctcttcttcgaccgggaggacgagctgcgcaccttcgagtgcatgtcccgccacggccaggggccccgcctcctcggccgcttcccaacggccgcgtcgaggagttcatccacgcacggacactgtcagctcccgacctacgcgatcctgagatttcagctctggtggctacaaaactgagggagttccacagccttgatatgcctggtcccaagcatgtgctcctctgggacagactgaagaactggctcaaaactgccaagaatctgtgcccagctgatcaggccaaggaactacgcctggacagcctggaggacgagatcagcacactggagaaagagttctcaggggattaccaccactggattggtttttgccacaacgatctccagtacggcaacatcatgatagatgaagagaccaacatgctgaccataattgactacgagtatgcaagcttcaatccagttgcatatgacatcgccaaccatttctgcgagatggcggcagactaccattcagagaagcctcatatactggactacagtaaatttccagatgttgatgagcagaggcgtttcgtaaagaactacctgagcacttctgacgaggaaccccaaggggaagaggtggagaatctggtccagagcgttgagaagtacacgctcgccagtcatctggtttggggcctctggggaataatatccgaccatgtcaacgatatcgacttcgactaccaggagtacgcaaggcagagattcgagcagtactggctgaagaagccggctgtcctaacttcatgaatataaatcccatggcttgaggaactccctgatgcatgggctgtgctgcacgtaaccatgcgcagttttactcacactggctgagatatgataagaaatatgtgaaggaagaagatacagagaagtagaagcccgttttatgatcataaggttcagtttcaggaaggatgctgcctatcggggctatggttggcatattttatagcctcgtagttgcattttgtatatgctgcttaatggaggatgtgtgtataaccagtctcgtaaaaaaatacaatagagatctggaatttgtagggcttgtagagtagggggtgtactagcttggaggcagcacctcctttgtttttcaagaaagaaaatatattaatatt

SEQ ID NO: 1860 - DNA, 1740 bp, Avena sativa
aaccatcccaaaacacgccagacagagaagaaccttcttgttacgcttagcgttgcaacgcttctccagcatcatcagatcagaaaagaacacacagataccaagaccaacaggcgaaagcgccaaatcctctgcttccactctccaagattggatcgaacacccgcgcaggcgcgaaaagaaagaaaagacgtgattattagcgactgacgatggttgcgatcgagaaccagagccaggcgcagagggcggcggagacggctgggcggagcatcccgaaggaggcgcggaggctgctgcacgagctggcggcggagtgggccgacgtggcggactgccgggcgctggaggtggtgccgctcaagggcgccatgaccaacgaggtgtaccaggtgcgctggctcaccgccgccccgggcgccggcggcggcgaggcgctcaaggagagggaggtgaggaaggtgctggtgcggatatacggcgacggcgtggagctcttcttcgaccgggaggacgagctgcgcaccttcgagtgcatgtcccgccacggccaggggccacgcctcctcggccgcttccccaacggccgcgtcgaggagttcatccacgcacggacactgtcagctcccgacctccgcgatcctgagatttcagccctggtggctacaaaactgagggagttccacagccttgatatgcctggtcccaagcatgtgctcctttgggacagactgaagaactggctcaaaactgccaagaatctgtgcccagctgatcaagcgaacgaactacggttggacagcctggaggatgagatcaacacgctggagaaagagttctcaggggattaccaccactggattggtttctgccacaacgatctccagtacggcaacatcatgatagatgaagagaccaacatgctgaccataattgactacgagtatgcaagcttcaatccggtggcatatgacatcgccaaccatttctgcgagatggcggcagactaccattcagagaagcctcatatactggactacagtaaatatccagatgttgatgagcggagccgtttcgtaaggaactacctgagcacttctgacgaggatccccaagaggaagaggtggagaatctgctccagagcgttgagaagtacacgctcgccagtcatctggcttggggcctctggggaataatatcggaccatgtcaacgatatcgacttcgattaccaggagtacgcaaggcagagattcgagcagtactggctgaagaagccggctgtcctaacttcatgaatataaacccaaattgcttcaggaactccctgatgcatgtatgggctgtgctgcacgtaaccctgtgcagtgttactcacacgcatacatcacctggctgagatatgataggaaatatataaaggaagaagatacagaggtgtagaagcccgttttatgttcaggaattctcgttctgaacgtcataaggttcagtttcaggaaggatactgtctatggcggctttggttggcattttatagcctggacgcagcgaggataaagcctcgtagttgcattttgtatatgttccttaatggaggatgtgtgtataaccggtctcgtaaaaaaatacaatagagatctggaattggtagggagtagggggtgtactagcttggaggcagcacctcctttgttgtactgtacgcattttttccaagaaagaaaatatattaatatt

SEQ ID NO: 1861 - DNA, 1696 bp, Triticum aestivum
gcaaaacctccctgttacttgcagctgcaacgcctgcctagttctttatatccaatctcgcttcaccaaaacttcaaaaaaaaaaaatctcgcttcaccaagaacaagaagaatacccaaaccagaaaagaaacagaaagatcagccgtaagcaccggattgtccatttccgctccagaatcgggcgcgaaaagaagagaacagaagacgtgattagcgagaatggtggcgatcgagaaccatagccaggtccagaggccggcggagtccgcgaggatccccaaggaggcgcggcggctcctgcacgacctggccgcggcgtggccgaacgtggcggactgccgcgcgctggaggtggtgccgctcaagggcgccatgaccaacgaggtgtaccaggtgcgctggctcaccgccccggccggcggcgaggcggggacgctcaaggagagggaggtgaggaaggtgctcgtgcggatttacggcgacggcgtcgagctcttcttcgaccgcgaggacgagctgcgcaccttcgagtgcatgtcccgccacggccagggcccccgactcctcggccgcttccccaacggccgcgtcgaggagttcatccacgcacggacgctgtcggctcccgacctacgcaatcctgaaatttcagctctggtggctacaaaactgagggaattccacaaccttgacatgcctggtcccaagcatgtgctcctctgggacagactgaagaactggctcaaaactgccaagaacctgtgcccgaccgatcaagcggacgaactacgcttggattgcctggagaacgagatcgcctcgctggagaaagaattctcaggggattaccaccactggattggtttctgccacaatgacctacagtatggcaacatcatgatggatgaagagaccaacatgctgaccatcattgactacgagtatgcaagcttcaacccggttgcatatgacatcgctaaccatttctgcgagatggcggcagactaccattcggaaaagcctcatatactggactacagtaaatatccagatatcgatgagcagaggcgtttcgtgaagacttacctgagcacttctcgcgaggaacctgaagcggaggaggtggagaatctgctccagagcgtggagaagtacacgctcgccagtcatctggtttggggcctctggggaataatatcggatcgtgtcaacgacatcgacttcgattaccaggagtatgcaaggcagagattcgagcagtactggcagaagaagcctgcggtcctaacctcatgaatagctaaacccatggcttcgggaaatccctgagggcctgtgctgcacagaagctgtgcagtgttactgatgcacatatcctggctgggatataacagtaaggatatgacagaagcatagtattacgaggaagcataagcccgttccagggtcagacgttcccatttcgaaccttcacaaggtccagcttcaggaaggaagctgtttatgagggctttgattaactgtttataggtatagcctcgacgcaacgatgataaagcctcgaagttgcattttgtatgttgttctcctaagcaccgctggcggtgttagtgtgactgtgttactagtttatgtatacttatgaacaatgtatgtactataagacatctcgtaaaagaagtattgagtttgt

SEQ ID NO: 1862 - DNA, 1799 bp, Triticum aestivum
ccacgcgtccgagcaaaacctccctccctgttacttgcagctgcaacgctttgcctagttctttatatccaatctcgcttcaccaagaacaagaaagaatacccaaatcagaaaaagaaacagaaagatcaaccgtaagcgccggattgtccatttccgctccagaagagagcagaaggcgtgattagcgagaatggtggcgatcgagaaccaaagccaggcccagaggccggcggagtccgcgaggatccccaaggaggcgcggcggctcctgcacaacctggcggcggcgtggccgaacgtggcggactgccgcgcgctggaggtggtgccgctcaagggcgccatgaccaacgaggtgtaccaggtgcgctggctcaccgccccggccggcggcgaggcgggcgcgggggcgctcaaggagagggaggtgaggaaggtgctcgtgcggatttacggcgacggcgtcgacctcttcttcgaccgcgacgacgagctgcgcaccttcgagtgcatgtcccgccacggccagggcccccgcctcctcggccgcttccccaacggccgcgtcgaggagttcatccacgcacggacgctgtcggctcccgatatgcgcgatcctgaaatttcagctctggtggctacaaaactgagggaattccacaaccttgacatgcctggtcccaagcatgtgctcctctgggacagactgaagaactggctcaaaactgccaataacctgtgcccaaccgatcaggccaacgaactacgcttggattgcctggaggatgagatcgcctcgctggagaaggaattctcaggggattaccaccactggattggtttctgccacaatgatctacagtatggcaacatcatgatggatgaagagaccaacatgctgaccatcattgactacgagtatgcaagcttcaacccagttgcatatgacatcgctaaccatttctgtgagatggcggcagactaccattcggaaaagcctcatatactggactacagtaaatatccagatatcgacgagcagaggcgtttcgtgaagacttacctgagcacttctcgcgaggaacctgaaacggaggagctggagaatctgctccagagcgtggagaagtacacgctcgcgagtcatctggtttggggcctctggggaataatatcagatcgtgtcagtgacatcgacttcgattaccaggagtatgcaaggcagagattcgagcagtactggcagaagaagcctgccgtcctaacctcatgaatagctgtacctattgcttcaggaactccctgagggcctgtgctgctgcacacaaactgtgcagtgttactaacacacatatcccctggctgggataatgacaggaaggatatgaaagaagcatactattacaaggaagcataagcccgttccagggtcagacgttcccatttcgaaccttgacaaggtccagcttcagaaaggaagctgtctatgggggctttggttgattgtttataggtatagcctcgacggctcgacgcaacgatgataaagccttggagttgcattttgtatgttgttttcctaagcaccgctggtggtgttcgtgtgattttgtgctagtaatgtatgtatacttgacggacaaagtatgtactataagacatctcgtgaaagaagtatgagtatgtatgagatcctgattaagccgtgcttggagtgtactagcttggagacggcagtctttgcggttctccataataagacggtgttatcactgaaactttcaggtcctgaactt

SEQ ID NO: 1863 - DNA, 1585 bp, Saccharum officinarum
ctctctctccagtctcctcctcgcgtcggcagtcggcttggcagggccgaatcaatggcggtcgacccgcggcaggtggtggcgggcttcctcaccctctccatgttcgtcatgctcggcaacatgatcaagcacgaccacttctcccccgtcaccgaggagctgggcttggaggcaacaggttcggagtcgaacacagtgaagcttgacaacaatgctgaaatgaacagcattgatacggctggagtggaggacctgatggacgctatcgaggaagttaaaccttgctggaccaaaccaagtccaaaaaatcagccatctaatggttttgttacattctccttgactatgggccctgaatatcacatctcacagatcacagatgctgtggttgttgcaaggtatctaggtgcaacacttgtactcccagacatcagaggaaatgaattaggaaataagcgaaaattccaagacatgtacaacgtggataaattcgtgaggagcctggatggtgttgtcgaagtaatagatgaaatacctgatgaagtgagtgctaagaagccagcagttatcagagtaccaaaccgtgtgactgaaagcttcatcacggacaccatccagcccatcttccaaaaaaacaagtacttaagactagcggtcattttctcttcagtaagtttaaggccaaaggagacgagtaacaaggacttggatgcaactgcttgccttgcaatgttcagtggcctcgaactgaagcatgaatattctgaagtggccagaaaaatgttggataggcttcaagaattaagcaagaaatcagatgggaaggtcttggcaatcgatttgcggaccgacttgctggaaaagaagagttgcaagacaactagaggcgctcgaagaaaaggctgctataaccctgatgaggttctggctttcctgaggagtgttggcttctctcctaatacaaccatctacttgacagagacgtggtggcacaaaggcctgaatgatctgaaggaagaatatccaaatacttataccaaggatgacattatgccagctgaggacaaaggtgaattcctgaaatccagcaatgcagacctagcaagggctctggaccttgagatctgctcacagagcgatgtgttcatccctgctgtcgctggcctgttctatgggcatgtcacaggtaagaggattgcatctggccgtacccagatcattgtgccttctcagtccagcacctcaactcatgcttcagacttcatctccacctacatctccaacaagaaccaccttgcctactcatgctactgctagtatgcttttgtactgccattaataagatagctgaagcgagccgcagggcagtgctctgggtgcatataaaagtacctctcgttaacatgatgttgtacactagttaatgttttgtttttgaggaatattagcatatattgtgtgttgtttacttgtttggacattaaactttggaacaacagcaaggagcataaaactgcttgtatgctgtaaaatgaacgtgaggtcaggcgtcgtgaaaagagtttgattccttgtagcgctc

SEQ ID NO: 1864 - DNA, 1916 bp, Sorghum bicolor
ccacgccggtcgcgacgccgggatacccggcgccagtccgccaccaaccaaccgccgcgagtagaagaggcagtggtgcgccgaaaaccggcacccccgcgtgcggagcgtgcttgcctcgcactgtcacagtcgcgcacggtccctgtttcatctgtcggtggtgacccgccccgcttcatctatcatctgtcatctccccactcccccagtgcagtcccaggtcctcctgtccgccccactctctccagtctccttctcgcgtcggcggtcggcttggcagggcggaaccaatggcggtcgacccgcggcaggtggtggcgggcttcctcaccctctccatgttcgtcatgctcggcaacatgatcaagcacgaccatttctcctcccccgtcaccgaggagctggccttggaggcaacaggtgtggagtcgaacacagtgaagcttgacaacaatgctgaaatgaacagcgtcgatatggctggagtggaggacctgatggacgctatcgaggacgttaaaccttgctggaccaaaccaagtcaaaaaaatcagccatctaatggttttgttacattctccttgactatgggccctgaatatcacatctcacagatcacagatgctgtggttgttgcaaggtatctaggtgcaacacttgtgctcccagacatcagaggaaatgaattaggaaataagcgaaaattccaagacatgtacaatgtggataaattcgtgaggagcctggatggtgttgtcgaagtaatagaagaaatacctgatgaagtaagtgctaagaatccagcagttatcagagtaccaaaccgtgtgactgaaagcttcatcacagacaccatccagcccatcttccaaaaaaacaagtacttaagactagcagtcattttctcttcagtaagtttaaggccaaaggagacgaataacaaggacttggatgcaactgcttgccttgcaatgttcagtggcctcgaactgaagcatgaatattctgaagtggccagaaaaatgttggataggcttcaagaattaagcaagaaatcagatgggaaggtcttggcaatcgatctgcggaccgacttgctggaaaagaagagttgcaagacaaccagaggcgctcgaaggaaaggctgctataaccctgaagaggttctggctttcctcaggaatgttggcttctctgctaatacaaccatctacttgacagagacatggtggcacaaaggcctgaatgatctaaaggaagaatttccaaacacttataccaaggatgacattatgccagctgagaacaaaggtgaattcctgaaatccagcaatgccgacctagcaagggctctggaccttgagatctgctcacagagtgacgtgttcatccctgctgtcgctggcctattctacgggcatgtcacaggtaagaggatcgcatctggtcgtactcagatcattgtgccttctcagtccagcacctcaactcatgcttcagacttcatctccacctacatctccaacaagaaccaccttgcctactcatgctactgctagtatgtttttgtactgccattaataagatcagctgaagtgagccgcagcccgcagggcagtgctctgggtgcatatacaagtacctctcgttaacatgatgttgtacactagttaatattttgttattgggaatattagcatatattgtgtgctgtttacttgtttggacattaaactttggaacaacagcaaggagcataaactgcttgtatgctgtaaaatgaacgtgatgttaggcgtgtgaaaagagtccgcttcatgtaccttgtagcgctctttatcttctgtctgctcacaagttgatgtagtaattgctctggaagtctccatggaaactgtgtataattgcgcgtg

SEQ ID NO: 1865 - DNA, 1912 bp, Sorghum bicolor
ccacgccggtcgcgacgccgggatacccggcgccagtccgccaccaaccaaccgccgcgagtagaagaggcagtggtgcgccgaaaaccggcacccccgcgtgcggagcgtgcttgcctcgcactgtcacagtcgcgcacggtccctgtttcatctgtcggtggtgacccgccccgcttcatctatcatctgtcatctccccactcccccagtgcagtcccaggtcctcctgtccgccccactctctccagtctccttctcgcgtcggcggtcggcttggcagggcggaaccaatggcggtcgacccgcggcaggtggtggcgggcttcctcaccctctccatgttcgtcatgctcggcaacatgatcaagcacgaccatttctcctcccccgtcaccgaggagctggccttggaggcaacaggtgtggagtcgaacacagtgaagcttgacaacaatgctgaaatgaacagcgtcgatatggctggagtggaggacctgatggacgctatcgaggacgttaaaccttgctggaccaaaccaagtcaaaaaaatcagccatctaatggttttgttacattctccttgactatgggccctgaatatcacatctcacagatcacagatgctgtggttgttgcaaggtatctaggtgcaacacttgtgctcccagacatcagaggaaatgaattaggaaataagcgaaaattccaagacatgtacaatgtggataaattcgtgaggagcctggatggtgttgtcgaagtaatagaagaaatacctgatgaagtaagtgctaagaatccagcagttatcagagtaccaaaccgtgtgactgaaagcttcatcacagacaccatccagcccatcttccaaaaaaacaagtacttaagactagcagtcattttctcttcagtaagtttaaggccaaaggagacgaataacaaggacttggatgcaactgcttgccttgcaatgttcagtggcctcgaactgaagcatgaatattctgaagtggccagaaaaatgttggataggcttcaagaattaagcaagaaatcagatgggaaggtcttggcaatcgatctgcggaccgacttgctggaaaagaagagttgcaagacaaccagaggcgctcgaaggaaaggctgctataaccctgaagaggttctggctttcctcaggaatgttggcttctctgctaatacaaccatctacttgacagagacatggtggcacaaaggcctgaatgatctaaaggaagaatttccaaacacttataccaaggatgacattatgccagctgagaacaaaggtgaattcctgaaatccagcaatgccgacctagcaagggctctggaccttgagatctgctcacagagtgacgtgttcatccctgctgtcgctggcctattctacgggcatgtcacaggtaagaggatcgcatctggtcgtacccagatcattgtgccttctcagtccagcacctcaactcatgcttcagacttcatctccacctacatctccaacaagaaccaccttgcctactcatgctactgctagtatgtttttgtactgccattaataagatcagctgaagtgagccgcagcccgcagggcagtgctctgggtgcatatacaagtacctctcgttaacatgatgttgtacactagttaatattttgttattgggaatattagcatatattgtgtgctgtttacttgtttggacattaaactttggaacaacagcaaggagcataaactgcttgtatgctgtaaaatgaacgtgatgttaggcgtgtgaaaagagtccgcttcatgtaccttgtagcgctctttatcttctgtctgctcacaagttgatgtagtaattgctctggaagtctccatggaaactgtgtataattgcg

SEQ ID NO: 1866 - DNA, 1851 bp, Zea mays
gtagaagaagaagcagaagtactcaatcccgagactaacgccgagccgtgttgcggtctgcggagcgtgcttgccacactcacagtcgctcactccctgtgcagctgtgctcctgtcggttgtcgccccgcttcatctgtcgtctcctccagtgcagtccctcctccccctgtctccgccccaactctctccagtctcctcgcgtcggcagtcggcctggcagggctgaatcaatggcggtcgacccgcggcaggtcgtggcgggcttcctcaccctctccatgttcgtcatgctgggcaacatgatcaagcacgaccacttctctcccgtcaccgaggagatgggcttgaaggcaacaggtgcgcgatccaacacaatgaagcttgataacaatgctgaaatgaacagtgtcgatatggctggagtggaggacctgatggacactatcgaggaagttaaaccttgctggaccaaaccaagtccaaaaaatcagccatctaatggttttgttacattctccttgactatgggccctgaatatcacatctcacagatcacagatgctgtggttgttgcgaggtatctaggtgcaacatttgtactcccagacatcagaggaaatgaattaggaaataagcgaaaattccaagacatgtacaatgtggataaattcgtgaggagcctagatggtgttgtcgaagtaatagatgaaatacctgatgaagtgagtgctaagaagccagcagttatcagagtaccaaaccgtgtgactgaaagcttcatcatggacaccatccagcccatctttaaaaaaaacaagtacttaagacttgcggtcattttctcttcagtaagtttaaggccaaaggagacgagtaacaaggacttggatgcgactgcttgccttgcaatgttcagtggcctcgaactgaagcatgaatattctgaagtcgccagaaaaatgttggataggcttcaagaattaagcaagaaatcagatgggaaggtcttggcaatcgatttgcggaccgacttgctggaaaagaagagttgcaagacaaccagtggcgctcgaagaaaaggctgctataaccctaatgaggtcctggctttcctgaggagtgttggcttctctgctaatactaccatctacttgacagagacatggtggcacaaaggcctgaatgatctgaaggaggaatttccaaatacttataccaaggatgacattatgccagctgagaacaaaggtgaattcctgaaatccagcaatgcagacctagcaagcgctttggaccttgagatctgctcgcagagtgacgtgttcatccctgctgtcgctggcctgttctacgggcatgtcacaggtaagaggattgcatctggtcgtacccagatcattgtgccttctcagtccagcacctcgactcatgcttcagatttcacctccacctacatctccaacaagaaccacctagcctacacatgctactgttagcatgcttttgtactgccattaataagatcagctgaagtgagccgcagggtagtgctctgggtgcatatacaagtacctctcgttagtcgttaacatgctgttgtacactggttgatgttatgttatgaggaataaatattagcatatgttgtgtgttgtttacttgtttggatattaaactttggaacaacagcaaggagcataatgactgcttgtatgctgtaaaatgaacccgaggttaggcgtgtgaaaagagtttgcttcatgtaccttgattcatcaccttctgtctgctcaccaattgatgtagtaattgctccggaagtctccatggaagcaatgtatagatgtg

SEQ ID NO: 1867 - DNA, 2024 bp, Trigonella foenum-graecum
ttgaagtgtaataaataaacaataaaattgtattgacttgatgatgcttccttttgaaatgtgaaaatcaaatattaaattaatgcgtctgcattgcttttagtgtctgtattcatccccagctgctgtattcaaaatggaatgatacaaaaataattcaaaatggaatgaaatatttcccatgaatatgtgtgtctatatatatactgacacagacattcttaataatattacaatagctgaatacttatccctaactcatgaaccaaaacatgtcaccacttgttcttttcccttttgctctcttattattcttcttcttgttcaaaaaacacaaaacatctaagaaaccaacaaatctaccaccaggtcctaaaggcctccctttcattggaaacttacaccaacttgatagttcagctcttggtttaaacttctatgaactctcaaagaaatatggctctttaatctaccttaaacttggttctaggcaaacagttgttgtttcatcagctaaaatggccaaacaagtaatgaaaacacatgacatcgatttctgtaacagaccctctttaatcagccatatgaaagtctcatataatggattagatcaagtatttgcaccatatagagaatattggagacacacaaaaaaactttccttcattcattttcttagtgtcaaaagagtctcaatgtattcctcagttagaaaatatgaggtgacacaaatgatgaagaagatatcagaatatgcttcttccaacaaagttgtgaacatgtctgcgcttcttatttgtcttacaagtactatagtttgtaggaccgcgttcggaagaaagtatgaagaggacggaattgagcgtagcatgtttcaatgtttgcttaaagaacttcaggaattgttaatttcgttcttttacgcggattatttgccttttgttggagggatcattgatagatttaccggaaagatgagtcgtcttgagaaaacgttcaaggttttggatgaattttttcaaggtattgttgatgaacatcttgatccggaaaggaagaattttcctccacatgaagatgatgtaattgatgccttgattcaattgaagaatgatccttactgctcaatggatctcactcctgatcacatcaaacccttgataatgaacttgttgttcgcggggacagacacaattacatccgtagtagtttgggctatgactgcactaatgaagaatccaagagcaatgcagaaagtacaagaagagattcgaaaagtgtttgcagggaaaggttttatagaggaagaagatgtccaaaagcttccatatctcaaagcagttataaaagaaacaatgagattgtacccatctttgcctatacttttaccaagagaaacgatgaaaaagtgcgacattgaagggtacgaaattccagacaagacattggtgttcgtgaatgcttgggcgatccacagagacccagaagcatggaaggatcccgaagagttttatccagagagattcctaaacagtgatatagatttcaaagggcaagattttgagcttattccgttcggttcggggcgaagagtttgccctggattaaacatggctgttgctactgtgaaccttgtacttgctaatcttctttacttgtttgattgggaaatgcctgaaggagttaagagggaagatatagacattgatggtcaaccaggacttgttcaacacaagaaaaatcctctctgccttgttgctaagaagaggatttgaatgtgtgtgatcttgaatgtgcatgttatattatatttatattaagaaaataaagcatgcattttgtgactaagcaattactatatataccattcccttgtgttgtatgttcaaagaaataaaagatatcatcagaagaatggtttagaacattaatgttttattctataaatggtttttgacttggtcaaagtcgagtcatcgtttgttctatgaatgattgttgtttaccaatttaatctcatttca

SEQ ID NO: 1868 - DNA, 1765 bp, Trigonella foenum-graecum
agattacaatagctgaattagtttatccctaactcatggaccaaaacatgtcaccacttgttcttttcccttttgctctcttgctattcttcttcttgttcaaaaaacacaaaacatctaagaaaccaacaaatctaccaccaggtcctaaaggccttcctttcattggaaacttacaccaacttgatagttcagctcttagtttaaacttctatgaactctcaaagaaatatggctctttaatctaccttaaacttggttctaggcaaacagttgttgtttcatcagctaaaatggccaaacaagtaatgaaaacacatgacatcgatttctgtaacagaccctctttaatcagccatatgaaagtctcatataatggattagatcaagtatttgcaccatatagagaatattggagacacacaaaaaaactttccttcattcattttcttagtgtcaaaagagtctcaatgtattcctcagttagaaaatatgaggtgacacaaatgatgaagaagatatcagaatatgcttcttccaacaaagttgtgaacatgtgtgagcttcttatttgtcttacaagtactatagtttgtaggaccgtgttcggaagaaagtatgaagaggacggaattgagcgtagcatgtttcaatgtttgcttaaagaacttcaggaattgttaatttcgttcttttacgcggattatttgccttttgttggagggatcgttgatagatttaccggaaagatgagtcgtcttgagaaaacgttcaaggttttggatggattttttcaaggtattgttgatgaacatcttgatccggaaaggaagaagtttcctccacatgaagatgatgttattgatgccttgattcaattgaagaatgatccttactgctcaatggatctcactcctgatcacatcaaacccttgagaatgaacttgttgttcgcggggacatacacaattacatccgtagtagtttgggctatgactgcactaatgaagaatccaagagcaatgcagaaagtacaagaagagattcgaaaagtgttttcagggaaaggttttatagaggaagaagatgtccaaaagcttccatatctcaaggcagttataaaagaaacaatgagattgtacccatctttgcctatacttttaccaagagaaacgatgaaaaagtgcaacattgaagggtacgaaattccagacaagacattggtttcgtgaatgcttgggcgatccacagagacccagaagcatggaaggatcccgaagagttttatccagagagattcctagacagtgatatagatttcaaagggcaagattttgagctgattccgttcggttcggggcgaagagtttccctggattaaatatggttgttgctactgtggaccttctacttgctaatcttctttacttgtttgattgggaaattcctgaaggagttaagagggaagatatagacattgaaggtcaaccaggacttgttcaacacaagaaaaatcctctctaccttgttgctaagaagaggattgaatgtgtgtgatcttgaatgtgcatgttatattatatttatattaagaaaatgaagcatgcattttgtgactaagaaattactatatatacgattcccttgtgttgtatgttcaaagaaataaaagttatcatcctatatagaagaatggtttacaacattaatgttttattctataaatggtttttgtacttggtcaaagtcgagtcatcgtttgtac

SEQ ID NO: 1869 - DNA, 1998 bp, Trigonella foenum-graecum
tgatttgatgatgcttccttttgaaatgtgaaaatcaaatattaaattaatgcgtctgaattacttttagtgtctgtattcatcacctgctgctgtatttaaaatggaatgagacaaaaataattcaaaataattcaaaatggaatgaaatatttcccatgaatatgtgtgtctatatatatactgacacagacattcttaataatattacaatagctgaatacttatccctaactcatgaaccaaaacatgtcaccacttgttcttttcccttttgctctcttattattcttcttcttgttcaaaaaacacaaaacatctaagaaaccaacaaatctaccaccaggtcctaaaggcctccctttcattggaaacttacaccaacttgatagttcagctcttggtttaaacttctatgaactctcaaagaaatatggctctttaatctaccttaaacttggttctaggcaaacagttgttgtttcatcagctaaaatggccaaacaagtaatgaaaacacatgacatcgatttctgtaacagaccctctttaatcagccatatgaaagtctcatataatggattagatcaagtatttgcaccatatagagaatattggagacacacaaaaaaactttccttcattcattttcttagtgtcaaaagagtctcaatgtattcctcagttagaaaatatgaggtgacacaaatgatgaagaagatatcagaatatgcttcttccagcaaagttgtgaacatgcctgcgcttcttatttgtcttacaagtactatagtttgtaggaccgcgttcggaagaaagtatgaagaggacggaattgagcgtagcatgtttcaatgtttgcttaaagaacttcaggaattgttaatttcgttcttttacgcggattatttgccttttgttggagggatcattgatagatttaccggaaagatgagtcgtcttgagaaaacgttcaaggatttggatggattttttcaaggtattgttgatgaacatcttgatccggaaaggaaaaattttcctccacatgaagatgatgtaattgatgccttgattcaattgaagaatgatccttactgctcaatggatctcactcctgatcacatcaaacccttgataatgaacttgttgttcgcggggacagacacaattacatccgtagtagtttgggctatgactgcactaatgaagaatccaagagcaatgcagaaagtacaagaagagattcgaaaagtgtttgcagggaaaggttttatagaggaagaagatgtccaaaagcttccatatctcaaggcagttataaaagaaacaatgagattgtacccatctttgcctatacttttaccaagagaaacgatgaaaaaatgcgacattgaagggtacgaaattccagacaagacattggtgttcgtgaatgcttgggcgatccacagagacccagaagcatggaaggatcccgaagagttttatccagagagattcctagacagtgatatagatttcaaagggcaagattttgagcttattccgttcggttcggggcgaagagtttgccctggattaaacatggcggttgctactgtggaccttctacttgctaatcttctttacttgtttgattgggaaattcctgaaggagttaagagggaagatatagacattgaaggtcaaccaggacttgttcaacacaagaaaaatcctctctaccttgttgctaagaagaggattgaatgtgtgtgatcttgaatgtgcatgttatattatatttatattaagaaaatgaagcatgcattttgtgactaagcaattactatatataccattcccttgtgttgtatgttcaaagaaataaaagatatcatcagaagaatggtttagaacattaatgttttattctataaatggtttttgacttggtcaaagtcgagtcatcgtttgttctatgaatgattgttgtttaccaatttaatctcattt

SEQ ID NO: 1870 - DNA, 1624 bp, Medicago truncatula
tcacataagatattacaatagctgaatagctatccctaattcatgaacaaaaacatgtcaccccttattcttttaccctttgctctcttgctattcttcttgttcaaaaaacacaaaacatctaagaaatcaacaactcttccaccaggtcctaaaggccttcctttcattggaaacttacaccaacttgatagttcagctcttggtttaaacttctatgaactctcaaagaaatatggctctttaatctatcttaaacttggttcaaggcaaacaatagttgtttcatcagctaaaatggccaaacaagtaatgaaaacacacgacatcgatttctgtaaccgacccgctttaatcagccatatgaaattctcatatgatggattagaccagtttttttcaccatatagagaatattggagacacaccaaaaaactttccttcatccattttcttagtgtcaaacgtgtcgtaatgttttcctcagttagaaaatacgagacaactcaaatgatcacgaagatatcagaacatgcttcttccaacaaagttgtgaatttgcatgagcttctcatgtgtctaacaagcgcggtagtttgtaggactgcgttcggtagaaggtttgaagatgaagcagctgaacgtagcatgtttcatgatttgcttaaagaagctcaggaaatgacgatttcgttcttttacacggattatttgccttttgttggagggattgttgataagttcaccggattgatgagtcgtcttgagaaattgttcaagattttggatggttttttccagagtgtttttgatgaacatattgatccaaatagaaagaagttgcctccacacgaagaggatgtaattgatgccttgattgaattgaagaatgatccttactgctcaatggatctcagtgctgaacacatcaaacccttgatcatgaatatgttgttggcgggaacagacacaattgcggccgcggtagtttgggctatgactgcactaatgaagaatccaagagtgatgcagaaagtacaagaagagattcggaaagcatatgaagggaaaggttttatagaggaagaagatgtccaaaagcttccatatttcaaggcagttataaaagaatcaatgagactgtacccgtcattacccgtacttttaccaagagaaacgatgaaaaagtgcgacatcgaagggtacgaaattccagacaagacattggtgtacattaacgcgtgggcaatccatagagatccggaagcatggaaggatccagaagagttttatccagagagattcataggtagtgatatagatttaaaaggacaagatttcgagctgattccatttggctcggggcgaagagtttgccccggcttaaacatggcaattgctactgtggaccttgtacttgctaatcttctctatttgtttgattgggaaatgcctgaaggagtaaagtgggaaaatatagacattgatggtcttccaggacttgttcaacacaagaaaaatcctctctgccttattgctaagaagaggattgaatgtgtttgatctttgtttttcaagttatgttatatttatcctaagaaaataaagcatgcttgttataact

SEQ ID NO: 1871 - DNA, 1839 bp, Trigonella foenum-graecum
gaaatatttcccatgaatatgtgtgtctatatatatcctgacacacacattcttaataatattacaatagctgaatagttatccctaactcatgaaccaaaacatgtcaccacttgttcttttcccttttgctctcttgttattcatcttctttttcaaaaaacacaaaacatccaagaaaccaacaaatctaccaccaggtcctaaaggccttcctttcattggaaacttacaccaacttgatagttcagctcttggtttaaacttctatgaactctcaaagaagtatggctctttaatctaccttaaacttggttctagggaaacaattgttgtttcatcagctaaaatggccaaacaagtaatgaaaacacatgacatcgatttctgtaacagaccctctttaatcagccatatgaaggtctcatataatggattagatcaagtatttgcaccatatagagaatattggagacacacaaaaaaactttccttcattcattttcttagtgtcaaaagagtctcaatgtattcctcagttagaaaatatgaggtgacacaaatgatgaagaagatatcagaatatgcttcttccaacaaagttgtgaacatgtctgcgcttcttatttgtcttacaagtactatagtttgtaggaccgcgttcggaagaaagtatgaagaggacggaattgagcgtagcatgtttcaatgtttgcttaaagaacttcaggaattgttaatttcgttcttttacgcggattatttgccttttgttggagggatcattgatagatttaccggaaagatgagtcgtcttgagaaaacgttcaaggttttggatgaattttttcaaggtattgttgatgaacatcttgatccggaaaggaagaattttcctccacatgaagatgatgtaattgatgccttgattcaattgaagaatgatccttactgctcaatggatctcactcctgatcacatcaaacccttgataatgaacttgttgttcgcggggacagacacaattacatccgtagtagtttgggctatgactgcactaatgaagaatccaagagcaatgcagaaagtacaagaagagattcgaaaagtgtttgcagggaaaggttttatagaggaagaagatgtccaaaagcttccatatctcaaagcagttataaaagaaacaatgagattgtacccatctttgcctatacttttaccaagagaaacgatgaaaaagtgcgacattgaagggtacgaaattccagacaagacattggtgttcgtgaatgcttgggcgatccacagagacccagaagcatggaaggatcccgaagagttttatccagagagattcctaaacagtgatatagatttcaaagggcaagattttgagcttattccgttcggttcggggcgaagagtttgccctggattaaacatggctgttgctactgtgaaccttgtacttgctaatcttctttacttgtttgattgggaaatgcctgaaggagttaagagggaagatatagacattgatggtcaaccaggacttgttcaacacaagaaaaatcctctctgccttgttgctaagaagaggatttgaatgtgtgtgatcttgaatgtgcatgttatattatatttatattaagaaaataaagcatgcattttgggactaagcaattactatatataccattcccttgtgttgtatgttcaaagaaataaaagatatcatcagaagaatggtttagaacattaatgttttattctataaatggtttttgacttggtcaaagtcgagtcatcgtttgttctatgaatgattgttgtttacca

SEQ ID NO: 1872 - DNA, 1901 bp, Trigonella foenum-graecum
ggaatgaaatatttcccatgaatgtgtgtctatatatatactgacacagacattcttaataatattacaatagctgaatacttatccctaactcatgaaccaaaacatgtcaccacttgttcttttcccttttgctctcttattattcttcttcttgttcaaaaaacacaaaacatccaagaaaccaacaaatctaccaccaggtcctaaaggccttcctttcattggaaacttacaccaacttgatagttcagctcttggtttaaacttctatgaactctcaaagaagtatggctctttaatctaccttaaacttggttctagggaaacaattgttgtttcatcagctaaaatggccaaacaagtaatgaaaacacatgacatcgatttctgtaacagaccctctttaatcagccatatgaaggtctcatataatggattagatcaagtatttgcaccatatagagaatattggagacacacaaaaaaactttccttcattcattttcttagtgtcaaaagagtctcaatgtattcctcagttagaaaatatgaggtgacacaaatgatgaagaagatatcagaatatgcttcttccagcaaagttgtgaacatgcctgcgcttcttatttgtcttacaagtactatagtttgtaggaccgcgttcggaagaaagtatgaagaggacggaattgagcgtagcatgtttcaatgtttgcttaaagaacttcaggaattgttaatttcgttcttttacgcggattatttgccttttgttggagggatcattgatagatttaccggaaagatgagtcgtcttgagaaaacgttcaaggatttggatggattttttcaaggtattgttgatgaacatcttgatccggaaaggaaaaattttcctccacatgaagatgatgtaattgatgccttgattcaattgaagaatgatccttactgctcaatggatctcactcctgatcacatcaaacccttgataatgaatttgttgttcgcggggacagacacaattacatccgtagtagtttgggctatgactgcactaatgaagaatccaagagcaatgcagaaagtacaagaagagattcgaaaagtgtttgcagggaaaggttttatagaggaagaagatgtccaaaagcttccatatctcaaggcagttataaaagaaacaatgagattgtacccatctttgcctatacttttaccaagagaaacgatgaaaaaatgcgacattgaagggtacgaaattccagacaagacattggtgttcgtgaatgcttgggcgatccacagagacccagaagcatggaaggatcccgaagagttttatccagagagattcctagacagtgatatagatttcaaagggcaagattttgagcttattccgttcggttcggggcgaagagtttgccctggattaaacatggcggttgctactgtgaaccttgtacttgctaatcttctttacttgtttgattgggaaatgcctgaaggagttaagagggaagatatagacattgatggtcaaccaggacttgttcaacacaagaaaaatcctctctgccttgttgctaagaagaggatttgaatgtgtgtgatcttgaatgtgcatgttatattatatttatattaagaaaataaagcatgcattttgggactaagcaattactatatataccattcccttgtgttgtatgttcaaagaaataaaagatatcatcagaagaatggtttagaacattaatgttttattctataaatggtttttgacttggtcaaagtcgagtcatcgtttgttctatgaatgattgttgtttactaatttaatctcatttcattttggttccatccactgattaaataaattactatcaggaacg

SEQ ID NO: 1873 - DNA, 1714 bp, Trigonella foenum-graecum
acaaataattcaaaatggaatgaaatatttcccgtgaatatgtgtctatatatatactcacacacacattcttaataagattacaatagctgaatagctatccctaactcatgaaccaaaacatatcaccacttgttctttttccttttgctctcttgctattcttcttcttgttcaaaaaacacaaaacatctaagaaaccaacaaatctaccaccatgtcctaaaggccttcttttcattggaaacttacaccaactcgatggttcagctcttggtttaaacttctatgaactctcaaagaaatatggctctttaatctaccttaaacttggttctaggcaaacagttgttgtttcatcagctaaaatggccaaacaagtaatgaaaacacatgacatcgatttctgtaatagaccctctttaatcagccatatgaaactctcatataatggattagatcaagtatttgcaccatatagagaatattggagacacgcaaaaaaactttccttcattcattttcttagtgtcaaaagagttctcaatgtattactcagttaaaaaatatgaggtgacacaaatgatgaagaagatatcataatatgcttcttccaacaaagttgtgaacatgcatgagcttcttatttgtcttacaagtactatagtttgtaggaccgcgttcggaagaaggtatgaagaggacggaattgagcgtagcatgtttcaatgtttgcttaaagaacttcaggaattgataatttctttcttttacgcggattatttgccttttgttggagggatcgttgatagatttaccagaaagatgagtcatcttgagaaaacgttcaaggttttggatggattttttcaaggtattgttgatgaacatcttgatccggaaaggaagaagtttcctccacatgaagatgatgtaattgatgcattgattcaattgaagaatgatccttactgctcaatggatctcactcctgatcacatcaaacccttgataatgaacatgttgttcgcggggacagacacaattacatccgcaatagtttgggctatgactgcactaatgaagaatccaagagcaatgcagaaagtacaagaagagattcgaaaagtgtttgcagggaaagattttatagaggaagaagatgtccaaaacttccatatctcaaggcagttataaaagaaacaatgagattgtacccacctttgcctatacttttaccaagagaaacaatgaaaaagtgtgacattgaagggtacgaaattccagacaagacattggtgttcgtgaatgcttgggcgatccatagagaccaagaagcatggaaggatcccaaagagttttatccagagagattcctagacagtgatatagatttcaaagggcaagattttgagctgattccgttcggttcggggcgaagagtttgccctggattaaacatggttgttgctactgtgaccttgtacttgctaatcttctttacttgtttgattgggaaatgcctgaaggagttaagagggaaggatatagacattgatggtcaaccaggacttgttcaacacaagaaaaaatcctctctgccttgttgctagaagaggattttgaatgtgtgtgatcttgaatgtgcatgttatattatatttatattagaaataaagcatgcattttgggtactaagcaattactatatata

SEQ ID NO: 1874 - DNA, 1057 bp, Vigna unguiculata
ggctccttcttcttctctccttctttctccacacctctgtttttcttttttctcagctccactttctcttcctccactctgaggttccactagttattctgtataggaccagcactgcttaaagtttcaagctttgcaacttttggaagatacccacctaaccattttcactggcctaaggaggggtttttggtttcaactatttctgcttttaccttcaaaagggtcatagatgatagccagctctttctgcaatgctgattctatgttttcaagagaagaggggatagatgttagaaagatgatggagcataaaaggagtccctgctctgttgaccaaagcagttatacttctattgcatctaaaaggcaaaaggctgatttatctatcagcactaaggagaggaaggagaagattggggaacgaattgttgctcttcagcagcttgtttcaccatatggaaagacagatacatcttctgttctaaaggaggcaatggaatacataggattccttcataaacaagttaagctgctcagtgctccataccttgaaacttcagcagcagccaagatgcagggtatggagtcatgcagcctgaggagtagagggttatgccttgttcctgtgtcatttacaattggagttgctgagagcaatggtgcagatatctgggctcccatcaaaactactacttcacccaaattggagaatgatgtctctcaatttcattgacaaaatttctcacttttattgcagcctaaaggttgctatgctaagttgctaaagcagtgtagtggcatgaaaatctgtcatcatacatctagatggaatcataataactaaaatagttaaaccattaaaagaactctctagtcatcaagaagctttccacacctttaagattttaagtgggtgatggggctaagcttccaattagccaaatgtgttcttaatttcttatgctgattattaagtgtatatttcaaaatttctagttctataatgattccatgtactgattagcttaatgaaagtcgtttcttgatttgatga

SEQ ID NO: 1875 - DNA, 1175 bp, Glycine max
acgtaaggaattattgtattatattcattttctagctttataaaatcacattgacattgacctgctcctccttcctcttcttccttctccacaagaagccacacacacctctgtttctttctctgctccacactttctcttcctccattattgagcttccactagtttttttttctttctttctttctttcaaggacttaattgcactgcttaaagtctcaagctttacaacttttggaagacacccatcaaaccattttttgcagccatcacttgcctaaggaagagggttcttttggtttcaaccattttctgcttttagcttcaaaaggatcatcatagatgatagccagctccttctgcaatgctgattctatgttttcaagagaagaggggatagatgttagaaagatgatggaacataaaaggagcccctgctctgttgaccaaagcagttatacttctattgcctccaaaaggcaaaaggctgatttatcgatcagcactaaggagaggaaggaaaagattggcaaacgaattgttgctcttcagcagcttgtttcaccatatggaaagacagatacatcttctgttctaaaggaggcaatggaatacataggattccttcataaacaagttaagctgcttagtgctccataccttgaaagttcaccagcagcaaagatgcagggtatggagccatgcagcctgaggagtagagggttatgtcttgttcctgtgtcatttactattggagttgctgagaccaatggtgcagatatctgggctcccattaagactactacttctcctaaatttgagaaggatgtctcccaatttcattgaataattttctcacctttacagcctaaaggttgctaaagttgctaaactagcatgaaaatgattatgatcatacatctagatggaatcatagtagctatatatatatatatataatagttatatcattaaaaaaaaactctagtcaagaagctgtcccacacctctaagattttaaacgggtgatggggctaagcttccaattagccatatgtgcccttaactaattaattccatgtgttgattattaagtgtatatttgaaaaattctagttgtataatgattccatgtactgattagcttaatgaaagtcgtttctagatttgatgta

SEQ ID NO: 1876 - DNA, 1164 bp, Glycine max
cacattgacattaacctgctcctccttcctcttctttttccttctttctccacaagaagccacacacacctctgtttctttctctgctccacactttctcttcctccattattgagcttccactagttttttttcccctttctttcttccaaggacttaattgcactgcttaaagtctcaagctttacaacttttggaagatacccattttttgcagccatcacttacttgcccaagaagagaggggctttcttttggtttcaaccattttctgcttttggcttcaaaaggaacatcatagatgatagccagctccttctgcaatgctgattctatgttttcaagagaagaggggatagatgttagaaagatgatggaacataaaaggagaccctgctctgttgaccaaagcagttatacttctattgcatctaaaaggcaaaaggctgatttatcgatcagcactaaggagaggaaggaaaagattggcgaacgaattgttgctcttcagcagcttgtttcaccatatgggaagacagatacatcttctgttctaaaggaggcgatggaatacataggattccttcataaacaagttaagctgcttagtgctccataccttgaaagttcaccagcagccaagatgcagggtgtggagccatgcagcctgaggagtagaggcttatgtcttgttcctgtgtcagttactattggagttgctgagagcaatggtgcagatatctgggcccccattaagactactacttctcctaaatttgagaaggatgtctcccaatttcattgacaaattttctcatctttgcagcctaaaggttgctaaagttgctaaactagcatgaaaattactatgatgatacatctagatggaatcatagtagctatatatatatatataatagttaaagcattaaaaaaaaaaaactctagtcaaaaagctgtcccacacctcttagattttaaacgggtgatgggggtaagcttccaattagccatatgtgcccttaattaattaattccatgtgctgattattaagtgtatatttgaaaaattctagttgtataatgtttccatgaactgattagcttaatcaaagtcgtttcaagaatttgatgagagtacgaatgtcaatatttcactgtgct

SEQ ID NO: 1877 - DNA, 1067 bp, Cajanus cajan
aaggaattattgtattatattcatttagctttataaaatcagattttgacactaaccttctcctccttcttcctcttcttctttctcctttgcttctctttctcttcctccattgatgacctttcactagtttttctctcaaggacaagcactgcttaaagtctcaagctttaaagcttttggaagatacccaccaaaacatttccttgggttttggtttcaaccatttcagcttttagcttcaaaagggtcatagatgatagccagctccttctgcaatgctgattctatgttctcaagagaagaggggatggatgttagaaagatgatggaacataaaaggagtccctgctctgttgaccaaagcagttacacttctattgcatctaaaaggcaaaaggctgatttatcgatcagctctaaggagagaaaggagaagattggtgagcgaattgttgctcttcagcagcttgtttcaccatatggaaagacagatacatcttctgttctaaaggaggcaatggattacataggattccttcataaacaagttaagctgctaagtgctccataccttgaaagttcaccagcagtcaagatgcagggtatggagccatgcagcctgaggagtagagggttatgtcttgttcctgtctcaattacaatgggagttgctgagagcaatggtgcagatatctgggctcccattaagactactacttcgcctaagtttgagaatgatgtctcgcaatttcattgacaaattttgtgacctttgcagcctaaaggttgctaaaccagtctagtagcatgaaaatttatcatcatacatctagatggaatcatagtagctaaaatagttaaatcattaaaagaaactttagtcaagaagctgtcccacacctttaagattttaaacgggtgatggggggttaagcttccaagtagcataatatgtcttaattccatatgctgattattaagtgtatatttgaaaaattctagttgtataatgattccacgtactgatttagcttaaatgaaaagtcgtttctagatttgataag

SEQ ID NO: 1878 - DNA, 1111 bp, Phaseolus coccineus
taacctgctcctccttcctcctcctcttttcttcttctttctccacaagccacaaacaaacatctctgtttttttctctcagcttcactttctcttcctccactcatcagattccactactttttctttctaggaccagcactgcttaaagtctcaagctttgcaacttttggaagtaccccacctaaccattttcacttgcctaaggagagggtttttggtttcaaccatttctgcttttaccttcaaaagggtcatagatgatagccagctccttctgcaatgctgattctatgttttcaagagaagaggggatagatgttagaaagatgatggagcataaacgaagtccctgctctgttgaccaaagcagttatacttctattgcatctaaaaggcaaaaggctgatttatctatcagcacaaaggagaggaaggagaagattggggaaagaatagttgctcttcagcagcttgtttcaccatatggaaagacagatacatcttctgttctagaggacgcaatggagtacataggattccttcataaacaagttaagctgctcagtgctccataccttgaaacttcagcagcagccaaaatgcagggtatggatgcatgcagcctgaggagtggagggttatgccttgttcctgtgtcatttacaattggagttgctgagagcaatggtgcagatatctgggctcccatcaaaactgctacttcaccaaaattggagaaggatgtctcgcaatttcattgaccaagtttctcacctttattgcagcctaaaggttgctatgctaagttgctaaaccagtgtagtggcatgaaaatttgtcatcatacttctagatggaatcataatagctaatatagttaaagcattaaaaaaaactctagtcatgaagctgttccacacctttaagattttaaatgggtgatggggctaagcttccaattagccaaatatgttcttaatttcttgtgctgattattaagtgtatatttcaaaatttctagttgtataatgattccatgtactgattagcttaatgaaagtcgtttcttgatttgatgaaagtgccaatgtcagtgtttcactgtgct

SEQ ID NO: 1879 - DNA, 1031 bp, Lotus japonicus
gacactaacctttctcccccttcctcttcctcttcttccttttccactagaaaccacaccactctgttcctcttcctcactgcccctcttcctcttcttccattcatgaacttccactagatttttcctttcaaggcacagcttaaagtcacaatctttccaacttttggaagaaaaaagagggcttttggtttcaaacatttctggtttctgctccaaaatcaaagatgatagctagctccttctgcaatgctgattcagtgttttcaagagaagaggggatagatgttagaaaaatgatcggacataaaaggagtccatgctctgttgatcagagcagttatacctctattgcatctaaaaagcaaaaggctgatttatctatgagttctaaggataggaaggaaaaggttggagaacgaattgttgctcttcagcagctcgtttccccatatggaaagacagatacatcttctgttcttaatgaggcgatggaatacataggattccttcataaacaagttaagctgctcagtgctccttacctggagagttcaccagcaaccatgatggagggcatagagccatgcagcctgaggaatagaggattatgtcttgttccagtctcaattactatgggagttgctgagagcaatggtgcagatatctgggctccaatcaagaccacttcaccaaaatctgagaaggatattgtctcacaatttcattgacaaattttgtccaagttgcgaagctaatcttgtagcttggaaatttatcaaattatgttcttacatctatggaatctatcatctatcatagttgctaaaatagttagaagtgttaagaattcaatctagtagcaaccccacgcctctaaaattttaaactggtgatggcggtaagctatcaagttgccatatatatccttaattctctgtgctgattataaagtgtatatttataatttctagctgtacaatgattccatgtactgactagcttaatggaagttgtttcaagatttgatg

SEQ ID NO: 1880 - DNA, 1447 bp, Glycine max
gtaggaggaaaacgtggtgttgggatagagaagcgaaagaaaccaaaccacaatgaaataaaaagccccttttgtagaacagtgatacattcgctttctatttcttcctcatctcgtacgtttcgtggatccttactcaacgcaacacaacacaacacagtagaaaaattatgagttccaaaggtgttggtgaagattgcctgggatgggcagcaagagatgcatccggagttctatcaccttacaaattcagtcgcaggactcctgggaatgaagatgttcttattaaaattacacactgtggtgtttgcttcgccgatgtagtttggacaaggaataaacatggtgactcaaagtatcctgttgtgcctggtcacgagattgctgggattgtgacaaaggttggctccaatgtccaccgttttaaggttggtgaccatgttggagtggggacttatgtcaactcatgtagggattgtgaacattgtaatgacagagaagaagttcattgtaccaagggatctgttttcacttttaatggtgttgattttgatggtacaattacaaaaggaggatactccagttacatagtagtccatgagaggtactgcttcacgataccaaaatcctatgcattggcttcagcagctcctttgctttgtgctggaattacagtttattcaccgatggtgcgccacaagatgaatcaacctggtaaatctcttggagtgattggtcttggtggcctcggtcatatggcagtgaaatttggaaaggcatttggtttgagtgtgacagttttcagcactagcatatccaagaaagaggaggcactgagcctgcttggtgcagacaaatttgttgtttcatctaatcaagaggaaatgacggcattggctaaatcgttggactttataatcgacacagcatctggtgatcacccgtttgatccttacatgtcactgttgaagacatatggtgtttttgtcctagttggtttcccaagtcaagtcaaattcagccctgcaagccttaatataggatcaaagactgtagccggaagtgttacaggtggtacaaaagatatacaggagatgattgacttctgtgctgcaaacgagattcacccaaatatagaggtaattccaatcgagtatgccaatgaagctcttgagaggctcatcaatagggacgtcaagtaccggtttgtgatagatattgagaactccctgaaagaaaaataagttgtacttgttgcctcctaaattgggcatgattggacttcaccttgttcgataaacaagatgttcatagttcataattacttacatagaggtgatttcaatggagtatgcgatgtaaatgttgaattttccttaattattttgggaactaatattatttgactattataatattttggattatgaaataataataattatgg

SEQ ID NO: 1881 - DNA, 1299 bp, Vigna unguiculata
  misc_feature (365)..(365): n is a, c, g, or t
  misc_feature (459)..(459): n is a, c, g, or t
  misc_feature (769)..(769): n is a, c, g, or t
cacattcgtagatccttactcaacacaccacagaaaaattatgagttccaaaggtgttgatgaacagtgcctgggatgggcggcaagagatgcatccggagttctatcaccttacaaattcagtcgcaggaatcttgggaatgaagatgttcatattaaaattacacactgcggtgtttgctacgctgatgtaatttggacaaggaataaacatggtgactcaaagtatcctgttgtgcctggtcatgagattgctgggattgtgacaaaggttggccctaatgtccaccgtttcaatgttggtgaccatgttggagtggggacttatgtcaactcgtgtagggattgtgagtattgtaacgaanaacaagaagttctttgtaccaagggatcagttttcacttttaatggtgttgattttgatggtacaataacaaaaggaggatactcaagctacanagtagtccatgagaggtactgcttcacgataccaaaaggctatccattggcttcagctgctcctttgctttgtgctggagttactgtttattctccgatggtgcgccacaagatgaatcaacctggaaaatctcttggggtgattggtcttggtggccttggtcatatggcagtgaaattcggaaaggcatttggtttgagtgtaacagtttttagcactagtgtatccaagaaagaagaggcactgacctcgcttggtgcggacaaatttgttgtttcatctaatcaagaggaaatgaaggcgttggcnaaatcgctggattttataatcgacacagcatctggtgatcacccatttgatccttacatgtcacttttgaagccatatggtgtttttgtcctagttggtttccctagtgaagtcaaattcagccctgcaagccttaatataggatcaaagacttttgccggaagcattacaggtggtacaaaagatatacaagagatgattgacttctgtgctgcaaacgatattcacccaatgatagaggtgattccaatcgagtatgccaatgaagctcttgaaaggctcgtaaatagagacatcaaatatcggtttgtaatagatattgagaactccctaaaagaaaattaagaagttgcttgcaaaactagacatcgttggagtttatcatgtccaaaaggtaatgatgcttagtgttcatatttacttccatagacatggttccaatggatcattcgatctaaataaaatgttgaattttcctcaactatgtgtaactgatatgatatgattattggaatattttgggacatgga

SEQ ID NO: 1882 - DNA, 1381 bp, Arachis hypogaea
ggggtatcttcgtcgcagagagttcaacaagaagcgccacctcgcatagcacagataatgagtgctgaagaagccaataaagattgcctagcgtgggctgcaagagattcatctggagtcctatcaccttacaaattcagtcgcagggctcttgggaatgatgatgttcacataaaaattacccactgtggggtttgttatgctgatgttgtttggactaggaataaacatggtgactccaaatatcctgtagtacctggacatgagattgccggggttgtggaaaaagttggttctagtgtccagcgtttcaaagttggtgaccatgttggagtagggacttatgtcaactcatgcagggattgtgagtattgtaatgacagacaagaagttcattgtgtgaagggagcagtttataccttcaatggcgttgatgttgatggaacaattacaaaaggaggatattcaagttacatagtagtccatgaaaggtactgttatgtgatacctaagaattacccattggcttcagctgctccactgctatgtgctggaattactgtttacagtcccatgatgcgccacaaaatgaatcaacctggcaagtctctagcagtgattggtcttggtggtcttggtcatatggcagtgaaatttggaaaggcattcgggttgaatgtaacagttatcagcaccagtgtatccaagaaagaagaggccctgagcctactcggtgcagataaatttgttgtttcaactgataaagagcaaatggcggcactggccaagtcttttgactttataattgatgcggcttccggtgatcatccgtttgatccttacatggcactgttgaagatatctggtgctatggtcctggttgggttccctagtgaagtcaaattcagccctgctaaccttattcttggtatgagaaccatatcagggagtgttactggtggcacaaaagagacacaagagatgattgacttctgcgccgcaaatggaattcacccaagcatagaagtggttccaatagagtatgcaaatcaagctcttgagagaatgataaatagggatgtgaaatatcggtttgttatagatattcaaaactccctaaaataggtccaaagaaatgagtatacatggttgtggaccgacctctttttatatacatgttggaagatttggataaatatatcatattttctagtcggcttttgagtttctatttctccgctcctcacatggtttcaaatcagtaaggactgaagttgaggactgcgaattttgaatgtctgggacatgttgagaactagaaaaataattcgtgtggttttattatcatatctcataagtaaaagattctaactattttctg

SEQ ID NO: 1883 - DNA, 1920 bp, Manihot esculenta
aagcgtttcagtttttagcctccacagaactagtgaggaacactgtttctctcaacatcaactacacatacactctccctaccttccgtctctggtctgaattgttatctggttcgctgaaagccctaattctacgctcataattccaggtctaactcactccaaaagatagttcagaggaggagttgaagggaagtagtgcttaaagcctttataaggagcacattactcctatcccaaaccgatgtagaatttccctcacgcccaggactatactggaacgtgacacatttacgggagatccaacatcggtgggaggctctgataccatattaaatttatatcaggtctaactcacccaaaagttagctcaaggaagaagtgcctaaggcttttataaagggaatgagttctgagagtgtaaaggaggactgctttgcatgggcagctagagatccatctggagttttatcaccatacaagttcaagcgcaggactactggggaagatgatgtttccctaaaaatcacacattgtggaatctgctatgctgatgttatttggactaggaataaacttggggattcaaagtatcccttggtgccaggacatgagattgttggaatggtacaagaggctggacctaatgttagccgcttcaagcctggtgaccgagttggagtaggcacttatgtcaactcatgcaaagaatgcgagtattgtaatgatagggaagaagttcattgtgaaaaagggtcagtttttacttttaatgccattgatcttgacggtacaatcacaaaaggaggatattctagctacattgttgtccatgaaaggtactgctttatgataccagatgactatccattggccttagcagcacccctgctatgtgctggaattactgtttacaatcccatgatgcgacatgggatgaaccaacctggtaaatctctaggagtgattgggctaggtggtcttggtcacatggcagtgaagtttgggaaggcttttggactgaaagtaacagtttttagcacaagcatttctaagaaagaggaagccttgggtgtgcttggtgcagacaattttgttgtctcatctgaccaagaacagatgaaggcactctctaaatcactggactttatagttgacacagcttctggtgatcatccatttgacccatacatgtcacttttgaagactgctggggttcttgttcttgtggggttcccaagtgaagtcaaattcagtccagcatctctcattctgggtatgagaaccgtgtctggtagcataacgggtggtacaaaagtgacacaagaaatgctggacttttgtgctgctaaaaaaatttatcccgagatagaattaatccctattgattatgcaaatgaagctcttgaaagggtagtaaagagagatgtgaagtaccggtttgtgatagatatagagaactccttgaagtgaagatagagatgaaggcttatgatataaatctggcaggtatgggaagtctctttatggaagcaaaaggaaatatctctgctcaaataattaagtaaaaggtggttgattactaaaggcaattaacctttgctagtagcgtgtctggagggaaattggttaatgtaaggtcatggtgatcaagtgttgggcatcaaatattcaaataagtactttctaaattatttgccaatgggatgatgaaatcaaacgaaatcggcaaagctgagatggctctgtctgtttgtccgggtggtgacatgtattcatgcatgcttgcatgctggtattttttttttttttttaatattattctgttgttggggtactagaaattaggtgggatgacaaattccgctataatatatggtaatttgtccaatttatgtcttatttattgttaattataac

SEQ ID NO: 1884 - DNA, 1728 bp, Quercus alba
atccaatcactttttattgtctttacttggattcgattagattggattggtcttttatagtatagtgtctctgtctctgtctctgtctctctctcactcacccactctctctccataatccatattcttgttctcaagtttgtgtcatcaaccaacatcctccctcctaactggtaacccaacacaaatctgatctctctctgcctctgcctctgggtccaagatgagctccttggctgcaaaagatgactgccttgcatgggcagcaagagacccatctggagttttatcaccttacaacttcagccgcagggctgttggcagtgatgatgtttcattaaaaattacacactgtggaatttgttatgctgatttaatttggaccaggaattttcatggggattcaaagtatcctgtagtgcctggacatgagatagcaggaatcgtgaaagaggttggttccaatgttcaccacttcaaagttggtgaccatgttggagtgggtacctatgtcaactcatgcagaagttgtgagtattgtaatgatggacaagaagttcattgtgtaaaaggatcagtttacacctttaatgctgtggacgcggatggtagcattaccaaaggaggatattccagttacattgtagtccatgaaaggtactgcttcaggatacctgaaaactatccattggcttcagcagctcctttgctttgtgctggaattactgtgtactctcccatggtgcgtcacaaaatgaaccaacctggtaaatctctaggagtgattgggcttggaggtcttggtcacatggcagtgaagtttggaaaggcttttgggttgaacgtaacaattttcagcactagcgtatccaagaaagaggaagccctgagtttgcttggtgcaaacagatttgtggtctcatctgaccaagagcaaatgaaggccctggctaagtcatttgactttataattgacacagcatctggtgatcacccatttgatccctacatgtcactgttgaagactgctggtgttctagtcttggtggggttcccaagtgaagtcaaattcagccctggaagccttaatataggtaataaaaccatttctggtagcgtaacaggtggtacaaaggtgacccaagaaatgatagacttctgcgctgctcacaaaatttacccaaacatagaagtaattccaattcagtatgcaaatgaagctcttgagagactaataaagaaagatgtgaagtaccgttttgtgattgatattgagaactccttgaaatgacactgctaaagaaaccaggaattcctcctctcaaaagcatacagtgattggcaattgttcttttttggatggtgggcatttaattctattaacaagcatttggtgttgctcttctgcatcatacaatagcctgaaataagtgaataggtctttgagtggttttgtgagaaatggctttataaagacttttgtgtcattttcttaggtctttgaatggtgttgtgagaaatgaattagtaaaagttcgaagtatggacttttaaactgttgtgtttttgtgtcctcgtcttgtggctgcgcagcaggctctacttgtagggaatatgtcattttgtttgggagttctttattttattttgtttcccggagaccaaactgaaaaatccctcacccagaatatctttgtttaacactcataacgctaaagatttgttcag

SEQ ID NO: 1885 - DNA, 1436 bp, Trigonella foenum-graecum
ggataacaacattcttaatttatccgatagactatagagagatagtgacataactgactcagcaaacaaaacagtgattcaattcattatcacaattttcacataccctcttccttcaatggcggatcagaaccaaaaagcagagatctttgaactcaacaatggcaccatgcagctccttgttaccaatcttggttgcactatcacctccttctctgttcctggcaaagatggtgtgttatccgatgttgttcttggccttgattctatcgaatcctatcagaaaggtctagctccttattttggctgcattgtgggtcgggttgcgaaccggattcaaaatggaaagtttacgcttgatggtgttgagtattcgttgcctctcaacaaagccccaaacagtcttcatggtggaaatgttgggtttgataagaaggtatgggaggtaattgaatataaaaaaggcgaaactccatcgatcacttttaagtatgacagtcatgatggagaggaaggctatcctggcgacatcactgtcactgcaacttacacgctcacctcaagcactactatgaggctcgacatggaaggagtgtcaaagaacaagccaaccatcattaacttagctcagcatacctattggaacttagctggccatagctcaggggatatactcaaccattcaattaagataccggctaatcatataactcccgtcgatcagcacactgtgccaaccggtgaaatcacgcccgtgaagggtacaccttttgatttcacatctgagaagagaataggtgataccattaatcaagttggaatgggatatgaccacaattacgtgcttgattgtggcgaagagaaagccggtttaaggcatgctgcaaaagttagggatccatcaagttcaagggtacttaacttatggacaaatgcacctggtatgcaattttatactgcaaattatgtcgacaatgtagctggaaaaggaggcgctgtatatggaaagcatgccgcattatgtctagagacacaaggattccctgatgcggtaaacaaaccgaattttccatccgttgttgttaaacctggtgagaagtatcagcattctatgttgtttgagttttcgattgaatgaatattgttggagagttggagtgattactgaaataaataaggtagacttgttctgcttaatattagggtttagaacttgaactctagttgctactagaactgttacttgtgtttaaataatggtctcaagcttttgagagactagttttaagagcatatcatgagctgttttattttataattcctaaatgtaaacatcatactgcaaaataaatggactaaaattcattttctacagaactgtacattgagatgcccaacttataaaataatttgtagatttggctgttgtgaaatgc

SEQ ID NO: 1886 - DNA, 1269 bp, Arachis hypogaea
acacctcataatctcaattcatgagtacaacaacatcaaaaacaaaaagcgtatattcatttagttacgtcacatccacctagcaactcagtgactcagtgagtgagaccggcgattcaatcaccttcccttacaatggccgatcagaaccagaaacctgagatcttcgagctcaacaatggcaccatggacgtcaaagttaccaacctcggatgcaccatcatctccctctccgttcccggcaaagatggggcgttgtctgacgttgttcttggcctcgattccgttgaatcatatcagaaaggtcttgctccttatttcggctgcattgtgggtcgcgtagcaaaccgaattaaggagggaaagtttacacttgatggggttgagtactctttgcctctcaacaaacccccaaacagtcttcatggaggaaatatagggttcgataagaaggtatgggaggttgttgaatataaaaagggtgaaaccccatcaattacttttaaatatcacagtcatgatggagaggaaggttatcctggggatattactgttactgcaacttacacgctcatttcgggaacaactatgaggcttgacatggaaggagtaccaaaggacaagcccaccataattaacttagctcagcatacctattggaacttggctggccacaactcaggggacgtccttaaccattccattcagatatgggggaatcatgtaaccccagtcgatcagaacactgtgccaaccggtgaaataatgccggtgaagggcaccccatttgattttaccactgagaatagaataggcaacaccattggtcaggttggaatgggatacgaccacaactatgtgcttgattgtggtgacgaaaaagcaggtttgaaacatgctgccaaagtgagggatccctcaagttcaagagtgctaaacttgtggacaaatgcccccggcatgcagttttacacggcaaactatgtcaatggtgttaatggaaaaggaggcgccgtatatggaaagcatgcagggctgtgtttggagactcagggattccctaatgccataaaccagccaaatttcccatgtgttgtggttagacctggtgagaagtaccaacattcaatgttgtttgagttttcaatcgagtaaagtgatgatgtggcattggaatgaggaagacgttttttccttttttctgtttccatgttttggtttggaacttgaacaatggtgtttctcacaataagtaaaatgtgtgtttgt

SEQ ID NO: 1887 - DNA, 1285 bp, Phaseolus coccineus
cttcaattccaatggcggatcagagccccaaaccagagacctttgagctcagcaatggcagcatgaaggttctcctcaccaatctcggatgcaccatcatctccttatctgttcccggaaaagatggggtgttatccgacgtcgttcttggcctcgattctgttgaatcctatcagaaaggtcttgctccttattttggctgcattgtgggtcgggttgccaaccgaatcaaggatggcaaatttacacttgatggagttcagtactctttgcctctgaacaaacccccaaacagtctccatggtggaaatgttgggtttgataagaaggtatgggaggtagttgaacataaaaagggcgaaaccccctcaattactttcaagtatcacagtcacgatggagaggaaggttatcctggggatatcaccattacagccacttacacactcacctcaagcacaactctgaggcttgacatggaaggagtgccaaaggacaaacccaccatagttaatttggctcagcatacctactggaacttagctggtcacaactcagggaacattcttgaccattcaattcagatatgggctaatcatgtcattcctgtggaccagaatactgtgccaactggtgaaataatgtcagtgaaggataccccttttgattttacatctgagaatagaataggcaacaacattagtgaggttggattgggatatgaccacaattatgtgcttgattgtggagaagagaaagatggtttgaggcatgctgcaaaagtgagggatccatcaagttcaagagtacttaacttatggacaaatgcccctggtgtgcaattttacactgcaaactatgttaatggtgttcaaggaaaaggaggggccatatatggaaagcatgcagggttatgtctggagacacaaggattccctaatgccataaaccagccaaattttccatctgttgtggttcgtccaggtgagaagtatgaacacaccatgttgtttgagttttcacttgagtgatgttgttggagtggcttagcagtgaggtagaagacatcttgtattgcatattatgatttacaacctgaactttgccttctaaaattatcactttttgcttcaaataattatcactgtcccaagtttgaattctccattataagctgtgctgttttgcgctcctaaatgtagcattatgtagcaaaatgtttgtaattggaagttgtgaattttgtgtatgttgaacttttaataaagacgagtttttaacattg

SEQ ID NO: 1888 - DNA, 1274 bp, Glycine max
acactattcattaggattagttagttctcctgttgttgttgtagcgctgattgaggtagcgctgattcgatcgcatcagaacattcattcacattcatatcctctctctccgatcccaatggcggatgagagccccaaaccagagaccttcgaactcaacaatggaagcatgcaggtcctcctcaccaatctcggctgcaccatcatctccttatccgtacctggaaaagatggtgtgttatctgacgttgttcttggccttgaatctgttgaatcctatcagaaaggtcttgctccttattttggctgcattgtgggtcgagttgctaaccgaattaaggatggcaagtttacacttgatgggattcattactctttgcctatcaacaatccaccaaacagtctccatggtggaaatgttgggtttgataagaaggtatgggaggtagttgaacataagaaaggcgaaaccccctcaatcacttttaagtgccacagtcatgatggagaggaaggttatcctggggatatcactgttactgccacttacacactcacctcaagcacaactctgaggcttgacatggaaggagtgccaaagggcaagcccaccatagttaacttagctcagcatacctactggaacttagctggccacaactcagggaatatacttgaccattcaattcagttatgggctaatcatatcacacctgtgaacgagaataccgtgccaaccggtgaaatcatgccagtgaagggtaccccttttgattttacatcttttaatagaataggcagcaccattagtcaggttggactgggatatgatcacaattatgtgcttgattgtggggaagagaaagagggtttgagacatgctgcaaaagtgagggatccatcaagttcaagagtacttaacttgtggacaaatgcccctggtgtgcaattttacactgcaaactatgtgaatggtgttcaaggaaaaggaggtgctatatatggaaagcatgctgggttatgtctcgagacacagggattccctaatgccataaaccagccaaattttccttctgttgtggttcgtccgggcgagaagtatcaacataccatgttgtttgagttttcacttgagtgatgtttgttggagtggcatagcaatcaggtagacatcttgatctgcatattatgatttagaacctgaacttagtaggcttctcctgaaataaacacttgtttgtgttcaaataattgaatgatcatttcattgtctc

SEQ ID NO: 1889 - DNA, 1243 bp, Glycine max
acacaggagggaggtgagggactgatgactgagatagcggtgattcaattgcatcatcacaatcacaacattgcttattgacattcatatcctctcattctctctctttttctttctcttcaattccaaacctatggcggatcagagccccaaaccagagaccttcgaactcaacaatggcagcatgcaagtcctcctcagcaatctcggctgcaccatcatctccttatccgtacccggaaaagatggattgttatccgacatcgttcttggcctagaatctgttgaatcctatcagaaaggtctcgctccttattttggttgcattgtgggcagggttgcaaaccgaattaaggatggcaagtttacacttgacgggattcaatactctttgccaatcaacaaacccccaaacagtctccatggtggaaatgttgggtttgataagaaggtatgggaggtagttgaatataaaaaaggaaataccccctcaatcacttttaggtgccacagtcatgatggagaggaaggttatcctggggatgtcaccgttactgcaacttacacgctcacctcaagcacaactctgaggcttgacatggaaggtgtgccgaaggacaagcccaccatagttaacttagctcagcatacctactggaacttagctggtcacaactcagggaatatacttgaccattcaattcagctatgggctaatcatatcactcctgtcgacgagaatacagtgccaaccggtaaaatcatgccagtgaagggtaccccttttgattttacgtctgagaatagaataggcaacaccattagtcaggttggactgggatatgaccacaattatgtgcttgattgtggggaagagaaagagggtttgagacacgctgcaaaagtgagggatccatcaagttcaagagtacttaacttgtggacaaatgctcctggtgtccaattttacactgcaaactatgttaatggtgttcaaggaaaaggaggtgctatatatggaaagcatgccgggttatgtctggagacacaaggattccctaatgccataaaccagccaaattttccatctgttgtggttcgtccgggtgagaagtatcaacataccatgttgtttgagttttcccttgagtgatgtttgttggagtggcataacaatggggtagacatcttgttgtgcatattatgtttgcgttcaaataattgaatgaccatttcattgtcc

SEQ ID NO: 1890 - DNA, 1263 bp, Vigna unguiculata
ctctctctcttcaattccaatggcggatcagagccccaaaccagagaccttcgagctcagcaatggcagcatgaagattctcctcaccaatctcggatgcaccatcatctccttatctgttcccggaaaagatggtgtgttatccgacgtcgttcttggcctcgactctgttgaatcctatcagaaaggtctttctccatattttggctgcattgtgggtcgggttgcaaaccgaatcaaggatggcaagtttacacttgacggggttcagtactctttgcctctgaacaaacctccaaacagtctccatggtggaaatgttgggtttgataagagggtatgggaggtagttgagcataaaaaaggagaaaccccttcaatcacttttaagtatcacagtcaagatggagaagaaggttatcctggggatatcacttttacagccacttacacactcacctcaaacacaactctgaggcttgacatggaaggaataccaaaggacaaacccaccatagttaacttagctcagcatacctattggaacttagctggtcacaactcagggaatgtacttgaccattcaattcagatatgggctaatcatttaactccggtagatgagaataccgtgccgaccggtgaaatcaagccagtgaagggcaccccttttgattttacatctgagaaaagaatagggaacaatatcagtgaggttggattgggatatgaccacaattttgtgctggattgtggagaagagaaagatggtttgaggcatgttgcaaaagttagggatccatcaagttcaagagtacttaacttgtggacaagtgcacctggtgtgcaattttacactggaaactatgttaatggtgttgtaggaaaaggaggtgctgtatatgaaaaacatgcagggttatgtctggagacacagggattccctaatgccataaaccagccaaattttccatctgttgtggttcgtccgggggagaagtatcaacacacaatgttgtatgagttttcagttgagtgatgttgtctgagtggcatagcaatgaggtagacatcttgtttgcatattctggtttagaacctgttttttggcttctgaaattatcagttgtttgcgttcaaataattatcaattatctcaagtttgagtttttcataataaactatggtgttttactctcctcctaaatataggtgagacataaaccttcttttggtcaatacactggatttttctttttctcg

SEQ ID NO: 1891 - DNA, 1228 bp, Vigna unguiculata
  misc_feature (890)..(890): n is a, c, g, or t
  misc_feature (948)..(948): n is a, c, g, or t
  misc_feature (1126)..(1126): n is a, c, g, or t
  misc_feature (1161)..(1161): n is a, c, g, or t
  misc_feature (1204)..(1204): n is a, c, g, or t
ggacactgtgaacgtggctatagtggagttgagagagagaaagcatgaaaatttgtagtgggttttagtttaggagttgggtttagaatcttgtttggaattgggagagtgtgcgtgtgtgtgagagagagttatgtacatagcttccatgggaaggtctttcaaggactctttgaaactgcttgaagctgatattcaccatgccaataccctcgcatcagattttccaagggaatatgacggtgcatgccttcagatgagaatgtcatacagtatggcagcacacctatttctctttttggtacaatggacagattgcaatcttgcaggggccctaggattgttaagaatcctaatatacaaggtttatgtagatgggacaactaccatgtctacccatgaaaggaaagcaagtattagagaattctatgcggtcatatatccctcattgttgcaactccaaaaaggtgtaactgatacagaggataaaaaacagaaggctgtatgcttggagaggtatcggaaaagagacgaagaggagcacagacagccttcggatatagacattgaaagggaagaagaatgtggaatatgcatggagatgaacagtaagattgtgttacccgactgcaaccatgtcatgtgcctgaaatgttaccacgaatggagaacaagatcacagtcatgccccttttgccgcgacagtctgaagagagtaaactcaggcgatctctgggtgttcactgatggtagggatgttgtagacatggcaacagtgacaagagagaatctgagaaggcttttcatgtacatagataagttgcctttgatcattccagactctctttttgacacttatgactctcatctaagatgagtgattttactcncagtctggtgttggaggggcagttcctttcaatttagtaacataaactccgaatgtcnttcggtaaatttagtttatagagtcgcagtgttgcttcccacgtctttgcgaaaaagtttccaaccctgagtatactgtgggttggtggtgaagtgaaggtgagtatgttgctcatttgtctttgtatatcctgtacagattgaattgcttgttcagaagaggtctgtttccatattntgtgtctcagaagagtacatttttcatggatcccncctaaaatgcctatgtagctttgaatggagcaaaatgagtatntataatgtgtttcaattctcttca

SEQ ID NO: 1892 - DNA, 1198 bp, Vitis vinifera
actcggaccaaacccactccttggagagagagaaaaagcgagggttttggggcggtgaattagggttttcttgtttgaagtggggcgatcgattgatggtggtggttgtgtgtttcgttttgtgattgtttcttgagaaagtttggggagatatagagagagaccgtggggggagatgtacatagcttccatgcgaaaatctttcaaggattctctcaaagtgcttgaagccgatcttcagcacgccaatactctggcgtcggatttccctagggagtatgatggtgcctgccttcagatgagaatgtcatacagtccagctgcacacctgtttcttttcctagtgcaatggactgactgccaccttgctggtgctcttggactattaaggatcctaatttacaaggtttatgtggatggcacgacgaccatgtccactcatgaaagaaaagcaagtattagagagttttatgctgtaatttatccctctttactgcaactagaaagaggtcttaccgatacagaagataagaagcaaaaggcagtgtgcatggaaaggtacagaagaagagatgatgaggaacataagcaatattcagacgtggacattgaacgagaagaagagtgtggtatttgcatggagatgaatagtaagattgttttgcccaattgcaaccatgccatgtgcttgaaatgctaccgagaatggcgatcgagatcacagtcgtgccccttctgtcgtgacagtcttaagagagtgaattctggtgatctctgggtattcacagacagcagggacataattgacatggttacagtcactagggagaatctcagaaggcttttcatgtacatagacaagttgcctctgatcattcctgattccctttttgaccagtatgattctcatctaagataggtgattagtacacagcctgagcccactgtctcatgtgtttttcaatgagtctgtagttctctgtctgctttaattttacataaggaccgagattgattggttcggtcgatctagatttagttacaactgttatgctttcttcccgcttctgagaaaaggaagaagcaaaggcctgagttattgtgggcagggaggtgaaggtagtggtctatttagaaggtttatgaattgtaagagaatttgtacatgtttgtacagtttgaaagtttgcccatgaaa

SEQ ID NO: 1893 - DNA, 1766 bp, Glycine max
aacaacgaacataatcgaaatatcaaaaactataaatgttttgttttcttgtttatactatctactcttaaagaaaaggacaatcgcgaccagatattaaaaagacatagacgccgattgcgaccttttcaaacatataaacttacaaaaatgccctaaagaaagttgaaaaataacgagtttttatttaagggtgagagatgtacatagcttccatgggaaggtctttcaaggactccttgaaactgcttgaagctgatattcaccatgccaataccctggcgtcagattttccaagggaatatgatggtgcgtgccttcagatgagaatgtcatatagtccagcagcacacctgtttctctttttggtgcaatggacagactgcaatcttgccggagcccttggactgttaagaatcctaatatacaaggtgtatgcggatgggacaactaccatgtctacccatgaaagaaaagcaagtatcagggaattctatgcggtcatatatccctctttattgcaactgcaaaaaggtgtaacagatacagaggatacaaaacagaaggctgtatgcatggagaggtatcgcaagagagatgatgaggagcacagacaaccttcagacatagacattgaaagagaagaagaatgtggaatatgcatggagatgaatagtaagattgtgttgcccgactgcaaccatgtcatgtgcctgaaatgttatcacgaatggaggacaagatcacaatcatgccctttttgccgcgacaatcttaagagagtaaactcgggtgatctctgggtgttcactgacaatagggatgtagtagacatggcaacagtgacaagggagaatcttagaaggcttttcatgtacatagataagttgcctttggtcattccagactttctctttgacacatatgactctcacctaagatgagtggttgcaacagacagattttactgtctggtgtgtggtcttggaggggtggttcctttctatttagtaacgtaaactccgaatgcaatttggtaaatttagtttatatagagttgtattgttgcttcccacgtcttccagaagtatccagccctgtgtttactgtgggttggtggtgaagttgagatggatgatggagaaattgaaggggatgtgaatcatcgcattcaagcaggatggatgaaatggagaaaagcatcgggagtgttatgtgatgcaaaggtaccgatcaagctaaaggaaaagttttatcggactgcggtaagaccggcgattttgtacggaacagaatgttgggcggtcaagagccaacatgagactaaagtaggtgtagcggagatgaggatgttgcggtggatgtgtggtaagactcgacaggataaaacatgtagagagaagactggtagactctgtagtgaggagagtagagtagaccagatggagagaaggcaaacaattcgaggaagacccaaaaagactataagagaggttatcaagaaggatcttgaacttaatgatttggatagaagtatggtacatgatagaacattatggcggaagttgatccatgtagccaaccccacctagtgggataaggcgttgttgttgttgttgctgttgtattcaacccaaaacttgaatttacctcactgaaaaacttattttcatagtagtttctccgagtaagtcagatagtgtttttctttatcactcctagtctcaagtaagaattttttttcttaagaaagacattgaaattaa

SEQ ID NO: 1894 - DNA, 1107 bp, Euphorbia peplus
tgacgaaggagcagcaggaggagcttctgtttcaggtggttcggttttgcggtggttatcggagcgacgggaagattaatcggttgttccgattagatagttgaaggagatgtatgtgtcttctatgcgaaagtcattcaaagactctctcaaagttcttgaagctgatattcaacatgctaatactctggcatcagattttccaagggagtatgatggagcctgtcttcagatgagaatgtcatatagtccagctgctcatctgtttctttttttagtacagtggacggactgcaatcttgctggggcgcttggactgctaagaatcctaatttataaggtatatgtggatggtacgaccaccatgtctactcatgaaagaaaagcaagcattagggagttctatgctgttatttatccctctttattgcaacttgaaagaggggtcactgatactgaagataaaaaacagaaggtagtctgcatggaaagataccgaagaagagatgatgagggaaataagcaacattcagatgtggacatggaaagagaagaggagtgtggcatatgtatggagatgaatagtaaaattgtactgcctaactgcaaccatgccatgtgcctgaaatgttaccgtgaatggaggacaagatcacagtcatgccccttctgccgagacagtctgaagagagtgaactcagctgatctctgggtatttactgatagccgggacatagtggatatggcgacagtggcgagggagaatcttagaagattatttatatatatagataagctgccactgataattccagaatctctttttgacacatatgattctcatattaggtagaggttccaaataacagtccaaaaatctccttcgcaaagtggtatgttgatccgaaaagtaaaagtcaagggttattaattgggtagatttatgtcttgttctgtttcgtttcattacctaaagtcactgaagattgattttgatttggcataaacttatgtcaaatcgagagatgattcagtgcggggttttcttcttcttcccgcttcttatcggaagaatccaactaagattattagtgaatgagttggtag

SEQ ID NO: 1895 - DNA, 1259 bp, Vitis vinifera
tttcttgtttgaagtggggcgatcgattgatggtggtggttgtgtgtttcgttttgtgattgtttcttgagaaagtttggggagatatagagagagaccgtggggggagatgtacatagcttccatgcgaaaatctttcaaggattctctcaaagtgcttgaagccgatcttcagcacgccaatactctggcgtcggatttccctagggagtatgatggtgcctgccttcagatgagaatgtcatacagtccagctgcacacctgtttcttttcctagtgcaatggactgactgccaccttgctggtgctcttggactattaaggatcctaatttacaaggtttatgtggatggcacaacgaccatgtccactcatgaaagaaaagcaagtattagagagttttatgctgtaatttatccctctttactgcaactagaaagaggtcttaccgatacagaagataagaagcaaaaggcagtgtgcatggaaaggtacagaagaagagatgatgaggaacataagcaatattcagacgtggacattgaacgagaagaagagtgtggtatttgcatggagatgaatagtaagattgttttgcccaattgcaaccatgccatgtgcttgaaatgctaccgagaatggcgatcgagatcacagtcgtgccccttctgtcgtgacagtcttaagagagtgaattctggtgatctctgggtattcacagacagcagggacataattgacatggttacagtcactagggagaatctcagaaggcttttcatgtacatagacaagttgcctctgatcattcctgattccctttttgaccagtatgattctcatctaagataggtgattagtacacagcctgagcccactgtctcatgtgtttttcaatgagtctgtagttctctgtctgctttaattttacataaggaccgagattgattggttcggtcgatctagatttagttacaactgttctgctttcttcccgcttctgagaaggaagaagcaaaggcctgagttattgtgggcagggaggtgaaggtagtggtctatttagaaggtttatgaattgtaagagaatttgtacatgtttgtacagtttgaaagtttgcccatgaaatgtctctccaagcttagaaagaaagccccttttctctttctctgcagcaggcgggttgcttcctagttgaagctaccatgtaagaaaatgagacatttaccagatggtttcagtgataaatggttggct

SEQ ID NO: 1896 - DNA, 1091 bp, Phaseolus coccineus
gtggctatagtagaggtgagagagagaaagcacgaaaatttatagtgggttttggtttagcagtggggtttagaatcttgtttggaactgggagtgtgtgtgagtgtgtgtgtgagagagagatatgtacatagcttccatgggaaggtctttcaaggactctttgaaactgcttgaagctgatattcaccatgccaataccctggcatcagattttccaagggaatatgatggtgcatgctttcagatgagaatgtcatacagtatggcagcacacctatttatctttttggtgcaatggacagattgcaatcttgccggagccctaggactgttaagaatcctaatatacaaggtgtatgtagatgggacaactaccatgtctacctatgaaaggaaagcaagtattagagaattctatgcggtcatatatccctctttgttgcaactgcaaaaaggtgtaacagatacagaggataaaaaacagaaggctgtatgctcggagaggtatcggaaaagagacgaagaggagcacagacagctttcggttatagatattgaaagggaagaagaatgttgaatatgcatggaaatgaacagtaagattgtgttacccgactgcaaccatgttatgtgcctgaaatgttaccacgaatgtagaacaagatcacagtcatgccccttttgccgcgacagtctcaagagagtaaactcaggtgatctgtgggtgttcactgatggtagggatgttgtagacatgacaacagtgacaagggagaatcttaaaagacttttcatgtacatagataagttgcctttgatcattccagactctctttttgacccttatgactctcatctaaaaatgactggttttactcactgtctggtgttggagggacagttcctttcaatttagtaacataaactccgaatgtcattcggtaaatttagtttatagagtcgtagtgttgcttcccacgtcttgcaaaaaagtttccaaccctgagtttactgtgggttggtggtgaaggtgagagtatgtatatcatgtacagattgaattactgattaacaagaggtttgtttcc

SEQ ID NO: 1897 - DNA, 1278 bp, Lotus japonicus
ggaacctgctatttcataacacagagacaaaaaagtatcaaactttgttgtgggttttagattgttgtttggtttttgattgaaaagttttgtcgtttgagactccgagttagagagaaactactagtattattatgtacatagcttcttcttcttcttcttccatgggaaggtctttcaaggaatccctcaaacttcttgaagctgatatccaccatgccaataccctggcctcggattttccgagggaatatgatggtgcgtgccttcagatgagaatgtcatacagtccagcagcacgcctgtttctttttttggtgcaatggacagactgcaatcttgccggagctcttggactgttgagaatcctaatttacaaggtgtatgtggacgggacaactaccatgtctgtccatgaaagaaaagcaagtattagggaattctatgggttcatatatccctctttattgcaacttcaaaagggtgtcactgatacagaggataaaaaacagaaggctgtttgcatggaaaggtatcgaagaagagatgatgaggaggatagacagtcttcagacatagacattgaaagagaagaagaatgtggaatatgcatggaaatgaatagtaagattgttttgccagactgcaaccacgccatgtgcctgaaatgttaccatgaatggagaacaagatcacagtcatgccccttttgccgagacagtcttgagagtgtgaactcaggtgatctgtgggtattaactgatagtagggatgtggtagacatggcaacagtgacaagggagaatattagaagacttttcatgtacatagataagttgcctctgatcattccagattccctttttgatacatatgactctcacctaagataagtgattgcgacagacacattttgctgttctggtgtgatcttggatgggtagtagtcttcaatttagtcacataaacttgtgattcggtaaatttagtgcatgtttggtttcacgatttgcacagaatccaacgcacacttactgagaactgagaagctaagacaaagcttctaacctataacatttcatcgtggaaccaacatgttatttagagttgcagtgcttgcttccctggtcttcgtgaagtatccagcggccctaagtttactattgtctgttagttaagttgagatggtaaattgtatgtagctcatgtgtatatcctgtacagattaaattacttattaagaagaggtttgcatattctgtgcctctctgataattg

SEQ ID NO: 1898 - DNA, 1398 bp, Glycine max
tctcttctctcttcactatgtgtgactctctctctcacacaaactagagcgagaaatattatagtagctctgcgtttttggggtatcattattcaaccacccattttctctcttcttcttcttccattgagaaaattctctttcatcgtgtgtgatcggtgagatgtacgtagcttccatgcgcaagtctttcaaggactccttgaaagtccttgaagctgatatccagcacgccaataccctggcttcagattttccaagggagtatgatggtgcatgccttcagatgagaatgtcatacagtccagctgcacacctgtttcttttcttggtgcaatggacagattgtcatcttgctggagcccttggactgttaagaatcctaatttacaaggtctatgtggatgggacaaccaccatgtctacacatgaaagaaaagcaagtattagagaattctatgctgtcatatatccctctttattgcaacttgaaaaaggtgtcactgataccgaggataagaagcaaaaggttgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcttgaaatgttacagagaatggcgaacgatatcacaatcatgcccattttgccgtgacagtctcaagagagtaaactcaggcgatctctgggtattcactgatagaagggatgtggtagacatggcaacagtgactagggagaatctcagaaggcttttcatgtacatagataagttgcctctgattgttcctgactccctttttgacacatacgactctcacataaggtaagtgattgcaacagaacagattttaatgtatgctgttgtcttggatggatagagctatattcctctccacttccaagttagtcacataaaagcccaagcccaaacccaatcagaggctaattgagttcgaattatatatagagtcgcagtacttgcttcccacttttgctgccagaagtatccagccctgtgttaattgtgggttggtggtgaagttgagatggtaaattgtatctatctagttagctcttttgtatatccctgtacagatcgaattaatcacttcttattaacaagagatttgcacatttggttcttgtcatttaagtgtgaatctcttgaggaaaaaaaaatcttttacttttcatcatcaatgaatgtatttaacggaatgtaatagcctcataggtgctttttctatgtagtatctatctgtattcgctatatttcctcaaggtcctcttaatagtaactactattatgttttatatt

SEQ ID NO: 1899 - DNA, 1371 bp, Trigonella foenum-graecum
atacaatacaatacaatactagtgagagaaactactagagcgagaataaccaccacaaaacacactacaggtacagggttcttcttcttctttttttgtttggtgagagagaaagagatatgtacgtgggttcttccatgcgcaagtctttcaaggattccttaaaactccttgaagctgatatccaacacgccaatactctggcctcggattttccaagggagtatgatggtgcaagtcttcagatgagaatgtcatacagtccagctgcacacttgttctttttttgttcaatggactgattgccatcttgctggtgctcttggattgttgagaatccttatctacaaggtgtatgtggatggaacaaccaccatgtctacccatgaaagaaaagcaagtataagggaattctatgctgtcatttatccctctttattgcaacttgagaagggtgtcactgattctgaggataaaaagcagaaggctgcatgtatggagaggtatcgtagaagagatgatgaggattgtaggcaatcttctgacattgacattgaaagagaagatgaatgtgggatatgcatggagatgaatagtaaaattgtgctgcctaactgtaatcatgctatgtgcctcaaatgttaccgagaatggcgaacaagatcacagtcgtgcccattttgccgtgacagtctgaagagagtgaactcgggggatctctgggtatacactgatagaagggatgtggttgatatggcaacggtgacaagggagaatctcagaaggcttttcatgtacatagataagttgcctttgattgttccagactccctctttgacacgtatgactctcacataaggtaagtgattgcaacatacagattttaatgtatgctgttgtcttgagtggatagttgttactcgctctcagtgcgaagttagtcatatgaagtctgaacctgattcggaaaatttagtatatgttatatctgtagagttgcagttcttgcttcccactttaccaaaagtatccaaccctttgttattgtgggttggtggtgaagttgagatggtaaatttgtatctagctagcacatatgtatatccctgtacagattgaattacttaacaagagatttgcacaatatcctcctgtcgagttacttggattgtatctttggatttaactgtgtatggaaatgtaaattgttttccatttcagcctttttacaactatttgatgaatgtatgtattgatgtatagagtattttaattactaatattagagataaatatattacttagaaaaaaaaaaagaagactaaaattagagagaaaatatttgagagaagttagtaaatttagtaaga

SEQ ID NO: 1900 - DNA, 1454 bp, Carica papaya
accaccaagaaccaatgcccaccaaacccatctctgaatgagagagaaagagagtgagggttgtagttgctgagcaaaattagggtttttgggtactgaaaaatcttcctttttttggggatcaaactccttggactgagtttctttggggtttccttttctgggttgcaatttttttctttttttgttgttgaaaaaatttgtttttttttttttttgtttttttggagatgtacataggttctatgcgaaagtcattcaaggactccttgaaagtgcttgaagctgatattcagcatgctaatactctggcatctgattttccgagggactatgatggtgcctgcctccaaatgagaatgtcatacagtccagctgcacacttgttcctctttttagtgcagtggacagactgccatctcgctggagctcttgggctgttaagaatattaatttacaaggtttatgtcgatggcacaacaaccatgtctacccacgaaagaaaagcaagtattagagagttctatgccgttatttatccctccttactgcaacttcaaaaaggtgttactgatactgaagataagaagcagaaagcagtatgcatggaaaggtaccgaagaagagatgaagaggagcacagactacagacagatgcagatattgaaagagaggaagaatgtggaatatgtatggagatgaatagtaagattgtattgccgaattgcaaccatgccatgtgcctgaaatgttaccgtgaatggcgaacaagatcacagtcctgtcccttttgtcgcgacagtcttaaaagagtgaattctggtgatttgtgggtatatacagacagcagggatgtggtcgacatggcaacagtgacaagggagaatttcagaaggctgttcttgtatgtagataagctgccactgatcgttcccgacaacctttttgacccgtacgattcccacttaagatagttgacacgaacagaccaaagatcactatctcctctggcctctaacaagtgaattccggttgcataaagacgagatgttttattcgatgaaactaggttagtttgcatttgcagtggttgcttcccacttctgatacgaagaaaccggcctaagtagttgctatggtctggtgggagaagtcgaaatagtttgatattccaagaggttgataaaaattgtatttagcacatttgtacatgctttgtatagccctctcctattgttccatcacaaaaagatgtcttctaactctgtttgtatcttgggttgtgaacctcttttatcagagatgaatcagttagtctctgcatctggtgttatccaggtctatatatataatggagaatttgcataggagtcagaaattagcttctcaatatgaagagtttttttatgcagaaaataaaatggacaagaaattatatgcattaaatttgttta

SEQ ID NO: 1901 - DNA, 1443 bp, Glycine max
cggcatagaagcaacacgaagcactctctttctctctcttcactgtgtgactctctctcacacacaaactagagcgagaaatattatagctcagggttttggggtatcattattcaaccatcaaccattttctctcttcttcttctctagtgagaaatttctctttcattgtgtgtggtcagtgagatgtatgtagcttccatgcgcaagtctttcaaggactccttgaaagtccttgaagctgatatccaacacgccaataccctggcctcagattttccaagggagtatgatggtgcatgccttcagatgagaatgtcatacagtccagctgcacacctgttccttttcttggtacagtggacagattgccatcttgctggagcccttggactgttaagaatcctaatttacaaggtctatgtggatgggacaaccaccatgtctacacatgaacgaaaagcaagtattagagaattctatgcggtcatttatccctctttgttgcaacttgaaaaaggtgtaactgatactgaggataagaagcaaaaggctgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcctgaaatgttaccgagaatggcgaacaatatcacaatcatgcccattttgccgcgacagtctgaagagagtgaactcaggtgatctctgggtattcaccgatagaagggatgtggtagacatggcaacagtgacaagggagaatctcagaaggcttttcatgtacatagataagttgcctctgattgttccagactccctttttgacacatatgactctcacataaggtaagtgattgcaacagaacagattttaatgcatgctgttgtcttggattgatagagctataatcccttccacttaaagttagtcacataaaaacccgaacccgagtcggctaattgagttcgtactatatatagagttgcagtacttgcttcccacttctgctgccagaagtatccagccctgtgttaattgtgggttggtggtgaagttgagatggtaaattgtatctatctagctagctcatttgtatatccctgtacagatcgaattaattacttcttattaacaagagatttgcacatttggttcttgtcatttaagtgtgaatctcttgagaaaaaaacttttacttttcttcatcaatgaatgtatttaacagaatatattagcctcggaggtgcttttcctatgtagtgtgtttagtatctgtattcgctatatttccttaaggtcctcttaattgtaactactattatgttttatattatttaagcactgtagtctatagtactgttt

SEQ ID NO: 1902 - DNA, 3487 bp, Ricinus communis
cccccttttctttctctttctattctatcggcttcgctttcatgagaatagaagcaaagcacctcctgcaaaacactaaattaaatttgaaaatctaaagcttattttatgagagagagtgactttgggtttttgggtttgagggtgtgtgcttggagaatttttattgtgtgatttgagggtttgttgaggaggagatgtacgtagcttctatgagaaagtcattcaaagactccctcaaagttcttgaagctgatattcaacatgctaatactctggcttcagattttccaagagattatgatggtgcctgccttcagatgagaatgtcatatagtccagctgcccacctgttcctttttctagttcagtggacagactgccaccttgcaggtgcccttggattgttgagaatcctaatttataaggtatatgtggatggcacaaccaccatgtctactcatgaaagaaaagcaagtataagggagttctatgcggttatttatccctctttattacagcttcaaagaggggtcactgatacagaagacaagaaacagaaagcagtatgtttggaaaggtaccgaagaagagatgaggaagaacataggcttcgaacagatgtagatattgaaagagaagaggagtgtggaatatgcatggagatgaatagtaagattgtattgccaaactgcaaccatgccctgtgtttgaaatgttaccatgaatggaggtcaagatcacagtcatgtcctttctgccgggacagtcttaaaagagtgaactctggagacctgtgggtgttcacagacagtagggatgtagtggacacggcaacagtgacaagggagaatcttagaaggctattcatgtacatagataagctgccactgattgttccggattccctttttgacacatatgattcgcaccttagataggcggcgcaaaaactaaactaaactgtctgattatctccatctccaatggtgtttggatgagcagtacccatctcgcaaaagtttaaagaaaaggggagttgctttgcatgagtagtttttctttcttttgtttacataacataaaagaattcactgaaactgatttggccaaaaaggaaaaggagattgaggccgaaatttaaggaatttcagtggggtagtttcttgccgcatctagttagaagaattccaactagcgatgttaggaagatgaatcggtaaggtcgagagagagagagagagagagatgggtgggggatcggctcataagttgtatttattcagcacatttgtacatcctttcttgtatagcttcgcatttacttgcgacgtgcaatagttaatgcaaaattctcctccgtacgtatcagattcttacagaaatctcctggcggacggacattgtgcttcaggaatctcgtattgtaattcctgatacgatactttaaagtagtttcattctccgtaattgatggctgtgcgcaaaagccaagcaatttgttgagatggtaaggaaagctacttggtttctttttcacttgtgctgagctgggcccaattttcaggaaatctactatctgaatatgtgacagcccaaatatgaagatgaatggcccaagcttgaacaaaaaaagaaaatgaaattggaagaagtgggacctagtggcacgttaggactgtgatgaaaatgggaagaaagatataataaaacaacaaggcacaacctgtcaaccctacatcttggcttttgaaaatttgatttttatggtctccctctctccctgcctttcttgtggacgggagcgccagcatgcatcttgtttctgtcgaagaatgaaattgacaacgacgtcgtctttgagacgaacaactcgtactcccttggattagcatgaaaatagacacagctaccaaaggtgatgaaagcggttactgaacacacaatttttgcatacgcataaggacactggatgattctctttcttttttatttttttaaagaaaaaattataaaaaaagtaattttaaataacgaattgctgtgagtatctttttggcctctatttttaagccgcaccgatagttaaggaaaaaccagagaagaaaaagaaaattggattcatgtctgttgaaaaggagaggacaaagtagacgaaaaaaaaaagaaggaattgcaagaaagaaagggaaaagagatgggcaaagggggagagaggcatgtggaggaggaagaagcagaaggagtaatggcaacagacttcttctggtcatatacagatgaacctcatgcttcaagacggcgtcagatcctctctcagtacccccaaattaaacaactcttcggccctgatcctttcgctttctttaaggtttctgttgtggttttgcttcagcttggcacagctgcattacttcatgattctggctggctgaagatactggcaatagcctacttttttggctctttcctcaaccataatcttttcttggccatccatgagctgagccacaaccttgccttctcaactcctgtctataataggtggcttgggatttttgccaaccttcctgttggcgtacccatgtctgtaaccttccagaagtaccaccttgaacaccaccgcttccaaggagtagatggaattgatatggatatcccaagccaaattgaagctcatctagtgaggaatgtcatcacgaaatccatatgggttatcttccaactcttcttctatgctctgaggcctctatttctcaaaccaaagccccctggttattgggaattcatcaacctttttgttcagattgctttggatgtggctatggtttatttttggggctggaaatcttttgcttatctgatcctttccacatttgttggaggtggaatgcatccaatggctgctcattttatctcagaacattacgtcttcaacccggagcaagaaacatattcttattatggccccctgaattttgttacttggcatgtgggataccataatgaacaccatgatttccctaggatccctggaagcaagcttcacaaggtgaaggagattgcaccagaatactatgaaggtttagactcgtataaatcttggagtcaggtcatatacatgtatgttatggacagaacagtcgggccctttagccgaatgaagagaaaggtgtcaactaccacaaagaaatctgaataggggcacatgggatagtctttttgtgtgaagaaaatatggaaaatctatagtctgtaacatttttgaagcattaaattttttgttgtagtcttagactgaaaagatgagttgattgtttattcttccgcttttagtttacttgcttatgtatgcaaattgaacaaaaagacggctgttttctctacttgtctaattgatgttctctgagttcaattttgttcccgtccttggcattaagctttgcttggattataagatttgccttcattttggtaaaatatacta

SEQ ID NO: 1903 - DNA, 1355 bp, Vigna unguiculata
ctcttctctctcctctcttctcttcactctctgtgactcttacagaaactagagtcagaaatatagcccagaagggtttccttcacccaaccaatctctctcttcgtctcttcttccatttcacaaactttttcttttttttttcttgttttttgcggtgtgatcgctgcgatgtacgtagcttccatgcgtaagtctttcaaggactccttgaaagtccttgaagctgacatccagcatgccaacaccctggcgtcagattttccaagggaatatgatggtgcatgccttcagatgagaatgtcatacagtccagcagcgcacttgtttctatttctggtgcaatggacagattgtcatcttgctggggcccttggactgttaagaatcctaatttacaaggtctatgtggatggaacaaccaccatgtctacacatgaaagaaaagcaagtattagagaattctatgcggtcatatatccctctttattgcaacttcagaaaggtatcactgatactgaggataagaagcaaaaggctgtatgcatggagaggtatcgcagaagagatgatgaggattatagacagtcttctgacattgacattgaaagagaagatgagtgtggaatatgcatggacatgaataccaagattgtcttacccaactgcaaccatgccatgtgcctgaaatgttaccgagaatggcgaactatatcacaatcatgcccattttgccgtgacagtctgaagagagtgaactcaggtgatctgtgggtattcactgatagaagggatgtggtagacatggcaacagtgacaagggagaatctgagaaggcttttcatgtacatagataagttgcctttgattgttccagactccctttttgatgcttatgactctcacatacggtaagtgattgcaacagacagattttaatgtatgctgttgttgtcttggatcccttcttccacttgaagttagtgacataaaagccagaacctgaatcggctaattgagttcctattatagagttgcagtacttgcttcccacttctggtgccagaagtatccagcccctgtcatattgtggactggtggtgaagttgagatggtaaattgtatctatctagttagctcatttgtatatccctgtacagatcaaatcaattactcattaacaagagattttcacattcggttcttgtcatttaggtgtgaatctcttgtgaaactcttttagttttcatcatcaatgaatgtatttaacggaatgcctgtaatgtgttctgtagtttatgtatatgcattgtggccatcttataagaacttgctatgtttactttagaccctta

SEQ ID NO: 1904 - DNA, 1099 bp, Heritiera littoralis
gaccgccgcctagaaccacccactctgagtgagagagatacatagagagagagagagagagagccaaagcctggtataaagctagtttggagaaggatattagggttctttggtgggtgattgatcggaatttgtgttttgttctgggtgggggagatgtacgcagcttctatgcgaaagtctttcaaggactctctgaaagtgcttgaagctgatatccaacatgctaatactgtcgcttcagattttccgagggagtatgatggtgcatgccttcaaatgagaatgtcatacagtccggctgcacacctcttcttatttttggtgcagtggactgactgtcaccttgcaggagcccttgggctgttaagaatactaatttacaaggtttatgtggatggaactaccaccatgtctacacatgaaaggaaagcaagcataagagagttctatgctgttatctatccctctttactgcaacttcagagaggtgtcactgatacggaagataaaaacagaaagcagtgtgcatggaaaggtaccgaagaagaaaagatgaagagtataggcagctcactgacgtggattttgaaagagaagaagaatgtggaatatgcatggagatgaacggtaaaattgtgctgccaaactgcaaccatgccatgtgcttgaaatgttactgtgaatggcgttcaagatcacagtcatgccccttctgtcgtgatagtcttaagagagttaactctggcgatctctgggtatatatggacagtagggatataattgacatggccacagtgacgagggagaatcttagaaggcttttcatgtatatagataagttgcccctgattgtccctgattccatttttgatacttatgattcccacctaaggtgataagtacattctaattttctgtgctctgggtattttctacttgttttctcttgattacataaagaccaaattgctcgatttggcaaaattagttcatctagcaccgcagtgcgttcttcacacttctcaccagaagaaaccatgcccgagttattgtgggctgctgctgaagttgaggtagttcatctaggagcccataa

SEQ ID NO: 1905 - DNA, 1263 bp, Manihot esculenta
gaaaataagagaaaatccaattcttgagttagaaaggaggggttttggtagggagggagagagagaatttggggttttttgggtgtgggtgatagagagaggagaatctgattgattgaattttgagtgttgaaggagatgtacatagcttctatgagaaagtccttcaaagactctctcaaagtgcttgaagctgatatccaacatgctaatactatggcgtcagattttccaagggagtatgatggtgcctgtcttcagatgagaatgtcatatagcccagctgctcacctgtttctttttctagttcagtggtcagactgtcacctagcaggcgcccttggactgttgagaatcctaatttacaaggtttatgtagatggcacaactaccatgtctactcatgaaagaaaagcaagtatcagggagttctatgcggttatctatccctctttattgcaacttcaaagtggggtcactgatacagaggataaaaagcagaaggcagcatgcatggagaggttccgaagaagagacgatgaagaacggagacagctttcagaagttgacattgaaagggaagaggagtgtggaatttgcatggagatgaatagtaaaattgtactgcctaattgcaaccatgccatgtgcttgaaatgttaccgtgaatggcgatcaaggtcacagtcgtgccccttctgtcgagatagcctgaagagagtaaactctggagacctgtggatgtttactgatagtagggacatagtggacatggcgacagtgacgagggagaatcttaggaggcttttcatgtacatagataagttgccgctgattgttccagactccctttttgacaattatgattctcaccttagataggtgccaactagaatctgaaatctccatctctcatggtgtttggattattagtattaagctcaaaagaagaaaaaggaaaaaagggaagcgcaaagtttaggtttttttttttttcttttttctttttttctttttttctttttcctcctgttgccattgcataaaaagccgactgaaattgatatgcaaattgcaatttcagtgctttcttcccacttctggttagaagaacccaacttgagttattttcgtgagttggtaggtgaagttgagacttgagatagagaattagagatggggatcataacattgtatctaccacatttgtacattcttgtatagctttcatatttacgtataaaaagctttgcaatttcctct

SEQ ID NO: 1906 - DNA, 759 bp, Ricinus communis
atgtacgtagcttctatgagaaagtcattcaaagactccctcaaagttcttgaagctgatattcaacatgctaatactctggcttcagattttccaagagattatgatggtgcctgccttcagatgagaatgtcatatagtccagctgcccacctgttcctttttctagttcagtggacagactgccaccttgcaggtgcccttggattgttgagaatcctaatttataaggtatatgtggatggcacaaccaccatgtctactcatgaaagaaaagcaagtataagggagttctatgcggttatttatccctctttattacagcttcaaagaggggtcactgatacagaagacaagaaacagaaagcagtatgtttggaaaggtaccgaagaagagatgaggaagaacataggcttcgaacagatgtagatattgaaagagaagaggagtgtggaatatgcatggagatgaatagtaagattgtattgccaaactgcaaccatgccctgtgtttgaaatgttaccatgaatggaggtcaagatcacagtcatgtcctttctgccgggacagtcttaaaagagtgaactctggagacctgtgggtgttcacagacagtagggatgtagtggacacggcaacagtgacaagggagaatcttagaaggctattcatgtacatagataagctgccactgattgttccggattccctttttgacacatatgattcgcaccttagataggcggcgcaaaaacta

SEQ ID NO: 1907 - DNA, 1580 bp, Ricinus communis
gcaaaacactaaattaaatttgaaaatctaaagcttattttatgagagagagtgactttgggtttttgggtttgagggtgtgtgcttggagaatttttattgtgtgatttgagggtttgttgaggaggagatgtacgtagcttctatgagaaagtcattcaaagactccctcaaagttcttgaagctgatattcaacatgctaatactctggcttcagattttccaagagattatgatggtgcctgccttcagatgagaatgtcatatagtccagctgcccacctgttcctttttctagttcagtggacagactgccaccttgcaggtgcccttggattgttgagaatcctaatttataaggtatatgtggatggcacaaccaccatgtctactcatgaaagaaaagcaagtataagggagttctatgcggttatttatccctctttattacagcttcaaagaggggtcactgatacagaagacaagaaacagaaagcagtatgtttggaaaggtaccgaagaagagatgaggaagaacataggcttcgaacagatgtagatattgaaagagaagaggagtgtggaatatgcatggagatgaatagtaagattgtattgccaaactgcaaccatgccctgtgtttgaaatgttaccatgaatggaggtcaagatcacagtcatgtcctttctgccgggacagtcttaaaagagtgaactctggagacctgtgggtgttcacagacagtagggatgtagtggacacggcaacagtgacaagggagaatcttagaaggctattcatgtacatagataagctgccactgattgttccggattccctttttgacacatatgattcgcaccttagataggcggcgcaaaaactaaactaaactgtctgattatctccatctccaatggtgtttggatgagcagtacccatctcgcaaaagtttaaagaaaaggggagttgctttgcatgagtagtttttctttcttttgtttacataacataaaagaattcactgaaactgatttggccaaaaaggaaaaggagattgaggccgaaatttaaggaatttcagtggggtagtttcttgccgcatctagttagaagaattccaactagcgatgttaggaagatgaatcggtaaggtcgagagagagagagagagagagatgggtgggggatcggctcataagttgtatttattcagcacatttgtacatcctttcttgtatagcttcgcatttacttgcgacgtgcaatagttaatgcaaaattctcctccgtacgtatcagattcttacagaaatctcctggcggacggacattgtgcttcaggaatctcgtattgtaattcctgatacgatactttaaagtagtttcattctccgtaattgatggctgtgcgcaaaagccaagcaatttgttgagatggtaaggaaagctacttggtttctttttcacttgtgctgagctgggcccaattttcaggaaatctactatctgaatatgtgacagcccaaatatgaagatgaatggcccaagcttgaacaaaaaaagaaaatgaaatt

SEQ ID NO: 1908 - DNA, 888 bp, Castanea mollissima
gccttttttgggggttttcaaatttgggggaatttaagaattgggtttttactttatttatttattgttgtttgtgtgagtgagtgagtgaaaaataaatttggagatgtatgtggctaccatgagaaagtctttcaaggactctctcaaagttctcgaggctgatattcaacacgctaatactcttgcctcagattgtccaagggaatatgatggtgcctgccttcagatgagaatgtcatatagtccagctgcacacatattcctctttctggtccaatggacagattgtaaccttgcagcggccctaggactcttaagaatcctaatttacaaggtttacgtggatggcacaaccaccatgtctacccatgaaagaaaagcaagcataagagagttttatgcggtaatttatccctctatattgcaacttcaaagaggtgtttctgatacagaagataaaaagcagaaagcagtatgtatggagaggtatcgaaggagggatgacgaggaacataggctgcgttccgatgtagatattgaaagagaggaagaatgtggaatatgcatggaaatgaatagcaagattgtattgcccaactgcaaccatgccatgtgcttgaaatgttaccgagaatggcgatcaagatcacagtcctgtcccttttgtcgggatagtcttaagagagtgaattcaggtgatctctgggtattcacagacagcaaggacatcgttgacatggcaacagtgacaagggagaatcttagaaggttgttccagtatatagataagttaccattaattgttcccgattctctttttgacacttatgattctcacctaaggtgattagcatggcctaaaccctaagcccaccatcttttgtg

SEQ ID NO: 1909 - DNA, 1365 bp, Tropaeolum majus
cggccgggggtaacaacagaataagaagcaccacgaaacccacctccaccaaacccacttttcgaaaacgagggagacgaagtgagggtttttggtattgattgatttgaggagaaaccggattaggttttttgttttcctgagtcgtttgtggattgattcttgttttttgtttgtattgtttgctcgatttgattatttttgagaggggggagatgtacataggctctacacgaagatcattcaaggactctctgaaagttcttgaagctgatattcaacatgctaacactcttgcatccgactttccgagggagtatgatggtgcgtgtctacagctgagaatgtcttacagtccagctgcccacctgttcctatttttggtgcaatggacagactgtaatcttgctggagccctgggactcctaagaatactaatttacaaggtttatgtggatggcacaacaactatgtccacccatgaaagaaaagcaagcattagggagttctatgctgtaatatatccctctttgatgcaacttcaaactggtattactgataatgaagacaaaaagcagaaagcagtatgcatggaaaggtataaaagacgagatgaggaacatatcctacacacagatgtagacattgaaagagaagaggaatgtgggatatgcatggagacaaacagcaaaattgtgttgccgaactgcaatcatgccatgtgcttgaaatgttacagagaatggaggtcaagatctcagtcgtgcccgttctgtcgcgacagtctcaaaagagtgaactctggtgatctctgggtatatacggactgcggggacataatcgacatggcaaccgtaacaagggagaatcttaggaggctcttcacctatatagataagttgccactaattgttcctgaccacctttttgacacatacgattcacacttgcgatagggaagaagtcagtatcttacctggcctttgaacgagtagtaaccccttgccaccaatttctttataatggcataaaaaccgaactcggtttcggaaaaatttagattagtagtatcgcccgaagtctccgcttcccacttccgatgagaagaacccagccttttgttattatgggctgataggtgaagttgacatagtatcatcaaattcaaaggggttcctaaattgtatttagcacaactaattgtaaattgcatgtatagtctgttgtttccggtaatattagcctctcttttttatagtagaattgtgttaattagcttttcgcaatgaagtttacaggagtattaaatgggcttgatagcttggaagtatcctcgagacagttgatccaaaaggtccctggatt

SEQ ID NO: 1910 - DNA, 1426 bp, Glycine max
ataggctatagttcagttgagagagagaaagcatgaaaatttgtagtgggttttggttttggttttggagttgggtttataatcttcaatcttgtttgggagagagagagagagagagagatgtacatagcttccatgggaaggtctttcaaggactccttgaaactgcttgaagctgatattcaccatgccaataccctggcgtcagattttccaagggaatatgatgggacctgccttcagatgagaatgtcatacagtccagcagcacacctgtttctcttttttgtgcaatggacagactgcaatcttgctggagcccttggactgttaagaatcctaatatacaaagtgtatgtggatgggacaactaccatgtctacccttgaaagaaaagcaagtattagggaattctatgcaatcatatatccctctttagtgcaactgcaagaaagtgtggcagatacagaggataaaaaacagaaggctgtatgcatggagaggtatcgcaaaagagatgatgaggagcacagacagccttcagacatagacattgaaagagaagaagaatgtggaatatgcatggagatgaatagtaagattgtgttgcctgactgcaaccatgtcatgtgcctgacatgttaccatgaatggaggacaagatcacagtcatgcccattttgccgtaacagtcttaagagagtaaactcaggtgatctctgggtgttcactgataatagggatgtagtagacatggcaacagcgacaagggagaatcttagaaggcttttcatgtacatagataagttgcctttggtcattccagactttctctttgacacatatgactctcacctaagatgagtgtttgcaacagccagattttactgtctctggtgtgtggtcttggagggttagttcctttcaatttagcaatgtaaactcaaaaatgtaatttgataaatttagtttatataaagttgcagtgttgcttcctacgtctttcagaagtatccagccctgtgtttactgtgggttggtggtgaagttgagatggtaaattgtatgtaggtcatttgtatatcctgtacagattgaattacttgttacgaagaggtttgcttattctgtgcctctaattattgttaaaaatgtgaatctcttgagtttagaaatacctcctccctccctaaactaatagtattatattattgaatgcatttgatgggatatcaattgccaacttcatcgtaacaacttggctaatgctctttcctttgttgtagtgggatttggcatccacttccgtaccaaaatggaaaaagatcatatgcagttggaataatagctgtatctgaactgtggtgtaattattcatttacccaagggtccacatttgttttgcaacttttgttttacaagaaaa

SEQ ID NO: 1911 - DNA, 1220 bp, Medicago truncatula
tacaatatactagtgagagaaactagagccacaataaccaccacactgttcttcttcttcttcttcttcttcttcatcttcttctgtttgaaaagtttgcttttgttgttgctttggtaagagacagaaagagatgtacgttgcttcttccatgcgcaagtctttcaaggattccttaaaacttctccaagctgatattcaacacgccaatactctggcgtccgatttccctagggagtatgatggtgcatgtcttcagatgagaatgtcatacagtccagctgcaaccttgtttctcttttttgttcaatggactgattgccatcttgctggtgctcttggattgttaagaatcctaatttacaaggtgtatgtggatggaacaaccaccatgtctacccatgaaagaaaagcaagtataagggaattctatgctgtcatttatccttctttattgcaacttgagaaaggtgttactgactctgaggataaaaagcaaaaggctgtatgcatggagaggtatcgtagaagagatgatgatgactgtaggcaatcttctgacatagatattgaaagagacgatgaatgtgggatatgcatggagatgaatagtaaaattgtgttgcctaactgtaatcatgttatgtgcctcaagtgttaccgagaatggcgaacgagatcccagtcgtgcccattttgccgtgacagtttgaagagagtgaactcaggggatctgtgggtatacactgatagaagggatgtggttgatatggcaacagtgacaagggagaatctcagaaggcttttcatgtacatagataagttgcctttaattgttccagactccatctttgacgcgtatgactctcacataaggtaagtgattgcagcagacagattttaatggatgctgttgtcttgggtggatagttattagttgttactcgttttcaatgcaaatataaattctgaacctgattcagtaagtttagtttatgttatatttgtagagttgcagttcttgcttcccacttctaccaaaagtatccaaccctttgttgttgcgggttggtggtgaagttgagatggtaaatatgtatctagctagctcatatgtatatccctgtatagattgaattgcttaacaagagattttctatggtcctgttgagttacttggattgtatctatggatttaactgtatatggaaatgtaaatt

SEQ ID NO: 1912 - DNA, 1455 bp, Arachis hypogaea
tctctctctctgacagagaaaccccactcctcctcagcttcaatactcttcttcttcttcctaatttccatcagaatattaagtgatacaaacaataaagtatgaaactttgttgttgcctttttatggttctcactcctttctctctttctctctgattcttcttctcttcttcctcattccttttctgagttctttttgttttccattgaaaaagcaaaggcctttaaaatgtacataggaacttccatgcgaaggtctttcaaggattccttgaaagtccttgaagctgatattcagcacgccaataccctggcatcagagtttccaaaggagtgtgatggtgcatgccttcagatgagaatgtcatacagtccagctgcacacttgtttcttttcttggtgcaatgggcagattgcaatcttgctggagcacttggcttgttaagaatcctaatttacaaggtatatgtggatggaacaactaccatgtctactcatgaaaggaaagctagcattagagaattctatgcggtaatttatccgtctttgttacaacttcagaaaggggttacagattcagaggataagaaacagaaggctgtttgtatggagaggtatcgaaaaagagacgatgaggatcatcaactacattctgatatagacattgaaagagaagaagaatgtggaatatgcatggaagtgaatagtaagattgtgctgcctaactgcatccatgctatgtgcctgaaatgttaccgtgaatggagaacaagatcccaatcgtgccccttttgtcgcgatagtctgaagagagtgaactcgtgcgatctctgggtatttaccgatagccgggatgtagtcgacatggaaacagtgacaagggaggatatcaagaggcttttcatgtacatagataagttgcccttgatcattccagactcgcttttcgatccctacgactctcaactaagataaagtaaatgatcttgttcttgatgggtagttttcctttcaccttaatggcataataaatttagttttcattgttatagagttgcagtgtgtggcagaagaatcatccatcaacccgagtttactatggggttggtggtggaagctgagatgctaaattgtatctagctccattttgtatattcatattgtacagatcgatcgaattactttgttcacaagatatttgcattgcctgtatcaatcatgtttaaatgttgatctctttgatgcattttctgatgctaagttcagtttcactcaaaaagcaaggcaaagaatttaagggaccttgatgatgctaaagatacttcttaacccaaaaacaaagatagtatcttttactttgtgcaaaatgtgggtgaatctatcattgcttgccccataaaaatgtaatgtggaatgatgttatatgacagcaattaaagggaaaactatatg

SEQ ID NO: 1913 - DNA, 1567 bp, Populus trichocarpa
aacgctagctccacgacatcccactctctaatccacgtgtcccctctctatctatggcttcactttcaagaacagagtagaagaagaagaagctcctctgagaagaaccaaccccaccaccaaaaaaagaaaaggaaggaggttttggtgaagagaaaacaagaaaaattttcagggttttaacccgaagagagaatccgattgcttgatcttggaggttttgaagaagagatatgtatatagggtctgtgagaaaatctttcaaggactctcttaaagtgcttgaagctgatattcaacatgctaatactctggcatcagatatttcaagggattatgatggagcctgtcttcagatgagaatgtcatatagtccagcagcacacctgtttctttttcttgtgcagtggacagactgccatcttgctggtgcacttggactgctaaggatcctaatttataaggtttatgtggatggcacaaccaccatgactactcatgaaagaaaagcaagtatcagggagttctatgctgtaatttatccctctttattgcaacttcaaagaggggtcactgacacagaagataaggaacagaaggcggtatgcatggaaaggtaccgaagacgagatgatgaggaacataggcagcatgctgatgttgacattgaaagagaagaagaatgtggaatatgcatggagatgaatagcaagattgtactgcccaactgccaccatgccatgtgcttgaaatgttaccgtgaatggcgatcaagatcccagtcatgccccttctgtcgtgacagtctcaagagagtaaactctggagatctctgggtgtttactgacagcaaggacattgtggacatggcaacggtgacaagagataacctaagaaggctttttatgtatgtagataagttgcctctgataattcctgacaaccttttcgacacatacgattcacacgtaagataggcgacaagtacagcccgcaatcgccatctccctggtctttggatgaatagtaccactaccacctccccttttccttaatataacataaccactgaagattcagtaggcagaattgaggccacttggagtttcagggctttcttcccgcttcttgtcagaagaaaatccagccttggttattgtgggttggtaggtgaagttaaagatgggttttataaatcgtattttagcacatctgtacatgcttgtatagcctggagctcgcttataaaagctctgcaatttccctcccacattcgtcttgtgtctgtgggagaagaaaaaagatctattcgtcttgttcctaagctaaagacagctcgtatgaagtagtactggatcaacagatacaacagctcaaaataagcattgaaaacaagtaggagaatttattttttttcacgtgctttttcaagcgtaaagtaaatattttatatttaaaaagcatgtagcaatgtaaaaacaaatgctacttggacgtgccgctcttctaagaaactctttcttattacaaatgagacaagaaggggataaatttaccagtattttat

SEQ ID NO: 1914 - DNA, 1428 bp, Citrus clementina
attacatacatttacacacaatacccaaacaaacgccattaaaaaccctcaaacgaccttacctcacttctctatgactcttttctaaagagattctaaagtttaggttttcggtttccttttttttttttaatttcattttttatttaattttttggggctttcttccacttttccattttttaaattggagatgtacgtgggttccatgcgaaaatcgtttaaggactctttgaaagttcttgaagccgatattcagcatgccaacactctggcatcggattttccaagggagtatgatggtgcctgccttcagatgagaatgtcatacagtccagctgcacacctgttcctttttttagtacaatggacagactgccaccttgcaggagcccttggacttctgcgaatactcatttacaaggtttatgtggatggtacaaccaccatgtctacccatgaaagaaaagcaagtattagagagttctatgcgattatttatccctctttgttgcaactccaaagaggtgttacagacacagaagataagaagcagaaggcagtatacatggaaaggtatcgaagaagagatgatgaggaacaaaggcaatatacagatgccgatattgaaagagaagaagaatgcggaatatgcatggagacaaatagtaagattgtcttgccgaactgcaaccacgccatgtgcttgaaatgttaccgtgaatggcgaacaagatctcagtcatgccccttttgccgcgacagtctaaagagagtgaactcaggtgatctctgggtatatatggacagcagagacataatcgactcagcaacagtgacaagggagaatctaagacggctcttcctgtatatagacaagttgccgctgatcattcctgataacctttttgacccttatgattcccacctaagataggcttgagatggaagtacattctaaagtcaatatatttctatggtccctgaatgaatgattccctctgattttcttttcctttttttttttaagttacataaagaccgaaattctttttcggcaaaattaggtaacttgagaactgatctgcaagtggctttcttcccgcttctgttaagaagaatccagccagaggtattgtgggctggttggtgaagttgagatagttttaactagaaggggctcttcatgaattgtatgtagcacattttgtacatgcatgtatagctttctgtttgcttataagatgcttcccgttatctgtcaactccagcttcctctgttgttttgtttcatcccagagctccaaagtgagtgtttgcagctgctcatagtttcagtaacaaggtaattataactgtatactgatgaaaggagaggtggaagctgttggatttttcaaaatgttacgcttataaaattcttttcta

SEQ ID NO: 1915 - DNA, 1425 bp, Citrus sinensis
attacatacatttacacacaatacccaaacaaacgccattaaaaaccctcaaacgaccttacctcacttctctatgactcttttctaaagagattctaaagtttaggttttcggtttccttttttttttaatttcattttttatttaattttttggggctttcttccacttttccattttttaaattggagatgtacgtgggttccatgcgaaaatcgtttaaggactctttgaaagttcttgaagccgatattcagcatgccaacactctggcatcggattttccaagggagtatgatggtgcctgccttcagatgagaatgtcatacagtccagctgcacacctgttcctttttttagtacaatggacagactgccaccttgcaggagcccttggacttctgcgaatactcatttacaaggtttatgtggatggtacaaccaccatgtctacccatgaaagaaaagcaagtattagagagttctatgcgattatttatccctctttgttgcaactccaaagaggtgttacagacacagaagataagaagcagaaggcagtatacatggaaaggtatcgaagaagagatgatgaggaacaaaggcaatatacagatgccgatattgaaagagaagaagaatgcggaatatgcatggagacaaatagtaagattgtcttgccaaactgcaaccacgccatgtgcttgaaatgttaccgtgaatggcgaataagatctcagtcatgccccttttgccgcgacagtctaaagagagtgaactcaggtgatctctgggtatatatggacagcagagacataatcgactcagcaacagtgacaagggagaatctaagacggctcttcctgtatatagacaagttgccgctgatcattcctgataacctttttgacccttatgattcccacctaagataggcttgagatggaagtacattctaaagtcgatatatttctatggtccctgaatgaatgattccctctgattttcttttccttttttttttaagttacataaagaccgaaattctttttcggcaaaattaggtaacttgagaactgatctgcaagtggctttcttcccgcttctgttaagaagaatccagccagaggtattgtgggctggttggtgaagttgagatagttttaactagaaggggctcttcatgaattgtatgtagcacattttgtacatgcatgtatagctttctgtttgcttataagatgcttcccgttatctgtcaactccagcttcctctgttgttttgtttcatcccagagctccaaagtgagtgtttgcagctgctcatagtttcagtaacaaggtaattataactgtatactgatgaaaggagaggtggaagctgttggatttttcaaaatgttatgcttataaaattcttttcta

SEQ ID NO: 1916 - DNA, 1380 bp, Citrus sinensis
tcaaacgaccttacctcacttctctatgactcttttctaaagagattctaaagtttaggttttcggtttccttttttttttaatttcattttttatttaattttttggggctttcttccacttttccattttttaaattggagatgtacgtgggttccatgcgaaaatcgtttaaggactctttgaaagttcttgaagccgatattcagcatgccaacactctggcatcggattttccaagggagtatgatggtgcctgccttcagatgagaatgtcatacagtccagctgcacacctgttcctttttttagtacaatggacagactgccaccttgcaggagcccttggacttctgcgaatactcatttacaaggtttatgtggatggtacaaccaccatgtctacccatgaaagaaaagcaagtattagagagttctatgcgattatttatccctctttgttgcaactccaaagaggtgttacagacacagaagataagaagcagaaggcagtatacatggaaaggtatcgaagaagagatgatgaggaacaaaggcaatatacagatgccgatattgaaagagaagaagaatgcggaatatgcatggagacaaatagtaagattgtcttgccaaactgcaaccacgccatgtgcttgaaatgttaccgtgaatggcgaataagatctcagtcatgccccttttgccgcgacagtctaaagagagtgaactcaggtgatctctgggtatatatggacagcagagacataatcgactcagcaacagtgacaagggagaatctaagacggctcttcctgtatatagacaagttgccgctgatcattcctgataacctttttgacccttatgattcccacctaagataggcttgagatggaagtacattctaaagtcgatatatttctatggtccctgaatgaatgattccctctgattttcttttccttttttttttaagttacataaagaccgaaattctttttcggcaaaattaggtaacttgagaactgatctgcaagtggctttcttcccgcttctgttaagaagaatccagccagaggtattgtgggctggttggtgaagttgagatagttttaactagaaggggctcttcatgaattgtatgtagcacattttgtacatgcatgtatagctttctgtttgcttataagatgcttcccgttatctgtcaactccagcttcctctgttgttttgtttcatcccagagctccaaagtgagtgtttgcagctgctcatagtttcagtaacaaggtaattataactgtatactgatgaaaaggaaaggtggaaggctgttggatttttcaaaatggttacccttaataaaattcttttct

SEQ ID NO: 1917 - DNA, 1025 bp, Valeriana officinalis
gactccactcatttgatgttcattttttctgctttcaacaagagaagagatgtacgctgcttccatgcgaaaatccttcaaggattctctcaaagtcctccaagccgatattcagcacgccaatactctggcatcagattttccaagagaatatgatggagcatgcctgcagatgagaatgtcatacagtccagcagctcactattttcttatttcttgttcagtggacagattgtcacctggctggtgctctcgggcttttaaggattcttatttacaaggtgtatgttgatggaactactacaatgtctacacatgaaagaaaagctagcattagagaattctatgctgttatttatccttctttactgcaactcgaaagaggcgtgacggacacagaagacaaaaaacaaaaagctgtatgcatggaacggtaccgaagaaaagaggaagaacggaaacaaatttcagatgcagatattgaaagagaagaagaatgtggaatttgtatggagattaatagcaagatcgtcttgcctaattgcaatcatgccatgtgcttaaaatgctaccgtgattggcgcacaagatcacaatcatgtccattttgccgggacagtttaaaaagagttaattctggtgatttatgggtatttatggatagcaaggatatcatcgatatggcaacacttacaaaggaaaatctgagaaggctattcatttatgtagataagttgcctctaattgtcccagatatgcttttcgacacttacgattctcatataaggtaaaaataaaaagaagtagttacattttcttgatttggtgacataatgatcggtgttttttagtcggtctatttaggttttgttattacgtaagaaaaaaacactctgaattagatgaacccgcctgagttattatggggcagcggtttgaagctgatttagatatgtttttcagaaaaggtgggtttatgtttgaaatctgtatgcaccgataactttgtatatgcttctgtacag

SEQ ID NO: 1918 - DNA, 986 bp, Euonymus alatus
ttgggaaatgtacgtaggttctatgcgaaagtcgttcaaggactccttgaaagtgcttgaagctgatattcaacatgctaatacactggcatcagatttcccaagggattatgatggtgcgtgccttcagatgagaatgtcatacagtccagccgcacatctgttcctttttcttgtgcaatggacggattgcaaccttgcaggagccctcggactgttaagaatcctcatttacaaggtatatgtggacggcacgaccaccatgtccacacatgaaaggaaagcgagcatcagagagttctatgcgataatttatccctcattactccaacttcaaagaggtgttatcgatactgaagataaaaagcagaaggcagtatgcatggagaggtatcgaagaagagatgatgaggaccgcagacagtacactgatgtagaaattgaaagagaagaagaatgtgggatatgcatggagatgaataataagattgtattacccaactgcaatcataccttgtgcttgaaatgttaccgtgaatggagatcaagatcccagtcatgccccttttgccgtgacagtcttaaaagagtgaattctggtgatctatgggtgtttactgatagcagggacataatcgacatggcaacagtgacgagagagaaccttaggaggctattcatgtatatagacaagttgcctttgattgtaccagataacctttttgacgcgtacgattctcacctaaagtaggtaactaaaactttctcagattgcatctttcgtactccatgcatgagtaattctactatgattcagccataaaagccggaattgttccggcaaatttagattagttagaactccccacagccggcctccgccatgaaggctcaggtgggccagcgggtgaagttgagatagtttatttagaagtataaattgtatgtagcaaatgtgtatatgctttgtatagccttgacgtttt

SEQ ID NO: 1919 - DNA, 1395 bp, Silene vulgaris
aagtgaagaaaaaccctcttcaaactctagagatagagagagactgtgagtggtgggtacaattttatctttatttgagcctttttttggggattttaatcattttatgcaattaattgtgtaaaaaattgatcttttctgggttttttgggtgataaatgatcaaaagttctgtaccaaaaattcagttaatttattgattaatggtgtttgattgattactgttgctgggtaattttaatttttatctgggtaaattttataaaattgataaaggtgataaaagaagctttgaatttaagaaatgtatgttgcttccacgggaaagtctttcaaggattctctcaaagttcttgaagctgatattcaacatgctaatactctggcatctgagttacctagagaatatgatggggcttgccttcaaatgagaatgtcgtatgctcctgctgcccactttttgcttttcttggtgcaatggacagattgtcacctggcaggagcattgggcttgttgagaattctcatctataaggtttacgttgacggcaccactaccatgtcaacacatgaaaggaaagcaagtattagagagttttatggggtaatttatccttctctgttgcaacttgaaaatggtgttactgatacagaagataaaaaacagaaatctgtgtgcatggagagataccgcaaaagagatgaacatagacacttctctgatgttgatagtgaaagggaggaagagtgtggtatttgcatggagagttatagtaaaattgtgctgccaaattgtaaccatgccttgtgcctgaaatgctatcgagaatggcggtctaggtcacagtcatgcccgttctgccgagatagcctcaagagggtgaattccggtgatctctgggtgttcaccgacagtagagacgtggttgacatggcgactttgaccaaggagaatctgaggaggctgtttatgtacatagagaaactgcccttgattattccagaatctttattcgatgcctatgattcacacctgaaatgagacgatcttcaaaacccacagtagtcttcagtcacctgactgtaacctgtcccttgctactcagctctgcaggaggacgttatctggttagtctagttatctatctatatatatacataatatatgcaattgctcttatcttttggttctcttgatgtcggaaaagccctacttcatttatggtaggtaggacatgtgtatcaagaaaatggtggatatgggtttcgaaaatttgtaagtaggaaattatgtacattcttgtatagctttgtctttcaggaaaagaggggtctatggtttaaaaagaatccaaattggcttcattgtgtcgttaagatgttatgcttctcgtg

SEQ ID NO: 1920 - DNA, 1448 bp, Gossypium hirsutum
agagaaggaactagggtttatttttgaggggtgaaggattggttggaatttgattgtttttcctaagagatgtacacaagttctatgcgaaaatctttcaaggattctcttaaagtgcttgaagctgatattcaacatgctaataccctggcatcagattttccgagggaatatgatggtgcatgtcttcaaatgaggatgtcgtatagtccggccgcgcacctcttcttatttttggtgcagtggactgattttcaccttgcaggagcccttggattgttaagaatactaatttacaaggtttatgtggatggaactaccacgatgtctacacatgaaaggaaagcaagcatccgagaattctacactgttatctatccctctttgctgcaacttcagagcggtgtcactgatagtgaagataaacaacagaaagcggcatgcgtggaaaggtatcgtagaagagaagatgaagagtataagcagcttaccgatattgatttcgaaagagaagaagaatgtggaatatgcatggaaacaaacagtaaaatgttgctgccgaactgtaatcacaccatgtgcttgaaatgttatagggaatggcggtcaatatcacagtcatgccctttctgtcgtgatagtctcaaaagagttaactcgggggatctttgggtatatacagacagccgggatataatcgacatggccacagtgacaagggagaatcttagaaggcttttcatgtacatagataagttaccacttattatccctgataccatttttgatacttatgattctcatttaaagtgattaaatatagtctaaaacatcagctccacgatcagagcatttccggtaaaagtactatggaagctcttaatactagaagtcagattttattttgcccctctactcaaaaaatggacaactaagtccctgtacattagatcaaaaagcaagtcggtcttttctgttaaaaatctatactattaaaaactagtatggctaatgaaataactaaacagtaacacgtgacgtgccatgtgtacctcatgctgatgtataaggatcagttttggaattttaacaaaaggaccaatttgctctttgatttaacgtatagggactaatttacttattttttgagtagaggagacaaaatgtaatcttacttctaggacagaagcctccatggtacttttactgaggatttccttatcgtattttcttgattacataaggaccaaatctctcgatttggcaaatttagctaatctagtatatgcaatgccttttattcccacttctcaccataggcaaaaagaccatgcccgagttattgtgggctggtgctgaagttgaggtatatatagttcatgtaggatccataaagaaaacctgtatttagtacattttgtacatgcttgtatagccttttatgtttg

SEQ ID NO: 1921 - DNA, 1251 bp, Fragaria vesca
tcctctcgtcttcgctttcaagagcagcatagaagtagcacgaaggctttggagaccgagagagaggaaagagaaaaaaaaaagtgaaccgaaacagaggagactgagggtttttggaggaagagaagaagaaattagggttcttgaggcttattgacaatcaatcccaatatatttcagggtgcaaattagtttttgatatttttcttgggagttcttggggtttgtgtctgtgtgtggagatgtacatagcttcaatgcgaaagtcgttcaaggactctctcaaagtgcttgaagctgatatccaacatgccaatactctggcttcggattatccaagagagtatgatggtgcttgtcttcagatgagaatgtcttacagtccagctgctcatctcttcctttttctggtgcaatggactgactgcaacctcgctggagcccttggtctgctcagaattctaatttacaaggtgtatgtggatggcaccaccaccatgtctacacatgagaggaaagcaagcatccgagatttctatgctgtaatttatccctctttattgcaacttcaaagaggtgtcaccgatagtgaagataaaaggcagaaggcagtatgcatggaaaggtatcgaaaaagagatgatgaggagaatcgacagtgttcagatatagagattgaaagagaagaggaatgtggtatatgcatggagacaaatagtaaaatcgtattgcccaactgcaaccatgctatgtgcctaaaatgttaccgtgattggcgaacaagatctcagtcgtgccctttctgtcgtgacagtcttaagagagtgaactcgggcgatctctgggtatacactgacagcagggacatagttgacatggcaacagtgatgagggagaatcacaggaggctcttcatctacgtagataagttaccagtaattataccagataacctttttgacccctacgattcccacctaaggtagctgattgatgaagttcaaaagctacagttctcctgtggcaattcattgatttagcttattgtctcttaattccataaggtcccgaattcattcggcaagtgtcagtatcttcccacttctgtttaaaagagaacccaacagcctgagttattgtaggctggtgggtgaagttgaggagttatctaaattgtatgtagtacatttgtacatgcttgtacagcttggaagttccgcctataaaaagcttaaccagtccagttgtctc

SEQ ID NO: 1922 - DNA, 1176 bp, Euonymus alatus
ggttggggactgggaaagtgtttgattgttggagtggttgttgaatttgggaaatgtacgtaggttctatgcgaaagtcgttcaaggactctttgaaagtgcttgaagctgatattcaacatgctaatacactggcatcagatttcccaagggattatgatggtgcgtgccttcagatgagaatgtcatacagtccagccgcacatctgttcctttttcttgtgcaatggacggattgcaaccttgcaggggcccttggacttttaagaatccttatttataaggtttatgtggatggcacgaccaccatgtccactcatgaaaggaaagctagcatcagggagttctatgcaataatttatccctcattactccaacttcaaagtggtgtcagtgacactgaagataaaaagcagaaggcagtatgcatggagaggtatcgaagaagagatgatgaggaccgtagacagtacactgatgtagaaattgaaagggaagaagaatgtgggatatgcatggagatgagtagtaagattgtattacccaactgcaaccatgccttgtgcttgaaatgttaccgtgaatggagatcaagatcccagtcatgccccttttgccgtgacagtcttaaaagggtgaattctggtgatttatgggtatttactgactgcagggacataatcgacatggcaacagttacaagagagaaccttaggaggctattcatgtatatagacaagttgcctttgattgttccagatgatctttttgacgtgtacgattctcacctaaagtaggttactaaagcaggatcgaattgcctcttctgcactcctttcatgagtaattccactatgatttagccataaaggccggaattgttccgggaaatttagatccgctagaactccccacttcaaatgagaagcagccagcctgagccttcatggcggaggacggtgggtgaagttgagatagtttatttttagtgagtatcttataaattgtatgtagcaaatgtgtatatgctttgtatagtcttgatgtttgtctgtgaagtgaagacggaaagcgaatttcctcaaatcctttgtagaagttatgataatgattctctttttgagttgctattgttcctagaattgaacttctttcaggacaaaggtagcagtgaaa

SEQ ID NO: 1923 - DNA, 1580 bp, Gossypium hirsutum
aaggcgcgtgtcacggactgtcaagacaaagttcatttgactgtcatggctacctagaatttagaaccaccacccaccaatattgaaagtgaaagacgccttaaaagacactgtcaaataaaagctaagcttagagaaggaaactagggtttaatttttgaggggtgaaggattgattggaatttgattgttttttcttagagatgtacacaagttctatgcgaaaatctttcaaggattctcttaaagtgcttgaagctgatattcaacatgctaatactctggcatcggattttccgagggaatatgatggtgcatgtcttcaaatgaggatgtcgtatagtccggccgcgcacctcttcttatttttggtgcagtggactgattttcaccttgcaggagcccttggattgttaagaatactaatttacaaggtttatgtggatggaactaccacgatgtctacacatgaaaggaaagcaagcatccgagaattctacactgttatctatccctctttgctgcaacttcagagcggtgtcaccgatagtgaagataaacaacagaaagcggcatgcgtggaaagttatcgtagaagagaagatgaagagtataagcagcttaccgatattgatttcgaaagagaagaagaatgtggaatatgcatggaaacaaacagtaaaatgttgctaccgaactgtaatcacaccatgtgcttgaaatgttatcgggaatggcggtcaagatcgcagtcgtgccctttctgtcgtgatagtctcaaaagagttaactcgggggatctttgggtatatacagacagccgggatataatcgacatggccacagtgacaagggagaatcttagaaggcttttcacgtacatagataagttaccacttataatccctgataccatttttgatacttatgattctcatttaaagtgattaaatatagtctaaaacatcggctccacgattagagcatttcgggtagaagtactatggaagcccataatactagaagtcagattttattttgtccctctactcaaaaatggacaaataagtccctgtacatcagatcaaaaaacaagttagtcctttctgttaaaaatctgtactgataaaaactagtatggctaatgaaataaccaaacagtaacacgtgacgtaccatgtgtacctcatgctaatgtacaaggatcaattttgaaattttaacaaaaggactaatttgctctttgatttaacgtacatggactaatttgctcattttttaagtagaggaggcaaaatgtaatcctactcctaatacagaagtctccatggtatttttactgaggattttctaatcgtattttcttgattacataaggaccgaatcactcgatttggcaaatttagctaatctagtatatgcaatgcctttattcccacttctcaccataggcaaaaagaccatgcccgagttattgtgggctggtgctgaagttgaggtatatatagttcatgtaggatccataaagaaaaactgtatttagtacattttgtacatgcttgtatagccttttatgtttg

SEQ ID NO: 1924 - DNA, 1169 bp, Prunus persica
gagagaaaagggaaagagaaagtggagaggaagtgtgggtttttgggagtgggtgagaaaattagggttcttggaggctgattgaatatctctatctccgtgctttgtaattattttgactttttttgttgttttttattttatttttctgtggagatgtatatagcttccatgcgaaagtcattcaaggactctctgaaagtgctcgaagctgatattcagcatgcaaatacactggcctcggattatccaagggagtatgatggtgcttgtcttcagatgagaatgtcatacagtccagctgctcacctcttcctttttctggtgcaatggactgactgcaacctcgcaggagcccttgggctgttaagaattttaatttacaaggtttatgtggatggctcaacaaccatcatgtctaccaaggaaaggaaagcaagcatcagagagttctatgctgttatttatccctccttgttgcaacttcagagaggtgtcaccgacagtgaagataaaaagcagaaggcggtatgcgtggaaaggtatcgaaaaagagatgatgaggaaaatcgacagtgttctgatatagacattgaaagagaggaggaatgcggtatatgcatggagacaaatagtaaaattgtattgcctaactgcaaccatgctatgtgcttgaaatgttaccgtgattggcgaacaagatctcagtcatgcccattctgccgtgacaatcttaagagagtgaactcgggtgatctctgggtatacactgactgcagggacatagtggacatggaaacagtgatgagggagaaccttaggaggcttttcatgtatatagataagttgcctttagttacaccggataacccctttgacccttatgattcccacctaaggtgattgaatcagagtccaaaaccacaatctccagtggcaatttaatgaattagtttcttttcctttgattacataaggaccgaaaattcattcggcgggtttaaagtcggtatcttcccactcctgttcagaagacctcgcctgagttattttgtgctggcgggtgaagttgaggagtttataaaattgtatgtagtacatttgtaaatgcttgtacagctttgatgttggcttagtctttttaatatacaaatcctctccttcttgtt

SEQ ID NO: 1925 - DNA, 1023 bp, Cajanus cajan
attcatcatgccaataccctggcgtcggatttcctagggaatatgatggtgcatgccctcagatgagaatgtcatacagtccagcagcacacttgtttctctttttggttgcaatggacagattgcaatctcgccggagcccttggactgttgagaatcctaatatacaaggtatatgtggatgggacaactacaatgtctacccatgaaagaaaagcaagcatcagagaattctatgcggtcatatatccctcgttattgcaactgcaaaatggtgtaactgatacagaggataaaaaacagaaggctgtatgcatggagaggtatcgtaaaagggatgaggaagattacagacaatcttcagacatagacattgaaagagaagaagaatgtggaatatgcatggagatgaatagtaagattgtgttgcccgactgcaaccatgtcatgtgcctgaaatgttaccatgaatggaggacaagatcacagtcatgtcccttttgccgcgacagtcttaagagagtaaactcaggtgatctttgggtgttcactgatagtagggatatagtagacatggcaacagtgacaagggagaatcttagaaggcttttcatgtacatagataagttgcctctgatcattccagactctctttttgacacatatgactctcacctaagatgagtgattgcaagttgcaacagacagattttactgtctggtgtggtcttgaagaggtagttacttccattcgattcataaactccgaatgtaattcggaaaatttagtttatatagagttgcagtgttgcttccagaagtatccagccctgtgtttatgtgggttggtggtgaagttgagatggtaaattgtatgtagctcatgatcatttgtatatcctgtacagattgaattacttattaagaagaggtttgcatattaatattaatgtgcctctttttgttagaaaaacgtgaaatctctggagttaacaaaaaaaaaaaaaaagtaaactactagac

SEQ ID NO: 1926 - DNA, 1301 bp, Cucumis sativus
cttattacaaaacccacacacacactctcttctagagagagaaaaaatagagagagagaagacggaactcgcacgctgcctacccacttctagagagagacagacaggctctttttctttcttccacagcgaattagggtttttttctctccctttttttggagttgaatttttgtcgaattggttgtgttttgcttctttctttccccttcgggtggagatgtatgtttcttccatgagaaagtcgttcaaggactctctcaaagtgcttgaagctgatattcagcatgctaatactctggcatcagagttccccggggaatacgatggcccctgccttcagatgagaatgtcatacagtcctgctgctcacttgttcctctttctagtgcaatggactgactgccatcttgcaggagcgcttggactgctgaggattttaatttacaaggtctacgtggatggtacaaccaccatgtctacccacgagagaaaagcaagcattagggaattctatgctgttatttacccctctctattgcaacttcagagaggtgttactgatactgaagataaaaagcagaaagctgtctgcatggaaaggtaccgaagaagagacgatgaagaatgtatacagcgttcagatgctgacattgaacgggaagaagaatgtggaatatgcatggagacaactagcaaggttgtattgcccaactgcaatcatgccttgtgcttgaaatgttaccgtgaatggcgaacacgttcccagtcatgcccgttctgtcgtgacagtcttaagagagtaaattctggtgatctctgggtatttactgataacagggacattgtggacatggcaacggtgactcgagagaatctgaaaaggcttttcaagtacatagataaattgcctactattgttccagactctctcttcgacgcctatgatacacacctaagataagtgattggtacatacataatctaatgtcaatccttaagtagttcctctccaaatgaacagtttttttgttatgatatggcatgacaaaacgacctaaattcattcggctaaaaattagtaagagttagagaagacttgcaactgtttcttcccacttccatttctgaagggagaaaaaaccagtctttgagttattgtagactggtattgggtgggtaagttgatatggtttgatttaaagtcttccataaaaattgtatttaacacatttgtatatgtttgtacattcttgatgttatctattaaagcagctttgaatgcttaattttttctttgc

SEQ ID NO: 1927 - DNA, 1422 bp, Citrullus lanatus
tttcaaatattttatttcttccgacgctccaagacgagccgtccatcttccacgtgtccctcccactctctgccttcgccttcaagaggcactgcaccgaagcaacacgaaggtctaatacaaaacacacacacacactcttctagagagagaaagagagaagacggaactcgcacgctgcctacccacttctagagagagatagagagagggtctttttctttcttccagacggaattagggtttttttctcgctttttttggagttgaaatttgcaggaattggttgtgttttgcttctttctttccccttcgggtggagatgtatgtatcttccatgagaaagtcgttcaaggactctctcaaagtgcttgaagctgatattcagcatgctaatactctggcatcagaatttcccggggaatatgatggcccctgccttcagatgagaatgtcatacagtcctgctgctcacttgttcctcttcctagtgcaatggacagactgccatcttgcaggagcccttggactgctgaggattttaatttacaaggtctatgtggatggtacaaccaccatgtccacccacgagagaaaagcaagcattagggaattctatgctgttatttacccctctctattgcaacttcagagaggtgttactgatactgaagataaaaagcagaaagctgtctgcatggaaaggtaccgaagaagagatgacgatgaatgcatacagcgttcggatgctgacattgaacgagaagaagaatgtggcatatgcatggagaccactagcaaggttgtattgcccaactgcaaccatgccttgtgcttgaaatgttaccgtgaatggcgaacacgttcccagtcgtgcccattctgtcgcgacagtcttaagagagtaaattctggtgatctatgggtatttactgataacagggacattgtggacatggcgacggtgactcgagagaatctcaaaaggcttttcaagtacatagataaattgcctacaattgttccagactccctctttgacgcttacgatacgcacctaagataagtgattggtacatacataatctaatgtcactcctcaagtagtttttctccaaatgaacagtctatttgttatgagatgacatgacaataggactgaaattcatgcggctaaaaattagtaagagttaagagaagacttgcaactgtttcttcccacttccatttctgaagggaaaaaaaaaccagtctttgagttattgtagactggtattgggtggtgaagttgatatagtttgatttaaagtcttccataaaaattgtatttaacacatttgtatatgtttgtacattcttgattttatctttatctatcaaagcagctttgaatgctttgtttttctttgcaacttggggaaa

SEQ ID NO: 1928 - DNA, 1458 bp, Cucumis melo
gagagagagaaaagaaaaagagagagaaggcggaactcgcacgctgcctacccacttctagagagagacagacgggctcttttctttcttccacagcgaattagggtttttttctccctttttctggagttgaattttcgtggaattggttgtgttttgcttctttctttccccttcgggtggagatgtatgtttcttccatgagaaagtcgttcaaggactctctcaaagtgcttgaagctgatattcagcatgctaatactctggcatcagagttccccggggaatacgatggcccctgccttcagatgagaatgtcatacagtcctgccgctcacttgttcctctttctagtgcaatggacagactgccatcttgcaggagcgcttggactgctgaggattttgatttacaaggtctacgtggatggtacaaccaccatgtctacccacgagagaaaagcaagcattagggaattctatgctgttatttacccctctctattgcaacttcagagaggtgttactgatactgaagataaaaagcagaaagctgtctgcatggaaaggtaccgaagaagagacgacgatgaatgtatacagcgttcagatgctgacattgaacgggaagaagaatgtggaatatgcatggagacaactagcaaggttgtattgcccaactgcaatcatgccttgtgcttgaaatgttaccgtgaatggcgaacacgttctcagtcatgcccgttctgtcgtgacagtcttaagagagtaaattctggtgatctctgggtatttactgataacagggacattgtggacatggcaacggtgactcgagagaatctgaaaaggcttttcaagtacatagataaattgcctactattgttccagactcccttttcgacgcctatgatacacacctaagataagtgattggtacatacataatctaatgtcaatccttaagtagtttctctccaaatgaacagtctttttgttatgatatggcatgacaaaacgaccgaaattcattcggctaaaaattagtaagagttagagaagacttgcaactatttcttcccacttccatttctgaagggagaaaaaaaccagtctttgagttattgtagactggtattgggtgggaaagttgatatggtttgatttaaagtcttccataaaaattgtattcaacacatttgtatatgtttgtacattcttgatgttatctattaaagcagctttgaatgcttaatttttaatacgcaaagagattttggagttgactatggctcataggggagaaggcattgaaagtcaataggtgctatgtcaccctttcgactcatttaaatttttgttcaaccgtatgtgttattgttttatgttattgtatatgcattttttttctttagagaatagacatttgctgaaatcgggttatgtgactgctataag

SEQ ID NO: 1929 - DNA, 1243 bp, Populus trichocarpa
cacgacatcccactctctaatccacgtgtcttctctctgtctatggcttccctttcaagaacagagtagatgaagctcatctgagaagaaccaaccccaccaccacaagaagaaaaggaggttttggtggagacaaaagaagaacaattttcagggtttttagccgaaagagagaatccgattgcttggaggtttttaatgagagatatgtatatagggtctatgacaaagtcttttaaggactccattaaagttcttgaagctgatcttcaacatgctaatactctggcatcagatttttcaagggattatgatggagcctgtcttcagatgagaatgtcatatgctccagcagcaaacctgtttcttttcctttttcagtggacagactgccatcttgcaggtgcacttggactgctaaggatcctaatttataaggtttatgtggatggcacaacgaccatgttcactcacgaaagaaaagcaagcatcaaggagttctatgctgtgatttatccctctttattgcaacttcaaagaggggtcactgatacagaagataagaagcagaaggcagtatgcctggaaaggtaccgaagaagagatgatgaggaacataggcagcatactgacattgacattgaaagagaagaagagtgtggaatatgcatggagatgaatagcaagatagtactgcccaactgcaaccatgccatgtgcttgaaatgttaccgtgaatggcgaacaagatcccagtcatgccccttctgtcgtgacagtctcaagagagtaaactcgggagatctctgggtatttactgacggccgggacattgtggacacggccactgtgacgagagagaatcttagaaggcttttcatgtatattgataagctgccgctgattcttcctgacaaccttttcgacttgtatgattctcatataagataagttatgagtacagccaggaatcgccatctgatatggtctttggatgagcagtacacttccttttcttaatataacataatcgctggaattcatttggcaaaatttagggctctaagaatttcagcagtgtcttcccacttcctgtcagaagaaaatccaacccgagttattgtgggttggcaggtgaagttgatatattaaagacggggtctcgtaaaattgtatctagcacatttgtacatccttgtatagcttgaagcttgcttataagagctcagcaatttctctctac

SEQ ID NO: 1930 - DNA, 1519 bp, Malus domestica
atggcgggtgtaacgatcatcgcatgggtgcgtggagggaaagctgacgagtagaaagggaaggggaaaagtggcagacaaagcccaaagggagtggacataacacccgtgaaaatttcgacatgtacatagcttctatgcgaaagtcgttcaaggactctctgaaagttcttgaagctgatattcagcatgcaaatactctggcctcagattttccgagggagtatgatggtgcttgtgttcagatgagaatgtcatacagtccagccgctcatctcttcctttttctggtgcaatggactgactgcaaccttgcaggagcccttgggctgttaagaattctaatttacaaggtttatgtggatggctcaaccaccatgtctaccaaggaaaggaaagcaagcatcagagagttctatgctgttatttatccctctttattgcaacttcaaggaggtgtcaccgatagtgaagataaaaggcagaaggcagtgtgcctggaaaggtattgcaaaagagatgatgaggaaagtcgacagtgttcagatatcgacattgaaagagaagaggaatgcggtatatgcatggagacaaatagtaaaattgtattgcccaactgcaaccatgttttgtgcctgaaatgttaccgtgattggcgttcaagatctcagtcgtgccctttctgtcgtgacaatcttaaaagagtgaactcaggcgatctctgggtctacaccgacagcagggacataattgacatggaaacagtgatgacggagaatctcaggaggcttttcacgtatatagataagttgcctcttattacaccggataacccttttgactcgtatgattcccacctaaggtgatcaatgcggtccaaaaccagtcccccgtggcaatttaatggactggtttcctttcttttgattacataaggaccgaaaattcattcggcgggtgtaagatcttcccacttctgttcggaagacccagcctgagttattgtaggctggctggtgaagttgaggagtttataaattgtgtggggtaaatttgtacatgcttgtacagctttgaagttggcttagttttttacatacaagtcctctccttgtttcgaattgagtggtatggacggaggaacggatggaggaactgttcggaagcgggcagagatggaagaacacaatgtggtgagaatttcgagttgatgagaatactgagttcatgtttcttcgtaccaagttgcgaccgatacacccaacacttcgaagatggatgggcgtcaactgtgtttattgttcctgaaataatggacaactgaactggtaagtagactgttgttttactgggcgcgcatgggcctattgttctcatcattttgtttgttagcatatattcattagtgcatgctttgaaacaactaaatgcagtttaagccgtgtttgtcgctcttttggaaaagcgtctattttcaaggggcatttcgatttcaaataagaatcttgtgcttcgataa

SEQ ID NO: 1931 - DNA, 1385 bp, Solanum phureja
aactcttccatttttttctctttcttcattctgtacagtaaaaggagcagagaaaaagaagaacaaacagagtcatcaaaatttggggaaaattcttacaagagaaacgcatagattttgatttgaggaaaaaaaggggtggtgttgaagtggatttgtgatggtaaggagtgtttggttgtgagtaaaattcggttttgtttgggttttgggtggttagagaaaagagcgaaagagaaggaagattggagatatgaatagaggaggaattggaattggagggccaatgcgaaagtcctttaaggactctctcaaagttcttgaagctgatattcagcatgctaatactctggcatctgactttccccgagagtacgatggagcttgcctacagatgagaatgtcctacagtccagcagctcacctattccttttcttagtgcagtggactgattgccaccttgctggtgcccttggattgttgagaattcttatttacaaggtttatgttgatggcaccacaaccatgtcagttcatgaaaggaaagcaagcattagggagttctatgctgttatttatccctccttacttcaacttgaaagaggtgttactgattcagaagacaaaaaacaaaaagcagtttgccaggagagatacaggagaagagatgatgaggattacagacaatcttctgactcggatattgaaagggaagacgaatgtggaatctgcatggaaatgaacagcaaaattgtccttcccaaatgcaatcacgccctgtgtttgaaatgctatcgtgaatggcgttcgaggtcacaatcatgccctttttgccgcgatagccttaaaagggtaaactctggtgatctgtgggtatacatggacaacaaagacatcgtggacatgtcaacgataacaagggagaatctgaggaggctattcatgtttatagataagctacccttgatcgttccagataatgtttttgatcactatgatactcatataaggtagatgaacaatgctttcattgggggggattgatcatactaaagatcaagaaattggtctcgctagatttagaaatgcaggtggattactttatcaccttctgattagaagaacccgaccgagtcatcgtggtgcaggggttgaagccaagttagattagccaaaaaaatggagctttttaattgtacctcctaatttgtacatgcctgtacagttccagtttaacttcttgaaaacacaagtgtacccttttgttgtttgttttctaatcttcaagtatgccataaatgccagcatttgagctttctcaagtgcagagttttatggttgctatttataagagtgtataatatatgatgtacttagataccaa

SEQ ID NO: 1932 - DNA, 1561 bp, Eucalyptus grandis
agaaaagtacacaggaagcaagcagagcgcctgcccggggttccagaaatcacctggtttctggcgatggtcgtttcaagattcctcatttattaaaagggtctttattggttttgaattccttgagagagtgagagagagagagaagggccattttttctgtgtctaaccgggaagagtgcagagaaagcagagtgcgttcccggggttccagaaatcacctggttttggcgatagtcgtttcaagattcctcatttgttagaagggtctttgttgttttgagaattacttgtgtgtgtgtgtgagagagagagagagagagagagggtatttggagatgtacacgggctcgatgaggaagtcgttcaaggactctctgaaggtgctggaggcagacattcagcatgcgaataccctagcatctgattttccaagggattatgacggtgcttctctccaaatgagattgtcatacggtccagctgcacatttctttctttttctagtgcagtgggcagattgtcacttagctggtgcccttgggttgctaagaattctgatttacaaggtctatgttgatggcacgacgaccatgtcaacccatgaaagaaaagctagcatcagagagttctatgcggtaatatatccatcattactgcagcttgaaagaggtgtgaccgatactgaagatagaaggcagaagactacgtgcatggagaggtacaaaaggagagaagaggaggaacataggcagtttgcagatatagaatttgaaaaggaagatgaatgtgggatatgcatggaaatgaatagtaagattgtgctgccaaactgcagccacgtcatgtgcctcaaatgttatcgggagtggcggacaagatctcagtcctgcccgttctgtcggaacaacctcaagagagtaaactcgggcgacctttggatattcatggacagcagggacatagtcgacatgttcaccgtgaccagggagaatcttcggaggctcttcttgtacatagataagttgcctctggtcgaaccagataatctcttggaaacatatgattctcacctaaggtgatcaaagaccgtcggaaccaaaacccatttgtccaaagctcgctctcctcctgcatgtctccttactttttaatccttgatatgagggaaaatttgtaggttgttggttggtcctgcctattaatgtcagaagagccagcctcatttattgtcggctgatgggtgaagttcagaccagagtaggtggttcattagaagttctacaaataatctgcacttaccgattctcacatctgtatatataatttgtaaagattcttagtgggttaagttctgtcttttggtcttcaagagagagagagagagagagagagagggagagagcttttacaagttcagcaatcttgctgtttggctagttcataagtgacatccattcatggaccatgaacatttggcgctacgacatgaatgtggtgatttcctcccgatcagttttacgaaattgtgattataattgcttagtacatgcataaaatt

SEQ ID NO: 1933 - DNA, 1047 bp, Mimulus guttatus
agaagaagacaattccataatatcgaggcccagtctcagtcagatagtcctctctctcgatatacagtgcaacaaagaaatatctgcctgcatatccatctgaattaatcctttaattttaagcttaatcggtgttgaatttgccgataatcaatcatcagtaacggatgattatttgattcctggagaaaaatatatagagaaaaggggggaatttgaatttgttgggagaagagagatgtacgtaagcggcggaggtccaatgcggaagtctttcaaagattcgctcaaacttctcgaagcggatattcagcatgctaatactctggcatctgattttccgagggagtatgatggagcatgtctgcaaatgagaatgtcgtatagtccggcagcacactttttccttttcctcgttcaatggaccgactgtcacctagctggcgctctcggtttgttgagaatcctaatatataaggtttatgttgatggcaccaccactatgtcaactcacgagagaaaagcaagcattagagaattctatgctgttatttatccctctttactgcaacttgaaagaggggtcacagattcggaagataaaaagcagaaagccgtatgcctggaaagatacagaagaaaggatgaagaagagcacaagcaatgctcggatttagatattgaaagggaagacgaatgtgggatttgcatggagatgaatagtaagatagtattgccaaactgtaaccatgccatgtgcctgaaatgctacagagaatggcattcaagatcacagtcatgccctttttgccgtgacagcttaaagagggtaaattcttgtgatctttgggtgtttctggaaaccagggatgctatagacatggtgtctataacgagggagaatttgaagaggctgttcatttatatcgataaattgcctgtcgttgtacccgattccttattcgatgcctatgatactcatgtcaggtaatttaattaactggatgagaaagaaataatctctttatcaaatagatttagaaactt

SEQ ID NO: 1934 - DNA, 1392 bp, Solanum lycopersicum
aagaactcttacatttttttttctctttcttcattctgtacagtaaaagaagctgtgaaaaagaaagaagaaacagagtcatcaaaatttggggaaaattcttacaagagaatcgaatagattttgatttgaggaaaaaaaggggtggtgttgaagtggatttgtgatggtaaggagtgtttggttgtgagtaaaattcgttttttcttttttgggttttgggtggttggagtaaagagcgaaagagaaggaaaattgcaggtatgaatagaggaggaattggaattggagggccaatgcgaaagtcttttaaggactctcttaaagttcttgaagctgatattcagcatgctaatactctggcatctgactttccccgagagtacgatggggcctgcctacagatgagaatgtcctacagtccagcagcgcacctgttccttttcttagtccagtggactgattgccaccttgctggtgcacttggattgttgagaattcttatttacaaggtttatgttgatggcaccacaaccatgtcagttcatgaaaggaaagcaagcattagggagttctatgctgttatttatccctccttacttcaacttgaaagaggtgttacggattcagaagacaaaaagcaaaaagcagtttgccaggagagatacaggagaagagatgatgaggattacagacaatcttctgactctgacattgaaagggaagaggaatgtggaatctgcatggaaatgaacagcaaaattgtccttcccaaatgcaatcacgccctgtgtttgaaatgctatcgtgaatggcgttcaaggtcacaatcctgccctttttgccgcgatagccttaaaagggttaactccagtgatctgtgggtatacatggacaacaaagacatcgtggacatgtcaatgataacaagggagaatctgaggcggctattcatgtttatagataagctacccttgatcgtgccagataatgtttttgatcactatgatactcatataaggtagatgatcaatgcttccattgggggattgaatcatactaaagataaagtaattggtctcgctagatttagaaatgcaggtggattactttatcacctttcctgatttagaagaacccgaccgagtcattgtggtgcaggggttgaagctaagttagataagattagccaaaaaaaaatggagctttttaattgcatctcctaatttgtacatgcctgtacagttccagttttacttcttgaaaacacaattgttgtttgttttctgatcttcaagtatgccatgaataccagcatttgagctttctcaagtgcagagttgtatggttgctatttataagaatgtataatatatgatgtatttagtttcc

SEQ ID NO: 1935 - DNA, 1104 bp, Silene vulgaris
ctattttctagagatagagagagaaagtttgatgttatctgtatttaattatcttctttctgtgtgaattacatgcccatgtcatgaaaagctgagttttttaggatttctgggtgaaaagattgaaactttgttatctgggtaccaaaattcaatcaatttatttattgattggggtttatttattataatacaatttcaaggtggtaatttacgagggtaaaaagggttaatctttaagaaatgtatgttgattctatgcgaaagtccttcaaggattctctcaaagtacttgaagctgatattcagcatgctaatactctggcatctgagctttctagagaatacgatggtgcctgccttcaaatgagaatgtcctatgctcctgctgctcacttcttgcttttcttggtacagtggactgattgtaacctggcgggagctttgggcttgttgagaattctaatctataaggtctatgttgatggcaccactaccatgtcaacacatgaaaggaaagcaagtatacgagagttttatgcggtaatctttccatccctaatgcaacttgaaaatggtattactgatacggaagatagaaaacagaaagctgtttgcatggagaaatatcataaaagagacgaggaggaatgtattcagttctctgatgaggacattgaaagagaagaagagtgtggtatttgtatggaggattgtagtaaaattgtgctgcctaattgcaaccatgtcatgtgcctgaagtgctatcgagactggcggtcacggtcacagtcgtgccctttttgccgagatagtctcaagagggtaaactcgggtgatctctgggtgtatactgacaacaatgacgtggtggatatgaagacattaacgagggagaatcttaggaggctgttcatgtatatagacaagttgcccttgattgttcctgaatcgttattggacgcctatgactcccacctgaaatgacagcgactttgagcccacagtagattagttagagatgcgattgattttgatcttttgcaccgtcatgtcaaaaattgctgccttaactacggtaggcaggaatgaaggatatgtgtt

SEQ ID NO: 1936 - DNA, 1683 bp, Theobroma cacao
attgagcagaatgggctgagcccagagttttctcctcaggctgagccttttttggtgtgagccttgaccatgtggccctaaattctatccaggcccagggttgggatccatgactgaggaccaggcttctgattttccaagggagtatgatggtgcatgcgttcaaatgagaatgtcatacagtccagctgctcacctcttcttatttttggtgcagtggacggactgtcaccttgcaggtgcccttgggctgttaagaatactaatttacaaggtatatgtggatggaactaccaccatgtctacacatgaaaggaaagcaagcataagagagttctatgctgttatctatccctctttactgcaacttcagaggggtgtaactgatactgaagataaaaaacagaaagcagtgtgcatggaaaggtaccgaagaagagaagatgaagagtataggcagcttactgatgttgattttgaaagagaagaagaatgtggaatatgcatggagatgaacagtaaaattgtgctgcctaactgcaaccatgccatgtgcttgaaatgttaccgtgaatggcgctcaagatcgcagtcatgccccttctgtcgcgatagtcttaagagagttaactctggggatctctgggtatttacagacagcagggatataattgacatggccacagtaacgagggagaacctcagaaggcttttcatgtatatagataagttgccactgattgtccctgataccatttttgatacttatgattcccacctacggtgaaaagtacagtctaaactctcttctctatggtctgcgtattatctgctcgttccttttgattacataaagaccaaatcaccaaatcgcttgatttggcaaatttaggtccagctagtatttgcgcagtgctttcttcccacttctcatcagaagaaaccatgcccgagttattgtgggctggtgggtgatgtcgaagtagttcatgtaggagcccataaattgtatttagtacatttgtacatgcttgtatagcctaaagtttgatgatgcaaaagtccttgctggaatcaggtcctgccttatctgcttctactactggtttttgtgctaacttcctttgaactttgtatgaatcatttcaaaaattactaataaaataattcctgaagatatgctcaacagaaggtgaggttgcttgaatcttcgtctgcatattgcatgattgcatcaagtgatcacatgatctgttgttactatctcttactgaggtttgagcatgattttcaatgtttatacatataataattgaaaccatgaaccagcccctggttttgacatgccaatctttcaagcacacttggcagtttgcccttcgttcttttcttttcctttagtctcgcccccttactttttgggaaaatggcacttcttttaaggacatgacagcctggctggtatgagtactagcatttttagccagccattaccaaagatcttgtaaactactgattatgacaccggtctctgtttctgtagataatgaatgaacctaggatcattaataaatgtggtatccttaatttttttttctatttttttattaattattttattaaatcaggaagattggtttgaacaacagtaatatactatcaaaataaaaaaaaagtagaatc

SEQ ID NO: 1937 - DNA, 1415 bp, Tropaeolum majus
accacgaagaactcaccccacaaacccactttaagaagattttttttcctgtattgaagaacaaccagattagggtttttcgttgtaactcaatattttgtttcttcaggatttgaagttcatttcgataaggatgtacttaaactctatgcgaaagtcgttcaaggattctctcaaagttcttgaggcagatattcagcatgctaatactctggcatccgaatttccaagggagtatgatggtgcctgcctacaactgagaatgtcatacagttcagctgcccacctgctcctcttttggtgcaatggacagactgcaatcttgctggagccctcggacttctacgaatactaatttataaggtttacgtggatggcacaacaaccatgtctacccatgaaagaaaagcaagcatcagggagttctatgctgtgatatatccctctttgctgcaacttcaaagtggcattactgataatgaagataaaaaacagaaggcagtctgcttggaaaagtacagaagaagtgaagatatatatcatggactagacacggatttggatgatgaaagagaagaggaatgtggaatatgcatggagatgaacagcaaaatcgttttaccgtactgcaaccacgcaatgtgtttgaagtgttatcgagaatggggatcaagatctcaatcctgcccattttgtcgagacagtctgaaacgagtgaactccggtgatctttgggtttatacagacggtagggacataatcgacacggaaacggtgacaagggagaatctcaggaggctcttcatgtatatcgataagttaccactgattgttcctgatcatctttttggcagttatgatccccatttcagatgaaagctttcagtaacaaagcacaaatggccttttgagtgagtagtaagtaaaagcttccttccactcatttccttactcgcaaaaaaggccgaatcccgaaacccaattcgggaaaaaaaaatagattagcatgaaaatgaagtatttgcttcccgcttctaacgaggagaaacacagcccaccccctgctgatgggtgaagttagatcctaacccaagggttccataaaatttgtatttagcacaactgtaaatgtttgtatagtgcctcttgtcgcgtactaatagttgtcgaaaatctcttttctttttctttgataaggctatggtaacgtttcttaataactgagcaaatggtaatggtaaattgataatgtatcatgtattttttaagagtttaccatgccgcgagcccagtcgaatatgttatatcgataaagttagtcgttatactctgtacatagttatactatgttcttctctaagggtttaattagtggtggattatctgatttacgtctaggttcaataacccggccg

SEQ ID NO: 1938 - DNA, 1150 bp, Orobanche aegyptiaca
tccagaaatatctcatcaataaatctattttttttaaaattttccgattatcatcgaacggatgattattattattatttgattgtcgaaaatacaggggaaggaagaggatatgcacatgagcggcggcgccggaggtcctatgcggaagtctttcaaagactcgctcaaagttttagaagccgatattcagcatgctaatactctggcatctgatttttcccgggagtacgatggggcatgtctacaaatgagaatgtcatacagtccagctgcacattttttcctttttctcgttcagtggactgattgccaccttgctggcgctctcgggctgttgagaattttaatttataaggtgtatgttgacggcaccacaactatgtcaactcatgagagaaaagcaagcattcgtgaattctatgctgttatttatccatctctattgcaacttgaaagaggtgtcacggattcggaagataaaaagcagaaagctgtctgcctggagagatacaagagaaaggatgaggaagaacataggcattgctcggagttagacattgaaagggaagaagaatgtgggatttgcatggagatgaacagcaagatagtcttgccaaactgtaaccatgccatgtgcctgaaatgctacagagaatggcgttcaagatcacaatcatgccctttctgccgtgacagcttaaagagggtagactcttgtgatctatgggtatttcttgacggcagggacgttatagacatgacagctataacaagggagaatttaaagaggcttttcttgtacatagataagctaccccttgttgtccccgataccctatttgatgcctatgatacccatgtgaggtgaaattaactttgccttgattctggatcttcttcattctcagctgaggagcaagaactgacctctcttaaattagatttaggaagaaaaataacttcaagtggttagttctgcttttgattaggtaaaaaaaaaaccctgccttgattgtttgggctgaggtttaagttatacagagtgaaatgggacggtgtaactgtcgtatgtatgtgggaatttgtatatagttgtacagtttgaagtctgcttagtaaagctaaaatgaaatttgaattgtgggtc

SEQ ID NO: 1939 - DNA, 998 bp, Coffea canephora
gcggaagccctttaaggattctctcaaagttcttgaagctgatattcagcatgccaatactctggcttcggattttccacgggagtatgatggtgcttgcctgcagatgagaatgtcctacagtccagcagcacacctgttccttttcctggttcagtggactgactgtcacctagctggtgctcttggcctgttaagaatcttgatttataaggtttacgtcgatggcaccacaacaatgtccactcatgaaaggaaagcaagcattagagaattctatgctattatctatccctcattaatgcaactccagaggggggtaaccgattcagaagacaaaaagcaaaaagcagtgtgcttggaaagatataaaagaagagatgaagaggaacaccggcaaatttcggagctagaagttgaaagggaggaagaatgtggtatttgcatggagatgaacagcaaaatagtcttgcccaactgcaaccatgccatgtgcatgaaatgctaccgtgaatggcgtttaaggtcacaatcgtgccccttctgccgtgatagcctgaagagggtcaactcaggtgatctctgggtgcttatggacagcaaggatgtcgtggacatggctaccataacaagggagaatctgagaaggctctttatgtatatagataagttgcctcttgttgttccggataacctttttgacacttacgataatcatttaaggtaggcaaaagggttttgtctgagcggtctcctgaagtgctgctgtgtctctgggtgttctaaaccctataataacttcttcaactagattagaaatgcactggtttccttccacctttaagttgacaaaccccgcctgtattagtaggctgtgggtgaatttaagttagaatagctagaagaggcttataaattgtatgtagcaaaatcgtatatatgtacagctcaaagactcggttaaacagtcctttatatcattggatattcttccctgc

SEQ ID NO: 1940 - DNA, 1246 bp, Triphysaria pusilla
aaaatttaaagagggtgtcagtctaagtcagagagtcatctttttgaatttctctaggtagaaccagaaaattaaaataaaaaaaaaatctggaaacccagaagcatctattgatcactctaaatcccttttctgattttactttcaatttaaattatcatcggttcagatgattatttgattctggaaaaatagggcaaaaatactttttttttgttgttgaagaagagatgtacgttagcggcggcggaggccctatgcgaaagtccttcaaggactcgctcaaacttcttgaagccgatattcagcacgcaaataccctggcgtctgatttttcccgagaatacgatggtgcgtgtttacaaatgagaatgtcgtatagcccagcagcacactttttcctttttcttgttcagtggactgattgcaacctggctggcgctctcgggctgctaagaatcctaatttataaggtgtatgttgatggcaccacaactatgtcaactcatgaaagaaaagcgagtattcgtgagttttatgctgttatatatccgtctttgatgcaactcgaaagaggtgttacggattcggaagataaaaagcagaaagcagtgtgcttagagaggtacaggagaaaggatgaagaagaacagaggcaatgcttggagttggatattgaaagggaagatgaatgtgggatttgcatggagatgaacagcaagatagtcttgccaaactgtaaccatgtcatgtgccagaaatgctacagagaatggcgtacaagatcacaatcgtgccctttttgccgtgacagcctaaagagagtaaactctggtgatctatgggtgtttatcgatggcagggacgctatagacatgatgactataacgagggataatttgaagaggctgttcatgtacatagataaactgcctctcgttgtccccgatgacctattcgatgcatatgatacgcatgtgaggtaaataaacttgtgttgtggcagagagaatgtgggttgttcttgtgttcgggtttactgagaacaagaaagagtatcttaaattagatttagtagtagaaaaaaaaaactcggaagtggttcgtttcgcttctgattaggaaaaagcccagcctttattttggttgaggttttagtttagagaggaaactggggaatgtgacgtaagctaaatgtatgtggaaacttgtatatatgcttgtaaagtgttaaagtctgcttagt

SEQ ID NO: 1941 - DNA, 912 bp, Ananas comosus
aggcgggcgatttagggtttcgatcgatcgcttgatgagtagttgcggctccgtagcgggagatgttcttcgtttccatgcgcaaatcgttcaaggactccctcaaggtcctcgaagccgatatccagcacgcgaactcactggcttcggatttcccaagagaatatgatggagcttgccttcagatgcggatgtcctacagccccgccgcacacttgttccttttcctggtgcagtggactgattgtagccttgccggggctctcgggctgttgagaatcctaatttacaaagtttatgtagatggaacaaccaccatgtcgacccacgaaaggaaagcgagtattagggaattttatgctgtgatattcccctcgctgatgcaattacataaagggataaatgatatggaggataagaagcagaaggccgtgtgtatcgagagatatcgaagaagagacgaggatgagaggtggcatttctcggagatcgatgttgagagagaggacgaatgtgggatctgcatggagacgaacagcagggtcgtgctcccaaactgcagtcatgctatgtgcatgaagtgctacagagagtggcgttcacggtcgcaatcgtgcccgttctgccgcgacagcttgaagagagtaaactcgggcgatctatggatattcactgatggcagagacataatcgacatggcgacagtgacgagggagaatctgcggcgtctcttcatgtacatcgacaagctccctgtcgtcatcccagactctgtattggattcctatgattctcatgtaaagtgaccgggacgagtatcatatgacttcctcctcgtcgtaactcagaaacaattctttcagcaagtttctgctatctgattggcggaagttcctctggagctgctgctaa

SEQ ID NO: 1942 - DNA, 1835 bp, Trigonella foenum-graecum
caattggtctcattgttggttattttctcttcatttacttccaacctacagatgttgaggatcctaaaattacgccaatagtcgaccaagatgacgagactttgcaaaaaatgcttcctgagattcccaattggattaaaaatcctgactttgataggattgattggttgaacaagtttatagagcttatgtggccttatcttgataaggcaatttgcaagactgcgaagaacattgcgaaacccataattgaagagcagattccgaagtataaaattgattctgttgagtttcagacgctcactcttgggaccctgcccccaacttttcaaggaatgaaagtttatgtgactgatgagaaggagttgattatggagccttctataaaatgggctggaaatcctaatgtcaccattgctgttaaggcatttgggttgaaagcaaccgttcaggttgtggatttgcaagtttttcttttgcctcgcattactttgaagcctttggttccaagctttccttgctttgccaacatctatgtctctctaatggaaaagccacatgttgactttgggctaaagcttgtaggggcagatcttatgtctattcctggtgtctacaggattgttcaggaacttatcaaagatcaggttgcaaacatgtatctgtggcccaaaaacctggaagttcaaatattagatatggcaaaagctttgaggaggcccgttggaattttacatgtaaaggttgtgcaagccatgaagttaaagaagaaagatcttctcggtgcatctgatccttacgttaaactaaagcttaccgacgataagatgccatcaaaaaagactactgtaaagcacaagaacttaaatcctgaatggaatgaagaatttaatttggttgtcaaagatccagagacccaggttttacagctcaatgtttatgactgggagcaggttgggaagcatgacaagatgggtatgaatgtgatcactttaaaagaagtttcccctgaagagcctaaacgttttactctggaccttctaaaaactttggaacccaatgacgctcaaaatgagaaatcgcgaggacagattgttgtggaattgacttataaacccttaaatgaagaggagatgggcaagggctttgatgagacacagacaatacctaaagctcctgaaggcactccagctggtggaggtcaacttgtagttatagtccatgaagctcaagatgttgaagggaagcaccacactaatccacaggcacgtcttattttcagaggggaagagaaaaagactaagcgcatgaaaaagaacagagatccaagatgggaagatgagttcaaatttacagcagaggagcctcccaccaatgataggctacatgtcgaggttgtcagcacttcatcacgaaacttgctccatcaaaaggaatcgctgggttatgtcgacatcaatctcggagacgttgtttctaacaagagaatcaacgagaagtaccaccttatagattctaagaatgggcgcattcaggtagagttgcagtggagaactgcataagcacagtgatgaaattctccatacatatgtactcttgatttcaaccccacccctaaaaccatctgttaaaatttagcctcttccatgcagtgtaaggaaacagtgagaagacctttcttgtattcttgtgagatagaccgattttatttgtcaatcatgtacatgctgtgataaaaaaaaaggtttgtttgaaatagcaaaaaacatatttgttttgatttggataatatgacatgatcaaagacgacctttaagggttttggtcccgtggat

SEQ ID NO: 1943 - DNA, 2002 bp, Cajanus cajan
gcagtggtatcaacggcagatacgggggggacactaactgagtaggaatgaagtagtgaagacaaatcgcgatctggattgggtgtagctgagagatcgagttgagatgggtttcttcagttaccattttggggtttttcggatttggggttgggatttcgattggtcttgtggccggctattttctctttatctactttcaacccaccaatgttgaggatcctgaaatcaagccactggtggagcacgaccaagagactttgcaacaaatgtttccggagataccactctggataaagaatccggactttgatcggcttgactggctgaacaggtttttagaatatatgtggccgtatcttgataaggcaatttgcaagactgcgaggaacattgcaaaacccattatcgctgagcagattcctaaatataaaattgattcggtcgagtttgaaacactcacactggggtctctgccgccaacttttcaaggaatgaaggtttatgtgactgatgagaaggagttaattatggagccttctgtaaaatgggctggaaatcctaatgtcactatttctgttaaggcctttgggttgaaagcaactgtgcaggttgtggatttgcaagttttccttttgcctcgtattactttgaagcctttggttcctagctttccttgctttgccaacatatatgtctctctcatggaaaagccacatgttgactttggactaaagctcataggggctgatcttatgtctattccgggcatctataggattgttcaggagcttatcaaagatcaagttgcaaacatgtatctttggcccaaaaccttggaggttccaatattagatatgtcaaaagccttgaagaggcccgttggaattttacatgtaaaggttctgcatgcaatgaagttaaagaagaaagatcttcttggtgcatccgatccttatgtgaagctaaagctttctgaggataaattgccatcgaaaaagactactgtgaagcacaagaacttaaatcctgaatggaatgaagaattcaatatggttgttaaagatccagaatcccaggttttagagattaatgtttatgactgggagcaggttgggaagcatgacaagatgggtatgaatgtgattcctttaaaagaagtttcccccgaagagcctaaacgtttcactcttgatctcctaaaaaatatggatcccaatgatgtccaaaatgagaagtcacgagggcagattgttgtagaattgacatataaacccttcaaggaggaggatttgggcaaggggtttgaagagacacagacagttccaaaagctccagaaggtactccagctggtggaggtttgcttgtagttatagtccatgaagctcaagatgttgaaggaaagtatcacactaatccacatgtacgccttattttcagaggggaggagaaaaaactaagcgcattaaaaagaacagagatccaagatgggaagacgaattccattttacggtggaggagcctcccaccaatgatagattacatgtggaggttgtcagcacttcgtcacgaaacctgctccaccaaaaggaatcattgggttatatcgacatcaatcttggggatgttgtcgccaacaaaagaattaacgagaagtatcatcttattgactccaagaatggtcgcctccagatagagttgcagtggagaacctcggaagcatgaatgatgatttaattttccatcgatgtgtacttctgtttcctttttccctcccccttcccttcttttaaaattgtcttccatcgagtgtaaggaaatcgtgagaagggtatttcttgtattcttctcgtgagatatattggttttatttgtcaatcatgtacatgtttgtgataaaaatgtttgaaatagcaaaagcatagatatgatttggcttggattatatgcatttacatttatttggtacggttaaagacgacctatatgatgcttatccag

SEQ ID NO: 1944 - DNA, 2046 bp, Glycine max
aaacgatcttttcctcacttttttcttcttctttaaaataattgatctcttgaaaaaataaaaataaaaataaaattacactgaactgagtagaggaatggtgtagtagtggagagaaatcgcgatctggaatagggtttagctgaaagatcgagttgaaatgggtttctttggtaccattttggggtttttgggatttggggttgggatttcgattggtctcgtgtctgggtactttctcttcatctacttccaacccaccaatgttgaggatcctgaaatcaagccattgtcggagcaagagcaagagactctgcaacgaatgtttccagagattcctctttggataaaaaatccggattttgatcggcttgattggctgaacaagtttgtagaatatatgtggccgtatcttgataaggcaatttgtaagactgcgaaaaacattgcaaaacccataattgccgaacagattcctaaatacaaaattgattctgttgagtttgaaacactcacattggggtcgctgccaccaacatttcaagggatgaaagtttttgtgactgatgagaaggagttaattatggagccttctgtaaaatgggctggaaatcctaatgtcactgtttctgttaaggcatttgggttgaaagcaactgtgcaggttgtggatttacaagttttcctcttgcctcgcattactttgaagcctttggttcctagctttccgtgctttgccaacatatacgtctctctcatggaaaagccacatgttgactttgggctaaagctcataggggctgatcttatgtctattccgggagtctacaggattgttcaggagcttatcaaagatcaggttgcaaacatgtatctatggcccaaaaccttggaagttcaagtgttagatatgtcaaaagccttgaagaggcctgttggaattttacatgtaaaggttctgcaagcaatgaagttaaagaagaaagatcttcttggtgcatctgacccttatgtgaagctaaagcttactgaggataaattgccatcaaaaaagactactgtgaagcacaataacttaaatcctgaatggaatgaagaattcaatatagttgttaaagatccagactcccaggttttagagattaatgtttatgactgggagcaggttgggaagcgtgacaagatgggtatgaatgtgatccctttaaaagaagtttcccctgaagagcctaaacgttttactcttgacctcctaaaaaatatggatcctaatgatgcccaaaatgagaagtcacgagggcagattgttgtagaattgacatataaacccttcaaggaggaggatttgggcaaggggtttgaagagacacagacagtaccaaaagctcctgaaggtactccagctggtggaggtttgcttgtagttatagtccatgaagctcaagacgttgaaggaaagtatcacactaatccacatgtacgccttattttcagaggggatgagaaaaaaaccaagcgcattaaaaagaacagagatccaagatgggaagatgagttccagtttatggtggacgagcctcccaccaatgatagattacatgtggaggttgtcagcacttcatcacgaaacctgctccaccaaaaggaatcattgggttatatcgacatcaatcttggggatgttgttgccaacaaaagaatcaatgagaagtaccatcttatagactccaagaatggtcgcctccagatagagttgcagtggagaacctcggaagcatgatgattaaattctccatagatttgtacttctgtttcctttctccccgtctttccttttttaaagattgttttctatgcagtgcaaggaaaatgtgagaaaagggtatttcttgtgctcttgtgaaatatattgattttatttgtcaatcatgtacatgtttgagataaaaaggtctgaaatagcaaaagcatagatatgatttggttttgattatatacatttaccttacttggtatcattatagacgacctatatgatacgtatgc

SEQ ID NO: 1945 - DNA, 2035 bp, Glycine max
gctttgctttctgtttccgtctctcgccgttcaattgcttcgtctttggtcttcaaccgtttcaataacctgcccccacctcagctataaggacaaaatctctaacgattttttttccttactttaaaataattgatctattgcgataaaccgagtagaggaataatggtgtagtagtagtggagagaaatcgcgatctggaacagagtttagctgaaagaaaaagaatcgagttgaaatgggtttctttggtaccattttggggtttttgggatttggggttgggatttcgattggtctcgtggctggctactttctcttcatctacttccaacccaccaatgttgaggatcctgaaatcaagccattggcggagcaagagcaagagactctgcaacgaatgtttcccgagattcctctttggataaaaaatcccgattttgatcggcttgactggctgaacaagtttgtagaatatatgtggccgtatcttgacaaggcaatatgcaagactgcgaagaacattgcaaaacctataattgctgagcagattcctaaatacaaaattgattccgttgagtttgaaacactcacactggggtcactgcctccaacatttcaaggaatgaaagtttatgtgactgatgagaaggagttaattatggagccttctgtaaaatgggctgcaaatcctaatgtcactgtttctgttaaggcatttgggttgaaagcaactgtgcaggttgtggatttgcaagttttccttttgcctcgtattactttgaagcctttggttcctagctttccttgctttgcgaacatatacgtctctctcatggaaaagccacatgttgactttgggctaaagctcataggggctgatcttatgtctattccgggggtctataggattgttcaggagcttattaaagatcaggttgcaaacatgtatctatggcccaaaaccttggaagttcaagtgttagatatgtcaaaagccttgaagaggcctgttggtattttacatgtaaaggttctgcaagcaattaagttaaagaagaaagatcttcttggtgcatctgacccttatgtgaagctaaagcttactgaggataaattgccatcgaaaaagactactgtgaagcacaagaacttaaatcctgaatggaatgaagaattcaatatggttgttaaagatccagactcccaggttttagagattaatgtttatgactgggagcaggttgggaagcatgacaagatgggtatgaatgtgatccctttaaaagaagtttcccctgaagagactaaacgtttttctcttgacctcctaaaaaatatggatcctaatgatgtccaaaatgagaagtcacgagggcagattgttgtggaattgacttataaacccttcaaggaggaggatttgggcaaggggtttgaggagacacagacagtaccgaaagctcctgaaggtactccagctggtggaggtttgcttgtagttatagtccatgaagctcaagacgttgaaggaaagtatcacactaatccacatgtacgtcttattttcagaggggaggagaaaaaaactaagcgcattaaaaagaacagagatccaagatgggaagatgagttccaatttatggtggaggagcctcccaccaatgatagattgcatgtggaggttgtcagtacttcatcaagaaacctgctccaccaaaaggaaccattgggttatatcgacatcaatcttggggatgttgttgccaacaaaagaatcaatgagaagtaccatcttatagactccaagaatggtcgcctccagatagagttgcagtggagaaccttggaagcatgatgattaaattctccatagatttgtacttctgtttctttctccccttctttcctttttaaaaatttgttttccatgcagtgtaaggaaaaggtgagaagggtatttcatgtgttcctgggatatatattggttttatttgtcaatcatgtacatgtttgagataaaaaggtttgaaat

SEQ ID NO: 1946 - DNA, 1945 bp, Phaseolus coccineus
caccgatttcttctaaatttttgtttgcgttagctcagtagttgtagcagtaatggtgaagtagaggagaggaatcgcgatctgggacacggtgtagctcaaagaataaggatcgagttcagatgggtttcttcagtgccattttggggtttttcggattcggggttggaatttcgattggtcttgttgccggctattttctcttcatctactttcaacccactgatgttgaggatcctgaaatcaaaccattggtggagcaagagcaagagactttgcagcggatgtttccagagattcctctctgggtaaaaagtccggatttcgatcggcttgactggctcaacaaatttttggagtatatgtggccgtatcttgataaggcaatttgcaagactgccaagaacattgcaaaacccataattgctgagcagattcctaaatataaaattgattctgtagagtttgaaacactcacgctgggttcactgccgccaacttttcaaggaatgaaagtttatgtcactgatgagaaggagttaattatggagccttctgtaaaatgggctggaaaccctaatgtcactgtttctgttaaggcatttgggttgaaagcaactgtgcaggttgtagatttgcaagttttcctattgcctcgcgttactttgaagcctttggttcctagttttccttgctttgccaacataaatgtctcccttatggaaaagccacatgttgactttgggctaaagctcataggggctgatcttatgtctattccaggcgtctataggatcgttcaggatcttatcaaagatcaggttgcaaacatgtatttatggcccaaaaccttggaagttccaattttagatatgtcaaaagccttgaggaggcccgttggaattttacatgtaaaggttcttcatgcaatgaagctaaagaagaaagatcttcttggtgcatctgacccttatgtgaagctaaagcttactgatgataaattgccatcgaaaaagactagtgtgaagcacaagaacttaaatcctgaatggaatgaagaatttaatttgattgttaaagatccagattcccaggttttagagattaatgtttatgactgggagcaggttgggaaacatgacaagatgggtatgaatgtggtatctttaaaagatgtttcccctgaagagcctaaaagttttactcttgacctcctaaaaaccatggatcccaatgatgtccaaaatgagaagtcacgtgggcagattgttgtagaattgacatataaacccttcaaggaggaggatttggccaaggggtttgacgagacgcagacagtgccaaaagctcctgaaggtaccccggaaggtggaggtttgcttgtagttatagtccatgaagctcaagatgtcgaaggaaagtatcacactaatccacatgtacgacttattttcagaggggaggagaaaaaaactaagcgcattaaaaagaatagagatccaagatgggaagacgagttcagttttatggtggaggagcctcccaccaatgatagattacacgtggaggttctcagcacgtcatcacgaaaccttctccaccaaaaggaaactttgggttatatcgacatcaatcttggggatgttgttgccaacaaaagaattaacgagaggtaccatcttatagactccaagaatggtcgcctccaggtagagttgcagtggagaacctcacaagcatgatgaaataattctccatcaatttgtatttctgattcctttctccgccctcctttcattttaaaattgtctcgtgagatatattggttttatttgtcaatcatgtacatgtttgtgaaaaaggtttgaaatagcaaaagcataaatacgatttggtttggagtataatatacgtttacattatttgtttgtagaccacctattta

SEQ ID NO: 1947 - DNA, 2040 bp, Citrus clementina
tttgctttctccgtcggcacgctgctgcctctcaactctcctcgttgcttcaactcttcctttccttctatgattctttcgtcggcaaagttacaaaaggctgtttggataccgagaaaattaaccgagaaagtgagaaatgggagttatcagtacaatcttcggtttttgtggatttggcgtcgggatttcgtcggggcttgtgattggttacttccttttcatctactttcaaccaaccgacgtgaagaatcctgagattcgcccgttggttgagcgagattctgagactctgcagcagatgcttccagagatacctctttgggtgaaatgtcccgactatgatcgcgttgattggctgaataagttccttgaattaatgtggccttatcttgacaaggctatttgtaagactgcgaagaatattgcaaagcctataattgcagaacaaattcctaagtataaaatcgagtctgttgaatttgaaactcttacattagggactctaccaccaacttttcaaggtatgaaagtttatgtcactgatgagaaggagttgattatggaaccatgcttaaagtgggctgcaaatcctaatgtaaccattggtgttaaagcatttggtttgaaggcaacagttcaggtggtggatttgcaagtttttgctcaaccacgcattactctgaagcccttggtccctgcttttccttgttttgcgaatatttatgtgtctctcatggagaagcctcatgttgactttggactgaagctagtaggggctgatcttatgtcaattcctggtctctataggtttgttcaggagcttatcaaaactcaggtggccaacatgtacctgtggcccaaaaccctagaagtaccaattttggatccatccaaagcttaccggagacctgttggaattctccatgtgaaggttgtgaaggcaatgaatctgaaaaagaaagatcttctgggtgcatcagacccttacgtgaaactaaagatcaccgaggataagcttccatcaaagaaaaccactgtgaagcacaagaacttgaaccctgaatggaatgaggaatacaattttactgttagagatccagagtcccaggctgtagagcttgctgtttatgactgggagcaggttggcaaacatgacaagatgggcatgaatgttgttcctttgaaagaacttacccctgaagagcccacagttaagactcttgaccttctcaaaaacatggatttgaatgatggtcaaaatgagaagtcgcgtggacagcttgtggtggaattcatgtataaaccatttaaagaagaggacttaccaaaaagttttgaagagtcgcagacggtgcaaaaggctcctgaaaatacaccagctggtggaggtttgcttgtagttatagtccatgaagctcaagacgtggaaggcaagcaccacactaatccttatgcacggattcttttcagaggggaggagagaaaaactaagcatgtaaagaagaatagagatcccagatgggaggaggagtttcaatttatgctagaggagcctcccactaatgatagactacacgtggaagtttgcagtgtctcatcaaggattggactgctgcatccaaaggaaacgctaggatatattgacatcaatctttcagatgttgttagcaacaagcgaatcaatgagaagtaccacctcattgactcgaagaacggacgaatccagatcgagttgcaatggcgaactgcataaacatatgatctccttttcttcttccttttattagatactgcctgtaagtttacttcagtctgttgggtacagaaaacgctatcttgcgccattgtcttgaaggatctctttgtttgttgtttttgtaaatgtgtgtaaaaaattatattaatctcacacagaataatacactgtgattttagacgctggttcaatgatctttaatttgaggagattaatatttggtttgttcgttaaagttataaaccggtgacattgattaaaaataaaaataaactttactg

SEQ ID NO: 1948 - DNA, 2040 bp, Citrus sinensis
tttgctttctccgtcggcacgctgctgcctctcaactctcctcgttgcttcaactcttcctttccttctatgattctttcgtcggcaaagttacaaaaggctgtttggataccgagaaaattaaccgagaaagtgagaaatgggagttattagtacaatcttcggtttttgtggatttggcgtcgggatttcgtcggggcttgtgattggttacttccttttcatctactttcaaccaaccgacgtgaagaatcctgagattcgcccgttggttgagcgagattctgagactctgcagcagatgcttccagagatacctctttgggtgaaatgtcccgactatgatcgcgttgattggctgaataagttccttgaattaatgtggccttatcttgacaaggctatttgtaagactgcgaagaatattgcaaagcctataattgcagaacaaattcctaagtataaaatcgagtctgttgaatttgaaactcttacattagggactctaccaccaacttttcaaggtatgaaagtttatgtcactgatgagaaggagttgattatggaaccatgcttaaagtgggctgcaaatcctaatgtaaccattggtgttaaagcatttggtttgaaggcaacagttcaggtggtggatttgcaagtttttgctcaaccacgcattactctgaagcccttggtccctgcttttccttgttttgcgaatatttatgtgtctctcatggagaagcctcatgttgactttggactgaagctagtaggggctgatcttatgtcaattcctggtctctataggtttgttcaggagcttatcaaaactcaggtggccaacatgtacctgtggcccaaaaccctagaagtaccaattttggatccatccaaagcttaccggagacctgttggaattctccatgtgaaggttgtgaaggcaatgaatctgaaaaagaaagatcttctgggtgcatcagacccttacgtgaaactaaagatcaccgaggataagcttccatcaaagaaaaccactgtgaagcacaagaacttgaaccctgaatggaatgaggaatacaattttactgttagagatccagagtcccaggctgtagagcttgctgtttatgactgggagcaggttggcaaacatgacaagatgggcatgaatgttgttcctttgaaagaacttacccctgaagagccctcagttaagactcttgaccttctcaaaaacatggatttgaatgatggtcaaaatgagaagtcgcgtggacagcttgtggtggaattcatatataaaccatttaaagaagaggacttaccaaaaagttttgaagagtcgcagacggtgcaaaaggctcctgaaaatacaccagctggtggaggtttgcttgtagttatagtccatgaagctcaagacgtggaaggcaagcaccacactaatccttatgcacggattcttttcagaggggaggagagaaaaactaagcatgtaaagaagaatagagatcccagatgggaggaggagtttcaatttatgctagaggagcctcccactaatgatagactacacgtggaagtttgcagtgtctcatcaaggattggactgctgcatccaaaggaaacgctaggatatattgacatcaatctttcagatgttgttagcaacaagcgaatcaatgagaagtaccacctcattgactcgaagaacggacgaatccagatcgagttgcaatggcgaactgcataaacatatgatctccttttcttcttccttttattagatactgcctgtaagtttacttcagtctgttgggtacagaaaacgctgtcttgcgccattgtcttgaaggatctctttgtttgttgtttttgtacatgtgtgtaaaaaattatattaatctcacacagaataatacgctgtgattttagacgctggttcaatgatctttaatttgaggagattaatatttggtttgttcgttaaagttataaaccggtgacattgattaaaaataaaaataaactttactg

SEQ ID NO: 1949 - DNA, 1963 bp, Citrus sinensis
  misc_feature (1962)..(1963): n is a, c, g, or t
cgttgaacagttacaaaaggctgtttggataccgagaaaattaaccgagaaagtgagaaatgggagttatcagtacaatcttcggtttttgtggatttggcgtcgggatttcgtcggggcttgtgattggttacttccttttcatctactttcaaccaaccgacgtgaagaatcctgagattcgcccgttggttgagcgagattctgagactctgcagcagatgcttccagagatacctctttgggtgaaatgtcccgactatgatcgcgttgattggctgaataagttccttgaattaatgtggccttatcttgacaaggctatttgtaagactgcgaagaatattgcaaagcctataattgcagaacaaattcctaagtataaaatcgagtctgttgaatttgaaactcttacattagggactctaccaccaacttttcaaggtatgaaagtttatgtcactgatgagaaggagttgattatggaaccatgcttaaagtgggctgcaaatcctaatgtaaccattggtgttaaagcatttggtttgaaggcaacagttcaggtggtggatttgcaagtttttgctcaaccacgcattactctgaagcccttggtccctgcttttccttgttttgcgaatatttatgtgtctctcatggagaagcctcatgttgactttggactgaagctagtaggggctgatcttatgtcaattcctggtctctataggtttgttcaggagcttatcaaaactcaggtggccaacatgtacctgtggcccaaaaccctagaagtaccaattttggatccatccaaagcttaccggagacctgttggaattctccatgtgaaggttgtgaaggcaatgaatctgaaaaagaaagatcttctgggtgcatcagacccttacgtgaaactaaagatcaccgaggataagcttccatcaaagaaaaccactgtgaagcacaagaacttgaaccctgaatggaatgaggaatacaattttactgttagagatccagagtcccaggctgtagagcttgctgtttatgactgggagcaggttggcaaacatgacaagatgggcatgaatgttgttcctttgaaagaacttacccctgaagagcccacagttaagactcttgaccttctcaaaaacatggatttgaatgatggtcaaaatgagaagtcgcgtggacagcttgtggtggaattcatatataaaccatttaaagaagaggacttaccaaaaagttttgaagagtcgcagacggtgcaaaaggctcctgaaaatacaccagctggtggaggtttgcttgtagttatagtccatgaagctcaagacgtggaaggcaagcaccacactaatccttatgcacggattcttttcagaggggaggagagaaaaactaagcatgtaaagaagaatagagatcccagatgggaggaggagtttcaatttatgctagaggagcctcccactaatgatagactacacgtggaagtttgcagtgtctcatcaaggattggactgctgcatccaaaggaaacgctaggatatattgacatcaatctttcagatgttgttagcaacaagcgaatcaatgagaagtaccacctcattgactcgaagaacggacgaatccagatcgagttgcaatggcgaactgcataaacatatgatctccttttcttcttccttttattagatactgcctgtaagtttacttcagtctgttgggtacagaaaacgctatcttgcgccattgtcttgaaggatctctttgtttgttgtttttgtacatgtgtgtaaaaaattatattaatctcacacagaataatacgctgtgattttagacgctggttcaatgatctttaatttgaggagattaatatttggtttgttcgttaaagttataaaccggtgacattgattaaaaataaaaataaactttactggnn

SEQ ID NO: 1950 - DNA, 1637 bp, Manihot esculenta
atggggtttttcagtacaattttcggtttctgtggatttggagttggaatttcaatgggtcttatgatcggatactaccttttcatatatttccaacccagcgacgatcctgagattcgtccattggttgagcaagactcagaaactttgcaacgcatgcttccagagatacccctgtgggtgaaaaatccagattatgatcgtattgactggcttaacaagtttcttgagtatatgtggccttacctggacaaggccatttgtaagactgtaaagaatattgcagcacccattattgctgagcagatccccaaatataaaattgattcagttgaatttgaaacacttacgctaggatccctaccaccaactttcacaggaatgaaagtttatgtcactgatgaaaaggagctgataatggaaccatgcttcaaatgggctggaaatcctaatgtcactgttgctgttaaagcttttgggttgaaagtaactgctcaggtgctggatttgcaagtttttgctttaccacgtataactctgaagcctttggttcctagttttccttgttttgccaaaatctatgtgtctcttatggagaagccacatgttgactttggactaaagcttgttggagctgatctcatgtcaatacctggcctctacagagttatccaggagattatcaaagatcaggttgccaacatgtatctgtggccgaaaaccctagaagtacagataatggatcctacaaaagccttgaagaagcctgtgggaattctcagcgtgaaagtgctgagggcactgaagctgaagaaaaaggatctgctgggtgcatcagatccttatgtcaaaataaagttgaccgaggataagcttccatcgaagaagacaactgtaaaacacaagaacttgaaccctgaatggaatgaggaattcaatttggttgttaaagatccagagacccaggctgtagagttccatgtttatgattgggagcaggttggcaaacatgataagatgggtatgaaagtagttcctctaaaagaactcccccctgaggagccaaaatttatgactcttgacctacttaaaaatatggatatgaatgattctcaaaatgagaagtcacgtgggcagctagaggttgagttaacatataaaccattcaaagaggaggagatgcctagtggttttgaagagtcatcaaatacagtgcagaaggctcctgatggaaccccagctggtggaggtctgcttgtagtgattgttcatgaggctcaggatgtggaaggaaagcatcatactaatcctcatgcacggctcatttttagaggggaggagaggaaaactaagcatataaagaagaaccgagatcccagatgggaggaggagttccagtttatgttggatgagcctcccactaatgatagactacacgtggaagttgtcagcacttcaaagaggatgggcttgttacatcctaaggaatctctgggttatgtggacattagtcttgcggatgttgttagcaacaaaaggatcaatgagaagtaccatcttatagactcaaagaatggtcggattcaaattgagatgcagtggagaacatcttcctgagcttgtttactgtttgtttt

SEQ ID NO: 1951 - DNA, 2674 bp, Theobroma cacao
atccaatgatttctcgccacgtagtatggccccacaggcggtgccccaaagagagaaaaaccaagtgaagattaattgagaaaataattatacttagctttgattatccgccactctccagtgtccaagaaacacctgtcagaagaggtcggtgacctgttcgccttcccttcctttagatcttcccttcagatttttttttttggtcaataaacgtacaaaatttcgttacgaaatgaaagacacatagatcggtgaaggacaataccgtcattccattttttccatcggtgttgtaatattttaactgcatagtatctccattttcattttccatttttttttcatttgatttgccggcgtaaacagtaaattctggggaacacgaggagttttctttgaagagagtgattgatccgaagaaagttccagaaactttttgattttagggattgtttggtacacagggaaacttcaaacaaaaaaaaagaaaaagaaaaaggattattggttttttgaattgatggggttttttagtactgtgttgggattttgtggatttggagttgggatttcggcgggtcttgtgatcggttattatttcttcatctacttccagcctagcgatgtcaaggatcctgaaatccgtccattggttgagcaagattcagagactttacaaaggatgcttcctgagataccactctgggttaaaaacccagactatgatcgtgttgactggataaacaagtttttggagtatatgtggccttatcttgacaaggccatttgtgcaactgccaagaatattgccaaacccataattgaggagcaaattcctaaatataaaattgacgccgttgaatttgaaacacttacattaggatctctgccaccgactttccaaggtatgaaggtttatgtcacggatgagaaggagttaatcatggaacctttaataaagtgggctggaaatcctaatgttactgttgctgtaaaggcatttggactgaaggcaactgttcaggtagtggatttgcaagtgtttgctctaccacgcattaccttgaagcctttggtcccaagctttccgtgttttgcaaatatctacgtgtccttgatggagaagccccatattgactttggattgaagcttataggggctgatctcatgtcaatacctggtctctacaggtttgtccaggagctcatcaaagatcaggttgcaaacatgtatctttggcctaaaaccctgcaagtaccaattctggatccggcaaaagcttttaagagacctgtaggaattctccatgtgaaagttgtaagggcaatgaagctcagaaagaaagatcttttgggtgcatcagacccttatgttaaactaaagctaactgaggataagctttcatctaagaaaaccactgtgaagcacaagaacttaaaccccggatggaatgaggaatttgatatgcttgttaaagatcctgagacccaggccttagagtttaatgtttttgactgggagcaggttggcaagcacgacaagatgggtatgaatgtggttcctttgaaagaacttactcctgaggagccaaaagttatgacccttgaactccttaaaaatatggacttaaatgatcctcaaaatgagaagtcacgtgggcagcttgtgatggaactaacatataagcccttaaaagatgatgaaataccaaaaacttttgaggagtcaaaaacagtgcagaaggctcctgaggatacacctgatggtggaggtgtgcttgtagtcatagtccatgaggcacaagatgttgaaggaaagcaccacactaatccatatgtgcgggttctttttagaggcgaggagaaaaagactaagcatgtaaagaaaaacagagatccaagatgggaagaggaatttgcatttatgttagatgaacctcccactaatgataaattgcatatggaagttctcagcagttcatcaaggataggcctgctgcaccctaaggaatcattaggttatatcgacatcaatctttcagatgttgttagcaacagaagaatcaatgagagataccatcttatagactcaaagaatggacggatccagatagagttgcaatggagaactaaatgagcttagtgtatctctttcgtttatacccttgaatattgttggatttttctgaatttgaggatttactgcaccacagcaagccatttcttaatctgtcttcaacattataggtcattttatttgtttgtttctgtacatgattgtaataatagcaccaactaccgaggacgaccctttctatttttgagctcgctttgtcttcttacgttttacttcacgtgtcccgcaacttatagccttgaacttccatgcagttgttgcaagaaagaaatgaaacgttatgcttgggcaccattaaacagttcaaagcacacacggttttgggccgacattggcaggtggacctgggtaagcccccggcgacgagcccgcaccacggcctagcttgctgatcttctgtcatggagtgggaggcacaaatgttaagcagtcttatcctgctatgcttggaagcaggagtggcccaaagtggccttctgttttagaaattcaattagttgtatttttaaggaataatgaagtaatttggaattc

SEQ ID NO: 1952 - DNA, 1615 bp, Glycine max
aactgacatgggtttctttggcaccatatttggtttttttggctttggaattgggatttctattggtttcgttattggctattttctctttatatatgttcaacccactgatgttaaggatcctgaaattcaaccattggcggaggaagactcggaaactttacagagaatgattcctgagataccactttggataaaaaatccagactttgatcgggttgattggcttaacaagcttatcgaatatatgtggccataccttgataaggcaatatgcaaaactgcaaagaatattgcaaaaccaataattgacgagcaaataccgaaatataagattgattctgttgagtttgaagagttcacactaggatctttgccgccaacttttcaaggaatgaaagtttatgagactgatgaaaaagagttaattatggagccttctataaaatgggcgggaaatcctaatgttattgttgctgttaagaaatttgggctgaaagcaatcattcaggtgatggatttgcaagcttttcttgcacctcgtattactttgaaacctttggttccaagttttccatgttttgcaaatatctatgtgtctctcatggaaaagccacatgttgactttggactaaagcttgtaggggttgatcttatgtctattcctggcttctacaagtttgttcaggagtttattaaagatcaagttgcaaatatgtatttatggcctaaaaccttggaagttcaagttatagacccaacaaaagccttgaagaggccggttggaattttaaatgcaaagattttaaaagcgatgaagttaaagaagaaagatcttcttggtgcatctgacccttatgtgaagctaaacttgaccgaggataagttgacgtcaaaaaagactactgtgaagcataaaaacttgaatcctgaatggaatgaggagtttagtttggttgttaaagatcctgagtctcaagctttagagctttatgtctatgattgggagcaggttgggaagcatgacaagatgggtatgaatatggttcctttgaaagaacttttgcctgaagagcctaaagtttttactcttgacctcctaaaaaacatggatcctaatgatgcccaaaatgagaagtctcgtggacaaattgttttggaattgacgtataaaccttttagagaggaagacttagcaggttttgatgaaacacaaccaatacaaaaagctcctgaaggcactccacctggtggtggtctacttgtagtcataatccatgaagctcaagacatagagggaaagtaccatactaatccacatgtacgtcttattttcaggggagaggaaaaaaggactaaggtcatgaagaagaacagagatccaaggtgggaagaagagttccaatttctggtggaagagccccccactaatgacaaattacatgtagaggttgttagcacttcatcacgaaaccttctacgtcaaaaggaatcattgggctatgctgacatcagtcttgcagatgttgttgccaacaatagaattaatgagagacaccatcttattgactccaagaatggtcgcattcaaatagagctacaatggagagcttca

SEQ ID NO: 1953 - DNA, 2180 bp, Populus trichocarpa
taggaaagttcaaactaaaagagttcaggttgaatacgttttgatctacaaggactaaagaaacttagttttttccctcttgtttctgtaatcatgcttgcgctctccgtcgcttccacagtattcttcaccttcatatcttcttcccgaggttctcatagcaacgaatcaagggtagatcagtcatttgattgacaatcattattatgcatagtaattagtgtctgatctgagaaatcgagaagatgctttatagaaatttttttaattatccttgcaaactctctgatttaaattactctcgtgaaaaagatatttaaggtctgtttgtttacttagaaaaaaatggggtttcttagcacaatatcagggttttgtggatttggtgttggactttccacgggtctcaccatcggttattacctctttatctacttccaacccaccgatgtcaaggatcccgaggttcggccattggcagagcaagactccgaaactttgcaacggattcttccagaaataccgctatgggtgaaaaatccagactatgatcgcattgattggctaaacaggtttattcaacttatgtggccttacctcgacaaggccatttgtaagactgtgaagaatattgcgaagccgataattgctgagcagattccgaaatacaaaattgatgcggttgagtttgaaactcttacacttggaaccctaccgccaacttttcacggtatgaaagtttatgtcactgatgagaaggagttgataatggaaccatgcatcaaatgggctggaaatcctaatgtcactgttgctgttaaagcatttgggttgaaagcaactgctcaggtggttgatttacaagtttttgcttcaccacgcataactttgaagcccttggttcctagttttccttgttttgccaacatctatgtgtctctcatggagaagccacatgttgactttgggctcaagctcttgggggctgatctaatgtcaatacctggcctttacagggtcgtccaggagattattaaagatcaggttgcaaacatgtatctatggcctaaaaccctggaagtacccatcttggatcctgcaaatgccatgaagaggcctgtgggaattctcaaagtgaaggttctgagggcaatgaagctgaagaagaaagatctgatgggagcatcagacccttatgtgaaaataaagctgactgaagataagcttccagccaaaaagactactgtgaagcacaagaacttgaaccctgaatggaatgaggaattcaatttggttgttaaagatccagagtctcaggccttagagcttcgtgtttatgactgggagcaggttggcaaacatgacaggatgggtatgaatgtagtgccactgaaagatctcacaccagaggaaccaaaagtcatgactctcgacctccttaaaaatatggacttgaatgatcctcagaatgaaaagtcacgagggcagcttatggtggaattgacatataaacccttcaaagaggacgatttaaacaaaagttttaaagatgaggtggaacagaaggctcctgaagggacccctgctggtggaggtctgcttgttgtaacgattcatgaagctcaggatgttgaaggaaagcatcacactaatccatacgtacgacttctttttagaggggaggagatgaagaccaagcgtgtaaagaagaacagagatcctagatgggaggaggaattccagtttacactggaggagccccccgttaatgcgaagctacatgtggaagttgttagcacctcatccaggattggcctgctgcatccaaaggaatcacttggttatgtggagatcaatctctcagatgttgttagcaacagaagaatcaacgagaggtatcaccttatcgattcgaagaatggaaagattcagattgagctgcagtggagaccagcttcataagcctatcgattgtcctcccttttgtttttctttgttctcaagcctcgaaattcaagctctgtttcgagtataggatgtgtgtgaaaggaaagtatttattgtttcagcaaaattctttgtgctgcttatgtacgttgattgcaattaaagaaactattcatgggcttacatgggattcaaaatctagtgctataaagaatgaggtagccttctctgtt

SEQ ID NO: 1954 - DNA, 2282 bp, Vitis vinifera
agaaaaccccaccgtcgccgttaccgacaattgccaaagtttcacgcgccttgagtaataatttccatttttcaaatccgttgtgtggatccaatgggtcactgattggctaaagaataaatgctcctttattgcccactgatgccaaattaagatgcattgtcttaccactcgcaaacggcttctttctactcttactcaacaaggcagatttcatgatattttctttaaagaaagtgacatgggaattgcattttctgggaggttgagttagtttctttctgggttttaggttgaagggacgaagaaggaagggggtttttgggattagttgggactggggagagagtggattggtggtttttggtgaagtgagagaggattgaagatgggtattgtgagtacaatactgggtttttgtggatttggtgtggggatctcaattgggctttttattgggtattacctcttcatctacttccaacccactgatgtgaaggatcctatagttcgtcctctagttgaacaagattcaaaaactctgcaacgtttgcttccagagataccccaatgggtgaaaaatccagactatgatcgagttgactggcttaacaaattcatagaaaatatgtggccttacctggacaaggcaatttgcaagactgcgaagaacatagcaaaacctatcattgctgagcaaattccaaaatacaaaattgattcagttgaatttgaagcactcaccttgggctccctaccacctacatttcaaggaatgaaagtctatgctactgatgaaaaggagttgatcatggaactatccatgaagtgggcagggaatcctaacatcactgttgcagtaaaagcatttgggttgagagccactgtgcaggtggttgatttgcaagtatttgctgctcctcgcatcaccctgaagcctttggttccatcatttccttgttttgccaatatatttgtgtctctcatggagaagccacatgttgactttggactaaagctgctaggagcagacgtaatggccattcctggcctgtatcggttggtgcaggagcttatcaaagatcaggttgcaaatatgtacctatggcccaaaacccttgaagttccaataatggatcctgcaaaagccatgaaaaagcctgttggcattctcagtgtgaaggttgttagggcaatgaagctaaaaaagaaagatattatgggggcatcagatccttatgttaaaatgaagttgactgaggacaaacttccttcaaagaaaactactgtgaaacataaaaacttgaatcctgaatggaatgaggagtttaatatggttgttaaagatccagaatctcaagcattagaggtcatcgtctatgattgggaacaggttggtaaacatgataagatgggcatgaatgtcattcccctgaaagagcttacacctgatgagccaaaagttttgacacttgatttacttaaaaacatggacccgaatgatgttcaaaatgagaagtcacggggacagattgttttagaagctctgtacaaaccttttaaggacactgaaataccaaaggatcttgaagatcccaatgcgatagaaaaggctcctgaaggaacacctgctggtggtggtttgcttgtaatcattgtccatgaagctcaggaggttgagggaaagcatcacacaaatccatatgttcgattacttttcaggggagaggagagaaaaaccaagtatgtaaagaaaaacagagaccccagatgggaagaggagtttcaatttatgctggaggaaccacctaccaacgatagaatacatgtagaagttgttagtacctcatcaaggatgggcttactacatcctaaggaaactctgggttatgtggatataaacctctcagacgttgttagcaacaaacggatcaacgagaaataccatctaattgactcaaagaacggaaagattcaaatcgagttgcaatggcgaacttcaacataagagggaaatgcttttctcccatttctttaaactttgtgtttgatgagggaaaccgaatgaaatcctttgtttctgtgtcgatgttatgttaggcatttttaataattggctctgtaaattaccccaaaaaggaatcttttatgtttctgtgaatctttggcttgcgggtttgtttttcctttattccaaatttcaagttgtcctcttatggactgccttttggactgggcccaatgatgtgaacccacatccactgccaaaagccttatccaac

SEQ ID NO: 1955 - DNA, 2060 bp, Vitis vinifera
cactcgcaaacggcttctttctactcttactcaacaaggcagatttcatgatattttctttaaagaaagtgacatgggaattgcattttctgggaggttgagttagtttctttctgggttttaggttgaagggacgaagaaggaagggggtttttgggattagttgggactggggagagagtggattggtggtttttggtgaagtgagagaggattgaagatgggtattgtgagtacaatactgggtttttgtggatttggtgtggggatctcaattgggcttttgattgggtattacctcttcatctacttccaacccactgatgtgaaggatcctatagttcgtcctctagttgaacaagattcaaaaactctgcaacgtttgcttccagagataccccaatgggtgaaaaatccagactatgatcgagttgactggcttaacaaattcatagaaaatatgtggccttacctggacaaggcaatttgcaagactgcgaagaacatagcaaaacctatcattgctgagcaaattccaaaatacaaaattgattcagttgaatttgaagcactcaccttgggctccctaccacctacatttcaaggaatgaaagtctatgctactgatgaaaaggagttgatcatggaactatccatgaagtgggcagggaatcctaacatcactgttgcagtaaaagcatttgggttgagagccactgtgcaggtggttgatttgcaagtatttgctgctcctcgcatcaccctgaagcctttggttccatcatttccttgtttcgccaatatatttgtgtctctcatggagaagccacatgttgactttggactaaagctgctaggagcagacgtaatggccattcctggcctgtatcggttggtgcaggagcttatcaaagatcaggttgcaaatatgtacctatggcccaaaacccttgaagttccaataatggatcctgcaaaagccatgaaaaagcctgttggcattctcagtgtgaaggttgttagggcaatgaagctaaaaaagaaggatcttatgggggcatcagatccttatgttaaaatgaagttgactgaggacaaacttccttcaaagaaaactactgtgaaacttaaaaacttgaatcctgaatggaatgaggagtttaatatggttgttaaagatccagaatctcaagcattagaggtcaacgtctatgattgggaacaggttggtaaacatgataagatgggcatgaatgtcattcccctgaaagagcttacacctgatgagccaaaagttttgacacttgatctactaaaaaacatggacccgaatgatgttcaaaatgagaagtcacggggacagattgttttagaagctctgtacaaaccttttaaggacactgaaataccaaaggatcttgaagatcccaatgcgatagaaaaggcccctgacggaacacctgctggtggtggtttgcttgtaatcattgtccatgaagctcaggaggttgagggaaagcatcacacaaatccatatgttcgattacttttcaggggagaggagagaaaaaccaagtatataaagaaaaacagagaccccagatgggaagaggagttttcatttatgctggaggaaccacctaccaacgatagaatacatgtagaagttgttagtacctcatcaaggatgggcttactacatcctaaggaaactctgggttatgtggatataaacctctcagacgttgttagcaacaaacggatcaacgagaaataccatctaattgactcaaagaacggaaagattcaaatcgagttgcaatggcgaacttcaacataagagggaaatgcttttctcccatttctttaaactttgtgtttgatgagggaaaccgaatgaaatcctttgtttctgtgtcgatgttatgttaggcatttttaataattggctctgtaaattaccccaaaaaggaatcttttatgtttctgtgaatctttggcttgcgggtttgtttttcctttattccaaatttcaagttgtcctcttatggactgccttt

SEQ ID NO: 1956 - DNA, 1230 bp, Glycine max
atcgcgttttgcctttggtcctctccacattcaaaacccttcttcctttcagttcctagttgcctctgctgcaacagctttctgtcgcaaattgatgatatttgggtgttgatgcgcttctgtcatttggtttagattcaggatgaaaatgtcactggtttggcctctcttaacgaggcgaggattcagcacaagctctgagaatcttgttgcttctgtgctctttgagagattgccagtggtcattcccaaaattgatcctgtggtttatgcatttcaagaattctcgtttcgatggcgacaacaatatcaacgcagataccctgatgaatttcttgacaaatctgatgcaagggggaaaggtgattatcagattgactatgtgccagcaccacgaatcactgaagccgaccaaagtaatgaccgaaggtcattacaaagagctcttgacagaagactctaccttcttctctatggtaatgcatatggggctccaagtgggaagcctgtgtggcattttccagagaaagtttatgaatcagaggacaccatgcgcaagtgtgcagagtctgccttaaaatcagtcataggagatctttctaatacatattttgttggaaatgctccaatggcccatatggttgttcagccaacagaaaaccagtccggatccacatcttttaagcgattcttcttcaagtcacaagtaattgctaaaaacaagttcgacatcggaaaatgtgaggattttgtctgggtgacaaaggatgaattgacggagtattttcccgagcaagccgagtttttaaataagatgatcattagctgatgaaagtggagaacagttgtttaattgaaatttttgccagttagttcctagaatgacagtggagggccttgcaagaagatcaatgtaagataaagtttctgggcacattggaagatttcgatttaaagttaaacgtgacatctctagttttggagacttgtccgagttaatggatgctggaaggcttttttgtttaaaaacgtattttgttgtttcttttaatttgccatagctcttcttgtagttgtactgtaataaataagttgcaatggtgattatgacgatttgaatatgtttcccaattttgttgatatagtttctgtttggatatctatcttaccagttcagccaactagtcttgttttggagaccaaagtaacacttttactcatgccctgcca

SEQ ID NO: 1957 - DNA, 1202 bp, Cajanus cajan
cagagtacggggggatgcatcgtttaatactggggttttggctttgggttcagaaaacccttctttctttctttcctagttccctctgctgcaacaacttcctcatactttctcgcgaattgaatgaaatttgggggtgatgcgcttctgtctttcggtttaggatgaaaatttcactggttcggcctctcttaacaaagcgaggattcagctcaagctctgagaaccttgttgcgtctgtgctctttgagagattgccagtggtcattcccaaaattgaccctgtggtttatgcatttcaggaattctcgtttcgatggcggcaacaatatcaacgcagataccctgatgagtttcttgacaaatctgatgcaaggggaaaaggtgattatcagattgactatgtaccagcaccacgaatcactgaagctgataaaagcaatgatcgaaggtcattacaaagagctcttgacagaagactctaccttcttctgtatggtaatgcatatggggctccaagtgggaagcctatgtggcattttccagagaaagtttatgaatcggaggacaccatgcgcaagtgtgcagagtctgcattaaaatcagtcttaggagatctttctaatacatattttgttggaaatgctccgatggcccatatggttgttcagcctacggaagaccagtctggatccacatcctttaagagattcttcttcaagtcacaagtaattgctaaaaacaagttcaatattggaaaatgtgaggattttgtctgggtgacgaaggatgaattgatggagtattttcccgagcaagccgagtttttaaataagatgttcattagctgatgacaatggagaacagttgtttcattgaattttttgcaaggtagttcctataacaacagtggaggaccttgaaagaagatcaaggcaagatacgagtttctgggcacattagaagattttgatttaaagttaaatgtgacatctctaattttggagacttgttatgagttaatgatgctggaatgttttctgtttaaaaacttgtgtttttattattattattgtttgtcatttgtcttttctttcagttgtacacttgtactgtaataaataagtttctgatgaagatcttatcagtttctgtggtgattgtgacattttgaatatggtttccaattttgttgatgtagt

SEQ ID NO: 1958 - DNA, 1168 bp, Glycine max
cttgatgttttttgcttttgcccccctctctctctcctacttccaaaacccttgttcacttctccagttgccattgctgcaacagctatctcatattgtcccgaagaatggaatgatattgcgggctgatacgcttccattctttgcttaacgatgaagatgtcattggttcgacctctcttgacaaagcgagggttcagcacaagctctgagaaccttgttgcttctgtgctctttgagagactgccagtggtcattcccaaaattgaccctgtagtctatgcatttcaagaattctcgtttcgatggcgacaacaatatcaacgcagatatcctgatgaatttctagacaaatctgatgcaagggggaaaggtgattatcagattgactatgtgccagcaccacgagtcactgaagctgacaaaaacaatgatcgaaggtcattacaaagagctcttgatagaagactataccttctcctctatggtattgcatatggtgctccaagcgggaagcctgtgtggcattttcctgagaaagtttatgaatccgaggacaacatgcgcaagtgtgcagagtctgcattgaagtcagtcttaggagatctttctaatacatattttgttggaaatgctccaatggcccatacggttgttcagcctacagaagaccagtctagatccacatcttttaagagattcttcttcaagtctcaagttattgctaaaaacaaattcaacattggaaaatgtgaggatcatgtctgggtgacaaaggatgaattgatggagtattttcccgagcaagctgagtttttgaacaagatgatcattagctgatgacaatggaagacagttaattcagttgaaattattgcaagctctgaataacaatgaaggaccttgaaagaagatcaagctatcatagtgtttctgggcataactgaggtttttcgattggaagctacacttaacatctcaaatttgcccaattttgttgacaagtctgtttggatatctatcttagcagttcaccaccaagttttgttttagagttcaaagtaatacttgttttcctgagttcccgagaatgtctccacatttttggtcttgaacattagtcgcggttgcctccacattaagttatattttaataattttttaattg

SEQ ID NO: 1959 - DNA, 1134 bp, Glycine max
ctcccctacttccaaaacccttcttcacttctccagttcccattgctgcaacagctacctcatattgttccgaatggaatgatattgccgggtgatacgcttgcttaacgatgaagatgtcactggttcaacttcgacctctcttgacaaggcgagggttcagcgcaagctctgagaaccttgttgcttctgtgctctttgagagactgccagtggtcattcccaaaattgaccctgtagtttatgcatttcaagaattctcgtttcgatggcgacaacaatatcaacgcagatatcctgatgaatttctagacaaatctgatgctaggggtaaaggtgattatcagattgactatgtgccagcaccaagagtcactgaagctgacaaaaacaatgatcgaaggtcattacaaagagctcttgatagaagactctaccttctcctctatggtaatgcatatggtgctccaagcgggaagcctgtgtggcattttcctgagaaagtttatgaatctgaggacaccatgcgcaagtgtgcagaatctgcattgaaatcagtcttaggagatctttctaacacatattttgttggaaatgctccaatggcccatatggttgttcagcctacagaagaccagtctagatccacatcttttaagagattcttcttcaagtctcaagttattgccaaaaacaaattcaacatcggaaaatgtgaggatcatgtctgggtgacaaaggatgaactgatggagtattttcccgagcaagctgagtttttaaacaagatgatcattagctgatgacaatggaggatagttgtttagttgaaactattgcaaattagctctaaatgacagtgagggaccttgaaagaagatcaagctagcatagtttttctgggcataactgaagatttcaatttgaagttacacttaacatcccaaatttgcccaattttattgacaattatgtttggatatctatcttaccagttcaccaactagtcttgttttagagttcaaagtaacacttgtttctctgtgttcccgagaatgtcgcccaattttttggtcttgagcagtagtaccggttgccttgacagttaagttatattttaataatttttcttaa

SEQ ID NO: 1960 - DNA, 820 bp, Trigonella foenum-graecum
gttgcaggcaggttcctggcgacgtagctcgcattctctctctgtctctgtcattcgacggacgctgttgaaatcagaatcagctgagaggatgaagatgtcactggttcgtcctctcttgacaagctccgagaaaatggttgcctctgtgctctttgagagattgcctgtggtcattcccaaaattgatcctattgtttacgcatttcaggagttctcgtttcgatggcgacaacaatatcaacgtagatatccagatgaatttcttgacagatctgatgcaagggggaaaggtgattatcagattgaatatgtaccagcaccacgaatcactgaagcagacaaaacaatgatcgaaggtcactgcaaagagctctcgacagaagactctaccttcttctctatggtgatgcttatggggctccaagtgggaagcctgtgtggcattttccagagaaactttatgaatcagaggaaaccatgcgtaagtgcgctgagtctgcattgaaatcagtcataggagacctctccaatacatattttgttggaaatgctccaatggcccatatggttgttcagcctaatgaagaccattcaggatcctcatcttttaagaaattcttcttcaagtcccaagtaattgctaaaaacaagttcgactttggaaaatgcgaggattttgtttgggtgacaaaggatgaattgatggagtattttcccgagcaagctgacttttttaacaaaatgatcattagctgaggacagttgtttagtttaaattactttaatttagtttatttaattaaagtggaggagggtc

SEQ ID NO: 1961 - DNA, 1127 bp, Vigna unguiculata
cctaaacccttaccgcatcttcttccaaacggcgacgtcttgcctcaaacccttattgcgtttccttcaaaccctctcagtttcatcctctccaaaccgcggtcgaaccatcttcaaactcgtggccctttgagctgtttggtgagcactattcttttggattattcttgctttgattctggttgtcttgcatcaagattaggccatcttcttctgtctaaagtagcaagatgaagatgtcattggttcgacctctcttgacaaggcgaggattcagcacaagctctgagaaccttgttgcttctgtgctctttgagagactgccggtggtcattccgaaaattgaccctgtagtttacgcatttcaagaattctcgtttcggtggcgacaacaatatcaacgcagatatcctgatgaatttcttgacaaatctgatgcaaggggaaaaggtgattatcagattgactatgtgccagctccacgattcactgaagctgacaaaaacaatgataaaaggtcattacaaagagctcttgatagaagactctaccttctcgtctatggcaacgcgcatggagctcctagtggaaagcctgtgtggcattttcctgagaaagtttatgaatctgaggacaccatgcgcaagtgtgcagagtctgcattggagtcaatcataggagatctttctaatacatattttgttggaaacgctccaatgggccatatggttgtgcagcctacagaagaccagtctggatccacatcttataagaggttcttctttaagtctcaagtaattgctaaaaacaagttcaacattgcaaagtgtgaggattttgtctgggtgacgaaggatgaattgatggagtattttcctgagcaagctgaattttttaacaagatgatcattagctgatgacaatggaggacatttgttttgttgaaacaattgcaaattatcacagaatgatagtgaatgaccttgaaagaacatcaaactacaaataatgtttcaggccacatctcgatttaaagtttggatatctatctttccagttcaacaacatatcttgtttttaaatttcagagtaaattgtttttatgtgtaaaaaaaaggaaaaaaaaa

SEQ ID NO: 1962 - DNA, 1329 bp, Cajanus cajan
ggggttgcccaaatctgaaagcgaaagcccagagaggcccattatctgaaagtgaaggcccgttaaaggttgatgaggtcatgagaagcgtccacggaagcatagacggagacgaaaacatgaacatgaaaaagttgggattcatattctgaagaaactttggggcagtaacgaactgaagccgtcatcagcgttggctcgcctccgtgttctgccgctggatgaagatgtcattcattcgacctctcttgacaaggcgaggattcagcacaagctctgagaatcttgttgcttctgtgctctttgagagactgccagtggtcattcccaaaattgaccctgtagtttatgcatttcaagaattctcgtttcgatggcgacaacaatatcaacgcagatatcctgatgaatttctggacaaatctgatgcaagggggaaaggtgattatcagattgactatgtccctgcaccacgagtcactgaggctgacaaaaacaatgatcgaaggtcattacaaagagctctcgacaaaagactctaccttcttgtctacggtaatgcatatgggactccaagtgggaagcgtgtgtggcattttcctgaaaaagtttatgaatctgaggacaccatgcgcaagtgtgcggagtctgcattgaaatcagtcataggagatctttctaatacatattttgttggaaatgctccaatgggccatatggttgttcagcctacagaagaccagtctggatccacatcttataagaaattcttcttcaagtcgcaagtaattgctaaaaacaagttcaacattggaaaatgtgaggattttgtctgggtgacaaaggatgaattgatggagtatttccacgagcaagctgagttttttaataagatgatcattagctgatgacaacggagggcagttgttttgttgaaattattgcaaattagctcagaaagacagtgaaggaccttgaaagatgaagctagcatagtgcttctgggcacaaatcgattttaaatttgcccatttttttcacaagtatcgtctttccagtttaccaactagtcttgttatagagttcaaaataacatcttggtttagttaatcaagaagataaagtttggttaaaagttacacaatccctggaaatatgggatatgttcagtcatgtaagaattcagtttcattgctcgtaacagattgtatcgcaattttggtcctaaagaaaatgtcacatgctcatccaaacttttaaacccccaattttttctttgggattaatgtgggagaataattaaatatgcttaatatccaattcatcatg

SEQ ID NO: 1963 - DNA, 1034 bp, Trifolium pratense
  misc_feature (314)..(314): n is a, c, g, or t
  misc_feature (384)..(384): n is a, c, g, or t
cgacgtcgcattccctaactaccattgaccgaccgaccggcgttactgtattcttttcttcttcaaatccaaagatgaagaagatgtcactggttcggcctctcttgacaaggcggcggcgaggattcagcaccatgaccacctctgacaaaatggttgcctctgtgctgtttgagagattgcctgtggtcattcccaaaattgatcctattgtttatgcatttcaggaattctcgtttcgatggcgacaacagtatcaacgtagatatccagatgaatttcttgacagatctgatgcaagggggaaaggtgantatcagattgattatgtaccagcaccgcgaatcaccgaagcagaccaaaacaatgatcgaaggtcactanaaagagctcttgacagaagactctaccttcttctctatggtgatgcttatggggctccaagcgggaagcctgtgtggcattttccagagaaactttatgaatcagaggaaaccatgcgtaagtgtgcagagtctgcattgaaatcagtcataggagatctctccaatacatattttgttggaaatgctccaatggcccatatggttgttcaacctaatgaagaccattcagtatccacatcttttaagaaattcttcttcaagtcccaagtaattgcaaaaaacaagtttgactttgaaaaatgcaaggattttgtttgggtgacaaaggatgaattgatggagtattttcctgagcaagctgagttttttaacaaaatgattatcagctaaagagagttgtttagttaaaactattttaaattagtttgtttaattacagtggagagggcattgaaagaaaatgattgtaggtttatgagctcgaccataggtttttattaaatttaacatctcaaattttagagacatgtatggcttatgggctcgacgataggtttttcttgactttttcttataaataaagccggagggagtatatctctacatgtcatgttttttcctctcatagttgtatttgaataagatgcc

SEQ ID NO: 1964 - DNA, 1140 bp, Arachis hypogaea
gggtgaagtcacagtgagttcccaatttgcattgctcctcgctcttgttccattcattgcactttgtagaacgaaagctacctcatttctgatctctcctcactttcctcgaatcgaagatacttttggggtcaggatgaggatgtcattgattcggcctctgttggcaaggcgaggtttcagcacaagctctgaaaaacttgttgcttctgtgctctttgagaggctgccagtggtcattcccaaagtcgaccctgtagtttatgcatttcaggaattttcatttcgatggcgccaacaatttcaacgcagatatcctgatgaatttctagacaaatctaatgctaggggcaaaggtgattatcagattgactacgtgccagcaccacgaatcaccgaagctgacaaaacgaatgatcgaaagtcattacaaagagctcttgaccgaagactttaccttcttctcttcggtaatacatatggggctccaagtgggaagcctgtgtggcattttccggagaaagtttatgaatcagaggagaacatgcgcaagtgtgctgaaactgcattgaaatcaatcataggggacctttctcatacatattttgttggaaatgctccaatgggtcatatggttgttcagcctacagaagacacatctaaatccaccccttttaagagattctttttcaagtcacaagtaatcgcaaaaaacaagttcaacattggaaaatgcgaggattttgtttgggtgacaaaggatgaattgttggagtactttccagagcaagccgagtttttaaacaagatgatcctcagctaattacagcagaggacggttgtttcattaggataattgcaaattagttcatacaatgctgcaggaccctgaaagattatcaagctaacatatagtttatggtcaaaatagaagtttattcttgttttggagatttatgagtttatggtgctcaaaggctattgttttggatctcttctttccttttattttctacccttttttcatctgtattttctgccagttttgctgtaataaatgagttgcctttgtgatttagtgttagaatgtgttgccctattttgttgacagtctgtgtatcatcacatctttatcagttc

SEQ ID NO: 1965 - DNA, 1173 bp, Phaseolus coccineus
gacctttactgtaacaaccatctcttatgctttggtctctctcactcggcagattccaccccatcacagaacctatttcaaaacgaaagcagaacgctacggcgaggccacagcgaagcaaggtgacgcgattcttggcaaggcgatgtgaagtgaggcactgcgagacgagaaagacgacgacgaacccaaatagaaaacgaaggcagcaggtccaggatgaagatgtcattggttcgacctctcttgacaaggcgaggattcagcacaagctctgagaaccttgttgcttctgtgctctttgagagactgccagtggtcattcccaaaattgaccctgtagtttacgcatttcaagaattctcgtttcggtggcaacaacaatatcagcgcagatatcctgatgaatttattgacaaatctgaaacaaggggaaaaggtgattatcatattgactatgtgccagcagcacgattcactgaggctgacaaaaacaatgataaaaggtcattacagagagttcttgatagaagactctaccttctcgtctatggtaatgcacatggggctcctagtggaaagcctttgtggcattttcctgagaaagtttatgaatctgaggacaccatgcgcaagtgtgcagagtctgcattggaatcaatcataggagatctttctaatacatattttgttggaaatgctccaatgggccatatggttgttcagcctacagaagaccaatctggatccgcatcctataagagattcttcttcaagtctcaagtaattgctaaaaacaagttcaacattgcaaagtgtgaggattttgtctgggtgacaaaggatgaattgatggagtattttcctgagcaagctgatttttttaacaagatgatcattagctgatgataatggaggactatttagttgaaacgatcgcaaatatcacagaatgataatgaatgaccttgaaagaacatcaaaccataatgtttcagggtacatctctatttaaagtttggatatctgtcttcaccaacaaattttgtttttgaattttaaagtaaattgtttttttctgcgttttttggtagagatttagaatctaagttatgtattttaaaatcgtgattaaaagtttcgggagatttaattcttcatttgaccctctta

SEQ ID NO: 1966 - DNA, 1419 bp, Trigonella foenum-graecum
caaatggcagctacaacaactcctgctgctctcaggtttcttcctccaaaccccacaaccagaaaaactctccatatcttctcaattctaaaaccaaatgttgtctcactgcgttcattctctcacaaataccctttttctctacctccctgcaaatgttctttcactgccccagtttccactacaacatacgagttttctgataatgcttcagaaatggagttaagattaaatataggaagcatggatataagaagcacaaaagacatatcggttgatgcaaacgatacatctttagctatcagagttttgcaatcaggatctcctatcacattgatagacactaatcctctttttgacagaattaaaccctctgaaacaatatggtatatagatgatgatcagcttgttgtgaatttcaagaaacatgatcctgagctgaaatggcctgacattatgcaatcatgggaatcacttgctgcaggatcatcacagcttttgaaaggaacatcaatttatcttgttggtgattccactgaaattaaccagaaagtggctgaagagctttctacgggtcttgggtacacgccacttagtacaaaagagttactcgaaacttattccaaccaaactgtggattcatggctgcttgctgaaggttctgactcagtagccgaaggcgaaggcactgtacttgaaagcataagtagtcatgtaagagcagtagttgcgacattaggaggtaaacatggtgctgctggaagatccgataaatggcgacatctttatgcaggatttactgtctggttgtcacagactgaagcatcagatgaagattctgcaagggaggagactcacagaaacgtcaaagatcgcataactgcatacacgaatgcggatgtagttgtcaagctacagggttgggatcctgcttatgccaaaagtgtggcacagggatgtttgagtgccctaaaacagttaatcctatcagacaagaagcttccaggtaaaaagagcctatacataagattgggatgtcgcggcgattggccaaacatcaaaccccctggttgggatccatcaagtgaaggtggcaaaactcttggcacacaataatgatgcttgtaatactaataataatgagtaacatcaaatttgttaatacaagtttgttaaagtaatataagagaaatgtggcagggtgtttcggaaactggtttatcctccaatttttcagcagcagttgaagttcttggttgctgtacaatttgtgctttcaattggagttcattcactgggtttactctcgttaaaattcggcacatgaaaaatgaatgtattttgaattaaaaaaatgcttcagtccaaaatatgatctactgttactgagtattctggttttaagtttaactttattaa

SEQ ID NO: 1967 - DNA, 1261 bp, Trifolium pratense
ctgaaatggtagctactactcctgctgctctccactttcttcccccaaacaccacaaccacaaaaacaatccacttcttctcaatcttaaaaccaaatgtcatctcacttcgttcattctctcattcttcttcttcttcttcattattttctctatctcacagataccctttttctctacctccctgcaaatgttccttcactgctcctgtttccactacaacctacgagttttctgataatgcttcagagatggagttaaaattaaatataggaagcatggatataagaagcacaaaagacatattggttgatgcaaacgatacatctttaactatcaaagtgttgcggtccggatctcccattacattgatagaaactaatcctctttttgacaggattaaaccctctgaaacaatatggtatatagacgatgatcaacttatcgtgaatttcaagaaacatgaccctgagttgaaatggcctgatatcatgcaatcatgggaatcacttgctgctggatcatcgcagcttttgcaaggaacttcaatttatcttgttggtgattcaactgaaatcaaccagaaagtggctgaagagcttgctactggtctcgggtacacgccacttggtactaaagagttgctcgaaacttattccaaccaaactgtggattcatggctacttgctgaaggttctgattcggtagccgaaggcgaaggtgctatacttgaaagcataagtagtcatgtaaggacagtagttgcaacattaggaggtaaacatggtgctgctggaagatctgacaaatggcgacatctttatgcaggatttactgtctggttgtcgcagactgaagcatcagatgaagattctgcaagagaggagacacacagaaacgtcaaagatggcgtatctgcatacacgaatgcagatgtggttgtcaagctacagggatgggatcctgcttatgccaaaagtgtggcacagggatgtttgagtgccctaaaacagttgatcctatctgacaagaaacttccaggtaaaaaaggtctatacataagactgggatgtcgcggtgattggccaaacatccaaccccctggttgggatccgtcaagggaaggtggcgaaattcctggcacacaataatgatgcttgtaataataatgaaggaacgaacgaatgaataacatcaaatttgtcaatacaactttgttagtaaatgtaatgtaagagaaatgtggcaggttgtttcaaaa

SEQ ID NO: 1968 - DNA, 1434 bp, Cajanus cajan
atgttatgtcatcatgtgatggtgtgaaaatgaaggccaagtccaagtttttgaaggaaccacatagtatttttgttatctgaaatggcagctgctcctgcttgtctctgttatctctcccaaaaccccacaatctcaaacctgaacctctcactctttaaacccaatgtgctctcactgcgatcattctttcactctccttttccctctctttctcaaaaacactatcttcggctccgtccctgcaagtgttcctccacggcccccctctccaccacaacctacgagttttcagatggttcttcggaagtggagttaagattaaacataggaggtttggatatccgaagctccagagacatattggttgacacaaacgatacctctttagctattagagtgttgcggccaggatctcccatcacactcatagaaactaatcctctttttgataggatcaaatcctctgaaacaatatggtatatagatgatgatcaacttgttgtgaacttcaagaaacaggaccctgatttgaaatggcctgacatcatggagtcttgggaatcacttactgcaggatcttcacaacttttgcaagggacatcaatatatcttgttggcgattccactgaaatcaaccaaaacgtggctcaagagctagcaactggtctcgggtacacgccacttagcacaaaagagttgctggaagcatataccaagcagactgtggattcatggttgcttgctgaaggctctgactcagtagcagaagcagaaagtgctgtacttgaaagcataagtagtcatgctagggcagtagtcgcaacattaggtggaaaacatggtgccgctggaagatctgataaatggcaacatctttatgcaggatttactgtctggttgtcacagactgaagcactagatgaagattctgcaagggaggagacccataataacgtcaaagatggcataatttcatacacaaattcagatgtggttgttaagctacagggctgggatcctgcttataccaaaaatgtagcacaagcatgtttaagtgccctaaaacagttaatcctgtcagacaagaaacttccaggtaaaaaagcctctacataagactgggatgtcgcggtgattggccaaacatcaaaccccctggttgggatccatcaagtgaaggtaacgcaactcttggcacacagtaatgttgcttgaaattagtgagtaacatgtaatttgtttacacaagtgtatccaccacaaaggtaatataagagacagcttcagttgttcatattgtttgttattctaggtagcaaaaccaatgctttatagtttgataactatgtgatggatggtgtaacataactaaggtcttcttggtcgtaaaactgatcatatgtgaattggtagtggccaaatgatgattgg

SEQ ID NO: 1969 - DNA, 981 bp, Trigonella foenum-graecum
tttcgccgaatgtagcggtgcattggatcgaatagatgatactctgtttcaccgaaagcaagccacgtgtgcaatgtgaatactttactagaagttcatcgacactacacgacactgttagcggcaactgaaactcctttttataagcatgaatgaatgaatgtacaagaaaagttagaacaagattttgttagaatcgaatcgaagagaagatgcaggaaatggcaaaggcaaaagctgaggagaagaaaatcggtatgacagaaacttggttgaggaaacaccgtcctatctacaacgcagcaaccagacacccttttattcttagcattcgcgatggaaccgttcaatctcattccttcaaaacatggcttgcacaggattacttgtttgttagagcgtttgtcccatttgttgcaagtgttctgatgaaagcttgcaaggaatcagatgatagtgatgacgtggaagttatattgggaggcatgggttctctcaaagatgaattatcatggtttaagagagaatccaacaaatggggtatttcactctcagatgtgcttcctcaaaaaccaaacacaaactattgtaggttgttggaaagtttgatgagtccagaggtggattatactgcagctcttactgcattttgggcaattgaaatggtgtatcaagagagttttgcacattgcattgaacaaggctcaaaaaccccaccagaattgaaggagacttgtgaaagatggggaaatgaggggtttggtcagtactgccaatctctgcaaaagcttgtcaatcaacgcttgcagaaggcttctgatgatgaactcaaacaagctgaagttgtgttgctgagtattattgaacatgaagttgaattctggaatatgagccgtggaaatgtttgattttatctttgttcaaaagaaaactttgatgtatgtgtactgtgtaaaataatgaaagcttgtttatcttgtt

SEQ ID NO: 1970 - DNA, 698 bp, Lotus japonicus
cgacaacatggcggagaagatgaaagtcgaggagaagaaaatcggcatgattgaaacttggttgaggaagcaccgtattcactacgacgcagccaccagacaccctctgattcttagcattcgtgatggcaccatacacatcaattccttcaaaacatggctcgctcaggattaccttttcgttcgagagtttgtcccatttgttgctagtgtgctgataaaagctagcaaggaatcggatgacagtgctgacatggaagtcatattagggggcatggcttctctgggggatgaaatatcatggttcaagagagaagccaacaagtggggtattgaactttctgacgttgttcctcagcaggcaaatataaactattctaggttactggaaagtttaatgaggtcagatgtggaatatactgtggctatgacagcattttgggccattgaagcagtgtaccaagagagctttgcccactgcattggagaaggctccaaagccccaccggaactggaggagacttgtgcaagatggggcaatgagggttttggtcagtattgccaatctctgcagaagattgccaaccagcgcttacaaaaggcttctgatgatgagctcaaaaaggctgaagttgtgttcctcagtgttcttgagcatgaagttgagttttggaacatgagccgtggaaatgtttgat

SEQ ID NO: 1971 - DNA, 922 bp, Glycine max
aagaaagaaagcgagaaaacaagaagtagtgagaagaagggagagaatggaggaaaaggcaaaagctgagcagaagaagataggtatgaccgagacttggttgaagaagcaccgtcttctttacaatggagccactagacaccctcttattattagcattcgcgatggcaccatcaacactgcttccttcaaaacatggctcgcacaggattacttgttcgttcgggcgtttgtcccatttgtggctagtgtgctgataaaagcgtggaaggaatcagattgcagtggtgacatggaagtcatattggggggcatggcttctctggaggatgagatttcatggttcaagacagaagccaacaagtggggtatttcactttctgacgttgttcctcagcaggctaacaaaaactattgtgggttgctggaaagtttaatgagtccagacgcggaatatactgtggctattacagcattttgggctattgaaacggtgtatcaagagagctttgcccactgcattgaagaaggctccaaaaccccaccagaactgaaggagacttgtgtaagatggggcaatgaggcctttggtaagtattgccaatctctgcagaacattgccaatagatgcttgcaaaaggcttctgatgaagaactcaaaaaggctgaagttatgttgctaagtgtccttgagcatgaagttgaattctggaacatgagccgtggaaatgtctgatatggttcaagaagccttcaatgtatgaatataataaaatcatctaagcctagggaaatactgcatatgttattgttcggttggatcattcacagcgtaatgtactgcgtgaaatgtttactttcctagaaaaaatagagtaaattagaactgagaaaattaaagaaataataaaggaattctact

SEQ ID NO: 1972 - DNA, 2999 bp, Glycine max
gtttgttcttgttttcagtgtgattgacatttacttcagaagggggtctttcttttccatgttgccaacttgctaataataaaagatcaagttgttttgttttgttgctttttgtaagtttgttgttttgttagtgccttagtggtgcacttctttgtttgtttaacttaattagttaaggtggtgctttttggaaatttcgaaggttcaagaaacgaggtcgcatgttcatgcacctggggaagaagagaaggtgatgacaaggaagcagaaggctgagtccaaggcacatgaagtggagcattctccaaagaaggccaaggtggaaaaagaagatggccaaatcaacggaaaatctgaaactggagttgcagaagaatatgatgagttctgcaaagtaacaaacgagcaccttcctttggaacaaatgagagagattatggaggctaatagccttgattcttctggctctgatcttgaaattgcaagaagatgccaagacttgctgttttatggtgcattggacaaatgctcggtttgcaatgggagtttggagttcgatggaagacgttatgtttgcagagggttctacagtgagtgggctagttgcactttcagcaccagaaaccctccaaggaaacaagaacccattaagttacctgattctgttcaggactctctggcttcagatttgctaaagaaatatcaggacccgagtcacaggcctcacagggatctaggcttagctgaaaaaccctttactggaatgatgatatctctgatgggtcgtcttactcggacacatcattattggaaaacaactattgaaaagcatggaggaaaggtggcaaactctataattggggcaacttgtttggtagcttcacctgctgagcgagaacgtggtggcacatccaaacttgcagaagccatggagaggggtataccagtggttagggaggcttggttgattgacagcatcgaaaagcaagaacctcagcctttggaatcttatgatcttgtctctgatctttctgtggatggcaagggtatcccctgggacaaacaagatcctggggaagaggctattgaatcactctcagcagaactcaagctttatgggaagagaggggtctataaagattccaagttgcaggaacaaggtggaaagatatttgaaagagatgggatattatacaactgtgccttctctgtttgtgaccaagggctaggactgaatgactattgcgtcatgcaactgattgttgtcccagagaatcctttgcatctgtactttaaaaaagggagagttggcgatgatccaaatgcagaggagcaattagaagagtgggacaatgtggatggtgctctgaaagagtttgcgaggctctttgatgaaataacaggaaatgagtttgaaccttgggaaagagagaagaagttccagaagaagccattgaagttttaccccattgacatggatgatggagttgaagttagacatggcgcactaggtcttcggcagctggggatagcagcgacacactgcaaacttgagcctttggttgcaaattttatgaaggtcttgtgcagccaggagatatacaagtatgcattgatggagatgggttatgactctccggaccttccaattggaatggttacaaatcttcatctgaaaagatgtgaggacgttctcttagaattcatagacaagatgaaatcactgaaagaaactgggcccaaggctgaggctgtgtggactgattttagccaaagatggttcactctgatgcactccacaaggcctttcaattttagagattatcaagagattgcagagcatgctgctgctgcgttagagggggtgagagacataacccaggcttctcacctcataggagatatgacaggctcaaccattgatgaccctttatcagagacatacaagaaattgggctgctcaatttctgccttggacaaaagttcagatgattatgagatgattgtgaaataccttgaaaaaacttatgagccggtcaaagttggtgacattgaatatggggtgtcagtggaaaacatttttgcggttcaaacaggtggttgcccttcctatgaagacatagtaaaattgccaaataaggttcttctatggtgtggatcacgaagctcaaacctcttgaggcacttacacaagggattctcgccagcaatatgctcattacctgttccgggttatatgtttggcaaagctattatctgttctgatgctgcagcagaggctgcaagatatggttttacagctgtggacaggccagaagggttcttagttttggccattgcttctctaggaaatgagattaccgagttgaaaagcccacctgaggatacatcatctttggaggaaaagaaggttggagtgaagggactggggaagaagaaaacagatgaatcagagcattttgtttggaaagacgatataaaagttccttgtggtaaactagttgcctcagaccatcaagatagccccctggaatacaacgagtatgctgtctacgataaaaagcaggcacgcataagctacttggtgggagtgaagtatgaagagaagggtgcagtgattgacacagctgaatgatgaaccaaaaaggatgaaaggaaagcttttttgtaatgcaggagttgaaagatatgaccatcttgtctgaagatgtactagtggtttctctagttggtggaagatctgtcattttgatgtatatttacgtgtgacaaaataggctgtatatggtgtcacattttgatgtatgtatagttaaattgcccaagttagggtaagtaaatattttgtcctactcatgactgcatgagaatggaactacatctaacactatgttgtttaagtcttagttgactagtactactcagcgactagtactactcagtctgtatgaatgatatgatgagtagaagaaatggtataatgatgtcctttatat

SEQ ID NO: 1973 - DNA, 333 bp, Lotus japonicus
cataatggagagggtgacaaagatcgtgtcggagaggccggtggtgatcttcagcaagagctcgtgctgcatgagccacagcatcaagaccttgttctgtgactttggggtgaaccctgcagtttatgaacttgatgagataccaagaggcagagacattgagcaagctctggtttcaaggctaggttgtagtccctctgttcccacagtgttcattggcggtgagcttgtcggtggagccaatgaagtgatgagccttcaccttaacaggtccttgattccaatgctcaagaaagcaggagctctctggctttgaatttcatcttagaataa

SEQ ID NO: 1974 - DNA, 602 bp, Lotus japonicus
acaccaacacattcctcactttgcttataacaacatacctgcttttcttctcaattctgcttccaaatctgtaatattgttcaacttcaagccatttaatttgaagtaatggagagggtgacaaagatggtatcagagaggccagtggtgatcttcagcaagagttcgtgctgcatgagccacagcatcaagacccttttctgtgactttggagtgaaccctgcagtttatgaacttgatgagattccaagaggcagagacattgagcaagctctttctaggcagcttgggtgctctccttctgtgcccaccgtcttcattggtggcgagcttgttggtggagccaatcaagtcatgagccttcaccttaaccgctccttgatcccaatgctcaagaaagcaggagcactttggctatgaatttcatctgatctcttcgatcaccttcacattaggcactacttaaataaattaaactcaatgtttttgctatatatgtcatgtaatgacaatgagactatatgtgtatgtagaagaagcgagttaataataatagaggctaactgatattgaggtgcagtttagcctctcttttttaatgt

SEQ ID NO: 1975 - DNA, 743 bp, Cajanus cajan
aaccacatacattcctcacttgcttccttgcttcttcatttcaagtatcacattctacctcattcacaaactagtccttccatttggcattgttgcacaaacacaatggatagggtgacaaagatggtatcagagagggcagtggtgatcttcagcaagagctcgtgctgcatgagccacaccatcaagaccctcttctgtgactttggtgtgaatccagcggttcatgagcttgatgagatccctagaggcagagacattgagcaagctctttcaagacttggctgtagtccttctgtgcctgctgtgttcattggtggtgagcttgttggtggagccaatgaagtcatgagtcttcaccttaatcgctctctcattccaatgcttaagaaagcaggagcactttgggtttgatcaacgtatcttcacccttctcatcacccacgcatgcacgctacctatattaataaacacgttttggttataggggctaattatgaggaaactatatatatccatgttattagtatagactatagagtatggcactggctatgtaataataataaggctaacttaactgatccgagtgtagtttagccttttttttggggttaatcttaaatgtaatgttatcgttttgatagttgtaataaactagatggagttgtagccttagcctacatgatgaaatttatcattttatttttaagcatcaatcagtaaattaaagtatcagacgt

SEQ ID NO: 1976 - DNA, 733 bp, Glycine max
ttcctcacttgcctccatatatagcaacctttgcttctctcattaattaattcacaaactaacttagcttccaaattcatatggagagggtgacaaagatggtatcagagaggccagtggtgatattcagcaagagctcgtgctgcatgagccacaccataaagaccctcttgtgtgactttggggtgaatccagcggttcatgagctggatgagatcccaagaggcagagacattgagcaagctctttcaaggcttggttgttctccatctgttcctgctgtcttcatttctggtgagcttgttggtggagccaatgaagtcatgagccttcaccttaatcgctccttaattccaatgcttaagaaagcaggagccctttgggtttaattgatcaattcatataattgatcttctcccaattcatcaccactcatcttgatcaaccacacatatatgcaggctctctaattaataattatacctgttttggttatatatatgtatgtaatgatgtgattatatacgtaggagcagcatatatataatgaggatatatgtgtgtgtgtgtgtgtgtgtgtccacggtattattaggatagagtatatcgcactagctatgtaataatgaggctaacttaactgatcgtggtgtagtttagccttttttgacgggttaaatcaatgtaatgttatctttttgatatacatatataataaattagatggagttgc

SEQ ID NO: 1977 - DNA, 314 bp, Glycine max
atcgaatggagagggtgacaaagatggtatcagagaggccagtggtgatcttcagcaagagctcgtgctgcatgagccacaccatcaagaccctcttctgtgactttggggtgaatccagcggttcatgagctcgatgagatcccaagaggcagagacattgagcaagctctttccaggctaggttgtagtccctctgtgcctgctgtcttcattgcaggtgacctcattggtggagccaatgaagtcatgagccttcaccttaatcgctccttgattccaatgcttaagaaagcaggtgctctttgggtttaa

SEQ ID NO: 1978 - DNA, 823 bp, Cleome spinosa
ggacacccatcgaacaatatacaaccccaccccacagaaaccctaatatccaattcatatatagaagaggagctttttctttccttaatcttgacataaaagtttccatcttttttaaaccccgatccccaaattaaacctgttgcaaaacaatctcagatctttgctttcgcattttcaaccaaagcatttcgagttctttatcgatacacacacacatatatatacatacatacataggatggagaggataacgaagatggtgaaggagagaccagtggtgatattcagcaagagctcgtgttgcatgtctcacaccatcaagaccttgctctgcgactttggtgtgaaccctgcggtccaagagctggacgaggtccctagaggccgagagatagagcaggccctctcccgtctcggctgcagcccatccgtgccggcggtcttcatcggcggcgagtttgtcggaggagccaatgaggtcatgagccttcacctcaaccgctccttgattcccatgctcaagcgtgctggtgcattatggctttgaatcttttggaactaatattaataattatatatacaagtagttttgttttgatggaataattgagtgattatgttgcttaaccacggttaagtgaggagatcaattcgggggtaataattaattaacacgtgtgacatgatgatgcgatttcgtacgtgtcggatcgataaccatgcccatgttgctgttgctgtgatcagatcgattctctctcggttttttattttgggagtgatgtaatttgtacggaatatatatataaatctattcagc

SEQ ID NO: 1979 - DNA, 726 bp, Phaseolus coccineus
atttggcattgttgcacaaggatcaattggcaatggatagggtgacgaagatggtttcagagaggccagtggtgatcttcagcaagagctcctgctgcatgagccacagcatcaagaccctcttctgtgactttggggtgaatccatcggttcatgagcttgatgagatacctagaggcagagacattgagcaagctctttcaagacttggttgcagtccctctgtgcctgctgtgttcattgctggtgagcttgtgggtggagccaatgaagtcatgactcttcaccttaaccgctccttgattccaatgctcaagaaagcaggagctctttgggtttgatcaacaatattatacaattgatcttgaccctactcatcactcatcacccacacatacatacacatatatatatatactctaataaatatgttttggttatataaatatatatatatatatatatatatatatatgtatgtatgtaatgatgtcattatataggtaggggcaggatatatatttaatgaagaaaccatatatccatgcatgctattattagtatagagttatggcacttgctatgtaataataaggctaacttagctcttccaggtctagtttagccttttttgatggcttaaatctaatgttatctttttgagttgtaataaactagatggagttgcagactatatatatcatgaactttaacattttgagcatc

SEQ ID NO: 1980 - DNA, 335 bp, Lotus japonicus
ttttttgcattatacacgaaatggagagggtgacaaagatggtatcagagaggccagtggtgatcttcagcaagagctcatgctgcatcagccacagcatcaagaccctgttatgtgactttggggtgaatcctgcagtttatgaacttgatgagatatctagagggagagacattgagcaagctctttcaaggctaggatgcaacccttctgtgccggccgtgtttatcggcggtgagcttgtgggaggagctaaagaagtgatgagccttcaccttaaccggtccttgattccaatgcttaagaatgctggagctctttgggtttgatcatga

SEQ ID NO: 1981 - DNA, 812 bp, Arachis hypogaea
ggggatacaaaaatcataagtaccaaccatatatatacgctaaagtagtcctccttaaaccaaaaccttttatcccaaattccgtggcaactcattatttggcattgttatatatctcgatcaggctagttgcattaatagttaagaatcacagagaaaaatagagactagctagtagaatggatagggtgacgaagatggcatcagagagggcagtggtgatcttcagcaagagctcatgctgcatgtgccacaccatcaagaccctcttgtgcgacttcggtgtgaacccggctgttcatgaacttgatgagataccaagagggagagacgttgaacaagctctttcaaggctagggtgcaacccttctgtgccggcagtgttcattggtggcgagcttgttggtggagccaatgaagtcatgagccttcaccttaaccgctccttgatcccaatgcttaagagagccggtgctctttgggtttgagagaaattaaagaaataaactaatcaccatgacattctcatcgagcaataaactcagatgttaattaattactttttattatttacttgttatgatcagattatattattatatggctgggttgggatatatattacaaagtgcatgtatattagcattatatggtctatatatggtactaaaaataataataaggctaataattaacttgactgatcgacgtgtagtttagccttcttccttttttctttttctatattaactgtctagggggttgtacttttaatttcacgacggagaataataatatattggatgaaattc

SEQ ID NO: 1982 - DNA, 647 bp, Malus domestica
acttcaatcgtctcgagtctcaactattcgcattgctctccttacccttttcccaacttcaaaattatacttttgaaaactactactatctgcattttgatcagcaatggaggcggtaacaaagatggcgtccgagagaccagtggtaatcttcagcaagagctcgtgctgcatgtctcactcgatcaaaaccctgctttgtgactttggggtgaacccagcagtgtatgagcttgatgagatgcaaagagggagagagatagagcaagctctctctaggctgggatgcaaccctactgtgcctgctgtgttcattggcggtgaacttgtgggtggagccaatgaggtcatgagtcttcatcttaagcgctccttaatccccatgcttaagcgcgtcggagcattatgggtttgatttagctaattaacttacataacaggagcttaagattcctagttatgcatgcttgatatattactaaacaaaaagaaatatcggagtcggattatataataaatatatagcatatatagagcatgtaagagttttcaataaggttattaacttatgatgtactctagcttttttgtaatacgctatgtttcttgttctggttattataataataaaatcttactttcattaa

SEQ ID NO: 1983 - DNA, 619 bp, Eutrema parvulum
gtaaaataaaagaaacaaaaataaactattagattttagttgcgataccatataaaacttgttgcgataccatatacacttgctgctcaatggagatgataacgaagatggtgttggagagaccagtggtgatatacagcaaaagttcatgttgtatgtcccacacgatcaagactttgctctgcgatttcggagcgaatccagcggtttacgagctcgatgaggtacctagagggagggagattgagcaagcgttgttgcggcttgggtgtagcccggcggttccggcggtttttatcggaggagagttggttggtggagccaacgaggtcatgagtcttcaccttaacggctcattgatccctatgcttaagcgggctggtgcattgtgggtttaacttaatatatatatctactttaattaactagttacttaacactaagttaagtacgcagaataatgtttttaacacttctttgatctttgacatggtgatatgtatgagtccacgtcagatcaataatccggatgttgtctttttaatgtttttgaggttattctaatttaaaaatgtgcgagcttaattatatgaacttttaagaaatatctattcacctg

SEQ ID NO: 1984 - DNA, 741 bp, Eutrema parvulum
gtccgatctaatccaataatcatcgtattctctgcctctatataaacaaagacttctcaccaatttcatatccacacaacattctcataaaaccttattgtaaaacctattccaaaggtaaaataaaagaaacaaaaataaactattagattttagttgcgataccatataaaacttgttgcgataccatatacacttgctgctcaatggagatgataacgaagatggtgttggagagaccagtggtgatatacagcaaaagttcatgttgtatgtcccacacgatcaagactttgctctgcgatttcggagcgaatccagcggtttacgagctcgatgaggtacctagagggagggagattgagcaagcgttgttgcggcttgggtgtagcccggcggttccggcggtttttatcggaggagagttggttggtggagccaacgaggtcatgagtcttcaccttaacggctcattgatccctatgcttaagcgggctggtgcattgtgggtttaacttaatatatatatctactttaattaactagttacttaacactaagttaagtacgcagaataatgtttttaacacttctttgatctttgacatggtgatatgtatgagtccacgtcagatcaataatccggatgttgtctttttaatgtttttgaggttattctaatttaaaaatgtgcgagcttaattatatgaacttttaagaaatatctattcacctgaagga

SEQ ID NO: 1985 - DNA, 700 bp, Arachis hypogaea
tcacaaacccagatacatcattacacattgatcacaaaattcccccaagctaaggtagttgttttctattaaactgcattaaataattaaatcaaacccatctaggaattgagggtatacaccattatattgtattgaataatggatagagtgacaaagttggtttcagagaggccagtggtgatatttagtaggagtacatgctgcatgtgccacaccatcaagacactgttctgtgattttggtgtgaacccagcggttcatgagttggatgagatacaaagaggaagagacatagagcaagctctttcaaggtttggttgcaacccttctgtgcctgcagttttcattggtggtgagcttgttggtggaaccaatgaagtcatgagccttcaccttaaccgatccttgatccctatgctcaagaaagctggtgctctttgggtttgaattttcatttcattttcattttcacatcatcatcttattgctatcactatctactcaccatgcacacacatgcacttactaataagtctgttttggcatagtaatatatatatatagagagagagagggcagtgtcatatattcatataatatagagttcatatatatggcactagatgcttgctaaaagaatgatgtaattatctttttgatgattataataaactaatacatggtagtttgcagaacc

SEQ ID NO: 1986 - DNA, 697 bp, Arabidopsis thaliana
tatatccacacaacatttacacaatacccttattctccacgtagaatcaagagtacttcttttccttaaatctctacaaaaaaaaaatcgatctatatactaagagatcataaatatagattcatagacctatttaagaaacgacttaagaagctgttggatcatataccatataaaatagcaatggatatgataacgaagatggtgatggagagaccggtggtgatttacagcaagagctcttgctgtatgtctcacacgatcaagactttgctctgcgatttcggagcaaatccagcggtttacgagctggatgagatatctagagggagggagatcgagcaggcgttgttgcggctcgggtgtagccccgcagttccgggcgttttcattggtggagagttggtcggtggagccaacgaggtcatgagtctacatcttaacggatccttgattcccatgcttaagcgggctggtgcattgtgggtttgacttatcatgtttttaactagtttacttaacactaagttaagtacgcagaataattttaacacatctatgatcttggcatggtgatatgatgagtccacgtcggatcaataatcagtgtgttgtctttttttttttggttgtcttactttaagatatgtatcgactgatacgaacttctatgaaataaaaatatattgacctgcat

SEQ ID NO: 1987 - DNA, 634 bp, Gossypium hirsutum
atggggacctcacaatctcaacaacagctatacatttagcctctcacttgcaaaacccttccttacttttggcattgttttccgcgtagtatatcaaatggagagagtgacaaagttggcatccgagaagccagtggtgatcttcagcaagagttcgtgttgcatgtcccacaccatcaaaacccttttctacgactttggtgtcaaccctgcggttcacgaactcgatgagatttctagagggcgtgaaatcgaacaaactctttcgaggctcggttgcaacccttctgtcccagccgtcttcattggtggtgaattcgttggtggagctaatgaggtcatgagtcttcatcttaatcgatccttaattccaatgcttagaagagttggggcactttgggtttaatccaaaaattaatccactaacttgcatgccaaggcactaataaaattgtgattattatatattattatatataatcacataaattagatccatgagagtgtagatttcaggtctaattaacggtgagcactactaattaacgacttctcttagtgagtgggtatgttatctttttggtaatgtactaattatgtttttgagtaataaaagttgcgatttacatttaaa

SEQ ID NO: 1988 - DNA, 681 bp, Tropaeolum majus
cggccggggtacaccaaaaacatcatcaacatttcaatccacaaagctcataaaacaaaaaaaaaacattcctttttatcatttttctatcataaataacatttcggaaatacccattaaacgtttttgtgtttgcttctctctcaagcatcgtatcatcgaaaactcgataaacacaatacttttgtaatatggataaggtgacaaagttggttgcggaaaggccggtggtgatcttcagcaaaagttcatgctgcatgtgtcacaccatcaagaccttattctgtgactttggggttaaccccgcggttcatgagctcgatgagataccaagaggtcgagaaatcgagcaagcgttgtctagacttggtcgcagccctaccgtacccgttgtgttcataggtggtgagctcgtgggtggaaccatgaagttatgagtctccatcttaatcgatctttgatcccaatgcttaaaagggttgagcattatgggtttgatataattagtttaagtaattaactaattaagtacttatactaacttagtatttagtacttaattaattaacttgaggccttaaagcaattaaagggtataaataaagatgtggtataattatagtaatatatgactacaatgatgagtttactactttattatagtaaagtgctatgtatatg

SEQ ID NO: 1989 - DNA, 321 bp, Fragaria vesca
caatggaggcggtgacaaagatggcgtccgagagaccagtggtgatctttagcaagagctcatgttgcatgagccactcaatcaagaccttgctttccgactttggtgtgaaccccgcagtgtatgagcttgatgagatgcacagagggagagaaatagagcaagctctgttgaggctcggatgcagcccatctgtgccggctgtgttcattggtggcgaatttgttggcggagccaatgaagtcatgagcctgcatcttaagcgctctttaatccccatgcttaagcgcgttggtgcattgtgggtttgatcaatctcat

SEQ ID NO: 1990 - DNA, 811 bp, Fragaria vesca
caagtataactagtacgtactgcaaccatatactccacgctccacatttctcagttactcacccattagcattacatactttgccttgtttgatatatacattgttgttttggaccttaccgaaagacgattaacttgcaatggaggcggtgacaaagatggtgtccgagagaccggtggtgatcttcagcaagagctcatgctgcataagccactcaatcaagaccttgctttccgactttggggtgaacccagcagtgtatgagcttgatgagatgcaaagagggagagaaatagagcaagctctgttgaggctcgggtgcagcccatctgttccggctgtgttcattggtggcgaatttgttggcggagccaatgaagtcatgagtcttcatcttaagcgctccttaatcccaatgcttaagcgtgtcggtgcattgtgggtttaatttgttggcggagccaatgaagtcatgagtcgtcatcatcatgttagctaagcacttcctgtcaagaatcttaattagttatgcatgcataagagattaagtgtgggataattatatatgacatatagagcctgtgagagattttatttttatttttttaaataaggctactatttctacttaattagtattaagtactcttactagcttgaaagggttattagcctttttgtgatccaatgtacttcgtgttattttcccaaacaccaattgaaggggttgatatttgtgttcaactcagtattggtatgggaaggagaatatatatatatatatatatatatatatatatatatatatat

SEQ ID NO: 1991 - DNA, 725 bp, Fragaria vesca
acaaacacatcaaacacctcaccaatacacattcatctgaaagctctactttcctctgaatctaaacacatttcacttaccaattagcatacacttcgccttcgagtcattacattttcgccttgtttactggaagaaagctgctagctagcaatggaggcggtgacaaagatggcgtccgagagaccggtggtgattttcagcaagagctcatgctgcatgagccactcaatcaagacattgctttccgactttggggtgaacccagcagtgtatgagcttgatgagatgcaaagagggagagaaatagagcaagctctgttgaggctcggatgcagcccatctgtgccggctgtgttcattggtggcgaatttgttggcggagccaatgaagtgatgagtcttcatcttaagcgctccttaatccccatgcttaagcgcgtcggtgcattatgggtttgatcaatctcatcatcaagaaaaccaagtacctgcatgacaagcacgctaataagaatgctagctatgcacaagagatataagatatagagaaagtgagagttctgttttcaaaataagggtaactatagctacttgattagtactaagtactactcttaatggctgttttgtaacacatgtaaggcctggtgttattttctgaaacaccatgacgtacaattgtgttaaacacattataatataatattattggtgatttggtt

SEQ ID NO: 1992 - DNA, 651 bp, Gossypium hirsutum
cagagtacatgggaaagtacacaactacacgaactacatcaacaacacaaagtactctcccccaacgacaatacctttctacttgtcaaaaagaaaaaaaaacaacagtactagctttcttttttggtgcattgtttcgatagcaatggagaaggtacgaagttggcatccgagagaccggtggtgatcttcagcaagagttcttgctgcatgtgccatacaatcaagacccttttctacgaattcggagtcaaccctgcagtctacgagcttgatgagatccctagaggacgtgaactcgaacaagctcttttaagacttggttgtagcccttcggttccggtcgtgtacatcggtggtgaatttgttggtggagccaatgaagtcatgagtcttcaccttaaccgatccttaatcccgatgcttagacgagccggagccctttgggtttaattcatccaatctcactctaacttgcatatcaaggcactaataaagtatgtgattacatataatatatatagtcacattaggtttaagttctaattaacagtagaatgtatcgaggcatcgtactttatatctttactaattagagtgttatctttttggtaatgtactaattatgtctttttggtaataaaaatcatg

SEQ ID NO: 1993 - DNA, 860 bp, Cannabis sativa
caacacaacaccccatcacaagaccctatataaacacatccttaccagcctaaatttcccacaacaaaaacatcatcaactcttcttactacaaactacaacaacttctactactttcataccattccagcctagctctactacttcttcttcttcctcttcttcttcttagtgtcaaatattattgttggcattgttacattttgatatattattaataattataatggagagagtgactaagatggcatcagagaagccagtggtgatcttcagcagaagcacttgttgcatgtgccacaccataaagacattgttctgtgattttggtgtgaacccaacggtttacgagctagacgagatcccaagagggagagagatcgaacaagccctcaccatgctcggctgcagccccactgtacccgcagtcttcattggtggtcagctcgttggtggtgccaatgaggtcatgagccttcatctcaagaggtccttaatcccaatgctcaaaagtgttggagctttatgggtttaattaataataataataatcccaatatatattatgtttcttataaaccctattacctttcacgtacgtataagtttagagttttaagagattatatattaatattatataataaaaataataataataataataataagcatagcttaattagactactttttccttttttgaagaaagtagttagtaagctagctagcttaatatatagatatatatatatgtaatatgtataatctactacttggtgtgtactgtgtagtacttagcctttttgtaacactattattataatataattaatgaatatattgtgtttttcttatac

SEQ ID NO: 1994 - DNA, 535 bp, Brassica napus
caaaggttaaataagaaacaaaaattaagaaactgaattttagtagtgataccttataatacaactagcaatggagatgataactaagatggtgttggagagaccagtggtcatttacagcaaaagctcatgttgtatgtcccacacggtcaagactttgctctgcgacttcggtgcaaatccagcggttcacgagcttgatgagatacctagaggcagggagattgagcaggcgttgttgcggcttggatgtagcccggcggttccagccaattttattggaggagagttggttggtggagccaacgaggtcatgagtcttcaccttaacggctcattgatccctatgcttaagcaggctggtgcattgtgggtctgacttaatatatttaactaaatagtttacttaacactaagttaagtacgcagaataatgtttttaaatacatctatggtttttgacgtggtgatatgtatgagtccatgtcagatcaataatccgggtgttatcttttactgttttgatgttacatga

SEQ ID NO: 1995 - DNA, 720 bp, Citrus clementina
aaacctcaagcactagctacctaggaaatagttagtttcatcacatttttcatactatacaagcttgcattgcattgctttgctctctttcatcttcgtttctttacttctctagcattgtatccacaattcaattaatactatggcaatggagcgagtagccaaaatggcatcagagaggccagtggtgatcttcagcaagagctcttgctgcatctgccactcaatcaagactctcttctgtgactttggagtgaacccagctgtttatgagctggacgagatgccgggcgggcgtgagcttgagcaggatcttcaaaggctcggttgcagccccgcggtgccggccgtgttcatcggcggtgagctggttggtggagccaatcaagtcatgagtcttcatctcaatcggtctttgatcccaatgcttaaaagggttggagcaatatgggtctgattaaaactaatttttaatcagttacgaatctttttgcgcatcgggcactttttaattataaattaataaacatgtgatgtgacttagctagcttagttgcataatatgacatattaagaggattattatatactatataggtgtcggatgtcttggttttagtcctaatgaatctactaatcactatgtatcgcgtgaatgtcgtctttttggtatcgtaatgttgtggttttgtttgctaataaagttgctgttttttttca

SEQ ID NO: 1996 - DNA, 720 bp, Citrus sinensis
aaacctcaagcactagctacctaggaaatagttagtttcatcacatttttcatactatacaagcttgcattgcattgccttgctctctttcatcttcgtttctttacttctctagcattgcatccacaattcaattaataatatggcaatggagcgagtagccaaaatggcatcagagaggccagtggtgatcttcagcaagagctcttgctgcatctgccactcaatcaagactctcttctgtgactttggagtgaacccagctgtttatgagctggacgagatgccgggcgggcgtgagcttgagcaggatcttcaaaggctcggttgcagccccgcggtgccggccgtgttcatcggcggtgagctggttggtggagccaatcaagtcatgagtcttcatctcaatcggtctttgatcccaatgcttaaaagggttggagcaatatgggtctgattaaaactaatttttaatcagttacgaatcttttggcgcatcgggcactttttaattataaattaataaacatgtgatgtgacttagctagcttagttgcataatatgacatattaagaggattattatatactatataggtgtcggatgtcttggttttagtcctaatgaatctactaatcactatgtatcgcgtgaatgtcgtctttttggtatcgtaatgttgtggttttgtttgctaataaagttgctgttttttttca

SEQ ID NO: 1997 - DNA, 695 bp, Eutrema halophilum
acacaacattctcacaaaaccttattcttccagtactcgaatcttattttcaatctcatcttcctttgcccgaaaatacatacatatttgatttttaaacctaattcagaaacacgacgtaaacaaaactatataaacaatattttggatcgtagctcttataccataaactagaagaaatggagatgataacgaagatggtgttggagagaccggtggtgatatacagcaaaagcgcatgttgtatgtctcacacgatcaagactctgctctgcgatttcggagcgaatccagcagtttacgagctagacgaggtgtctagagggagggagattgagcaggcgttgttgcggctcgggtgtagccctgcggttccggctgtttttatcggaggagagttggtcggtggagccaacgaggtcatgagtttacaccttaacggatctttgatccctatgcttaagcgggctggtgcattgtgggtttgacttgctatacatatacttaactagctacttaacactaagttaagtacgccgaataatgtttttttaacacagctattatatgagctttgacatggggatatgagtccaagtcagattaataactagggtgttgtcttcttgttttttgaggtcatcctaatatattaaatgtatgagttatatgaacttctatgatattgacctacc

SEQ ID NO: 1998 - DNA, 733 bp, Eutrema halophilum
tagaaacaaaatccaaacatcttgtccgatctaatccaataatcatcgtcttctctgcctctatataaacaaaagacttcccaccaatttcatatccacacaacattctcacaaaaccttattcttccagtactcgaatcttattttcaatctcatcttcctttgcccgaaaatacatacatatttgatttttaaacctaattcagaaacacgacgtaaacaaaactatataaacaatattttggatcgtagctcttataccataaactagaagaaatggagatgataacgaagatggtgttggagagaccggtggtgatatacagcaaaagcgcatgttgtatgtctcacacgatcaagactctgctctgcgatttcggagcgaatccagcagtttacgagctagacgaggtgtctagagggagggagattgagcaggcgttgttgcggctcgggtgtagccctgcggttccggctgtttttatcggaggagagttggtcggtggagccaacgaggtcatgagtttacaccttaacggatctttgatccctatgcttaagcgggctggtgcattgtgggtttgacttgctatacatatacttaactagctacttaacactaagttaagtacgccgaataatgtttttttaacacagctattatatgagctttgacatggggatatgagtccaagtcagattaataactagggtgttgtcttcttgttttttg

SEQ ID NO: 1999 - DNA, 687 bp, Castanea mollissima
caattgccttcacattccttacaaccctagctacattgctcgcttaatcactactattttcgagtgaaacccttttctcaaaatttggcattgtgtccaaatttagtctttttcttatactacatttcaaaattttgcattaattggcaatggagagagtgacaactttggcatcagagagacccgtggtgatcttcagcaagagctcttgctgtatgtgccactccatcaagaccctcttcaatgattttggggtgaacccaactgtgtatgagcttgatgagattcaaagagggagggacattgagcaagctctttcaaggcttggttgtagcccaagtgtcccagctgtgttcattggaggtgaacttgtgggtggagccaatgaggtcatgagtcttcaccttaagaggtccttaatcccaatgcttagacgtgctggggcaatatgggtttgattaacttagcttataacaacatcaggcgctaataaatgttgtggctataacataataatatatatatgcatgagaagtaggcgtcagatgtattaaacctatagagagagagcttactataaagtctacttcgtacgagtactataagctttttgtaataatataatgttatgctttttgctaatgttgtcccaatttgcatcaatggtataacttctaagtttaaaaa

SEQ ID NO: 2000 - DNA, 742 bp, Quercus alba
gaccaaaactcaattgccttcacattcctcacaaccctagctacattttcgagtgaaacctttctctcaaaatttagcattgtgtccaaatttagtctttttcctatactacatttcaaaattttgcattaattggcaatggagagagtgacaactttggcatcagagagacctgtggtgatcttcagcaagagctcttgttgtatgtgccactcgatcaagaccctcttcaatgattttggggtgaacccaactgtgtatgagcttgatgagattcaaagagggagggacattgagcaagctctttcaaggcttggttgtagcccaagtgtcccagctgtgttcattggaggtgaacttgtggggggagccaatgaggtcatgagtcttcaccttaagaggtccttaatcccaatgcttagacgtgctggggcaatatgggtttgattaacatagcttataacatcatcaggcgctaataaatgttgtggctataacacaataatatatgcatgagaaatagccgtcagatgtattaaacctatagagtgagagcttactataaagtctactacgtacgtgtactctaagctttttgtaataatgtaatgttatgctttttgctaatgtacgttgtcccaatttgcatcaatggcataactcctaagtttaatattgttcttaataagctcattgttggggcaaactggcgagcttctaattttttaatacttatttagta

SEQ ID NO: 2001 - DNA, 828 bp, Carica papaya
tcacacctcttctaccatttcctcacgcctaatcgtttaccgatactttttattataacttgcattttatacccattaaagtctgtctccttcgtccattaatcagatcatatatatagagtttagtggtttgtggcgatggagagattgacaaagatggtgcaagagaagccggtggtgatctttagcaagagctcttgctgcatgtgccacacggtcaagactctgatatgtgacttcggggtgaatccggcggtgcacgagctggatgagataccaagagggcgggagatcgagcaggctctggctcggcttgggtgcagtccgacggtgccggcggtgttcataggtggtgagcttgtgggtggagccagtgaagtgatgagtcttcacctcagtcgctccttaatccccctgcttaaaagggctggagctttatgggtttaaagttgattaattaaattaatcggcggcacccataataagcatcgtgttcctgtgatgatgatcatttgctaactggttatttacatatagtgtatatctatacactttgaagatgacatatgagatatcagtaggtaggtgccggatggaatattattaaaaactacgtaatggtactaaatattgcgagtcctttatatatatatatatgagtgtagtaatggtcttttttggtaatgtaatatatatatatatatatgtatatgtatttactgttatatatacatatggtctctttttcgtaatatgtaatgttccatgtatgatcccttttggtgatgtaacttattcagcttataataataaattagttaccgttaa

SEQ ID NO: 2002 - DNA, 1286 bp, Raphanus sativus
tgggccacaaagttgtatataagctatgaacaagaacgacataaacgtatgcttctctaatattaatcaatataatggcttatgatttttatattaatcgagatcagctatagaacgctctatggaattgtacgaactaaggacactatcaccttttagccatgactaaatacatatgaaaaaaatacatacatatgcctaatggacaactttttaaataaaaaatacactttcgaaatcatcagattctctctttacttaacatttgtgatccaaaataaaactgaccttgtgtcgctgtcggaagtgatatcattagaaacaaaatcttaacatattgtccggtctgatccaataatcatagtcttctctgcccctatataaacaagctcttccaaccaattttatatcaacacatcattctcacaaaaccttattcttcaagtccaatcaagagttttactttgttttccccttaaatcttttcgatattttcttttgattattaaacttgttgaaaaacaacgtaaagaagaaatctaaatagttggataccatcgaaaacaacaatggagatgataacgaagatggtgttggagagaccagtggtgatatacagcaaaagctcatgttgtatgtctcacacggtcaagactttgctctgtgattttggagcgaatccagcggtttacgagttagacgaggtgtctagagggagggagattgagcaggcgctgttgcggctcgggtgtagcccagcggttccggctgtttttattggcggagagttggtcggtggagccaatgaggtcatgagtctacaccttaacggatccttaatcccgatgcttaagcgggctggtgcattgtgggtttgacttagtatatctaactagcaacttaacactgagttaagtacgcagaataatgtttttaaattttaacacatggatgatctttgacatggtgatatgatgagtccacgtcagatcaataatcagtgtgttgtcttcttattgtacttctgaggttacttctacattttcaaaatgtgcaatcaattatatgaacttttaagagaaaactgtatacgaatctgaaggaactaatttaattataataaactgatttgtcttactcgtttgtgattatattatcactgtatgaatattcatattcaaattcagtaaaatgcacattgttgataaaaagaacaagctgaatgcaagatggggctggaattatatggattgtaaagaaactaaactttgtataagtaagatatc

SEQ ID NO: 2003 - DNA, 346 bp, Glycine max
tacatatatatatatatataatggatagggtgacacagatggcatcagagagaccagtggtgatattcagccggagttcctgctgcatgtgccacaccatcaaaaccctcttcagtgactttggagtgcatccaaatgttcatgaacttgatgagataccaagagggaatgacattgagcaagctctttcaaggctagggtgcagcccctctgtgcctgttgtgttcattggcggtgagcttgttggtggagccaatgaagtcatgagccttcaccttaaccgctccttgatccctatgcttaggagagctggagctctttgggtttgatcaatttcactactata

SEQ ID NO: 2004 - DNA, 497 bp, Glycine max
tcaagtaccttctccttcacattccctcagcactttctgtattcaaaacttttggcattgtttccaatatcctaacttgagactatatatatagcagcatatatatatatataatggatagggtgacacagatggcatcagagaggccagtggtgatattcagcagaagttcatgctgcatgtgccacaccatcaaaaccctcttcagtgactttggagtgcatccaaatgttcatgaacttgatgagataccaagagggaaggacattgagcaagctctttcaaggctagggtgcagcccctctgtgcctgctgtgttcattggtggtgagcttgttggtggagccaatgaagtcatgagccttcaccttaaccgctccttgatccctatgcttaggagagcaggagctctttgggtttaatcaatcaattaattcactactatcaggcactaattaattaataaatctgttttggttacatatgtataattatgg

SEQ ID NO: 2005 - DNA, 697 bp, Thellungiella halophila
ggacacaacattctcacaaaaccttattcttccagtactcgaatcttattttcaatctcatcttcctttgcccgaaaatacatacatatttgatttttaaacctaattcagaaacacgacgtaaacaaaactatataaacaatattttggatcgtagctcttataccataaactagaagaaatggagatgataacgaagatggtgttggagagaccggtggtgatatacagcaaaagcgcatgttgtatgtctcacacgatcaagactctgctctgcgatttcggagcgaatccagcagtttacgagctagacgaggtgtctagagggagggagattgagcaggcgttgttgcggctcgggtgtagccctgcggttccggctgtttttatcggaggagagttggtcggtggagccaacgaggtcatgagtttacaccttaacggatctttgatccctatgcttaagcgggctggtgcattgtgggtttgacttgctatacatatacttaactagctacttaacactaagttaagtacgccgaataatgtttttttaacacagctattatatgagctttgacatggggatatgagtccaagtcagattaataactagggtgttgtcttcttgttttttgaggtcatcctaatatattaaatgtatgagttatatgaacttctatgatattgacctacc

SEQ ID NO: 2006 - DNA, 805 bp, Brassica napus
aacattgttctacgagtccaatcaagagttttcttttccctaaaatcttgtctttcgttattaaacttgtttaaacaacgtaaagaagaaatctaaagagtagttgctcctagtcctattaccacatataatacaaaaatggagatgataactaagatggtgttggagagaccagtggtgatatacagcaaaagctcatgttgtatgtctcacaccgtcaagactttgctctgcgattttggagcgaatccagcggtttacgagctagacgaggtgtctagaggaagggagattgagcaggcgcttctgcggctaggttgtagcccggcggttccagctgtttttataggaggagagttggtcggtggagccaacgaggtcatgagtctacaccttaacggatccttaatccctatgcttaagcaggctggtgcattgtgggtttgacttaatatataactaactagtttacttaaccctataagttaagtacgcagaataatgctttttaaagttttaacacatctatgatctttgacatggtgatatgatgagcccacgtcagatcaataatcagggtgttgtcttcttattttactttttttactttcttattgtacttttgaggttacttacttaaccttaacactaaaattatgaatggtgactaaggaatgattaggaataatgcattccctaacattcctataaaaaatcaccattcataaggaataataattctctcacattccctctggttcttttttttgtagagaattaaagaacaaaattattccttattaaa

SEQ ID NO: 2007 - DNA, 645 bp, Lippia dulcis
caacaaaccaagagctccctagcaacattacttgcatacatccaaccatatatacttgtgtaaccctattttccttgttataaccaacaacaatggatagagtgagcaaaatggtggccgagaagccggtggtgatcttcagcaagagctcttgctgcatgagccactcagtcagatcgctcttttgcgatttcggggtcaacccgatggtgtacgagctcgacgagatccccaggggccgggagatcgagcaggcactgtcgaggctcggatgcaaccctaccgtgcctgcggtgttcattggcggggaattcgtcggaggggcgaatgaagtcatgagtcttcacctcagtagatccttgaagccgatgctcaaaagggccggcgccctctggctttgattttagggtttacgagcgatgtgtccgatatgtacgagtgaataataatatgcagttttggtgcatgtgatttgtgtgtgggaagagtcggattagttagtggagagagagatgagagacgagtttttgtgctctagtttatgtttttaaattacgtatatgtgcttcagctttttttaataaagctgcattaagtacttatgcttgtgttaatctatagtatgaaactttcaggatttgaaag

SEQ ID NO: 2008 - DNA, 667 bp, Malus domestica
cgaattccgttgctgtcgatcctctcaactattcgcattgctctccttacccttttcccaacttcccaatctttttgacacacctttcacttcaattctcatttgctctcctaaaccctaatcttcttacatttttgaagagtactgctagctacatttcaatcagcgatggatgcggtgacaaatatggcttcagagagaccagtggtgatcttcagcaagagctcgtgctgcatgtcgcactcgatcaaaaccctgctttgtgactttggggtgaacccagcagtgtatgagcttgatcagatgcaaagagggagagagatagagcaagctctctctaggcttggatgcaaccctactgtgcctgctgtgttcattggtggtgaacttgttggtggagccaatgaggtcatgagtcttcatcttaagcgctccttaatccccatgcttaagcgtgtcggagcattatgggtttgattaattcaaactatggctaattaacttgcataacagaagctattaagattcctagttatgcatgcttgagatattaactaaacaagtatcggagtcggaataaataaaaaataaaaaaaaatctatatatatataatatcatataataaggttattaacttattatgtactctagcttttttgtaagatg

SEQ ID NO: 2009 - DNA, 699 bp, Arabidopsis lyrata
catatcaacacaacattacaaaacccttattctccacgtagaaccaagagttttcttttccttaaatctctacaaaaaaaaaatcgatctataaagagcacatacatattgattcataaacctatttaagaaacgacttaagaagctgttggatcatatataccatataaaatagcaatggatatgataacgaagatggtgatggagagaccggtggtgatatacagcaagagttcttgttgtatgtctcacacgatcaagactttgctctgcgatttcggagccaatccagcggtttacgagctggatgagctacctagagggagggatatcgagcgggcgttgttgcggctcgggtgtagccccgcagttccggcggttttcatcggtggagagttggtcggtggagccaatgaggtcatgagtctacatcttaacggatccttgattcctatgcttaagcgggctggtgcattgtgggtttgacttattatatttttaactagtttacttaacactaagttaagtacgcagaataaaaatttaacacatctatgagctatggcatggtgatatgataagtccacgtcggatcaataatcagtgagttgtcttttttttgttttgatgttaccttacttttaaatatgtgttgacttgtatgaacttttacgaaaataataatatatcgacctgcat

SEQ ID NO: 2010 - DNA, 656 bp, Brassica rapa
  misc_feature (653)..(654): n is a, c, g, or t
tacgagtccaatcaagagttttcttttccctaaaatcttttctttcgttattaaacttgtttaaacaacgtaaagaagaaatctaaagagtagttgctcctagtcctgataccacatagaatacaacaatggagatgataactaagatggtgttggagagaccagtggtgatatacagcaaaagctcatgttgtatgtctcacacggtcaagactttgctctgcgattttggagcgaatccagcggtttacgagctagacgaggtgtctagaggaagggagattgagcaggcgctcttgaggctcgggtgtggcccagcggttccggctgtttttatcggaggagagttagtcggtggagccaacgaggtcatgagtctacaccttaacgggtccttaatccctatgcttaagcaagctggtgcattgtgggtttgacttaatatataactaacaagtttacttaaccctataagttaagtacgcagaataatgttttttttttaatttcaacacatctatgatctttgacatggtgatatgatgagtccacgtcagatcaataatcagggtgttgtcttcttactgtatttttgtgaacttttcttattgtacttctgagggtacttacttaatactaagtttaagtaagcnnaa

SEQ ID NO: 2011 - DNA, 747 bp, Brassica napus
atcaacgcagagtacgcggggcacacaacaaactcacaaaaccttgttctacgagtccaatcaagagttttcttttccctaaaatcttgtctttcgttattaaacttgtttaaacaacgtaaagaagaaatctaaagagtagttgctcctagtcctgataccacatagaatacaacaatggagatgataactaagatggtgttggagagaccagtggtgatatacagcaaaagctcatgttgtatgtctcacacggtcaagactttgctctgcgattttggagcgaatccagcggtttacgagctagacgaggtgtctagaggaagggagattgagcaggcgctcttgaggctcgggtgtggcccagcggttccggctgtttttatcggaggagagttagtcggtggagccaacgaggtcatgagtctacaccttaacgggtccttaatccctatgcttaagcaagctggtgcattgtgggtttgacttaatatataactaacaagtttacttaaccctataagttaagtacgcagaataatgttttttttttaatttcaacacatctatgatctttgacatggtgatatgatgagtccacgtcagatcaataatcagggtgttgtcttcttattttactttttttactttcttattgtacttttgaggttacttacttaaccttaacactaaaattatgaatggtgactaaggaatgattaggaataatgcattccctaacattcc

SEQ ID NO: 2012 - DNA, 705 bp, Cleome spinosa
gacctcaaattaatcaccaaagatctcaagcttcttccttagccataccctaaaattcccgattaataatcttcgaaatcgttcttgtaaaatggaggtggtgacgaaattcgtgtcggagaaacctgtggtgatattcagcaagagctcgtgttgcatgtcgcacacgatcaagacattgttccacgactttggtgtgaacgcaacggttcacgagctcgatgaaatggcgagagggcgagaagtggagcaagccttggccatcctcggctgcagccccactgtgccggccgtcttcatcggaggccagctcgtgggcggagccaatcaagtcatgagccttcaccttagccggtctctcatccctatgctcaagaaagccggtgcattgtgggtttaatatttaactatagctaacattcactataatataatatatgcatgtgtgtatatatataacatatgatcgcatatacgtgtatacatgtatatgtgtgtgtgtatgtatttgtcgagctatgtgggtaaccctatgtaagctgccttcatgtgtaagttcacttctccgagcaacacactaacgtgaggtttggttcgttatgtgtttactactaatgagtaatgttaaatcttaatttaagctactactactcttctgtcggtaaaaatgtccattcaaatatttttcacctaaatatattatgg

SEQ ID NO: 2013 - DNA, 912 bp, Populus trichocarpa
agaaaccgtccgaaatatctagcagaacattcttcttttgcttcgcaatcaaatctttttctctttgctaccattgccaatccacccaaaaccttcaaatttaaccctatatatacgagtctcatgatatcaagcacctcacaaccaaaaaacttaactgtccatcacaatattccttactagctagctacatcatttgtttctctcctgctcgatcggttttgagacttctagctagcttgtaattaaaataactcgctaagtcattggcattagtttcttgctcgttgatttggaaatggagagggtgacaaatttggcatccgagagaccagttgtgatcttcagcaagagcagttgctgtatgtgccacaccatcaagactctcttcaatgagtttggggtgaacgtggctgtccatgagctcgatgagatgcctagaggaagggaaattgagcaagcactctcaaggtttggatgcccaacattgcctgccgtgttcattggtggtgaacttgtgggtggagccaatgaggtgatgagccttcaccttaatcgttccttaatcccaatgcttaaacgtgctggcgcgttatgggtttgatccatcgatgaactagcttagctacgcatcaggcactaaccaaataaattatgaaacatgttctggttgctcataacatacatatatgctaatgcatgaatatatctatatatataaatagcttgcaataatgttataaatcatactataggtgtcggatgtgtaattaagtatattgagtattagctactatatgtagtttgtgctgagagctagtttacgtacttctactcctttttgtaatgtaatgctactattatatatgtgctttttggctaataaaaccgcagtttgcttaaatttaaaga

SEQ ID NO: 2014 - DNA, 1162 bp, Prunus persica
ctcgatgatagatatggcagatcaaaaaaccaagtgtggaaaatgagccacctagctagctgctgttcatcatcaactcaccaagtattctccgagtactatcgtatcgccctttctactttctctagttctatgggcagagaaaccagagcgcagaaacgggttcctttgaaaaacaaaacaggaatataaacccgtaaatgaaaattttggtggatatgttcgcatgccacaaagtgttaccgtcatatagaaaaatccctcggaaaatataagcatgacggaataataatgtataaaggaagcaaatcaggataagaatgtgaagaagaaaaagaaaaagaatacaagtatacaaaaaatgtgcatatatttaggcaacaagcacatcaaaaacaagataagaatgtgaagccgtacaaaggacacgtctctatatttccgtattcaaaaagattcgatcaaattggatcgctgtcgagtgaagatcaaagcaagatttggcaagcagtgccgaaataacattcttcttttcctgcacagtgcactatcaaattaaaatccccttttaatttctagcaaaatagctaaagtcagcaatgccaatccacttgaactctcccaccatgtccctatatatacactcccacaacaacccaaaaactcaccacacaaaacctcaattctcacaaagctcacattgctcattgctctcctgacctttttcttaataatttcctctaaatttctgtcacgcatttcacttcaaatcccagttgaaaatcatctcaccaaacttgtcaacctttgttcaattgggcattgtgctgcatttcactagttagcttagcaatggaggtggtgacaaagatggcttcagagagaccagttgtgatcttcagcaagagctcatgctgcatgtgccattcaatcaagaccctgttttctgattttggggtgaacccagcagtgtacgagcttgacgagatgcagagagggaaagagatagagcaagctctttcaaggcttggctgcaaccctactgtgcctgcagtgttcattgggggagagtttgtgggtggagccaatgaggtcatgaatcttcatcttcagcgctccttaatcccgatgcttaaacgcgctggagcgttgtgggtttgat

SEQ ID NO: 2015 - DNA, 598 bp, Raphanus sativus
ggacacaacattcacacaaccttaacaaagatatcatattgattaggaaacctattccaaacgttaaataaagaaacaaaaactaagcaactgcattttagttgtgacaccatataaaactagtaatggagatgataacgaagatggtgatggagagaccagtggtgatatacagcaaaagctcatgttgcatgtcccacacggtcaagactttgctctgcgacttcggtgccaatccagcggttcacgagcttgatgaagtacctagaggcagggagattgagcaggcgttgttgcgtcttggttgtagccctgcggttccagccatttttattggaggggagttggttggtggagctaacgaggtcatgagtcttcaccttaacggttcattgatccctatgcttaagcaggctggtgcattgtgggtttgacttatctactttatctaactagttacttaacactaagttaagtacgcagaataatgttttgtaacacatctatgatctttgacatggtgttttgtaacacgtcaggtcaataatccgggtgttatctgtttagtgtttttgatgttatcctaatttaaacgcga

SEQ ID NO: 2016 - DNA, 768 bp, Fragaria vesca
acaccaacaagtataactagtactacaaccatatactccttcacgctccacatttctcagttactcaccaactagcattacatactttgccttgtttgatatatacattattgtattggaccttagcgaaagacttgcaatggaggcggtaacaaagatggtatctgagagaccagtggtgatcttcagtaagagctcatgctgcattagctactctatcaagaccttgctttctgactttggggtgaacccggcagtgtatgagcttgatgagatgcaaagagggagagaaatagagcaagctctgttgaggctgggatgcagcccatctgttccggctgtgttcattggtggcgaatttgttggcggagccaatgaaatcatgagtcttcatcttaagcgctccttgatccccatgcttaagcgcgttggtgcattatggatttgatcagtctcatcgatcatcatcaattaagttaactaagcacttcctattaagaatcttaattaattatgcacgcataagagatcaagtgtcggatgataatacatgacatatagagcctgtgagagtttttaataaggctactattgctacttaattagtattaactattaagtactcttactagcttgaaagggatcttattagcgtttttgtgatccaatgtaacacttcgtgttattttcccaaacaccaattgaaagagttgatatttgtgttcaactcagtattggtatggaaattgggaaggataatatatatat

SEQ ID NO: 2017 - DNA, 540 bp, Cleome spinosa
tctcaaacacaataattccacattttcacattttcaaatccacttctatcgtataaaccactaaccaaaccctaaaacccatatcgtaaaaacttccgaaactcgcaatttttttcaatggagaagctgcaaaagatggtatccgaaaaaccggttgtgatcttcagcaagaactcatgttgcatgtcccacaccatcaagaccctcttctgcgatttcggggtgaaacccgacgatctatgagctcgatgagatcggcagagggaaagagatcgagcaagccttggctcagctcggctgcaaccccacggttccggccgtattcataggcggccagctcgtgggcggagccaatcaggtcatgagcctccaccttaaccgatctctcatccctatgcttaagcgagccggagcattatgggtttgatctgttggtgttgtcatgtttttgtaataaaatgttctgaaaaaaaagagatattatagaagaataaatatgcatatatatatatatatataatatgtatgtatgtatgtacg

SEQ ID NO: 2018 - DNA, 664 bp, Eutrema parvulum
atcaaacatagaaacaacaaagtcacttctcatcttcacccaaagacatcatcaagctctctctaagctctcttgcttttctagtttccatcactgacatatctctcatttcaatcaaagaaaaaaatacatattcatcctctctgcgatttttgctttctaaacactctttcacattcaccaatggagaaggtacagaagctgatttccgagaagtcggtagtgatctttagcaagaactcatgctgcatgtctcacacaatcaagactctcttcatagactttggtgtaaacccgacggtctatgagctcgacgagatcaacagaggaaaggagatagaacaagcattggctcagctcggctgcagccccaccgtgccagtggtgttcatcggagggcagctcgttggtggagccaatcaagtcatgagtcttcaccttaatcgctctctcattccaatgcttaagcgtgtcggcgcattatggctttgataatgtaatgtgataatgtaatgatatgaaactaatcaaagcgaacaaaacaaaaacatacatatgactgtatgagttaatgctatgtctatctaagttttgaaaagatagattatgcgagttcctattttgtaaactgtgggtatacttataataaaaatcagctacagtt

SEQ ID NO: 2019 - DNA, 583 bp, Brassica juncea
ctcacaaaacactgttctacgaagtcaatcaagagttttcttttccctaaaatcttctctttcgttattaaacttgtttaaacaacgtaaagaagaaatctaaagagtagttgctcctagtcctgataccacatagaatacaacaatggagatgataactaagatggtgttggagagaccagtggtgatatacagcaaaagcttatgttgtatgtcccacacagtcaagacattgctctgcgatttcggagcgaatccagcggtttacgagctagacgaggtgtctagaggaagggagattgagcaggcgctcttgaggctcgggtgtggcccagcggttccggctgtttttatcggaggagagttagtcggtggagccaacgaggtcatgagtctacaccttaacgggtccttaatccctatgcttaagcaagctggtgcattgtgggtttgacttaatatataactaacaagtttacttaaccctataagttaagtacgcagaataatgttttttttttaatttcaacacatctatgatctttgacatggtgatatgatgactccacgtcagatcaataat

SEQ ID NO: 2020 - DNA, 796 bp, Brassica napus
ggcatgctactgatcgccctatccattaggccagctcgacccacgcgtccgcaaaaccttattctccgagtcgaatcaagagtttcattatttaaacctttacaaaaaaaatttgtttgatatttctttcgcccgtaaaacacatagatattgattcatactcataaacctattccaattgtaaaacaaagaaacaaaaactaaacagtttgattttagctgtgtgataccatataagactagcaatggagatggtcaagaggatggttttggagagaccagtggtgatatacagcaaaagcttatgttgtatgtcccacacggtcaagacattgctctgcgatttcggagcgaatccagccgtttacgagctagatgaggtatcaagagggagggagattgagcaggccttgttgcggcttgggtgtagcccagcggttccagcggtttttattggaggagagttagttggtggagccaacgaggtcatgagtcttcaccttaacggctcattgatccctatgcttaagagggctggtgcattgtgggtttgacttactatatttatctatagttacttaacactaagatatagttacttaacattaagttaagtacgcagaataatgttttttgtttaaatttcagacacatctatgatagttgacatggtgatcatatgagtccatgtaagatcactaatcagggtgttgtccttttattgtttttgagcttatatcagttaaaaatgttcgagtttatatgaacttgtaagaaaatatattgacctgaagga

SEQ ID NO: 2021 - DNA, 755 bp, Brassica napus
acccacgcgtccgaaccttattctccgagtcgaatcaagagtttcattatttaaacctttacaaaaaaaatttgtttgatatttctttcgcccgtaaaacacatagatattgattcatactcataaacctattccaattgtaaaacaaagaaacaaaaactaaacagtttgattttagctgtgtgataccatataagactagcaatggagatggtcaagaggatggttttggagagaccagtggtgatatacagcaaaagcttatgttgtatgtcccacacggtcaagacattgctctgcgatttcggagcgaatccagccgtttacgagctagatgaggtatcaagagggagggagattgagcaggccttgttgcggcttgggtgtagcccagcggttccagcggtttttattggaggagagttagttggtggagccaacgaggtcatgagtcttcaccttaacggctcattgatccctatgcttaagagggctggtgcattgtgggtttgacttactatatttatctatagttacttaacactaagatatagttacttaacattaagttaagtacgcagaataatgttttttgtttaaatttcagacacatctatgatagttgacatggtgatcatatgagtccatgtaagatcactaatcagggtgttgtccttttattgtttttgagcttatatcagttaaaaatgttcgagtttatatgaacttgtaagaaaatatattgacctgaagga

SEQ ID NO: 2022 - DNA, 732 bp, Citrus sinensis
  misc_feature (375)..(375): n is a, c, g, or t
  misc_feature (719)..(719): n is a, c, g, or t
cacgcgtccgaaacctcaagcactagctacctaggaaatagttagtttcatcacattcttcatactatacaagcttgcattgcattgctttgctctctttcgtcttcgtttctttacttctctagcattgtatccacaattcaattaataatatggcaatggagggagtagccaaaatggcatcagagaggcccgtggtgatcttcagcaagagctcttgctgcatctgccactcaatcaagactctcttctgtgactttggagtgaacccagctgtttatgagctggacgagatgccgggcgggcgtgagcttgagcaggatcttcaaaggctcggttgcagccccgcggtgccggccgtgttcatcggcggtnagctggttggtggagccaatcaagtcatgagtcttcatctcaatcggtctttgatcccaatgcttaaaagggttggagcaatatgggtctgattaaaactaatttttaatcagttacgaatctttttgcgcatcgggcactttttaattataaattaataaacatgtgatgtgacttagctagcttagttgcataatatgacatattaagaggattattatatactatataggtgtcggatgtcttggttttagtcctaatgaatctactaatcactatgtatcgcgtgaatgtcgtctttttggtatcgtaatgttgtggttttgtttgctaataaagttgcngttttttttcaaa

SEQ ID NO: 2023 - DNA, 568 bp, Populus trichocarpa
ctcgcaacagcttcctagctcacactgccctctagctacatcatttctgaccactgtttcattggcattattgtgctcagctttttaaacttatttcttgctcgacacagctgatttggaaatggagagggtgacaaagttggcatcggagaggccagtggtgatctttagcaagaccacatgctgtatgtgccacaccatcaagactctcttctgtgactttggggtgaacccggctgtccatgagcttgacgagatgcccagaggaagggaaatcgagcaagcactcacaagggctggatgcccaacgttgccggccgtgttcatcggcggtgagattgttggtggcgccaatgaggtgatgagtcttcaccttagtcgttccttaatcccaatgcttaagcatgccggagcattatgggtttgacccatcggctaattaccttcttgtcaggcactaaccaaataaatgagacgtgttttagctactctatactatgtacgaggagattattaataacacacacgcacacatgctagtaataatattactccataaattatagca

SEQ ID NO: 2024 - DNA, 717 bp, Populus trichocarpa
cacaatattccttactagctagctacatcatttgtttctctcctgctcgatcggttttgagacttctagctagcttgtaattaaaataactcgctaagtcattagcattagtttcttgctcgttgatttggaaatggagagggtgacaaatttggcatccgagagaccagttgtgatcttcagcaagagcacttgctgtatgtgccacaccatcaagactctcttcaatgagtttggggtaaacgtggctgtccatgagctcgatgagatgcctagaggaagggaaattgagcaagcactctcaaggtttggatgcccaacattgcctgccgtgttcattggtggtgaacttgtgggtggagccaatgaggtgatgagccttcaccttaatcgttccttaatcccaatgcttaaacgtgctggcgcgttatgggtttgatccatcgatgaactagcttagctacgcatcaggcactaaccaaataaattatgaaacatgttctggttgctcataacatacatatatgctaatgcatgaatatatctatatatataaatagcttgcaataatgttataaatcatactataggtgccggatgtgtaattaagtatatcgagtattagctactatatgtagtttgtgctgagagctagtttacgtacttctactcctttttgtaatgtaatgctactattatatatgtgctttttggcta

SEQ ID NO: 2025 - DNA, 1090 bp, Glycine max
gaattttcacaatttctaacagcctcactatccaaaagtgaagtgaagcagtgagtgagggaataatgttgcggattgctcccaaattcttcaccacggttcctcttcggaccatttcacccttcgcatgtcgcttctcagtccgttccatcgctgactcttctcctttcaacaaaatccgcattcaaagggatgatactgcatttgatgcatatgtcgttggaaaaaacgacgctcctggaatcgttgtgcttcaggagtggtggggtgtggactttgaaattaaaaatcatgctgtgatgatttctcaacttggtcgtggatttaaagctcttattccagatctgtacagaggaaaggttggtctagatgttgcagaagcccaacatttgtttgatggtcttgattggcaaggtgctgtaaaagatatcaatgcttcagttaactggcttaaggcaaatggttcaaaaaaggctggtgttactggattttgtatggggggtgctctcgcaattgcaagctcagtcttggttccaaatgttgatgctactgtagctttttatggagttccttcttctgagcttgcagaccctgcccaagccaaggctcctgttcaggcccactttggagagctggataattttgttggcttttctgatgttacggctgccaaggccttagaggagaagttgaaggcatctggtgttccacatgaggtacacatatatcctggcaatggacatgcattcatgaacaggtctccagaaggaatcaagaggaggaagaatatgggaatgcccgacgaagacgaagctgcagttcagcttgcatggtctcgcttccagtcatggatgacacattacttatccagctaaatagtttcttagtaatgccacaatggtatgataacatgatatacttctaattctgcatttgattagtagtttggtataactcttaatggccccatcaactctaaatatggtgctttgtttccttatgggtggatacatacacccttgagaaatttggcttggaaataattagtttgtctataataagtaaatatggtctttgtttattggtgtca

SEQ ID NO: 2026 - DNA, 1122 bp, Trigonella foenum-graecum
atgctgagatttgtaacatcgactgcgcccaaattcttcgccacaaagaccagttcaccctttgcttctcgcttctcagttcgttccatggctgactctgctgctcctttcagcaaaatccagattcaaagggatgacaacacaacatttgatgcgtacgtcattggtaaacacgatgctcctggaattgttgttctccaggagtggtggggtgtggattttgaaattaaaaatcatgctgctatgatttctcaacttggccgtggatttaaagctcttatcccagatctgtacagaggaaaggttggtttggatgttgcagaagcacaacatttgtttgatggtcttgattggccaggtgctgtgaaggacattcatgcttcagttgactggcttaaagcaaatggttcaaagaaggctggtgtaactggattttgtatggggggtgctcttgcaattgcaagctctgtgctggttccacatgttgatgctgttgtggctttctatggagttccttcttctgaacttgcagaccctgctcaagccaaagctcctgttcaggctcactttggagagctggacaattttgttggcttttcagatgttacggctgccaaggctttggaggagaagttgaaggcagctagaattccacatgaagtacatatataccctggcaacagacatgcattcatgaacaggtctccagaaggaatcagtaggaggaagaacatgggattgcctgatgaagatgaagcttcagttcagcttgcatggtctcgctttcaattgtggatgacacagtacttgtccagctaggtgatttattactagctgagatattacataatgctatgttctatcttaggaagtaaaacagtaatggtttcatctatgatgcatgtgtactaattaatacttcaacatggactgtaagcactgattgaataaatattgggttgaaaataaggtgaacccgtgatgtaagtgttttagcgtcaaccatcaacatttaccgttcgatatatttgtatttaatttgatggttggggtgaattaggtctccatttatcatctaaagagagaaactttacacaccttatgcattctaaaaagtcacga

SEQ ID NO: 2027 - DNA, 1097 bp, Cajanus cajan
gggggccagacaaattgtaagacacatttctccgaatctccattctcatttagactgttattctcttagcgtcgttcagaagtggagtgagtgagtgagtaatgttgcgtgttgccccaaaattcttcagcagtgtccctcttcggaccatttcaccctttgcatgtcgcttctcacttcgttctatcgctgattctgctcctttcaacaaaatccgcattcaaagggatgacacagcattcgatgcatatgtcgttggcaaaaccgatgcacctggaattgttgtgcttcaggagtggtggggagtggactttgaaattaaaaatcatgctgtgatgatttctcaacttggtcgcggattcaaagctcttattccggatttgtacagaggaaaggttggtctggatgttgcagaagcacaacatttgtttgatggtcttgattggcagggtgctgtgaaagatatccatgcttcagttaattggcttaaggcaaatggttcaaagaaggctggtgtcactggattttgtatggggggtgctctcgccattgcaagctcagtcttggttccagatgttgatgctgttgtagctttctatggagttccttcttctgagcttgcagaccctgccaaagccaaggctcccgttcaggcccactttggagagctggataattttgttggcttttcagatgttacggccacgaaggccttggaggagaagctgaaggtatctggtgttccacatgaggtacacatatatcctggcaatgcacatgcattcatgaacagatccccagaaggaatccagaggaggaagagcatgggaatgcctgatgaagacgaagctgcggttcagcttgcctggtctcgcttccagtcatggatgacacattacttaactgcctaaatggtatgatatgcttctatattcttaggtagtaatttagtgtaacacataatggccccataaactctaaatatggtgcttgttaccttagggtggatacacccttgggaaatttcactaataattttgaaatggtccaagtttgtctagactatagtaataagtaaatatggtctttgtttattg

SEQ ID NO: 2028 - DNA, 1047 bp, Trifolium pratense
tgctgagtgagagtgaggaggtttgtgaaatcatctgctcccaaattcttcccgacaaagccttttcggatcatttcaccctttgcttctcgcacatcagttcgttccatggctgattctgctcctttcaacaaaatccagattcaaagggatgataacactacatttgatgcgtatgtcattggcaaagaagatgctcctggaattgttgtactacaggagtggtggggtgtggactttgaaataaaaaatcatgctgcgatgatttctcaacttggtcttggatttaaagctcttattccagatctgtatagaggaaaggttggtctggatgttgcagaagcacaacatttgtttgaaggtcttgactggccaggtgctgtgaaggatatccatgcttcagttgactggcttaaagcaaatggttcaaagaaggctggtgtaactggattttgtatggggggtgctctcgcaattgcaagctctgtgttggttccacatgttgatgcggttgtggctttctatggagttccttcttctgaacttgcagaccctgctcaagccaaggctcctgttcaggctcactttggagagctggacaattttgttggcttttcagatgttacggctgcaaaggctttggaggagaagttgaaggcatctggagttccacatgaggtacacatataccctggaaacagccatgcattcatgaacaggtctcctgaaggaatcaataggaggaagaccatgggtctgcctgatgaagatgaagcttcggttcagctggcatggtctcggttccaatcatggatgacaaaatacttatccaactagataatttattactagccgagttcagctgagattgctatgttctatcttagttagtaaagtcgtaaggtaaggtttcatctatctgagttcagctgagatacaacatattagtaatttgtacttctccatggacttgaaacaatgattgaataaattttggtttgagactaatttgaaccgacaatataagttgttttccgcgtaaaaaaa

SEQ ID NO: 2029 - DNA, 1159 bp, Arachis hypogaea
ggagggttgcgtggttgagtgtagtgactagtgagtagggaaggaatgctgggtattgtgagagcatcatctagttccagattgttctctacatttcgcagggtttcacccttctcttcgcgcttctcagtccgctcaatggctcactctgctccccctttcaacaaaatcaccatccaaagggataacaccacatttgatgcatacgtcgttggcaaagaagatgctcctggaattgttgttcttcaggagtggtggggagtggattttgaaatcaagaatcatgctgtcaagatttctcagctaggtcctggatttaaagctcttattccagatctgtatagaggaaaggttggtcttgatgtcgcggaagcccagcatttgatggatgggctcgattggcagggcgctgtaaaggatatagaggcctcggttaactggcttaaagcaaatggttcaaacaaggttggtgtgaccggatactgtatggggggtgctctctcaattgccagctctgtgttggttccaggggttgatgccgttgtagctttctatggagttccttcttctgatcttgcagatcctgcaaaagccagggctcctattcaggctcacttcggagagcttgataattttgttggcttctcagatgtcacggctgccaaggccttggaggagaagctgaaagcatctggagttccacacgaggtacacatataccccggaaacagccatgctttcatgaacaggtcaccggagggaattgagaggaggaagagcatggggttgcctgatcaagatgaaggtgcagttcagttggcctggtctcgctttgagtcgtggatgactaggtacttgtcaagctgaattcagcttcttatgttacaatgctatactatctctagtaattatagtaaggaatataaaatggttgttattcttgtgagtgagtgactatgatacttgttactcttgtggggtgtttcctgatatgagtggatgcatctgttgtgaagtttggcttaggaataatcataaaatggttgtggttttcttgtagttagttaatgcgtaaaatatgtgtttctttgactaagataaattctatttgatcataatgtggttgggttggacatagtgattaatagtcattgaatta

SEQ ID NO: 2030 - DNA, 1100 bp, Vigna unguiculata
gttacagcatcactctccattcttaatttagagagatttgttcttcatagtctcatacagaagccaagtgaagaatgttgagcgtagctcccaaattcttcaccaccgccccacttcgaaccgtttcaccctttgcatgtcgcttctcagtccgttctatcgctgactctgttcctttcaacaaaatccgcattcaacgagatgatgacactgcatttgatgcatatgttgttggcaaaaacaacgctcctggaatcgttgtgcttcaggagtggtggggtgtggatttcgaaattaaaaaccatgctgtgatgatttctcaactcggtcggggattcaaagctcttattccagatctatacagaggaaaggttggtctggatgttgcagaagcacaacatttgatgaatggtcttgattggcaaggcgctgtaaaagatattcatgcttcagttaactggcttaaggcaaatggttcagccaaggctggtgttactggattttgtatggggggtgcacttgctattgcaagctcagtcttggttccaaatgttgatgctgctgtagctttctacggagttccttcttctgagcttgcagaccctgcccaagccaaggctcctgttcaggctcactttggagagctggataattttgttggtttttcagatgttacggcagccaaggccttggagaaaaagctgaaggaatctggagttgctcatgaggttcacatatatcctaacaatggacatgcattcatgaacaggtctcctgaaggaatcaagagaaggaagaacatgggaatgtcagacgaagatgaagctgcagttcagctcgcatggtcccgttttcagtcatggatgacacattatttaactgtctaaataccttactagtactgcctcaatggtatgttatacttctatgtaccatggtagaagtagtttaccagaactcttaatggccccataaatttggtgcttgtttcctgtagggtggattgcatacatgcacccccttgagaaatttgacttgggaataattttgaaacggttctagtttgtctataagaagtaaatatgctctttgtttattca

SEQ ID NO: 2031 - DNA, 1212 bp, Castanea mollissima
gcaaataataaggtgagtgtgaattatgttagctgccattttcacaacatccagactattccctaacttcaagccttccctctcaaccttctcacttgttcggacgctctctccctcttccgcttctcgcttccaagtccgatcaatggcctcctcttctcccttcaagaaaatccagattcagagagaagacactgcatttgatgcgtatgtggttggcaaagaagatgctcctgggattgttgtgcttcaagagtggtggggtgttgactttgaaatcaaaaaccatgctgagaaaatttctcaacttggccctggatttaaagcacttatcccagatttgtatcggggaaaggttggtttggatgttgcagaagcacaacacttgatggatggtcttgattggcaaggtgccgtgaaggatatctgtgcttcagttaactggcttaaagcaaatggttcaaagaaggtgggtgtaactggtttttgcatggggggtgctctctctattgcaagttctgttcttgcacctgaggttgatgctgttgttgctttttatggagttccttcatcagaacttgcagaccctgcccaggctaaggctcctgttcaggcccattttggggagcttgataacttcgttggcttttcagatgtgacggctgccaaggctttggaggagaagttgaaagcatcaggagttccatatgaggtacacatttatccaggcaatgcacatgcattcatgaacaggtctccagaaggtctgaagaggaggaagggcatgggattgcctgatgaggatgaagcttcggctgagctggcttggtctcgcttccagtcttggatgactcgttacttatctgcataagtatgtcttgtcatatgcacttctaccttgtatctgcataagtatgtcttgacccatgcacttctaccttgaatatcagccttcgttttagtggacgtattcaaaccccaagtatgacgtttatttctcttttggtaataatggatgcaactttgaggatttacttgatgtggaaatattaattcccaaaatgatttagtttactttgtaattatgtaaaagacaagatttggagaaaaacatctcaaactcctcgcatgtctctgtattagatgtaaattttaaaaatttaaccgttggattgcatgttctttatgttcttaatacacatatcaaatttt

SEQ ID NO: 2032 - DNA, 1177 bp, Quercus alba
agcaaataaaaaaagtgagtgtgaattatgttagctaccattttcacaacatccagactattccctaacttcaagccttccctctcaaccttctcacttgtacggacgctctctccctcctccgcttctcgcttccaagtccgatcaatggcctcctcttcccccttcaagaaaatccagattcagagagaagacactgcatttgatgcgtatgtggttggcaaagaagatgctcctgggattgttgtgcttcaagagtggtggggtgttgactttgaaatcaaaaaccatgctgagaaaatttctcaacttggccctggatttaaagcacttatcccagatttgtatcggggaaaggttggtttggatgttgcagaagcacaacacttgatggatggtcttgattggcaaggtgccgtgaaggatatccgtgcttcagttaactggcttaaagcaaatggttcaaagaaggtgggtgtaactggtttttgcatggggggtgctctctctattgcaagttctgttctcgcacctgaggttgatgctgttgttgctttttatggagttccttcatcagaacttgcagaccctgcccaggctaaggctcctgttcaggcccattttggggagcttgataactttgttggcttttcagatgtgacggctgccaaggctttggaggagaagttgaaagcatcaggagttccatatgaggtacacatttatccaggcaatgcacatgcattcatgaacaggtctccagaaggtctgaagaggaggaagggcatgggattgcctgatgaggatgaagcttcggctgagctggcttggtctcgcttccagtcttggatgactcgttacttatctgcataagtatgtcttgtcatatgcacttctaccttgaacaccagccttcgttgtagtggacatattcaaaccccaagtatgccgtttgttctcttttggtaataatggatgcaactctgaggatttacttggtgtggaaatatataatttccaaaacgatttagtttactttgtaattatgtaaaggacaaggtttggagaaaaacttttcaaactccttgcatgtttttggatttgatgtaaattctgaaaatttaaccgttgaattgcatgttatttatgttcttaatacacatattaaatttcgttt

SEQ ID NO: 2033 - DNA, 1262 bp, Theobroma cacao
caacggaaggttctatgagaaaataacgccgtaccttaagttgagtaagaatgcagtgaagcaatgttcgcagcagcattaatatcttcgtcaccgtgcagaaccttctccagaaattgtgttcccaagccctcttcctttaccctttcacgtgttctccctccctttgctgcccgcttttcagtccgatcaatggctgactctgctttgaagaaagttcagattcagagagacaatactgcatttgacgcatatgtggttggcaaagaagatgcgcctggaattgttgttctacaagagtggtggggtgtggatttggagataaaaaatcatgccctgaagatctcccaactggactcaggattcaaagctcttattccagatttgtatcgaggaaaggttggtctggatgttgcagaagcacaacacctaatggatggtcttgactggcaaggtgctgtaaaggatatccgtgcttcggtcaactggcttaaggctaatggctcaaagaaggttggtgtgactgggttttgcatggggggtgctctctctattgcaagttctgttttagttcctgaagttgatgccgttgttgcattttatggggttccttcaccagaacttgcagaccctgccctggccaaggcacctgttcaagctcattttggagaacttgataacattgttggattttcagatgtgacggctgcgaaggctttggaggaaaagctgaaagcatcagaaattccatatgagatgcatatctatccaggcaatgcacatgcctttatgaacagatcccctgaaggtatagaaaggaggaagggcatgggaatgcctgatgaggatgaagctgcggtccagcttgcatggtctcgattccaatcatggatgactcgtttcttgtcatcttaatttgctttggtattttattatggcgtatgcttcttgttctagcataattatcaaatatctcactggttttaagcagagatataaacatgcgtgtggtttgctgccatatatactaagaggtattggtttgaagacaaccttcaaaattaaattgggtattgtaagtcctataataatctgtattttcttgtgtaatagtttcctattgggtttcgccgaagctttatcttaatatgaacttggatttgtactgtttgtccctctctcgctgtctcacatactaaataagcttttgaattttcccactttatttttttgttgtactcaaataagcacctattttacaa

SEQ ID NO: 2034 - DNA, 1578 bp, Vigna unguiculata
ttcaaaaatctaatcacacaacaaactcttcaatttcatcttcaaaagcctcctcaattttttattattatatataattcattattttaataacaataatagcagtgttttcattcccactttgtttcgaaccttttcaatttcaattttaattattcaatcatgcattgccttgtctcttcctctctctagagagtttggccagccatgtcatcacagacagccgcagcggaggcgccgctgctccgcaaccgccacgacgccgcccgagcaccggcgctagcgctcctcctcggtcgagccggccgccgaggcccctccatgctggtgcgggagaccgcggcgcgcgagctcgaggagcgccgcgcggactggggctactccaagccggtggtggcgctcgacatgtcgtggaacatggccttcgtggtcgtctcggccgcgatgctcgcatgcaccatcagcgagcgcccgaactcgccgatccgcgtgtggatcgtcggatacgcgctgcagtgccttgtgcatgtggtgctcgtttggctcgagtaccggcgtcgtagccggagggactcgcgccgcggccaggggacgcaggacgtggagagccaggccggcagtgacaacgaagagggcggaaacgacagcgacagcgacgtggatgggagctctggcaattcgtctcgctcccggttcacaaaacgatgtgaatcaataaatacaggggtttcattcctttggtggatagtggggttttactgggttgtctctggtggtgatgtacttctgcaagatgccccacgattgtactggttatctgttgtctttctggcatttgatgtcttttttgccatcttttgtgttgtcttggcgtgcttgattggtattgcgctttgttgttgtttgccctgcatcattgctattctctatgcggttgcaggacaggaaggtgcgtcagaagcagatcttagcatacttccaaaatatagatttcgaatactaagcaatgaggataagcccagtggtggagctggatcaatggttcctatagaaaccagcagtgcttacttggcaaatgaacgactgcttttaccagaggatgcggaatgctgtatttgcctctgttcatacgaagatggggcagagctccatgctcttccctgcaaccatcatttccattcttcatgcatagtgaaatggctgaagatgaatgctacttgtcctctctgcaagtacaatattctcaagggaaacgaacaagtgtgacagaaagtgaagaacctaccaagtaccaactggttattttaacatctgttgtttaatatgtatatatagtttcaaaacaaaactcgctgtgttttgatcgttggttcgttttagctgtgtttctgtagagaaaagatagcatttatttataagatagcaaatgtagtctacctagcattatttcgtcctttgttagtttcacttgaaagttgtccactttatgaattgtttattacttttcggacggaaaccagattgttttacttgctattggttgagtaatcataggttttattcatttttgttgtgtta

SEQ ID NO: 2035 - DNA, 2113 bp, Vigna unguiculata
aaaaggacaagaatttgagaatcaatcaaacctaagtcaaaagctttgttaacataactcattggttgtgtcactctttaacacactcagaggatgtttgtgttgggtgcttcctccgccgcagccaccaccgccgccactaccaccgcagccaccatcccctctcgcattctctgtggaactctccactctccttatcccctcacaaccccccataacttctcttcccatctcctatccaaaactttggtgcggtcatcttcactgcacttcaggggtgttcccatcaaagccatggcggagactgataccatagcagcctctaaaattgcttcttcttcctctgtccctgggaccaagcaagccttgatatcattgtcagataagaaggatcttgcatttgttggcaatgggctccaggaattaggatacactattgtttcaactggaggaacagcttctgctttggagaaggctggagtagctgttactaaagtagaacagcttactcagttccctgaaatgcttgatggtcgtgtcaaaactttgcaccctaacatacatgggggtatcctggctagaagggacctaaaacatcatattgaagctcttaatacacatggaattggtacttttgatgttgtggtggtgaacttgtacccattttacgataaagtcactgcagctggtggcattgagtttgaggatggaattgaaaatattgacattggtggtccagccatgattagagctgctgcaaagaatcacaaagatgttttagtcgtggttgatacagaagattaccctgcccttctggaatttcttaaagggaaccaggatgatgaaaaattcaggctaaaacttgcatggaaagcttttcaacatgttgcttcctatgactctgcagtatctgagtggttgtggaagcagagtgtgggagataaatttcctcctagcttaacagtgcctctttcactcaaaagttctctccgttatggtgaaaatccccatcaaaaggctgcattctatgtcgacaaaaaactttctgaggttaatgctggtggaattgctacagccatccaacaccatggaaaggagatgtcatataataactacttggatgctgatgcagcttggaactgtgtgtgtgagtttaagaaccccacctgtgtagtagtgaagcataccaatccttgtggagtagcatcacgtgatgatattcttgaagcctacagactagctgttaaagcagatcctgtgagtgcatttggtggaattgtagcgttcaacgtggaaattgatgaggcactagctaaagaaattcgagaattcagaagccccacagacggtgagacaaggatgttttatgaaatagtagttgcacccagctacacagagaaggggcttgagattctgcgtggaaagtccaaaactttaaggattcttgaagccaaaaagaatgaaccgggaaagctttcactcagacaggttggtggaggttggttggctcaggattcagatgacttaaccccacaagacatcaagttcaacgtggtctctgggaaggctccacaagatgatgaacttcgtgatgcagagtttgcatggttgtgtgtgaagcatgtcaaaagcaatgccattgtgatagctaagaacaattgtatgctaggtatgggaagtgggcaaccaaaccgtgtggagagtttgagaatagcaatgaggaaagctggagatgatgttaaaggagcagccttggccagtgatgccttcttcccatttgcttggaaagatgctgtggaagaagcatgtgaaagtggaatcggtgttatagcagaaccaggtgggagtatcagagaccaggatgccatagattgttgtaacaagtatggtgtttcactactctttaccaatgtgaggcactttaggcactgattcaattttgccttgctacttcaactttctgtttctgttatccaaccggtgttactcaaatttctgcttccattaacttgtttctgaaatcaagtgaatgtatgagtaatatagaaaaaataaattgatgttctcctacattccaatatcttgtagcatattcataaaattatttagctta

SEQ ID NO: 2036 - DNA, 2122 bp, Glycine max
cattggttgtgtcacactaacacatacacactcggatgatgtttgtgttgggtgtttcttcctccgccgcagccgctcctgctgctgccacctcctccactcaccaccttctcagtggaacccttcactctccttcttccctctcaacttcccatctatttcccacaacttcggtgcgttcatcttcactgcacttcaggtgcgttccaatcaaagccatggctgaagttgatactatagcagtgtcaaaaactgcttcttcttctgctccgggcagcaagcaagccttgatatcattgtcagacaagaaggatcttgcatttgttgggaatgggctccaggaattaggatatactattgtttcaactggaggaacagcttctgcattggagagtgctggagtagctgttactaaagttgaaaagctcactaagttccctgaaatgcttgatggtcgtgtcaaaactttgcaccctaacatacatgggggtatccttgcccgaagggaccaaaaacatcacattgacgccctcagtgctcatgggattggtacttttgatgttgtggtagtgaacctgtacccattttacgataaagtcacatcagctggaggcgttgaatttgaggatggaattgaaaatattgacatcggtggtcccgccatgattagagctgctgcaaagaaccacaaggatgttttggtagtggttgatacagaagactaccctgcccttctggaatttcttaaaagaaaccaggatgatcaaaagttcaggctaaagctcgcatggaaagcttttcaacatgttgcttcctatgattctgcagtatctgagtggttgtggaagcagagtgtgggagataaattcccacctagcttgacagtgcctctttcactcaaaagttctctccgttatggtgaaaatcctcatcaaaaagctgcattctatattgacaaaagcatttctgaggttaatgctggtggaattgctacagccatccaacaccatggaaaggagatgtcatataataactacttggatgctgatgctgcttggaactgtgtatgcgagtttaggaaccccacgtgtgtagtggtgaagcatactaatccatgtggggtagcatcgcgtgatgatattcttgaagcctacagactagctgttaaagctgatcccgtgagtgcatttggtggaattgtagctttcaatgtggaaattgacgaggcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacatgacatcaagttcaacgtagtctctgagaaggctccacaggatgatgagcttcgtgatgcagagtttgcatggttgtgtgtgaagcatgtcaaaagcaatgctattgtgatagctaagaacaattgcatgttaggtatgggaagtgggcaaccaaaccgtgtcgagagtttgagaatagcaatgaggaaagctggagatgatgttaaaggagcagccttggtcagtgatgccttcttcccatttgcttggaaagatgctgtggaagaagcatgtgaaagcggaattggtgttattgcagaaccaggtgggagtatcagagaccaggatgccatagactgttgtaacaagtatggtgtttcactgctctttaccaatgtcaggcactttaggcactgacttaatttttgctttggaataacttcctgcctccattatccaagcggtgttgctggaacttgtgcttccaataggtagcactgaaacctgtttttgaagtcaagtgactgtatgagtaaggattgttctatccaatttatatagaaaaataaattgatgttctcctactttctaatgtcttatgtacattagaataatgtgatggaatcatcttttgcaatgaacagaatcaaattagacattcttgctgcaactattcaattatgttc

SEQ ID NO: 2037 - DNA, 2347 bp, Arachis hypogaea
gaaagattctgcttcaaccttcgcgtgagaatacacattaacacacagctttcttccctttcacttgttcgtcgttcgctcgtgcctgatagcctctgttccctctatctgcttcgccgtgtctgtgtctcttttttctcactgcttcgccgtctgccgctgcatgccactgctttgcgccttgtctgcccgcctctgccgctgctctactccttcgcgtctttgtgtctccctctttcactagtcactagaagcctataagggctcaaagctttatcatgtttgcgcccgctgctacttcccccaccacagctgctgctcgtcttttgcgtgcttccctcttctctccttcttctcattcccgtttccttccacctacttcggttcgatcctctttgtgcttcaactaccttcctatcaaagccatggctgacactacctcagtttcacatccaataactgcttctgcttcttcttctgattcaggtagaaagcaagcattgaaatcactttctgacaagaaggatcttgcttttgttgggaatggacttcaggaattggggtacactattgtgtcgactggaggaacagcttctgcattggagagtgctggagtggctgttactaaagtcgaacagctgacccagtttcctgagatgcttgatggtcgtgtcaaaactttgcaccctaatatacatggaggtatccttgctcgaagagatcaaaaacatcatattgaagctctcaacactcatggaattggtacttttgatgtggttgtggtgaacttgtacccattttatgataaagtaacatcaactggagtagagtttgaggatggaattgaaaacattgacattggtggtccagcaatgataagggctgctgcaaagaattacagggatgttttggttgtggttgattcacaagactaccctgcattattggaatttttgaagggaaatcaggatgatcaaatgttcaggttaaagcttgcttggaaagcttttgcacatgtttctgcctatgactctgcagtttctgagcggctgtggaagcagagtgggggagataaatttcctcctagcttgactgtgcctttgtcgctcaaaagttctctccgatatggtgaaaatcctcatcaaaaagccgcattctatgttgacaaaagactttctgaggttaatggtggtggaattgctactgccatacaacatcatggaaaggagatgtcatataataactatttggatgccgatgctgcttggaactgtgtgtgtgagtttagggatcccacatgtgtagtagtgaagcatactaatccttgtggggtagcatcacgtaatgatattcttgaagcgtacagactagctgttaaagctgatccagtgagtgcgtttggtggaattgtagctttcaacgtggaagtcgatgaggttcttgccaaagaaattcgtgaatttagaagcccaactgatggagagacaagaatgttctatgaaattgttgttgcacctggctacacagaggaggggcttgatgttcttcgcggaaagtcaaagactctacggattcttgaagcgaaaaagaacgaagcaggaaagctttctctcaggcaggttggaggagggtggttagtgcaggattcagatgacttgaccccacatgacatcaagttcagtgtagtatctgagaggactccagtggatgacgagcttcgtgatgcagagtttgcttggttgtgcgtgaagcatgtcaaaagcaatgctattgtgatagctaagaataagtgcatgttaggcatgggaagtggccagccaaatcgtttggagagcttaagaatagctatgaggaaagccggagatgatgttaaaggagcagctttggctagtgatgccttcttcccatttgcttggaaggatgcagtggaagaagcatgtgaaagtggggttggtgtcattgcagaaccaggtgggagtattagagacaaggatgctatagactgttgcaataagtacggtgtttccctagttttcacccaagtgaggcacttcaggcattaatatttggtttttgttttgggataactctctgtttctgttgtttcaaaatgggttttggtgaaagcattttaactgaagcccggtttttggcatcaaatggttgtatgagtagagtttgttgtactatccaagttgatgtagaaaagaaacacttatttagttattttacataagatggagccttctacaatggaccaagctgaattatagaccatgatggtccatgtggctctttgctatatactaaattactcataaatacagcccaggctgaaagcctttag

SEQ ID NO: 2038 - DNA, 2010 bp, Gossypium hirsutum
atgttggggacagccgcttctgcagccaccatccctcccactactgctcacgccgccaacaccatacgccgcgcctttcacagtaatcctttcaattctctctcttcttctcatcactctattctctgcgctcgctttcgttgcctctcgctacgctctttcaccgctgtttccaccaaagccatgtctcaccctcagaccctcgatgctcctcaccctcaatcctctgccgctggcaataagcaagcactaatatctttgtctgacaagaaagacctggctttgcttggcaatggccttcaagaactggggtatactattgtttcaactggaggaactgcatctgccttagaaaatgctggtgtatctgtaaccaaagtggagcaacttacttgtttccccgaaatgcttgacggtcgtgtgaaaacactacatcccaacatacatggtggtattcttgctagaagagaccaaaaacatcatatggaagctcttaataagtacggcattggtacatttgatgtggtggttgtgaacttgtaccccttttatgataaagttacttctatgggaggaatcgcctttgacgatggcatcgagaatattgatattggtggccctgcaatgattagagctgcggcaaagaatcacaaggatgtcttggttgttgttgactcacaagactatcctgcactccttgaattccttgaaggcagtcaggatgatcaacagttccggagaaagcttgcttggaaggcttttgagcatgttgcttcttatgattctgcagtttcagagtggctctggaagcagactgtgggagataaattccctcccagcttgacggtgccattatccctcaaaagttcacttcgctatggtgaaaatcctcatcagaaggctgcattttatgttgacaagagtctgtctgaggtcaatgctggtggtattgcaactgctattcaacaccatgggaaggaaatgtcatataataactatttagatgccgatgctgcttggaattgtgtctctgagtttaggaaccctacatgtgtggttgtaaagcacacaaatccatgtggagtagcttctcgtgatgacatccttgaggcttacaggctcgctgtgaaagctgatccagtgagtgcatttggaggaattgtagccttcaacatagaagtagatgaggctcttgctaaggaaattcgagagttccgaagcccaacggatggtgaaactcgaatgttttatgagattgttgtggctcctaagtatacagagaagggacttgagatcctccgtggaaaatcgaaaacattgaggatccttgaagcaaagaagaatgagaaagggaagctctcactacgacaggttggtggtggttggttagcccaggattcagatgatttgacccccgaggatatccagttcaatgtggtatccgagaagaagccacaagataatgagctttgtgatgcagaatttgcatggctgtgtgttaagcatgtcaagagcaatgctattgtaatagcaaaggacaaccgtatgttgggaatgggaagcgggcagccaaaccgtctggagagcttgagaatagctttgaggaaagcaggagatgaggtcaagggagctgctttagctagtgatgcatttttcccatttgcttggaaagatgcagtggaagaagcttgtgaaagtggtattggagtgattgcagagcctggagggagcattagagatggggatgctgtggactgttgtaacaagtatggagtttcattgcttttaacaaatgtgaggcacttcaagcattgatgcactttcatttttgccttaatgggttcaacttgctctctaagggggagagtgttgtgcaatttctgactgtaatgttcacaaataagaaacgtttgtgtttgtttttaaattttagaagttgaaccctgcagttttgtactggacatttattgctctctgagtttgccaaaataatagaatcagacatcttta

SEQ ID NO: 2039 - DNA, 2369 bp, Vitis vinifera
aatcaaacgctcttgctgagtgtttgtttgacgagaaagagagtatagaaaacaaaaaatagataaatttaacaaaaacaaacctaggcagagatactacagcggctcaggcaagagatgttgggtttagccaccactgctaccgctaccaccgccaccgcagctccgaccaccgctgcgaagaatcgcgttctctgcagctcaggaagacttcagcggtggtttcagcgttcttcggtcgcgtgctatcgcatttcttctccatcgctgcggtctaatttctgcgcagtcaaggctatggcggaggcggacaccatttcgattctgaaggctcagtctcagtccaatgcttcgggcaacaagcaagctttgatttcgttgtccgacaaaaaggatctagctttccttggaaatggcctccaaagtttaggatatacaattgtttcaactggaggaacagcatcagctttggaaaatgcaggggtctctgtaactaaagtggaacagcttacctgttttccagaaatgcttgatggccgtgtgaaaactttacatccaaacatacatgggggtattcttgctagaagagaccaaaagcttcacatggaagctcttaatgagcatggaattggtacttttgacgtggtggtggtgaacttgtatccattttatgataaagtttcttctggaggaattgaatttgaagatggaattgagaacattgatattggtggcccagccatgatcagagcggctgcaaagaatcacaaggatgttttggttgttgttgattcacaagattattccgcactcctagaatttctccaagggaaccaggatgaccaactgttccgaagaaagcttgcttggaaggctttccaacatgttgcttcttatgattctgcagtttcagagtggctgtggaagcagactgtaggagacaaatttcctcccagtctgacagttcctctctcactcaaaagttctcttcgttatggtgaaaaccctcatcaaaaggctgcattttatgttgacaagagtctttctgaggttaatgctggtggtattgctactgccattcaacaccatggaaaggagatgtcatataataactatttagacgctgatgcagcttggaactgtgtgtcagaatttaagaaccctacatgtgtgatagtaaagcatacaaatccctgtggagtagcttcacgtgatgacatccttgaagcttatagattagctgtgaaagcagatccagtgagtgcatttggtggtatcgtagccttcaacatagaagttgatgaggcacttgcaaaagaaatccgtgagtttaggagtccaactgatggtgaaacacggatgttttatgagattgtggttgcacccaagtattcacaaaagggacttgacatcctccgtggaaaatcaaaaactttaagaattttggaagcaggcaagaacgagaaaggaaagctttcacttcgacaagttggtgggggttggttagcgcaggattcagatgatttaaccccagaagatatcccattcaaattagtttctgagaaggctcctccggaaagtgagcttcgcgatgctgagtttgcatggttgtgtgtcaagcatgtcaagagcaatgccattgtaatagcaaagaataactgcatgttgggtatggggagtgggcagccaaaccgccgggagagtttgagaattgcagtgaggaaagctggggatgaggtcaaaggagctgctttggccagtgatgctttcttcccatttgcttggaaagatgcggtggaagaagcatgcgagagtgggattggtatcattgcagagcccggagggagcatcagagatggagatgccatagactgctgtaacaaatacggggtatcacttcttttcaccaatgtgaggcacttcaggcattaaggatgaggttcttctgtgttgcacccgtccttactccattacagctttcttcaaagttttggtgtttaaaaggaggatgatgatgatacttccctccatcccaactgtggaaggatgaaatataagatataaatgttgtgcaatccatcttaattgtattgtaagtctaggaggcaagtactgtaccttatgtatttggttatctcaattctgtgcttgatggatttaggcatgcacgcattgctcagagatgtgaaaaggtgagtcttgataataattttccctaccttggttttttcatggaaggagacaaagccattacaataaaatttctttcctggaactatcttaagtgaaatgcagtcgtcacccttcacaatgtgaagggaaatgggtatgtaatttgattatgttcttttttattttttacagactaa

SEQ ID NO: 2040 - DNA, 2064 bp, Zea mays
gtcgactgtcgacgccttcttcgccctctccgtccggcttccgcctcagctgaactcatgcgctatttcccaggccgccattcccactagggttttcggattattaggtttctagaacctttcttcgccgccccccccccccccccccccagaccccatgcacgctccgccgctggtcgcgttcgcagggggcgcctgccccgcttccgctgcctcctcgctgtcgccctggttggcctcgctgcggcccgccatcgttgctgcgccggcgaggctgctatggttccgccgcggggcactccggctggaagccaaggccgcgtggagggctaccggagggggacggggcccgcgggtcccggccaagggcgctgtgctcgcctcctatatgggtgccgaggaggtggtgggacccttgtcgctgctcgacgaggaagagctcattttgcacataagaaaggaacgggataatggaaaacttcctgcagatgttgccattaacttggaggagctgtattataattacaggaatgcagtcctgcaaaatggtgatcctaatgcatatgagatcatgctttcaaatatgacagctttgtttgatcgtgttctactggatgtacagaatccatttacctttccaccgtatcacaaagctgtgcgggaaccatttgactattacatgtttggtcagaactacattaggcctctggtagatttcaggaactcctatgttggcaacatttcccttttccatgacatggaagagaagctccaccagggccacaatgttgttttgatgtccaaccatcagacagaagcagatccagcaattatcgccttgcttcttgaaaaaaccaatccatggattagtgaaaacatagtttatgttgctggcgatagggttgttaccgatccactttgcaagccatttagcatgggaagaaatctcatttgtgtgtactcgaaaaagcatatgaatgattttccagagctaattgagatgaagaggagatcaaacactcggagcctcaaggaaatggccttgcttttacgtggtggttcacagctaatttggattgcaccgagtggtggtagagatcgcccaaatccttcaacaggagagtggtacccggcgcattttgattcatccacagtggacaatatgaggaggcttctggagcatgctggtgttcctgggcacatatatccactatcattactgtgctacgaggttatgcctccaccacaacaggtcgagaaagagattggtgaacagagggtgatatccttccatggagtaggcttgtcagcaactgaagaaacaaagtatggggatattacttgtcataccaagaatgctgatgagggaagggagctattcacaaatactttgtacaactcagttgttaatcagtacaatgtcctcaaatctgctatctttagagatcgtggagcagctgtatcaaacaatgccatctcactgtcacaaccatggcgatgaatgtagctttcccagtccagattcgatactgaagttaccttttcagaagaacaggtgaactgcaattgtgcaatttttctgggaaaaactcttgaagtttaatctttctgatatcactggactttaccaatcatggtggagcttattactctaatgcagatcctcgctaagatgtctggctggtcaagggtgattggtgattctgcagatagggatcctcgtaacattgcatgccgtcgtccgcaaattactgctccctcaggttgttcagtaatgtgctggttgggcactgaggaatccatcaggttgcatccttttgtctagacgtcgatttgtgttgttgaagtggtaaacattttcatcctgggctgtatcgtcatcatgtatagataggctcgagtctctctcttttttttttggctccacaattttttggagatataaaagcggcaggagttatgacatgcccacagtcggccctccttgtagaaatcctttggatgtaacctgtctctttcttatatacatactgaaagtcaaggcagatatcccgtgtttcgagt

SEQ ID NO: 2041 - DNA, 2129 bp, Zea mays
caattttttccttctattttaatttttgaagaaaaactaaacagagaagtcgaggaaaaattgctgttagcagcggacagggggtgagcgagcgggccgaggattcatctcgtgtcgacgacgccttcgccctctccgagtctccgtccgtcttccgcgtcctccgcagctggactcgtgcgctattccccaggacgctactcccactagggttttcggattaggtttctagaaccttccaccgccgcctctccatgcacgcgccgccgctggtcacgttcgcagggggcgcctgccccaccaccgcctccgcttcgccgtcgccctggttggcctcgccgcgggacgccatctttgccgcgccggcgaggcccctacggtcccgccgcgggacactccggctggaagctaaggccgcgtggagggctgccggagggggacggggcccgcgggtcccggccaagggcgctgtgctcgcctcctatatgggcgccgaggaggtggtgggaccatcgtcgctgcttgacgaggaagagttcatttctcacatcagaaaggaactggataatggaaaacttcctgcagatgttgccagtaacctggaggagctgtattataattacaggaatgcggttctgcaaaatggagatccaaatgcatatgaggtcatgctttcaaatatgatgaccttgtttgatcgtgttctactggatgtacagaatccatttaactttccaccttatcataaagctttgcgagaaccgttcgactattacatgtttggtcagaactacattaggcctctggtagatttcaggaactcctatgttggcaacatttcccttttccatgatatcgaagagaatctccaccagggccacaatgttgttttgatgtctaaccatcagtcagaagcagatccagcaattattgccttgcttcttgaaaaaaccaatccttggattagtgaaaacatagtttatgttgctggcgatagggttgttaccgatccgctttgcaagccatttagcatgggaagaaatctcatttgcgtgtactcgaaaaagcatatgaatgatttccctgagctaattgagatgaagaggagatcaaatactcgaagtctcaaggaaatggcattgcttttacgtggtggttcacagttaatttggattgcaccgagtggtggtagagaccgcccaaatccctcatcaggagaatggtacccggcaccattcgattcatctgcagtggacaatatgaggaggcttctggagcatgctggtgttcctgggcacatatatccactatcattgctgtgctatgaggttatgcctccaccacaacaggttgagaaggagattggtgagcagagggtgatatccttccatggagcaggcttgtcagtaactgaagaaataaactatggagacattactgctcataccaagaatgctgatgagggaagggagctattcacaaataccttgtacaactcagttgttaaccagtacaatgtgctcaaatctgctatctttagagatcgtggagcagctgtatcaaacaatgtcatctcactgtcacaaccatggcgatgaatgtccagtttcgttactgaagttaccttttcaaaagagcaggtgaactatcattgtgcaattttgctgggagaaactcttgaacttaaatctttttgatatcactagacttcatcaatcatggtggagcctgttattgtcatgcagatgctcgctaagaagtctgcaactgttggttggtcaagggtgattggcgattttgcacatacggatccgcagttactgctgcctcaggttgctcagcaatgtgctgctggttgggcaccgaggaatccatcaggttgcatcctttttgcccggacgtcgatttgtgcagttgaagtggtaaacgtttttttatcttgtttcgtcatcatgtatatacgtaggcttgagtcattgttggctccacattttttggagatataaatgcggtaggagttatgagatgtccacagtcggccctcccttgttgaattcctttggatgtatcctctctctttcgtacatgcactcactgaaagtcaatgcaaatatctcgtgtttctagta

SEQ ID NO: 2042 - DNA, 1952 bp, Setaria italica
gaacattccgccgccgcctcatgcacgcgccgccgctagtcgcgctcgccgggggcgcctgcccccccgccgccgcctcctcgtcgacgccgccctggctggcctcgccccgggccgccatcctcctcgccgcgccggcgaggctcctgcggtcccgccgcggggcgctccggctggaagccaaggcagcgtggagggcggccggaggcgggcggggcccgcgggtcccggccaagggcgccgtgctcgcctcctacacgggcgccgaggaggtggtgggaccgtcgccgctggtcgacgaggaagagctcagtttgcacatcagaaaggaagtggaggagggaaatctgcctgcagatgttgctagcgccctggaggagctgtattacaattacaagaatgctgtcctgcagaatggagatcctaatgcacatgatatcatgctttcaaatatgacggctttgtttgatcgtgttctgctggatgtacagaatccatttacctttccaccttatcacaaagctatccgagaaccgttcgactattacatgtttggtcagaattacatcagaccactggtagattttaggaactcctatgttggcaacatttccatttttcatgacatggaagagaagctccgccagggccacaatgttgttttgatgtctaaccatcagacagaagcagatccagcaattattgccttgctgcttgaaaaaaccaatccatggattagtgaaaacatagtttatgttgctggggatagggttgtcactgatccgctttgcaagccatttagcatgggaagaaacctcatctgcgtatactcgaaaaaacatatggatgattaccctgagctaattgagatgaagaggagatcaaatactcgaagcctcaaggaaatggccttgcttttacgtggtggttcacagttaatttggattgcaccaagtggtggtagggaccggccagaccattcaacgggagaatggtacccggcgccattcgattcatcctcagtggacaatatgaggaggcttctggagcatgctggtgttcctgggcacatatatccactatcattgctgtgctatgagattatgcctccaccacaacaggtcgagaaagagattggtgagcaaagggtgatatccttccatggagtaggcttatcagtaactgaagaaataaagtatggggatattactgctcataccaagaatgctgatgagggaagggagctatttgcaaatactttgtacaactcagttgttaatcagtacaacattctcaagtctgctatctttagagatcatgtaggagctgcatcaaacactgccatctcactgtcacaaccatggagatgaatgtccagattcattagtgaagtaaccttacttttcagaagatcagatggacggccattgtgcaattttgctggaagaaattgttgaactttaaactttgatatcactgcactttattaatcatggaggagcccgctactgtcctgcagaaactggtgatcggtggttctgcatatatggactccagcagctgtggcacgctggtcagtcggtctagcgcaagaatgtcgcctcaggttgcacaataatgtgctggttgtacatcagggtgcatgcgtcgaacctgcttgtcgacgagcatgtggatttgtgcggctgatgtcttaattttgttatattctgtttcgtgtatatagattttgatttttttttttggctccacatttggagataaaagcaggttctaattttctgctcttgcgcctgaaatccttgtatgtaacctgtctctttcgtactcaatggagtcaggataaagaggaaacatatcccatatgacgattacgtgctctacgtgacgctattagctgcgcagccactgatttcttttcgcagtttggagacgcacctggcattgcggcg

SEQ ID NO: 2043 - DNA, 1789 bp, Setaria italica
tttttctttttataaattatctgtttctgttgagacaaaacaaaacaaaaaaaaatcgaagaaaaaccgcaggcaaggggtgagcgggccgaggcttcatctcgtgtcgctatgccttcttcgccctctccgtcctcgctcgctccgcttcctccgcggctggactcgtgctcaaaatcgcaaatcccaaggcccgccactccccactaggccaccactagggttttcggattaggtttctagaacattccgccgccgcctcatgcacgcgccgccgctagtcgcgctcgccgggggcgcctgcccccccgccgccgcctcctcgtcgacgccgccctggctggcctcgccccgggccgccatcctcctcgccgcgccggcgaggctcctgcggtcccgccgcggggcgctccggctggaagccaaggcagcgtggagggcggccggaggcgggcggggcccgcgggtcccggccaagggcgccgtgctcgcctcctacacgggcgccgaggaggtggtgggaccgtcgccgctggtcgacgaggaagagctcagtttgcacatcagaaaggaagtggaggagggaaatctgcctgcagatgttgctagcgccctggaggagctgtattacaattacaagaatgctgtcctgcagaatggagatcctaatgcacatgatatcatgctttcaaatatgacggctttgtttgatcgtgttctgctggatgtacagaatccatttacctttccaccttatcacaaagctatccgagaaccgttcgactattacatgtttggtcagaattacatcagaccactggtagattttaggaactcctatgttggcaacatttccatttttcatgacatggaagagaagctccgccagggccacaatgttgttttgatgtctaaccatcagacagaagcagatccagcaattattgccttgctgcttgaaaaaaccaatccatggattagtgaaaacatagtttatgttgctggggatagggttgtcactgatccgctttgcaagccatttagcatgggaagaaacctcatctgcgtatactcgaaaaaacatatggatgattaccctgagctaattgagatgaagaggagatcaaatactcgaagcctcaaggaaatggccttgcttttacgtggtggttcacagttaatttggattgcaccaagtggtggtagggaccggccagaccattcaacgggagaatggtacccggcgccattcgattcatcctcagtggacaatatgaggaggcttctggagcatgctggtgttcctgggcacatatatccactatcattgctgtgctatgagattatgcctccaccacaacaggtcgagaaagagattggtgagcaaagggtgatatccttccatggagtaggcttatcagtaactgaagaaataaagtatggggatattactgctcataccaagaatgctgatgagggaagggagctatttgcaaatactttgtacaactcagttgttaatcagtacaacattctcaagtctgctatctttagagatcatgtaggagctgcatcaaacactgccatctcactgtcacaaccatggagatgaatgttagctttcttttgtccagattcattagtgaagtaaccttacttttcagaagatcagatggacggccattgtgcaattttgctggaagaaattgttgaactttaaactttgatatcactgcactttattaatcatggaggagcccgctactgtcctgcagaaactgtaagctct

SEQ ID NO: 2044 - DNA, 1958 bp, Panicum virgatum
ctcgtgccgatgccttcttcgccctctccgtcctcgctcccgcttcctccgcagctggactcgtgctcaaactcgcaaatcccaaggcccgccgcctctagggttttcggattaggtttctagaacattccgccgcctcgccgccgccatggctggcctcgccccgggctgccatcctcgccgcgccggcgaggctcctccggtcccgccgcggggcgcttcggctggaagccaaggccgcgtggagggcggccgggggcgggcggggcccgcgggtcccggccaagggcgccgtgctcgcctcctatatgggtgccgaggaggtggtgggaccctcgccgctgctcgacgaggaaggtctcgacgatgaagtgctcattttacacataagaaaggaagtggaggagggaaatctgcctgcagatgttgctagcagcctggaggagctctattacaattacaagaatgctgttctgaaaactggtgatccaaatgcatatgagatcatgctttcaaatatgatggctttatttgatcgggtcatgctggatgtacagaatccatttacctttccaccgtatcacaaagctatccgagaaccattcgattattacatgtttggtcagaattacattaggccactggtagactttaggaactcctacgttggcaacatttcccttttccatgacatggaagagaaactccgccagggccacaatgttgttttgatgtcaaaccatcagacagaagcagatccagcaattatcgccttgctgcttgaaaaaagcaatccatggattagtgaaaacatagtttatgttgcgggcgatagggttgttactgatccactttgcaagccatttagcatgggaaggaacctgatttgcgtgtactcaaaaaagcatatgaatgattaccctgatctacttgagaagaagaggagattaaatactagaagtctcaaggaaatggccttgcttttacgcggtggttcacagttgatttggattgcgccaagtggtggtagagaccggccagacccttcgacaggagaatggtacccggcgccattcaattcatcctcagtggataacatgaggaggcttctggagcatgctggtgttccagggcacatatatccactatcattgctgtgctatgaggttatgcctccaccacaacaggtggagaaagagattggtgagcaaagggtgatatccttccatggagtaggcttatcggtaactgaagaaataaagtatggggatattactgctcataccaagaatgctgatgagggaagggagctattcacagatactttgtacagctcagttgttaatcagtacaatgtgctcaagtctgctatctttagagaccgtggagcagcggctgcatcaaacactgccatctcactgtcgcaaccatggcgatgaatgtctagattccatagtgaagttaccttactttttcagaagatcagatggaggggcattgacattgtacaattttgatgggagaaattcttaaactttaaactttgacgtcaccgtactttattaatcatggaggtgcccgttactgcccttcagatcctgtcaagcgtgattggtggctttgcatacatggatcccatgcagtcggtcgatctggtgcaagtattgtcgcctcaggttaaacagtgacatgctggttggacaccaaaggatccatcaggttgcatgcgccgaaccagcttgtcgatgagcaagtggatttgtgctgttgacgtcataattttgttactttctgtttcgtgtacatagctttttgattctttctggcttcacattcggagataaaaagcgtaacatgctcacagtcagtttctcagtgtagccctgaaatccatggatgtaacccgtctctttcgtgctcactgatgtctgcataaagaggctacatattccgtgttc

SEQ ID NO: 2045 - DNA, 1462 bp, Zea mays
ccaacagatcaagcctagcaggaaataaaaaatctgtaagagagaaccaaaaaaaaaaggagtcaatcgccggcgacgggtacgggtgtacgcttgaggcgatcggcagagaagaccgagaccgacggctccagtgccgctgtcactgccagtctgccacagccagccgcctagcttgatccgccttttgtgctgtgcggatatgagggccgcgcagatcgatccgtcccccgcggcgccgcccaagtcgcggctgaagcgcctcttcgagcgccagctgctgcgggtctcgccggccgagcgcctcccgtcggcgcctcccggtggcggggacaaggatgagctgccggagcctagctcgctgtgcctggacggcatggtgcggagcttcctggaggacggcggcggcggcggcggagccgagcgggcggcagcggccgcgcggtgctgcaactgcttccacgccggcgacacctccgacgacgaggacggcccggctgccgccgacgccgcggccgctgacatcgcggagacaatcaaggggctcgtccactgcgccagcctccgggagcgcaacctgctggccgacgtgtcgacgctggtggagcgccaccgcgcgtcgggggcgcgcaagcgcgacctgctccgcctgctggcggggtccctccgcgcggcgggccacgacgccgcggtctgcctctcccgctgggacaggtcgccgtcccaccccgccggggaccacgcgtacctggacgtgctcctcccggccgcgtcggagcgcgccgggcgcgagcgcgtgctggtggacgtcgacttccggtccgccttcgaggtggcgcggcccaccaaggcgtaccgcgccgtgctgcagcgtctgccgccggtcttcgtcgggcgggacgaccgcctgcgcctcctcgtggcggccgccgccgacgcggcccgcgccagcctcaagaagcgcggcctccacctgccgccgtggcgcaagcccgagtacatgcgcgccaggtggctttccccctacgaccgcgaggctccgcagcccgaggccagcaccggtgagctcgccggcgacggcgagggaggtgggcccactgcttaatcaccgaggtcgtttttggaatttcctttttgctcttgcccttggggaatttgccgtgtggtccttgtgtgcgtacagggactagacgcgaatgtcctgctctgtttgtttttttcccttttcacccttttgatgggggtgtctgtttcgccgcgccggaagtcgtagtactgtagtagtagtagctagtgctggtaatgatggagaagagaaaggacacaccaaaaaaaattgcagctttattagattgatgatgaggtaaaagaaaaaggagattccggacagagacccgtcgttgttccaggcagcggaacctgacagcgaagaaagaaccacggagatgcatgatttgttgct

SEQ ID NO: 2046 - DNA, 1513 bp, Setaria italica
atcaacccgaacagaagaataaatcttgtgagaaagaaaacgaaaaaacagagaggaaaacaaaccctagccgcaccgatcgaagcgtcaatcgccggcgacggctatgcctgctgcgatccccggagaccaagaccaacgcctccactgacgcttgccgctgccgccgagtttgatccgccgaggcgccgacatgagggccgcgcagatcgatccgtccgccgcggcgccgccccggtcgcggttcaagcgcctcttcgagcgccaggtgccgcgggtctcgccggcggagcgcctcccggcggcgcccgccggcggggagaaggatgagctgtcggagcccagctcgctgtgcctggacggcatggtgcggagcttcctggaggacggcgttggcggcggcggcggcgagcggggagcggccgcgcggtgctgcaactgcttccacgccggtgacacctccgacgacgaggatggccccgcctcggcggatgccgcagccgctgacatcgcggagaccatcaagggcctcgtccactgcgccagcctccgggagcgcaacctcctcgccgacgtctccacccaggtcgagcgccaccgcgcgtcaggggcgcgcaagcgcgacctcctccgcctactggccgagtccctccgcgccgcgggccacgacgccgcggtctgcctctcgcgctgggacaagtcgtcctcccaccttgccggcgagcacgcgtacctggacgtcctcctccccgcgggctcggatcgcgccgagcgcgagcgcgtcctggtggacgtcgacttccggtccgcgttcgaggtagcgcggcccaccaaggcgtaccgcgccgtgctgcagcggctgccgtcggtgttcgtcgggcgggaggaccgcctgcgcctcctcgtggccgccgccgccgacgcagcgcgcgccagcctgaagaagcgcggcctccacctgccgccgtggcgcaagcccgagtacatgcgagccaagtggctctccccctacgatcgcgagactccccctcctccgcccccgccgctgccgcagccgcagcagccagaggcctccaccggtgagctcgccggcgacggcgagggaggtgcgcccagcgcgtaaccgaggtcgttttcggaattaccttttttccacttattcttggggaatttgcagtgtggtccttgtacagggactggacgcaaatgttctgctttgttttttttttcttccctacctttttattcttccttccctttttacccttttgatgggtttcatttccccccgcggcgtagatgtagtagtgtagtaactagtgctggtaattatggaggacaaaagggaccaaaaaaaatttgtagctttagtttgaattagaagagataaaaggaaaaggagattccggacagagacctgcctgattcttttggttccatcgttgctccaggcagcagaacctggcaatgcagcaacggccgtggatccatgatttgttgtgtttcttgcatg

SEQ ID NO: 2047 - DNA, 1929 bp, Oryza sativa
ttttcaattttaaggtgaactaaacacatcctttgtttccttctaaatcgcttgaaaaaaaaaggctttccactcggtttttgccatccaacgatcacctgatcgatggaagtgggagcatcacgaaacgagcggcaggactgacacgagagtagtaaaaactgcaggtctgcagccttaacttctcctgtcacccgctaaataccaaaactacccacaaaatacagcaacatttacagcttcgacactgcactcaatgccctcacacgctaaaggccaagcaggggtaacagggtcatttccggtgggaccgatgtgtcagtcgccacgtaggacaacgtttagataggcacgaccacgcagcatgccacgccgatctcctcgcgccacgtcacccctccggatccctttaaaaccaggctctcctcttcgtcttcttccaacagatcgacaccgaaaattcgaagcaaaaaaaggagaagaaaagaaaaggaaaaaaagaaaagaaaaacaaaccctagccgcaccgatcgaagccagtgagacgccgccgacggctatgcgtgaggcgatcgtcggtgaccacgatcgccgccgccgccgcacccgcatccagtgaaaccctgcactgtcgtctcgttcggttgtgaggagatgagggcggcggcggcggcggcggggcagatcgatccgtcccctggggcgccggcgaagtcgcggctgaagaggctgttcgagaggcagctgctgcgggtgtcgccggcggagaggctcccgtcggtcgcgggtgtcggggagaaggatgagtcgtcggagccgagctccgtgtgcctggacggcatggtgcggagcttcttggaggacggcgtcggcgtcgagcggccggcgggcgccgcgcgctgctgcaattgcttccacggcggggaggcgtctgacgacgacgacgacggccccgctgctgccgaggcggcggccacctccgacgccgcagagaccatcaagggcctcgtccactgcgccagcctccgggaacgcaacctcctcgccgacgtctccacgctcgtcgagcgccaccgcgccgcgggggcgcgcaagcgcgacctcctccgcctcctcgccgactcgctccgcgcggcggggcacgacgccgcggtctgcatctcccgctgggacaagtcctcctcccacccaaaaggcgagcacgcctacctcgacgtcctcctccctcccgcctccgaccgcgccgagcgcgagcgcatcctcgtcgacgtcgacttccggtcggagttcgaggtcgcgcggcccaccaaggcgtaccgcgccgtgctccagcgcctgccgtcggtgttcgtcgggaaggaggaccgcctccgcctcctcgtggccgcggccgccgacgccgcgcgcgccagcctcaagaagcgcggcctccacctcccgccatggcgcaagcccgagtacatgcgcgccaagtggctttcaccctacgagcgcgacgttccttcaccgcagcagccagatgcctccgccggtgagctcgccgtcgacggcgagggaggtggagcgtggactcaatgattgatgatcaaggactcgtcttttgttgattcttttttcttcgggaatttgcatttgcagcgtcatcttgggctggatgcaaatgttttattctttcttttcctttcctttttcccccttcatttttaccctttaatgggtttcattttggccatggagtagtagtaactgtagtagtaagcacggataagacgaacgggaacaaaaaaaatgtagtgttagttgaacagaaaaaaaagagagataatggattacggcaatatctacttctttcagtttcagtgttggtctgataacagaagataaatttaacttaatggagtacaataacataaaggaaaaacagttcag

SEQ ID NO: 2048 - DNA, 1345 bp, Leymus cinereus x Leymus triticoides
gatttccttcacagcacaaccaacaaattataactcgtaaaaggggaggaaaccaaaaaataaaccctagccgcgccgatcgaagccagtgcgacggctatgcggccggcgatcgcaggagaccaagatcgccgcctctagtcgcacagactccgtccgctcgtttccgcagccatgaggcccgccgcagcgcagatcgatccgtccccgtcccccgcggcgctggccaagtcacggctcaagcggctgttcgagcgccaggtgctgcgggtctcgccggcggagcggctcccgcccgtctccgccggcggggacaaggagaaggatgatttggagcccagctcggtgtgcctggacggcatggtccgcagcttcctggaggacggcggcggcgccgtcggcgagcgggcctcggccgcgcgctactgcaactgcttcaacggcggcgacgcctcggacgacgaggacgggcccgctgcggccgaggcgtctgccatctccgacgccgcggagaccatcaagggcctcgtccactgcgccagtctccgggagcgcaacctcctcgccgacgtgtccacgctcgtggagcgccaccgcgcggcgggagcgcgcaagcgcgacctcctccgcctcctcgcggcgtccctccgcgccatgggccacgatgccgcgctctgcctctcccgctgggacaagtcgtcttcccaccccgccggcgagcacgcctacgtcgacgtcctcctccccgccggctcggagcgcggcgaccgcgagcgcgtgctcgtggacgtcgacttcaggtcccagttcgaggtcgcacggcccaccaaggcctaccgcgccgtgctgcagcggctcccgtcggcgttcgtcggcagggaggaccgcctgcgcctcctggtggccgccgccgcagactcctcgcgcgccagcctcaagaagcgcggcctccacctggcaccctggcggaagccggagtacatgcgcgccaagtggctctccccctacgagcgcgaggctccttctccggcgccggatggctctgccagtgccagtgagctcgccgacaccggcgagggaggcgaagatggacccaaagtttaattaattaagaatctgtcattagctcatctttttttctcgggaatttgcagcgcagtccccggggcagggactggatgcagatgtttttgctatattttcgtccttttctctttgattttgacccttttgatgggtaacggagtagcagtaacttccagtaagtacggggaaggaagagcaacaaaataaataaattgtacgtagtgtttagctggaagagatttgagagattaacgaatca

SEQ ID NO: 2049 - DNA, 1317 bp, Pseudoroegneria spicata
  misc_feature (49)..(49): n is a, c, g, or t
  misc_feature (84)..(84): n is a, c, g, or t
  misc_feature (169)..(169): n is a, c, g, or t
  misc_feature (380)..(380): n is a, c, g, or t
  misc_feature (553)..(553): n is a, c, g, or t
  misc_feature (600)..(600): n is a, c, g, or t
  misc_feature (688)..(688): n is a, c, g, or t
  misc_feature (881)..(881): n is a, c, g, or t
  misc_feature (1150)..(1150): n is a, c, g, or t
  misc_feature (1240)..(1240): n is a, c, g, or t
  misc_feature (1250)..(1250): n is a, c, g, or t
attgtaactcgtaaaagaaaggggaggaaaaataaaccctagcccgccncgccgatcgaagccagtgagacggctatgcggccngcgatcgcaggagaccaggatcgccgcctctagccgcaccgacccccgtccgctcgcttccgcagccatgagggccgccgcggcncagatcgatccgtccccgtccccgtcccccgccgcgctggccaagtcgcggctcaagcgcctgttcgagcgccaggtgctgcgggtctcgccggcggagcggctcccgcccgtctccgccggcggggacaaggagaaggatgatttggagcccagctcggtgtgccttgacggcatggtccgcagcttcctggaggacggcggcggcgccntcggcgagcgggcctcggccgcgcgctgctgcaactgcttcaacggcggcgacgcctcggacgacgaggacggccccgccgcggccgaggcttctgccatctccgacgccgcggagaccatcaagggcctcgtccactgcgccagtctccgggagcgcaacctcctcgccgangtgtccacgctcgtcgagcgccaccgcgcggcgggagcgcgcaagcncgacctcctccgcctcctcgcgacgtccctccgcgccatgggccacgacgcggcgctctgcctctcccgctgggacaagtcgtcctcncaccccgccggcgagcacgcctacgtcgacgtcctcctccccgccggctcggagcgcggcgaccgcgagcgcgtgctcgtggacgtcgacttcaggtcccagttcgaggtcgcacgacccaccaaggcctaccgcgccgtgctgcagcggctcccgtcggcgttcgtcggcaaggaggaccgcctgcgccttntggtggccgccgccgcagactcctcacgcgccagcctcaagaagcgcggcctccatcttccaccgtggcggaagcccgagtacatgcgcgccaagtggctgtccccctacgagcgcgaggctcctcctccggcgccggatgcccctgccagtgccagtgagctcgccgacatcggcgagggaggcggagatggagccaaagcttaattaatcaaggatcggccattagttgattttttttttctcctggggaatttgctgcgcagtccncgggcagggaccggatgcagatgtttttgctatattttcgtccttttctctttcattttgacccttttgatgggtaacggaggactagcngtaacttccngtaagtaagtaccgggaaggaagagcaactaaataaataaattctagtgtttagttcaaaaaaaaaa

SEQ ID NO: 2050 - DNA, 750 bp, Amorphophallus konjac
ttaacgatttgctggtattgctgctgctgcaagtaaaactcattcagccgcaacccgtaagccgccccttgctgctttagaactttccacagcacctctctctctctctctgcgctgcggcgtcgaggtttcttgcgttcgctggttcgatcgggaaccgcgtttgattttctccacaaggctcctgagcatttgatatcagaagcagcatggccaagcaccatcctgacctgatcatgtgcaggaagcagccgggtattgcaattggtcgcctttgtgagaagtgtgatgggaaatgtgtgatctgtgactcatatgtgaggccctgcacactggtgcgtgtctgtgatgaatgcaactacggatcatttcagggcagatgtgtcatctgtggaggtgtgggaatttccgatgcatactactgcaaggagtgcacccagcaggagaaagatagggatggttgccccaagattgttaacctgggtagcgcaaagactgatctgttttatgaacgcaaaaaatatggctttaagaaaagatgatcccttcatcattttcttctttcatttatccccctaccatgctactcgtatctgtgtatgctactctaacaagtgcagtctacaggagagtggaacggtcgtcccgccagtcttgatctaatttgttctcactctttctatgaaacttgtcggagaaagtatgattgcccttattaatggtgtatgtacgcctagatttctagttgga

SEQ ID NO: 2051 - DNA, 620 bp, Amorphophallus konjac
gcgccgtaccatcctcctctgtctagggcatcgggcttcctctcgttcgtaatcgttcgtgcgctcgaaataagcgttgagctccggggtttgtgaggatccaattgcaacagtaacatggccaagcaccatcccgatctaatcatgtgccggaagcagcctggaattgcaattggccggctgtgtgagaagtgcgatgggaagtgtgtgatctgtgactcgtatgtgcggccctgcacgcttgtccgtgtctgcgatgaatgcaattatggatcatttcagggtaggtgcgtcatctgcggaggcgtaggaatttccgatgcatactactgtaaggaatgcacacagcaggagaaggatagggatggttgccccaagattgtcaacttgggcagtgcaaagacagatctcttttatgaacgtaagaaatatggttttaagaaaaggtgatgccctcagtggttcctggtatctttgctgtctgacatcttggctcgtcgaacccattaatgtgatttgaaaaggcgaacttctaatccaatgtatgctcctgagagagagcgcacttcgcttcttattttcctactttactatatcccttgtttgtacatagtgggggg

SEQ ID NO: 2052 - DNA, 660 bp, Amsonia hubrichtii
attgctctcggcgttaagattacggcgtcaagattacggcgtcgttaggttctcggtgttccctcccctgccgccattgctcgggttcggatgtgtggagcttacagggaaggaaaggaaaatgtgaaggttgctactatacttggggcctaaacatttgcggttgaaaatatggccaagcatcatcctgatttgattatgtgccggaagcagccaggaatagccattggtcggctttgtgaaaaatgtgatggaaaatgtgtaatatgtgattcctatgtgcgtccttgtaccctagtgcgagtatgtgatgaatgtaactatgggtcttttcaaggtcgttgtgtcatttgtggaggggttggaatttctgatgcctactattgtaaagagtgtacacaacaggagaaagatcgagatggttgtccgaaaattgtcaatcttggaagtgccaaaacggatctcttctatgagcgtaaaaagtatggctttaagaagagatgaggaaaatactgatttagttatgttgtactgtaattatggtttactatcaatatttcttggctttgtcaggaagttgataatctggaattagtatttccttttcgtagaccttgtgattgttaacttttcttctatggtaattctctgtactactgt

SEQ ID NO: 2053 - DNA, 2716 bp, Malus domestica
atggagcattcacgtaccaatggaaagcttgttttattgaaattcctgcatggtttcattcttttatggatgatcacatgtccggaatctgcagcacttcacagccctactctgcttggaaacgaatctgaccgcttggctttgcttgatttcaagaaaagaataactggagatcctctcaatgtcatgagctcatggaatcattccaccgatatctgcagttggtttggggtttcttgtcaccgttccaccaaaagagtcttgacgttgaacctagaagctcaaaaattggtaggctccctaccaccttccattggaaatcttacttacatcactagactcaacctgggaaaaaacatgtttcatggtgaaattcctcaagaaataggtcgtctaagaagcttgcaatacctcaacctgtctagcaattctttcagcgggaaaattccaactaatatatcgcactgcgcacaactaagaatgcttaatcttgaagtcaatgggattactgggtcaattccaatccaactcatttcattgttgcgtttaactcatctgaggctttcaagtaacaatctcagtggaaccatcccaggttggataggaaacttttcttctttgactagacttcatcttggcgacaataatttgcaaggaagcatacccactgagcttgcgcatataacaggcttggatagcctcatagtttcagagaataatctgtctggtatggttccatctagaatctataatatttcttccatacgttatatcagtgtttctgtcaaccagttgcatggagagctaccaccaaatctcggcactatgcttcctaatctcgtaggattttactgctttatgaacaaattcagaggaaatattcctgcatcattttccaatgcttctagatttcaattgcttgatcttggtatgaattggcttactgggacactccctggtgaaagtctaggaagcttgcgaagcttagttaagttaagcgttgaaggcaatcaactaggaaaaaggaaggttggtgacttgaattttctcagtttcttggctaattgcactagtttggagcatttgggtcttggctttaataattttggtggaggaattccgggatccatagccaacctttcgacccaacttcattatcttagtctggggggaaatgttatacatggaagcctccctaacggcattggaaatcttataaacttgacctttctagcattagaacataaccatttgggcggtattgtccctgatgaaattgggaagctaaagaagttagagcaactgtatttggatgttaaccaattttctgggtcaatcccatcttcccttggtaacatgacttcattgttaaacctctacatggagtctaacgggtttgagggaagtatacctccaagtcttggaaactgccaaaacctattggatcttgacctttcaaataacaaccttacgggcaccatacctaaaatgcttatgaagctttcaaccctttcaatttctttagacctgtctgacaattatttgactggtccactgccctttgaagtgggtgatttagtgcatctcatggagctaaatgtattaagaaacaatttatctggtgaaatcccgagcagcctcggcagttgtgctagtttggagcacttgtatttgcaaggtaataagtttcaaggaacaattcctcaatctcttaaagatttaaaagccttggaaaaacttgatctttcaagcaacaacttgtctggtcaaattcctgaattcataggcaagcttggtgctctcaagtatctcaatctttcatataatgattttgagggcgagttgcctaaagaaggtatttttgcaaattcaattgcatacgacatattgtatgtcctagcagagtacggcacaggaggccaagtttccatacttggagatgtttacagctatgggatactattgctggaaatgttcacaagaaaaagacctaccaatgacatgtttaaaggtggtctaagcatttaccaatttgtacccatggctttgcctgaccatgtcatggacgttgttgaccattcaattatcctcgacctcgaaacagatgccctattcgattctctgtgtcatttgtgctctcatctctcatacagtagcagcccttcgtccgagtcctccccagctatcttcggaacatggcgaagcatcatcctgacctgattatgtgccggaagcaacctggaatagctattggaaggttgtgtgagaagtgcgacggtaagtgtgtaatttgtgactcttatgtgcgtccttgcacgcttgttcgggtttgcgatgagtgcaactatggatctttccagggaaggtgtgttatctgtggaggggttggaatttctgatgcttattactgcaaagagtgtactcagcaggagaaagatagagatggctgtccgaaaattgtgaatctgggaagtgccaaaacagatctgttctacgaacggaaaaagtatggtttcaagaaaagatgatctttagcaggtcaagtttcgtttagcttccggaaatcattttgttgtgttcatcattgaggcttaggctatattacaatcaggtatttttcttaggaagcttgcttattcctgctcgtatgcttgactcttctattttgtcgttcgatatgcatccatctatggatgtttgaactcctcattatact

SEQ ID NO: 2054 - DNA, 640 bp, Malus domestica
gttgttgcaggaacatggcgaagcatcatcctgacctgattatgtgccggaagcaacctggaatagctattggaaggttgtgtgagaagtgcgacggtaagtgtgtaatttgtgactcttatgtgcgtccttgcacgcttgttcgggtttgcgatgagtgcaactatggatctttccagggaaggtgtgttatctgtggaggggttggaatttctgatgcttattactgcaaagagtgtactcagcaggagaaagatagagatggctgtccgaaaattgtgaatctgggaagtgccaaaacagatctgttctacgaacggaaaaagtatggtttcaagaaaagatgatctttagcaggtcaagtttcgtttagcttccggaaatcattttgttgtgttcatcattgaggcttaggctatattacaatcaggtatttttcttaggaagcttgcttattcctgctcgtatgcttgactcttctattttgtcgttcgatatgtttccaacctactctcatttggtaattctccctcgtaatctttgtagttagtctgtggcatccatctatggatgtttgaactcctcattatacttggagctttgttaatccaattttaaatatgcgattttatgttcatta

SEQ ID NO: 2055 - DNA, 688 bp, Arnica chamissonis
tttaaggcgttgcgtcatctgctccgagcatctttcttctgccatttttaagcccccaaatttgcagttccgactgtctcgatcttcatcagggtgttatagcttctggtagttgaggaaatcatggcgaaacatcatccagatttgatcatgtgcaggaagcagccaggaattgccattgggcgactttgtgaaaaatgtgatggcaaatgtgtaatttgcgactcttatgtgcgtccatgcacactcgtgcgcgtctgtgatgagtgcaactatggctccttccagggtcgctgtgtcatatgtggaggcgtgggcatctctgatgcgtattactgcaaagagtgcacgcagcaggagaaagacagggacgggtgccccaagatcgttaatctgggaagtgctaaaacggacttgttttacgaacggaagaagtacggatttaagaaacgatgataaacgatttcttcttttaatcattgtaacaccaactcaccaagcatgagatggattatcatctcaattatatccaaaataatgcttgtattagagtgcttttggttgtattttggattcatgagacaagttgcaggtcatgaaacacttttgagttagaatttgtggatttgatgatgatgttctttttcatattgtgtcatataattagaccctctgttatgctatatct

SEQ ID NO: 2056 - DNA, 780 bp, Catharanthus roseus
gccagccacggcgctgaggaagagggaaaccctagcttgagttaaatttgaaatcttcttctcatagttcagaaggttgctatttaacccaaggtctagaattttgctgtcaaaagtatggctaagcatcatccggatttgattatgtgccggaaacagccaggcatagccattggtcggctgtgtgaaaaatgtgatggaaagtgtgtaatatgcgattcctatgtgcgtccttgcacactggtacgagtatgtgatgaatgtaattatgggtctttccaaggtcgttgtgtcatttgcggaggagttgggatttctgatgcttactattgtaaagagtgtacgcaacaggagaaggatcgagatggttgtccaaaaattgttaatcttggaagtgccaaaacagatctcttctatgagcgtaaaaaatatgggtttaagaagagatgagggggatgttgattcaggtattccctcctttgtagtactgtaattatgagttcactttttgtatgtccaggttgcgtctggaaactgatgatgatttgatcatagttagtattttacctttgtaaacgttgcttggtaactctattctctcaggtaattatcagtactacaattttagtagctggacttagaaccccatgataagaaactggtctttactatggaatccgtcaattcatggtgcttgtaatgattcagctacattccttgagcatctgttttgtgaaactgcattcatagctatataaagtcatgatccattttgtttgc

SEQ ID NO: 2057 - DNA, 462 bp, Chelidonium majus
cggcagagcaaacatggccaagcatcatcccgatctgattatgtgcaggaaacaaccagggattgccattggacgactgtgtgagaagtgtgacgggaagtgtgtgatatgtgactcttatgtgcgtccttgcacacttgttcgggtctgcgacgaatgcaactatggatcattccaaggtcggtgtgtgatctgtggaggtgtaggtatctctgacgcctattactgcaaagagtgtactcaacaggagaaagaccgtgatgggtgcccgaagattgtcaatttagggagtgcaaaaactgatctcttctatgaacgcaagaaatatggttttaagaaaagatgaaggttattgggtatcttctcatgatggctagtttgaaaccctacatggttttgaaatgttgggtgtccctgatggtacatcaccttttctttcttttcatcagaacaggtagagat

SEQ ID NO: 2058 - DNA, 647 bp, Cirsium arvense
tagtctttttctgctgctggcttattcattcgcccccaaatactttcattatcttcaggttgttgccgtttcaaggagttgagagcctgctaaggaaatcatggccaagcatcatcctgatctgatcatgtgcaggaagcagccaggcatcgccattggccggctttgtgaaaaatgcgatggcaaatgcgtaatttgcgactcttacgtgcgtccatgtacgcttgtgcgtgtgtgcgatgagtgcaactatgggtcctttcagggtcgctgtgtgatatgtggaggcgtgggtatttctgatgcttattactgcaaggagtgcacacagcaggagaaagatagagatgggtgcccaaagatcgtcaatttggggagtgctaaaacggatctcttctatgaacgtaaaaaatatggatttaagaaacgatagttggtacagtttactttgaatgactgtatttgagatgatgatattaaggcttaagagatgatgtagaactccttgaccatttgaacctgagtaagaatttgtgtacttgatagtggcagtacgttctatgcttgacttataaggcttgaggtctaatcttaccgctatgctattttgaacaaaaaaaaatcgataccgagggagaggaatcaac

SEQ ID NO: 2059 - DNA, 670 bp, Cirsium arvense
tttcttcgtgttcaattgttcatctagtcttcattcaggttggtggtagtctaaaacaatggctaagcatcatcccgatctgatcatgtgccgaaagcagcccggaattgcgatcggaaggctttgtgaaaagtgcgatggaaaatgcgttatctgcgactcttatgtccgtccatgtacgcttgttcgggtctgcgacgagtgcaactacggatctttccagggtcggtgtgttatatgtggaggtgtcgggatttccgacgcctactattgcaaagagtgcacacagcaggagaaagatagggatggttgcccgaaaatcgtgaatttaggaagcgcgaaaacggatctgttttacgaacgtaagaaatacgggtttaagaaaagatgatttatatatgtgttgattatgctacatacttattatttgtatgtgattgattggctttggggtcatagatattcaactttggtaagaactttgtgtattagaatagaggggtgtggtgatctaagtgtcatgttataatgagtacttcttggtttactacttgttactactattcatatgttactaaacaatgcagcatatcccaattggaggtgggatatttatgtaaatctgacctttaaagtagaagtagaatgattatttctgtgaaaaaagaaa

SEQ ID NO: 2060 - DNA, 709 bp, Cirsium arvense
tcggtctgaagcccaattttctacatgctcctgattcctgaagacctaaaggttcgctttttaatatctcgtgtcttctgccggctgtttgtctcccaaaatttttgcatcccgactgtctcactgatcataaggctgttatagtttcagggagttgaaagcccgttgagaaaatcatggccaagcatcatcctgatttgatcatgtgcaggaagcagccaggaatcgccattggtaggctttgtgaaaaatgcgatggcaaatgtgtaatttgcgactcttatgtgcgtccatgtacacttgtgcgtgtgtgcgatgagtgtaactatggttcctttcagggtcgctgtgtgatatgtggaggtgtgggtatttctgatgcctattactgcaaggaatgcacacagcaggagaaagatcgagatgggtgcccaaaaatcgtcaatttggggagtgctaaaactgatctgttctatgaacgtaaaaaatacgggtttaaaaaacgataataagtatacattcgtctttgaatgattgtagttgaagatgattttaagttctgtaaaactccttgaccatttgaacttgagttagagtttgcgtatttgatgatagtgccggtatgttttatgttttttcatatagtcttgactagttgcttgtgtgcactatgccatgctacatattcctctttaccagtgttataaaa

SEQ ID NO: 2061 - DNA, 595 bp, Cirsium arvense
aaccgattcatcgtcattcttcctccggcggtcgcacatcaggtttctttctggccatctcagtcttcattcagattgtggtagtctaaacaaatggcgaagcatcatcccgatctgataatgtgccgaaaacagccaggaattgcaatcggaagactgtgtgaaaaatgtgacggaaaatgtgttatttgtgactcttatgtgcggccatgtacacttgtacgggtttgcgatgaatgcaactacggatcctttcagggtcggtgtgttatttgtggaggtgtcggtatttccgatgcttattattgcaaagagtgtacacaacaggaaaaagatagagatgggtgcccgaaaatcgtgaatttaggaagcgcgaaaacggatctgttttatgaacggaaaaaatacgggtttaagaaaagatgatcatattttgtgtcgattgtattacatacggatttgtatgtgtattgcttttggggattatagactatcttattcaactatgagtatgaaattgtgtttatttgtgttttgatgatttagggttattttcgtaatgaatacttgttggtttattagttgttactatcaa

SEQ ID NO: 2062 - DNA, 644 bp, Cirsium arvense
catcaaatttagctaggtttaaaatagtatcgtctgaagccccaattttctacatgcttcttggaggcctaaaggttcgctttaataaggaacatcttgcaatcttttcttctgccggctgcttgtctcccaaattttgcatcccgaattcccgactgtctcactgatcataaggctgttataatttcagggagttgagagcccgttgaggaaatcatggccaagcatcatcctgatttgatcatgtgcaggaagcagccaggaattgccattggccgactttgtgaaaaatgtgatggcaaatgtgtaatttgcgactcttatgtgcgcccatgtacacttgtgcgtgtgtgcgatgagtgtaactatggttcctttcagggtcgttgtgtgatatgtggaggtgtgggtatttctgatgcctattactgcaaagagtgcacacagcaggagaaagatcgagatgggtgtccaaagatcgtcaatttggggagtgctaaaactgatctgttctatgaacgtaaaaaatacggatttaaaaaacgataataagtatacattcttctttgaatgattgtagttgaagatgatattaagtcatgtaaaactccttgaccatttgaacttgagttagagtttgtgta

SEQ ID NO: 2063 - DNA, 675 bp, Cirsium arvense
cggggaagcttctagaggcctaaaggttcgctttaaggaccggcttatcgtgcgaacatcttgtagtcttttctcagctgctggcttattcattcgcccccaaatacttccattaacatcaggttgttactgttttcaaggagttgagagcctgctgaggaaatcatggccaagcatcatcctgatttgatcatgtgcaggaagcagccaggtatcgctattggccggctttgtgaaaaatgcgatggcaaatgtgtaatttgcgactcttatgtgcgtccatgtacacttgtgcgtgtgtgcgacgagtgcaactacggatcctttcagggtcggtgtgtgatatgtggaggtgtgggtatttctgacgcttattactgcaaagaatgcacacagcaggagaaagatagagatgggtgcccgaagattgtcaatttggggagtgctaaaacggatctcttctatgaacgtaaaaaatatggatttaagaaacgatagttggtacagtttactttgaatgactgtatttgagatggtattaaggcttaagagatgatgtagaactccttgaccattcaaacctgagtaagaatttgtgtatttgatggtggcagtatgttctatggttgacttgtaaggcttgagacttagtctcaccgctatgctattttgaac

SEQ ID NO: 2064 - DNA, 1231 bp, Citrus clementina
atgataagccctaaaattctcttttcaacatataacaaaaccctctctttgctgattcgaagcaatctcaacattttcttctccaagcaagcggacgttagcatctggacttcgagtcttctgtgcaggtcctaagaacttataggagctaccagctttttgtcgtagaaaccatggccaagcatcatcctgatttgatcatgtgcaggaagcaaccagggatagccattggaaggctctgcgagaaatgtgatgggaagtgtgtgatttgtgattcctatgtgcgtccttgcacccttgtgcgagtctgtgatgaatgcaattatggttcctttcagggtcgatgtgtcatctgtggaggggtgggaatctctgatgcatactactgcaaagagtgcacacagcaagagaaggacagggatggttgtccaaaaattgtcaatttgggcagtgcgaaaacggacctgttttacgaacgtaagaaatatggttttaagaaaagatgatgatagcccgctaattgtttttgtagcaagagcattttatctaccattatatacaattcttgacgatgatggattttgaggtgtttgaagttggaactaagatgtgtggcgtctgtaaccacgagtcattagagtgacttattatcttaacctctattcattactgaagcacctgcttatattctaatgggttcggattgtatttgaacatatctgtaatggaaacttctgcttaagtaacctcatttgtttctattaggacttggttttcagtttaataagcatgagtgatctcagtagtggatcagttgatggttatgtgtactttgtttggccacggtcaatcttattttgctattaaggaaatttgatgacttagttcaagagtaggttggttgcatgtcgattgtgatgggtaaaacgccaaaacctctgtttatttgacacttttggaggcttgtgaagtcatatgattgcgattgcataatgcatattcatggtactcgaacaagccaagtgccatcaaaggcgaaacagtgtaacaattcactctagtgaaagcactgcactaagatagtgcttctagtcctagccttccgtgaaaggcagcagcatatttggtgggttgagggagacttcaaattagttttgactctgatacaggaaaacaattccattatggaatgtatcagtcactaaatatggtgcaaaactagaactgacaa

SEQ ID NO: 2065 - DNA, 870 bp, Cucurbita pepo
cccattccatctcacaccaaccagcatccgtttgcgcccttctctttcggtaatatacctctgcgtcactgtcgcggccgtttttcttctgcttccgctgccgcagcctccatcgtagcggatttgagttgttgttctactctcttgtcggttctggttagaaactttatcggactggagagcttgttgcagttacaaaaagcatggccaagcatcatcccgatttgattatgtgcagaaagcagccaggaattgccattggccgactctgtgagaagtgtgatgggaagtgtgtaatctgtgattcttatgtccgtccctgtacgcttgttcgtgtttgtgatgaatgcaattacgggtctttccaaggccgttgtgttatctgtggaggagtaggaatctcagatgcctactactgcaaagagtgtacacagcaggagaaagatagagatggatgtccaaagatcgttaacttagggagtgcaaaaacagacttattctatgaacgtaagaaatacgggttcaagaaacgttaaagttaaaaaaaggatggatcttactgtaatctgaccgatttcggatttctaatcacaaactctcttagacatgtatgtatatgctgatgagaacagtcgtttgatcaaggccagggccggtgccattcactagcatcaaaaactatattgattgtgctgcttgtattgttgtgtttatattgatggataggaactttgcttcaaccaaaatttaataggagaagaaattagtttagaaaaaaaaaaaaaaacaaaaaaagtaaactctgcgttagactaaccacctagctctcgagactagccgaagcacacagggagtaggcaccactacaag

SEQ ID NO: 2066 - DNA, 638 bp, Fagopyrum esculentum
tcgccagtcgtcaccgccttggttgttgtccgcgataagctttctctttctactgttgctgctgagggatcttcaatccgccggttaaggcttgagaattattcaccgaaaacatggcaaagcatcatcctgatttgataatgtgccgcaaacagccaggcattgccattggtcgattgtgtgagaaatgtgatgggaagtgtgtgatatgtgattcctacgtgcgtccttgcacactcgtgcgtgtttgtgacgaatgcaactatgggtcctttcaaggtcgttgtgttatatgcggaggtgttggcatctcagatgcctactattgcaaagaatgtactcagcaggagaaagacagggatggctgtcccaaaattgtgaacttgggcagtgctaagacagacttgttttacgaacggaaaaagtacggtttcaagaaaagatgatggttttgtcggtatgtcatcctctatgctattcttgatgttgcaacaatgttaaatgtgttgttttactcaatgatctatttatctgcaaacaaggggatatatagattgcatatgcatttttttgtattgaatggattttgttgtattgacttatcttagaacactatatcctgtttggtttaaatttag

SEQ ID NO: 2067 - DNA, 760 bp, Fagopyrum esculentum
cgtttgatacttccattgcaggcaacttcaccgccttcgctctcagtcacaagctctttttaactcctttcgcttcacggaaaaaccttcaagcgccatttcaggtttaagaatcattaactgtaagaatggccaagcaccaccctgatctgataatgtgccggaagcagccaggcattgccattgggcgattgtgtgagaaatgtgacgggaagtgcgtgatatgcgattcatatgtgcgtccttgcacactagtgcgagtctgtgacgaatgcaactacggatcctttcagggtaggtgtgttatatgcggaggagttgggatttcagatgcctactattgcaaagaatgtacccaacaggagaaagacagggacgggtgtccgaaaatcgttaacttggggagtgctaagacagacttgttctacgaacgaaagaagtatggttttaagaaaagatgatcgctgcttgtgttgcgggactcaatgatgatatgtattatcactaagcagtaaggggatgttagtaatctaactgtatttgatgtttgtaccagagtaccaggtaagggcggatagactgacaaagattacaaagtactgaatgtgaactgcagtaatggtttatcctatggttattagaatcacgatctggttctatgattttaccaagggcccgtttggttaactccgggaacggaaacggaaacggaatgaaaacgaatctagttcatatcttgttaataaaacttttttggaat

SEQ ID NO: 2068 - DNA, 622 bp, Flaveria ramosissima
tcttcacgcaacgcaacattatcctttcgctatttctaaacccccaatattcgttcatcagggtgctatagcttctggttgttgaggtaatcatggcgaaacatcatcctgatttgatcatgtgcaggaagcagccaggcattgccattggtcggctttgtgaaaagtgtgatggcaaatgtgtaatttgtgactcatacgtgcgtccatgcacactcgtgcgtgtctgtgatgaatgcaactatggctccttccagggtcgatgtgtcatatgtggaggcgtgggtatttctgatgcatattactgcaaagagtgcacacagcaggagaaagatcgagacggatgtcccaagattgtcaacctaggaagcgctaaaactgacctgttttatgaacggaaaaaatacggatttaagaaacgatgataaacaacttcttttaatctttgtgacatcaagcatgagatgagttattatctcacttatccaaaacaattgtattagagtgcttttggttgtattgtggattcatgaggcaaactacaggtcatgaaacattttaagtttagaattgtggatttgataatatttctcatgttgtgttgtatatatttattagtttg

SEQ ID NO: 2069 - DNA, 817 bp, Humulus lupulus
actcagccgtcaccgccatttctccctcgcaccttctcttacattctctctctgtcgcgaacccggtcacccacgacacgcctatttcgttgtcgtgtgcatacaaatcctccgcccgcgccatttccgcaaccgcgccaagaagtcaataaccaccgccgagtgtactgtgtatcttgcagattatcatatattgagttaacttgttagatcatggccaagcatcatcccgatctgattatgtgccggaaacaaccgggaattgcaattggaagactatgcgagaaatgtgatggaaagtgtgtgatatgcgactcatacgtgagaccatgcactcttgtgcgggtttgcgacgaatgcaactatgggtcctttcaaggtcggtgtgttatctgtggaggagttggaatatccgatgcctactactgcaaggagtgtactcagcaggagaaagacagagatgggtgccctaagattgttaatttagggagtgccaagactgatttgttttacgaacgtaagaaatatggttttaagaaaagatgatgatgatgctcagcttactctgtcttcaatgctggtgctgatgacattttctttttatgtaaaggttataaggattggttaatattttgacttactatcgtgtaccattgacactcaagtttaaggattgagactcatgtagaagatggaccagagtttatagtgttcatttctatattgctacactgttatgtttggtagaaggtcctaagtttgtacccctgtagacagtagtgatggtaacatttcatgatatatatggtcttcactg

SEQ ID NO: 2070 - DNA, 434 bp, Olea europaea
gggggagaggcaaactgggagccattgaactgatttctactcatcttcttcatcaaagaaattggaagtgaatattccaagaaagtgtaaaagagggtatggctaagcatcatccagacttgattatgtgtcggaagcaaccagggatagccataggaaggctttgtgagaaatgcgatggtaagtgcgtgatatgtgattcctatgtgcgtccttgcacccttgtgcgggtatgtgatgagtgcaattatggatcgttccaaggacgttgtgttatctgtggaggggtggggatttctgatgcctactattgcaaagaatgtactcagcaggaaaaagaccgggacggatgtcccaaaatcgtcaatttgggaagtgcgaaaactgatttgttctatgaacgaaagaaatatggattcaagaaaagatgatgc

SEQ ID NO: 2071 - DNA, 1223 bp, Citrus sinensis
atgataagccctaaaatgctcttttcaacatattacaaaaccctctctttgctgattcgaagcaatctcaacattttcttctccaagcaagcggacgttagcatctggacttcgagtcttctgtgcaggtcctaagaacttataggagctaccagctttttgtcgtagaaaccatggccaagcatcatcctgatttgatcatgtgcaggaagcaaccagggatagccattggaaggctctgcgagaaatgtgatgggaagtgtgtgatttgtgattcctatgtgcgtccttgcacccttgtgcgagtctgtgatgaatgcaattatggttccttccagggtcgatgtgtcatctgtggaggggtgggaatctctgatgcatactactgcaaagagtgcacacagcaagagaaggacagggatggttgtccaaaaattgtcaatttgggcagtgcgaaaacggacctgttttacgaacgtaagaaatatggttttaagaaaagatgatgatagcccgctaattgtttttgtagcaagagcattttatctaccattatatacaattcttgacgatgatggattttgaggtgtttgaagttggaactaagatgtgtggcatctgtaaccacgagtcattagagtgacttattatcttaacctctattcattactgaagcacctgcttatattctaatgggttcggattgtatttgaacatatctgtaatggaaacttctgcttaagtaacctcatttgtttctattaggacttggttttcagtttaataagcatgagtgatctcagtagtggatcagttgatggttatgtgtactttgtttggccacggtcaatcttattttgctattaaggaaatttgatgacttagttcaagagtaggttggttgcatgtcgattgtgatgggtaaaacgccaaaacctctgtttatttgacacttttggaggcttgtgaagtcatatgattgcgattgcataatgcatattcacggtactcgaacaagccaagtgccatcaaaggcgaaacagtgtaacaactcagtctagcgacagcactgcactaagattgtgcttctagtcctagccttccgtgaaaggcagaagcattgtgtatttggtgggttgagggagacttcaaattagttttgactctgatacaggaaaacaattccattatggaatgtatcagtcactaaatatggtgcaaaa

SEQ ID NO: 2072 - DNA, 686 bp, Plantago ovata
cagataagcaatcaactacttgggtgagacgcaatggccaagcatcatcctgatctgatcatgtgtaggaaacagccaggaatagcaattggcaggctttgcgagaaatgtgatggcaagtgcgtgatttgcgactcttatgtgcgcccttgcacccttgtcagagtttgtgatgagtgcaattatggatccttccaaggacgctgcgttatctgtggtggagtaggaatctcggatgcttactattgcaaggagtgtactcagcaagagaaagatcgggatggctgtcctaagatagtcaatctgggaagtgcaaaaacagatctgttctatgaacgtaaaaagtatggttttaagaaaagatgacctgtgttactcgaatgtgtccaatgctaaaggacatcgtattgcagatacagagtgtgttttagttcggcctcttaaggtaatggagtatggtggtaactggtaagatgaagtgggttttgtaagtcccattttattcgagtttgaaagatttgctacttgttaacaaaattgatatattcatctctatattgtatgtgttggcttgtagcccttcactgtgttatgttagctgtagcatacgccttctgaatctggtgctcttctctggttcgtggcatatggtgctatggttttcatgattttagtgtaaaactggt

SEQ ID NO: 2073 - DNA, 738 bp, Platanus occidentalis
acttttcacgcagccagtataatattatttgtagaaggagaaaggagtttaatctcctcctactcattggcgcagattcgaccagtcaggaacgctacaacaactccggcacagggcataggcatatctgaggatccaagagtgttggagaaagcatggcaaaacatcatcctgatctgattatgtgtaggaagcagccgggtattgccattggacggctgtgtgagaagtgtgatgggaagtgtgtgatctgtgactcatatgtgcgcccttgcaccctcgtgcgggtatgtgatgaatgcaactatggatcattccagggccgctgcgtgatctgtggaggggtgggaatatctgatgcctactattgcaaggagtgtactcagcaggagaaagacagggatgggtgtccaaagatagtcaatttggggagtgcaaaaacagatctcttctatgaacgtaagaaatatggctttaaaaaaagatgaaggatatggtttcctcagtctgctatgttttactctttacggtatgatggttaagacactgttaattgaaagatttatgtgctccatgtattagcttttagccatttgaaagtcttcgctcttcgtcatttaacccatgtactgtctgtcatagtttttgactcttaacagatttacgaggtcaaacatctagagttaaagctttggagtagttattttttaagcactcaagtggtgtgagtcttgactt

SEQ ID NO: 2074 - DNA, 623 bp, Primula obconica
ctatttattcgctctctctttttcaaggtaaactcactgtgtttggctgaatctacgtacagactctcaacatctgcaggttcctccaatacaggaattgactcatcatggccaagcatcatccagatctgatcatgtgcaggaagcaaccaggtatagctattgggcgtttatgtgaaaaatgtgatggcaaatgcgtaatttgtgattcttacgtgcgcccttgtactcttgttcgggtctgcgatgaatgcaactacggatccttccagggacgatgcgtcatatgtggaggagtgggaatatctgatgcctactattgcaaggagtgtacacagcaggagaaagatagagatggttgccctaaaatcgtcaatttggggagtgctaaaactgatttgttctatgaacgtaaaaaatacggttttaaaaaacggtgaggatgtcacggtactttcttcgccttctgttttgtttcaacttaatatcctagaaactattttgagattacactcttttagcgtgtgagactatatttcacttataagttgtatgttattggatgttatccttcatttgtgaaacgtggggattcaaattggtcgtatgctacattagtttga

SEQ ID NO: 2075 - DNA, 610 bp, Primula obconica
gctaattcgatcccaccattaattacttgcaggtttgtctagtacaggttttgagagctaattgaagtcaaatggccaagcatcatcccgatttgatcatgtgcaggaaacagccaggtatcgctattgggcgtttgtgtgaaaaatgtgatggaaaatgcgtaatttgcgactcttatgtgcgcccatgtacacttgtgcgagtttgcgacgaatgcaattacggatcttttcagggacgatgtgtcatctgtggaggcgtggggatatcggatgcatactactgcaaggagtgcacacagcaggagaaggatagagacggttgccctaagattgtcaatttgggtagtgctaaaactgatttattctacgaacgtaagaaatatggttttaaaaaacggtgactatgtgggattactttgttcgctttctgttttcgcttattaattctaaatgtatgacattagaacttgtgagggtactatcttacttgcaatctgtatgttactggatctttgtttgtgaaaaccagattaccccggcaatgttatgaatccggatttgactatttttctacttaaatttgtactttttcttgataagtctgggt

SEQ ID NO: 2076 - DNA, 727 bp, Sarracenia psittacina
tttcccgcttatagaaagggaaaatttccacctattctgctgagctcgtcagggcaaccggaaactcgaatcccgtattttcgttgctggtggtcttccgttattttcgctgaaattcagccaggttatatcaacccttattttcgctgaaattcagtcaggttatatcaaatcttggatctaaaagctctttgcagaaagcatggcaaagcaccatcccgatttaattatgtgcaggaagcagccaggtattgccattggacgattatgtgagaaatgtgatggtaaatgtgtaatctgtgactcgtacgtgcgtccttgcacgctcgtgcgagtttgtgatgaatgcaactacggatccttccagggccgctgtgttatctgtggaggagtgggaatttccgatgcttactactgcaaagagtgcacacagcaggagaaagatagggatggttgtcccaaaattgtcaatttggggagtgccaaaactgacttgttctacgaacggaaaaaatacggttttaagaaaagatgatagtttttgtgtgttattattaagttttttcagtttttattatgctcggagattacatatttcaaacttttagaatatcgtcggccttgtatttctatttatagttagtattgggatttggtggagaagttgcattaactcttatcagaatggaaacattgttgagtttgtttttggacaatgtaaaccgtc

SEQ ID NO: 2077 - DNA, 695 bp, Sarracenia psittacina
tccatcatctggaactgtcaagtcttgcacagaaacatggccaagcatcatcctgatttgatcatgtgccgtaagcagcctgggattgccattggacggctttgtgagaaatgtgatggaaaatgtgtaatttgcgactcctatgtgcgtccttgtacacttgtccgagtctgtgatgaatgcaactatggatcctttcagggtcgctgtgttatatgtggaggagttggaatttctgatgcctactactgcaaagaatgcacacaacaagagaaagatcgcgatgggtgtccaaaaattgtcaatttggggagtgccaaaacggacttgttctatgaacgcaagaaatatggtttcaagaaacgatgacagcatttgggaattaccctcttaagttctgcttatctattattgtgcattacacattacatggaaaaacagttttcgaaatgttagaatggtgctgtaggatctgtgtttgtagccgttgctaggcttctttgttcaaggaaacgttgtgagctggtagacaagctaaattgaaattccctcaaatgagaaaatgatgtattgatgcctattattacgtggagttacgtggagcaagggttctcgttgtcacccgtcacatcacaccctctttgagtctattttgcacattaattgggattttataatttgattggaatcgttca

SEQ ID NO: 2078 - DNA, 709 bp, Sarracenia psittacina
acactatttctttctatcatctggaactgtcaagtcttggacagaaaacatggccaagcatcatcctgatttgatcatgtgccgtaagcagcctgggattgccattggacggctttgtgagaaatgtgatggaaaatgtgtaatttgcgactcctatgtgcgtccttgtacacttgtccgagtctgtgatgaatgcaactatggatcctttcagggtcgctgtgttatatgtggaggagttggaatttctgatgcctactactgcaaagaatgcacacaacaagagaaagatcgcgatgggtgtccaaaaattgtcaatttggggagtgccaaaacggacttgttctatgaacgcaagaaatatggtttcaagaaacgatgacagcatttgggaattaccctcttaagttctacttatttattattgtgcattacacattacatggaaaaacagttttcaaaatgttagaatggtgctgcaggatctgtgtttgtagacattgctaggcttctttgttcaaggaaacgttgtgagctggtggtagacgagctaaattgaaattccctcaaatgagaaaatgatgtattgatgcctattattacgcggagcaagggttcccgttgtcacccaagtcacatcacaccttctgtgagtctattttgcgcattaattggaattttataatttgattggaatagttcattattt

SEQ ID NO: 2079 - DNA, 599 bp, Silene vulgaris
ggaaacttagcctgcgaaatccgaagcaatggccaagcatcacccagatctcatcatgtgcaggaaacaaccaggaatagctatcggacgactatgcgagaaatgtgatggaaagtgtgtgatctgtgattcctatgtccgaccatgcacacttgtgcgagtctgtgacgagtgcaactatgggtcgttccaaggaagatgtgttatttgtggtggagtcgggatctcagatgcctattattgcaaagaatgtactcagcaggagaaggatagagacgggtgcccaaagatcgtgaatctaggaagtgcgaagactgatctcttctacgaacggaagaaatatggattcaagaaacgatgatggccgggaattctttggctgagtttgcttctatcctcatcagtggagatagaacatacaaagcctgcctgcattgttacctagttagtcccatcttttatagacagtctaaaactgacaagagtgggtttgaactagagtgttggtactatatttagctcgcggttatatttatgtatcactatcagacggttttgtgtatgaaagtttgagatattgttctgaccaaaaaaaaaaa

SEQ ID NO: 2080 - DNA, 713 bp, Tabernaemontana elegans
agcagcagtgccgaagcctcttctcctccatcgtttcagaattttccagcagccgccgcacggaggaacagtgaaacgcagctctaatcgaagaagaaatcttctcctcatagttcagaaggttgctattgcacctggggcctaaaattttgcagttgacagtatggccaagcatcatcctgatttgattatgtgccggaagcagccaggaatagccatcggtcggctttgtgaaaaatgtgatggaaagtgtgtaatatgtgattcttatgtgcgtccttgcacactagtgcgagtatgtgatgaatgtaactacgggtcttttcaaggtcgttgtgtcatttgtggaggggttggaatttctgatgcctactactgtaaagagtgtacacaacaggagaaagatcgagatggttgtccgaagattgtcaatcttggtagtgcgaaaacagatctcttctatgagcgtaaaaaatatggctttaagaagagatgagggacagatattgatgccattcttccatgtctatgtagtactgtacttatgtggtttactatctagatttcttggctatgtcaggaaagtgatgattttacctttgtagaccttgtgatcgtcaactttgttcataggtggtaattctcagtggtttgtattactattttggtggttggatgtttaatgctgtgatgagaatttggtctgcaccaca

SEQ ID NO: 2081 - DNA, 613 bp, Thalictrum flavum
ctagctctagaatctagattacagaagactccagaaagctccgtcggagaaggcgttggttttcttccctacttgcgcaggacacctacactgaaggaaaatggccaagcatcatcctgatctgattatgtgcagaaagcagccaggaattgcaattggacggttatgtgaaaagtgtgacgggaagtgtgtaatctgtgactcgtatgtgcgcccttgcacactcgtgcgagtttgtgatgagtgtaactatggctctttccagggtcgatgtgtgatctgtggaggggtgggaatatcagatgcatattactgtaaagaatgtacacagcaggaaaaagaccgggatgggtgtccaaagattgtcaatttggggagtgcaaaaactgatctcttctatgaacgtaagaagtatggattcaaaaaaagatgaagtgtatagggtaatttcttatgcccgacttgctgccttcaatctgatcctttgtaatacactgtagactatttgtattagttcatttcaattcactttagtagtcgtcactcttcaggtacgtaattcttgcaaaatagtaatcattgatggttctataatctatatacaatgatattt

SEQ ID NO: 2082 - DNA, 765 bp, Solanum lycopersicum
atcttcaatattcctctcgagtcatttctctgcagctaaacccctgcggctttaggttccagaaacttcgctcatcgattcaggttaagacgtcactgctagaaatatggccaagcatcatcccgatttgatcatgtgccggaagcagccaggaatagctatcggtcgactttgtgagaaatgtgatgggaagtgtgtgatttgtgattcatacgtacggccttgcacacttgtccgagtttgtgatgaatgcaactatggatcctttcaaggccgttgtgtcatctgtggtggtgttggtatctctgatgcttactattgcaaggagtgtactcagcaggagaaagatagggatggctgtccaaagatagtcaatcttggtagtgccaagaccgatctgttttatgaacgtaaaaaatatggtttcaagaagagatgagagggtcggatacctctttcacccttcggtgaagttcactactggaattttgtactagcataattgtgtcaaaattaggcatttgagtatagcctatgtacttactcactatattgccttggaacttgctgtattacatactgatatcacaagtttaacccattgtaatttcgttttgtgcaagggtatgcaacaaaatgccaacgctaatcgacttccgatctagtttcttttgggtgtaatttgtgaaaattttacttcagttaattttctatcatgatgtacactgtactcttgttctttagtcagcatgttgatgggatttg

SEQ ID NO: 2083 - DNA, 666 bp, Trigonella foenum-graecum
ggagactaaaccccaaaacccactgtatttccatcctctttcctccaaacccttccctcttcgttctctcacccagaaaagaagatttttctgcttcaacaagaaccctcagcttgttgaaaatatggccaagcatcatcctgatttgataatgtgccgtaagcagccaggaatagccattgggcgattgtgtgaaaaatgtgacggcaagtgtgtgatatgcgactcttatgtgcgtccatgtaccctcgtccgggtctgcgatgaatgcaactacggatcatttcagggtcgatgtgttatatgtggaggagtaggaatatctgatgcttactactgcaaggagtgtacacagcaggaaaaggatagggatggttgccccaaaattgttaatttagggagtgccaagactgatttgttctatgaacgcaaaaagtatggttttaagaaaaggtgatgaagatggattcaacattttgtatttctgtcaaacttttgtactaaatgtatgttttgcatctaaattttattgtacaattgttgccaatttaagtgatcatagcatatgaatggcagtgaggaattgaaccatttgctctttgtttgaatttttatggtgaacacatggttctgcctaccaatgataatcaatcattgttcgtgttt

SEQ ID NO: 2084 - DNA, 616 bp, Trigonella foenum-graecum
ctttttgtgttttctcattctccctctaactcttccgccacaacacacatcttgtttcgaggcaaagcgacgtcgttcaacaccactcttctcagcacagcatctagcaggttgttgaaaatatggccaagcatcatcctgatttgatcatgtgccgtaagcagccaggaattgctattggacgattgtgcgagaaatgtgatggcaagtgtgtgatatgcgactcttatgtgcgtccgtgtacacttgtaagggtctgtgatgaatgtaactatggatcatttcagggtcgatgcgttatatgtggaggagtaggaatttcggacgcttactactgcaaggaatgcacacagcaggagaaagatagggatggttgccccaaaattgtcaatttagggagtgccaaaactgatttattctatgaacgcaagaagtatggttttaaaaaaagatgaagatgatggattcaacatttgtgtttgtattaaactttttactcaatgtatgctatgatcggatatcagcaccataggatgagaccttttgcatgtaaacttttattatatgggatacaatcattgtatggttagttataattatcattaaccattttctc

SEQ ID NO: 2085 - DNA, 687 bp, Valeriana officinalis
ttctccgcaggctacgttctgaacatttggcaaccaaaaccctaatccaatggctaagcatcatcctgatctgatcatgtgccgtaaacaaccaggaattgcaatcggacgcttatgcgagaaatgcgatggaaaatgcgtgatctgcgactcatatgttcgtccgtgcactcttgttcgcgtttgcgacgaatgcaattacggatcttttcagggccgttgtgttatctgtggaggagtcggaatctctgacgcgtactactgcaaagaatgtactcagcaggaaaaagatagggacggatgccctaaaatcgtcaacttgggaagcgcgaaaaccgacttgttctacgaacggaagaaatatgggttcaagaaaagatagagaagctcataatgtgacatatctctttccaagggaatccttatgtgtatggaatctatatctatataatatatatctgaattttctgacaattatcttgagaaaaaaattgattgatgatgatcatctcaactttgtattcatcaaactgaggtttcattgttgtaaggggagttggctaattttgcttcggattctttgtttttgaagatccgaaaacggttcaatgtcaacttaagggtctttagcgtatatgacaccgaaggttaaccatatttacactttcaatactaaagttcaaaagc

SEQ ID NO: 2086 - DNA, 431 bp, Vinca minor
gcatggccaagcatcatcccgatttgattatgtgccgcaagcagccaggtatagccattggtcggctttgtgaaaaatgtgatggaaagtgtgtaatatgtgattcctatgtgcgtccctgcactctagtgcgagtatgtgatgagtgcaactatgggtcgttccaaggccgctgcgtcatttgtggaggggttggaatttctgatgcctactattgtaaagagtgtacgcaacaggaaaaagatcgagatggctgtccgaaaattgtcaatcttggaagtgccaaaacagatctcttctacgagcggaagaaatatggctttaagaagagatgagggtggatgctttgtcgattattccagctactattaaagcctttagtctaaaggttctaacgtggtgcccacattcactaaggtcaactcccccaa

SEQ ID NO: 2087 - DNA, 494 bp, Vinca minor
aaggttgctattggacttcgtggcctgaaattttagagttgaaagcatggccaagcatcatcccgatttgattatgtgccgcaagcagccaggaatagccatcggtcggctttgtgaaaaatgtgatggaaagtgtgtaatatgtgattcctatgtgcgtccttgcactctagtgcgagtatgtgatgagtgcaactacgggtcattccaaggtcgctgcgtcatttgtggaggggttggaatttctgatgcctactactgtaaagagtgtacgcaacaggaaaaagatcgagacggctgtccgaaaattgtcaatctcggaagtgccaaaacagatctgttctacgagcggaaaaaatatggcttcaagaagagatgagggtagattcttcttcaattatccaagctttgtagtactgtaattgcatgcttacatctgtatttcctggccatcaggaaagggattgtatgtagaccaggtgatgataactcta

SEQ ID NO: 2088 - DNA, 857 bp, Citrullus lanatus
aaaaatgaataaaagtaagaggaaaaccctaactctttcatctgtgctctacgctacttattcttcttcttcttcacgactcctcctcctccgtttcagcagctcagcgtcgccgccgctgtcactgtcatctttctttccttcgtgccgccgccaccgtccactttctgctgttttgcaccgattttctacttcatttttactggttacaaattttactggaacttaagagactgttgcagttgcataaggcatggccaagcatcatcccgatttgattatgtgccgaaagcagccaggaattgccattggccgactttgtgagaagtgcgatgggaagtgtgtaatctgtgattcttatgtccgtccctgtacacttgttcgtgtttgtgatgaatgcaattacgggtctttccaaggtcgctgtgtgatctgtggaggagtaggaatttcagatgcctactactgcaaagagtgtacacagcaggagaaagatagagatggatgtccaaagattgttaacttaggcagtgcaaaaacagatttgttctatgaacgtaagaaatatgggttcaagaaacgatgaagcaaaaacatatatctatcttcccaggatggatcatactgtaatatgatgaatttctgatttctaatctcaaactattttagacatgtatgtatatgctgatgagtcagaatgagaacagttgttggggccaaggcaattcatgagaattgaaaactttattgattgtgttgtgtttttgagtacaactatggcaggggcaaagatttaaccatccactcttgagatggtaattggtgtttttctcattgaactatgcttggattgacaa

SEQ ID NO: 2089 - DNA, 685 bp, Acacia harpophylla
ggctctcttccctgatttgcaatccgatccatcatcgtcagccatcggtcgaagcatactagatatatctccatcggtcgacactcttctccttctcctttgcattcccggccttttatatacaacacagcatttaggaggttgttgaaaacatggccaaacaccatcctgatttgattatgtgcaggaagcagccggggattgcaattgggcgactttgcgagaaatgtgatggcaagtgtgtgatctgtgattcttatgtgcgtccttgcacgcttgtccgggtctgtgatgaatgcaactacggctcatttcaagggcgttgtgtcatatgcggaggggtagggatatcggatgcttactactgcaaggagtgtacacaacaggagaaagatagggatggatgccctaagattgtgaatttagggagcgccaaaactgatctgttttatgaacgtaaaaagtatggttttaagaaacgatgatgatgatgatgatggattcttgataggtctgctgcatcttagtactaagactgctttttgagataaatgtaatttacttggaggccagacaggaaaggggtgtataaatttatctgacgcatgatatgaattgtttgtaaccctttttgtatgcatttgacctttttgcgatgataacaacttcctgtcagtaacccttt

SEQ ID NO: 2090 - DNA, 479 bp, Antirrhinum majus
atccgatttttccccagaacaagttcgaggttaaaagtctactttctagctgaggaactatggccaagcatcatcctgatctgatcatgtgccgaaagcaaccaggaattgctattggaaggctttgtgagaaatgcgatggaaaatgtgtaatttgcgactcttacgtgcgaccctgcacacttgtccgtgtttgtgatgaatgcaattatgggtccttccaaggtcgctgtgttatctgcggaggggtgggaatttcggatgcctactattgcaaggagtgtacacagcaagaaaaggatcgggatgggtgccctaaaattgtcaatctgggaagtgcaaaaacagatctgttttatgaacggaaaaagtatggttttaagaaacgatgattcgtattggctatttgtatttggttttgaggtgaaatcatatctaaggttgttgaatttatgttgtgcttggtgacttttatgggg

SEQ ID NO: 2091 - DNA, 582 bp, Malus domestica
tctcagtcaaccgagcccaactcccgcaatcgcgccgatcccctcttacagtagcatcctctcatccgagtcctctccagctatcttcggaacatggcgaagcatcatcctgacttgattatgtgtcggaagcaacctggaatagctattggaaggttgtgtgaaaagtgcgacggtaagtgtgtaatttgtgactcttatgtgcgcccttgcacgcttgttcgggtttgcgatgagtgcaactatggatctttccagggaaggtgtgttatttgtggaggggttggaatttctgatgcttattactgcaaagagtgtactcagcaggagaaagatagagatggctgtccgaaaattgtgaatctgggaagtgccaaaacagatctgttctacgaacggaaaaagtatggtttcaagaaaagatgataattaacaggtcaagtttcgcttagcttcgggaaatcattttgttgtgttcatcattgaggcttaggcaatattacaatcaggtatttttcttaggaagcttgcttattcctgctcgtatgcttgactcttctaatttgtcgttcgatatgtttc

SEQ ID NO: 2092 - DNA, 344 bp, Aquilegia formosa
gaaaatggccaagcatcatcccgatctgattatgtgcagaaagcagccaggaattgcaattggacggttatgtgaaaagtgcgatgggaagtgtgtaatctgtgactcgtatgtgcgcccttgcacactcgtgcgagtttgtgatgaatgtaactatggctctttccagggtcgatgtgtgatctgcggaggggtgggaatatctgatgcatattactgtaaagaatgtacacagcaggaaaaagaccgagatgggtgtccaaagatcgtcaatttggggagtgcaaaaactgatctcttctatgaacgtaagaaatatggtttcaagaaaagatgaaagatat

SEQ ID NO: 2093 - DNA, 339 bp, Aquilegia formosa
aaatggccaagcatcatccagatttgattatgtgcaggaagcagcctggaattgccattggacggctctgtgagaagtgtgatggaaagtgtgtgatttgtgactcatatgtgcgtccttgcacactcgtgagggtctgtgatgaatgtaactatggatcgtttcaaggccgctgcgtcatctgtggtggagttggaatatcggatgcctattattgcaaagagtgcactcaacaggagaaagacagggacggctgtccgaaaattgtcaacttagggagtgccaaaactgatctcttttacgaacgcaaaaaatatggtttcaagaaaagatgaagga

SEQ ID NO: 2094 - DNA, 1105 bp, Aristolochia fimbriata
acttgtgttgtagtttttaacattcgagcccgagcgcgagcccacattttccggttcgagccgagctcgagcattggcatattcgggctcggctcgattcctcttctagagacagcggtgttcgctgttctccgctttgccctcgccactgccggagtctcatctgacatctctttaccttaaaaatctataaatgtgcagttggatgcgcatttcttttggtctctctggattctggaaccctagccgctcttaagtttagctttgagaatccggaaccaaagccggtgattttagatagctgctgctcggtgtcgaacgactatctgccgcctttgacgagcaatgaatcacttctgatgatataacctggaacacggatgttcgtgaggggcaagggaaatctgagtctccggcgtcgaagttgatccagacggctaacaatcaacgcattgttgcgagaggctgcgaaccgtgctgcaatagaggccaggcattaagagagaacagctccactattggttacgtatatcaaggtgttgaggtactagtgccggctaaggagctatggctaagcatcatcctgatctcatcatgtgtaggaagcagccagggattgccattggtcggctgtgcgagaaatgtgatggcaaatgtgtgatctgtgactcatatgtgagaccttgtactcttgttcgtgtctgtgacgaatgcaactatgggtctttccagggtcgatgtgttatctgtggaggggttgggatttcggatgcttactactgcaaagagtgcacacagcaagaaaaggacagagatggttgtccgaaaattgttaacttggggagtgccaaaactgatctcttttatgaacgtaaaaaatatggatttaagaaaagatgaggtttgccgatgattcaggaaccagccccccagtgggcgcgtctgctgttgttatcgtgttttctagacattggtaccgtaaagaaaaatgttttatactttcttcgtaccattactttgcttctgcacttaccatctctgatgtatgatatctgttctatgaaatctccccaaggtgatcaacttgttaaaaatatgtaggacc

SEQ ID NO: 2095 - DNA, 823 bp, Artemisia annua
atcagacacgaagcagtggtattaacgcagtactcgacgggggagacacagagaaaggtgaaaagattcgaaacaagcagcgcgtcagtctcactcatcgtcttcttcttcacaaggctcctatagtttctgggagtcgagagcctgttcagtaaaaaatggcaaagcatcatcctgatttgatcatgtgcaggaagcagcctggaattgcaattgggcggctttgtgagaagtgtgatggaaaatgtgtaatttgtgactcttatgtgcgtccatgcacacttgtgcgagtctgtgatgagtgcaactacggatctttccagggtcgctgtgtcatatgcggaggggtgggtatttctgatgcttattactgcaaagagtgcacacagcaggagaaagatagggatggctgcccgaagattgtcaatttggggagtgctaaaactgacctgttctatgaacgtaaaaagtatggatttaagaaacgttgacgatacattctcttttggcgtgacatgataattctagttcattagaattatcatctcatttatctttagaaacgcttgtatgagagtctctagctgtatttttgttgatttgtggcctgatgctatatgtggtgatggtaatactgatacatgaccccagctgctagtcatgaaagacttgttacaatttgaatcgagttagaatttgtgtatgtgatggtgtttgtattatgatgccttctggttttccacatagtggtttctgattgctcgtttgttatgctatgtttttctgtttgcacatgtatttggtaccatcttttggtccaaaa

SEQ ID NO: 2096 - DNA, 698 bp, Artemisia annua
agacgcactcaaattcaaaaactgcgccgacttcccacacactttgaaaatcgatttttgaattcgtggtacaatcttcataacactatcaaggcttatatagtttctgggaatcgagagcctgttgtgtaaatcatggcaaagcatcatcctgatttgatcatgtgccggaagcagccaggaattgccattgggcggctctgtgaaaaatgtgatggaaaatgtgtaatttgcgactcatatgtgcgtccatgcacacttgtgcgtgtttgtgatgagtgcaactatgggtcctttcaggggcgctgtgtcatatgtggaggtgtgggtatatccgatgcctattactgtaaagagtgcacacagcaggagaaagatagggatggctgcccgaagattgtcaatttgggaagtgctaaaactgacctgttctatgaacgcaaaaagtatggatttaagaaacgttgatgatacattttcttttggcatgacatgatgattctagttcattagaattactattatctcatttatccttagaattttgttgatttgtggcctaatgctatatgtggtgatggtcttaccggtgagggtcttaacgaagatttgcatcttgagagagaattgatgattgagtttgattgggaattagggattgttgtttttgtatcaagagatgatccccgtcggagtac

SEQ ID NO: 2097 - DNA, 761 bp, Persea americana
ctaaaaatcattctctctctgctaccgaaaagaaaccctgaagaaaacgtcggccctttcttttccccaccctccaagattgcaagaaatgctcttgggacgccgatctctcaactctcaaaagcttctccttatcagttaggttcaatcgtcttttagttatctgaggaactatcgttgcaagaagcatggctaagcaccaccctgatctcatcatgtgccggaagcagcctggaattgccattggccgcttgtgtgagaagtgtgatgggaaatgtgtcatttgtgactcgtatgtgaggccttgcacgctcgtccgtgtctgtgatgaatgcaactatggttcattccagggtcgctgcgttatctgtggaggcgtgggtatttctgacgcttactattgtaaagagtgcacacagcaggaaaaagacagggacggttgtcccaaaatcgtcaacttggggagtgcaaaaactgatctcttctatgagcgtaagaagtatggtttcaagaaaagatgatggatattgttctactgcagccatctatttcttatgtttactatattgggtgagttggtaatctctaccagtcgtcgatgactaaacatgagtttttatcactgttaatgtagcaatgcttttctatttgtttaagggtctggtaatgcattagttgcattgcacttttgattttgtagaacatttgcgcaagtaaattgaagtcattaatgaactggatattaaaaaaaaaaaaaaaaa

SEQ ID NO: 2098 - DNA, 626 bp, Musa acuminata
ggagagctttgcggagccgattttgctgagagtttctcctgagggtttccgccatcgaggaactttggttgattagagcatcatggccaagcaccatcctgatctcatcatgtgccggaagcagccagggatagccattgggcgcctgtgtgagaaatgtgatgggaagtgtgtcatctgtgattcatatgttcgcccatgtactctagttcgtgtctgcgatgagtgcaactatggatccttccagggaaggtgtgtaatctgtgggggagttgggatatctgatgcctactactgcaaagaatgtacgcaacaggaaaaggaccgcgatggctgccccaagattgttaatttgggaagtgccaagaccgatctcttctatgaacgtaaaaaatatggatttaagaaaagataaattgtatctgatttttacatgctcgcttgtgtggcattgattaccactgacattcaagaccttggcgaaactgttgctttcatctgttggtgctgccaaaattgatggcaggcagccttatcttcttgaattctcatagatgttgaaatgatacaaagtttaaagactaggctacatgatgatcttgtgacctaataatttgctatttgta

SEQ ID NO: 2099 - DNA, 561 bp, Musa acuminata
gggggtttcttctagggtcattgacggtcgaggaacttttggatgattaaaggatcatggccaagcatcatcctgatcttatcatgtgtcggaagcagccagggatagccatcggccgtttgtgtgagaaatgtgatgggaagtgtgtcatctgtgactcttatgttcgcccatgcacccttgtacgtgtgtgtgacgagtgcaactatggatcattccagggaaggtgtgtaatatgtggtggagttgggatatctgatgcttactattgcaaagaatgcactcagcaggaaaaagatcgtgatgggtgtcccaagattgttaatttgggaagtgccaagaccgatctcttctatgaacgtaaaaagtatggatttaagaaaagatgatccatatccaatttaaatatattagtgctgtcaaagttggtgtctgtccgtctcaacttttcctagttctcatataagtggaatgtactggaggattaaagaagaaatgcaaaattgtaaagaccacaggatcttcttgccatcacggagttgtattgaatagccttcatgc

SEQ ID NO: 2100 - DNA, 725 bp, Hordeum vulgare
tacattccgcccgcctcgtcgacgtcgtctcggggtctcggcgcgtcgcccgcgggaagccaaggagccaggagcaagcgccgccgcggcgagctcgtcattcggaaggttagcagcatccgacagccatggcgaagcatcaccccgatctcatcatgtgccggaagcagcccggcattgccatcggccgcctgtgtgagaagtgcgacggcaagtgcgtcatctgcgactcgtacgtgcgcccctgcacccttgtccgtgtctgcgacgagtgcaactacggctctttccaggggaggtgtgtcatctgcggaggggtgggcatctcggacgcctactactgcaaggagtgcacgcagcaggagaaggaccgggacgggtgccccaagatcgtgaacctggggagcgccaagacggacctcttctacgagcgcaagaagtatggtttcaagaagaggtaggcattattttgtgctgctgtggcatgctggcacttgagttgatgataccaagagcaggtttgccgaatgtattgctatggtttggtacctgattgatgggagaatacatccgtggtgatgatctgatctgtaataactgtatctgatgtatggtcttaagcgagcctagctggaccctcaactgcttgtgcagtgacatgcgccgtgactgttgctgacttggaatgtggattgagatgactggctttgtgcgccgtgtcattg

SEQ ID NO: 2101 - DNA, 635 bp, Hordeum vulgare
agcggggccaggagcacggagcgacaccgccgcagcagccagcgcttcctctcgaagcaggttagcatctgaccagccatggcgaagcatcatcctgacctcatcatgtgccgaaagcagcctggcattgctattggtcgcctgtgcgaaaagtgtgatggcaagtgcgtcatctgtgactcgtacgtgcgcccgtgtacgcttgtccgggtctgcgacgagtgcaactatggctcattccagggaaggtgcgtcatctgtggcggagttggcatctcagacgcctactactgtaaagagtgcacgcagcaggagaaggaccgagatgggtgccccaagattgtcaacctaggaagcgccaagactgatctcttctacgagcgcaagaagtatggttttaagaagagatgaatcacatacatggatttgtcgggtcacattctgtgctgttacactaataccggaagcaggttgctgaggcaacggcattgtgctcgtgttatcgtttgatccttaatatacaagaatgcgtccctgataagctctgtaatgactagttctgttgtatggttcaaaactccacactgccgatgcagtatgcacttgatatgaatgactatgaatgttttgacttg

SEQ ID NO: 2102 - DNA, 648 bp, Phaseolus coccineus
gattgccacagaacccacttgttttgtgttaccgtttaagactcactttctctcgcttttctttagttaaatttcctttagttacgtcgtcttgtggtgatctatcgtcgatttgtctagcaggttgttgaaaacatggccaaacatcatcccgatttgattatgtgtagaaagcagccagggattgccattggaagactgtgtgagaaatgtgatggcaagtgtgtgatctgtgactcttatgtgcgtccttgtacacttgtccgagtttgtgatgaatgcaactatgggtcgtttcagggtcgatgtgtcatatgcggaggagtaggaatatccgatgcctactactgcaaggaatgcacgcaacaggagaaagatagagatggttgccccaaaattgttaatttggggagtgccaaaaccgatttattttatgaacgcaaaaagtatggttttaagaaaagatgatgagggtagattactgagacgcttgtatctctttaaactttttgtacgtgttttgttcggatataagaaatcttaggatgagaccttgactttgtaaacttttatatgttaaaatgattgtttagattgctgctgaaaaagaattagacattatggaagcatcatcaacttgaactcaaa

SEQ ID NO: 2103 - DNA, 614 bp, Brachypodium distachyon
gctccgtcgctcatcttcctcgcgcgagcgccgccacccctccctccccatcccgctgccgggcgccgcagacccctgcctcgtcttcctccaccgtaggttagcatctgacagccatggctaagcatcatcctgatctcatcatgtgccggaagcagcctggcattgctattggtcgcttgtgcgagaaatgtgacggcaagtgtgtcatctgtgactcgtatgtgcgcccatgtacgcttgtccgggtctgcgatgagtgcaactatggctcattccagggaaggtgtgtcatctgtggaggagttggcatctcagatgcctactactgcaaggagtgtacacagcaggagaaggaccgagacggatgccccaagattgtgaatctaggaagcgccaagactgatctcttctacgagcgtaagaagtacggttttaagaaaagatgaaccagatggtttcgtcagggcctttcgttggcttcattgtgttctgtggcattgacaccaagagtaggttgctgaggcaacggcattgtatttgtgttacgatttgatactggtaatacgagaatgaatccctgatatgacttgtaataactagagtactctaat

SEQ ID NO: 2104 - DNA, 780 bp, Brachypodium distachyon
cagacaagttttaggtttctagtagcctctaccgggctcgggggacctttgccgagctcagcttgcctcgtcgccgtcgtcgtcgtcgtctcggggtctttcgaggagcacggagcgacacacccgccggagggagcaaatcctccctgaggttagcacttgacagccatggcgaaacatcatcctgatctcatcatgtgccggaagcagcctggcatcgcaattggtcggttgtgtgagaagtgtgatggcaagtgtgtcatttgcgactcatatgtgcgtccatgtacacttgtccgggtctgcgatgagtgcaactatggctctttccagggaagatgtgtcatttgcggtggagttggcatctcagatgcgtactactgcaaggagtgtacacagcaggagaaggaccgagatggatgtcccaagatcgtcaatctaggaagcgcaaagactgatctcttctatgagcgtaagaagtatggttttaagaagagatgaacaggatggatttgtcaggtcctttcggtctcattctgcaatgttgcactgatactaagagtaggttcctgtggcaacggcattgtatccgtgttatgatattacatccatggtatgctctgtgataactgtttctatcatgtgatctaaaattctcaagagtctagactgtttatgcagtatgcagttgatgtgattgactgagtctgttgactcgaaatttgaactgagatggccttttctatgatatttaaatgcatggactgttttaacggcctg

SEQ ID NO: 2105 - DNA, 855 bp, Theobroma cacao
ttcacgttaagaaaaattaaaatttcatgttaattttgtcaaatttaacaagtgaacggccccacaaaagcccaactgctttgaaacaaacgtccatgatgttatctagacttttccacaacattctaaagcaaatacggcccgagttaaagccgaaatacttttaaatgggccaaacctaaagcccaactgacttaccccattgaccctatcttctcttccaaatctcagccctttctctttctctttctcttcttcttcgctgcgtcgagactccggcaaatcacgatagcagctttgctaggccccctcagttactagaacaacttagaaacgagttgcggcagtcatggccaagcaccatcccgatttgatcatgtgccggaagcagcctggtattgcaataggacggctgtgtgagaaatgtgatggcaagtgtgtaatctgtgactcctacgtgcgtccttgcacccttgtgcgggtgtgtgatgaatgcaactatggctcgttccagggtaggtgtgttatctgtggaggagtgggaatatctgatgcatattactgtaaggagtgtacacagcaagagaaagatcgggatggttgtccgaaaattgttaatctggggagtgccaaaactgacttattctatgaacgtaaaaaatatggttttaagaaaagatgattgctggatgattttatctgtagtgtgattttcttttttctatggttatgtagttgaggaatgagggattttaaaatgtcggaattatagttaaggctttaggttttgagattgttgtctgttaaagattttatcttcaagaactccaatataagtgtaccagaggcctgatc

SEQ ID NO: 2106 - DNA, 345 bp, Manihot esculenta
catggccaagcatcatcctgatttaattatgtgccgaaagcagccaggaattgccattggacgactttgtgagaaatgtgatgggaaatgtgtaatatgtgactcgtatgtgcgtccttgcacacttgtgcgtgtttgtgacgaatgcaattatggatccttccaaggtaggtgtgttatttgtggaggagtgggtatttcggatgcctactattgcaaagagtgcacgcagcaagagaaagatagggatgggtgcccaaaaattgttaatttagggagtgccaaaacagatctgttctacgaacgcaagaaatatggatttaagaaaagatgatgaggctatgg

SEQ ID NO: 2107 - DNA, 761 bp, Manihot esculenta
atgaatgaaaaataagaaagaaagaaagaagcgaaagaagcaacgacaggaatcagagaactcagtggtgaggaagctaatacagaatggcaaaacatcatcctgatttaatcatgtgcaggaagcaaccagggattgctattggacggctatgtgagaagtgtgatggtaagtgtgtaatatgtgattcttatgtgcgtccatgcacccttgtccgggtctgcgatgagtgcaactatggatccttccaaggtcggtgtgttatatgtggaggagtgggtatttctgatgcatattactgtaaagagtgtactcaacaggagaaggacagagatgggtgtccgaaaattgtcaatttgggaagtgcaaaaacagatctattttatgaaaggaagaagtatggtttcaagaagagatgaaatcaggggcagccatgttgctgcatgggaattatcttgtttttgttgatttgacttttattatgagcaagtcatccacaattccaagaatcctcatccaggcacataatccttatacagcattatgacttaacaatctacatattcagagatccagcaaaagaactactaactggaaactcttggtttagtgcattgttcagatggataactggcattgtgtttatttgtagcgcacaagtgcaatatctgtagaatgttgcaattgtaactgatttgaattaatggatttcttaatttcatgctcactgaagctacctttggattgctgcgcacgctctt

SEQ ID NO: 2108 - DNA, 760 bp, Ricinus communis
atgaatgaaaaataagaaagaaagaaagaagcgaaagaagcaacgacaggaatcagagaactcaaagtgcagaaggtaatacagaatggcaaagcatcatcctgatttgatcatgtgcaggaagcaaccgggaattgctattggacggctatgtgaaaagtgtgatggtaagtgtgtgatttgcgactcatatgtgcgtccttgcacgcttgtgcgggtttgcgacgaatgtaactatggatccttccaaggtcggtgtgttatctgtggaggagttggcatttctgatgcatattactgcaaggagtgtactcaacaggagaaagaccgagatgggtgtccaaaaattgtcaatttgggaagtgcaaaaacagatctattttatgaaaggaagaagtatggctttaagaagagatgaaatcaggggcagccatgttgctgcatgggaattatcttgtttttgttgatttgacttttattatgagcaagtcatccacaattccaagaatcctcatccaggcacataatccttatacagcattatgacttaacaatctacatattcagagatccagcaaaagaactactaactggaaactcttggtttagtgcattgttcagatggataactggcattgtgtttatttgtagcgcacaagtgcaatatctgtagaatgttgcaattgtaactgatttgaattaatggatttcttaatttcatgctcactgaagctacctttggattgctgcgcacgctctt

SEQ ID NO: 2109 - DNA, 820 bp, Ricinus communis
agtaattgcatatgaagaaaaaacttttacaggaaccccttcttcgcaaaagttcaagtcatgaatgaaaaataagaaagaaagaaagaagcgaaagaagcaacgacaggaatcagagaactcaaagtgcagaaggtaatacagaatggcaaagcatcatcctgatttgatcatgtgcaggaagcaaccgggaattgctattggacggctatgtgaaaagtgtgatggtaagtgtgtgatttgcgactcatatgtgcgtccttgcacgcttgtgcgggtttgcgacgaatgtaactatggatccttccaaggtcggtgtgttatctgtggaggagttggcatttctgatgcatattactgcaaggagtgtactcaacaggagaaagaccgagatgggtgtccaaaaattgtcaatttgggaagtgcaaaaacagatctattttatgaaaggaagaagtatggctttaagaagagatgaaatcaggggcagccatgttgctgcatgggaattatcttgtttttgttgatttgacttttattatgagcaagtcatccacaattccaagaatcctcatccaggcacataatccttatacagcattatgacttaacaatctacatattcagagatccagcaaaagaactactaactggaaactcttggtttagtgcattgttcagatggataactggcattgtgtttatttgtagcgcacaagtgcaatatctgtagaatgttgcaattgtaactgatttgaattaatggatttcttaatttcatgctcactgaagctacctttggattgctgcgcacgctctt

SEQ ID NO: 2110 - DNA, 602 bp, Catharanthus roseus
actagtggatccaaagaattcggcacgaggccagccacggcgctgaggaagagggaaaccctagcttgagttaaatttgaaatcttcttctcattgttcagaaggttgctatttaacccaaggcctagaattttgctgtcaaaagaatggctaagcatcatccggatttgattatgtgccggaaacagccaggcatagccatcggtcggctgtgtgaaaaatgtgatggaaagtgtgtaatatgcgattcctatgtgcgtccttgcacactggtacgagtatgtgatgaatgtaattatgggtctttccaaggtcgttgtgtcatttgcggaggagttgggatttctgatgcttactattgtaaagagtgtacgcaacaggagaaggatcgagatggttgtccaaaaattgttaatcttggaagtgccaaaacagatctcttctatgagcgtaaaaaatatgggtttaagaagagatgagggggatgctgattcaggtattccctcctttgtagtactgtaattatgagttcactttctgtatgtccaggttgtgtctggaaactgatgatgatttgatcatagttagtattttacctttgt

SEQ ID NO: 2111 - DNA, 672 bp, Centaurea maculosa
cgcgggggctcaacatcttctagtctttttctgctgctggcttattcattcgcccccaaatactttcactcttttatcaggctgttatagtttgaaggagttgagagcctgttgaggaaatcatggccaagcatcatcctgatttgatcatgtgcaggaagcagccaggcatcgccattggccggctttgtgaaaaatgcgatggcaaatgcgtaatttgcgactcttacgtgcgtccatgtacacttgtgcgtgtgtgcgatgagtgcaactacgggtcctttcagggtcggtgtgtgatatgtggaggtgtgggtatttctgatgcttattactgcaaggagtgcacgcagcaggagaaagatagagatgggtgcccgaagatcgtcaatttggggagtgctaaaacggatctcttctatgaacgtaaaaaatatggatttaagaaacgatagttggtacagtttactctgaatgactgtatttgagatggtattaaggcttaagagatgatgtagaactccttgaccatttgaacttgattgagaatttgtgtatttgatggtggcagtatgttctatgcttgacttataaggcttgaggtctaatcttaccgctatgctattttgaaccttgctctttacgtaagtatttggtgatgttttgttggcc

SEQ ID NO: 2112 - DNA, 622 bp, Centaurea maculosa
cgtcattttcttcgtgttcaattgttcatctcagtcttcattcaggttggtggtaatctaaaacaatggctaagcatcatcccgatctgatcatgtgccgaaagcagcccggaattgcgatcggaaggctttgtgaaaagtgcgatggaaaatgcgttatctgcgactcttatgtccgtccatgtacgcttgttcgggtctgcgacgagtgcaactacggatctttccagggtcggtgtgttatatgtggaggtgtcgggatttccgacgcctactattgcaaagagtgcacacagcaggagaaagatagggatggttgcccgaaaatcgtgaatttaggaagcgcgaaaacggatctgttttacgaacgtaagaaatacgggtttaagaaaagatgatttatatatgtgttgattatgctacatacttattatttgtatgtgattgattggctttggggtcatagatattcaactttggtaagaactttgtgtattagaatagaggggtgtggtgatctaagtgtcatgttataatgagtacttcttggtttactacttgttactattcatatgttactaaacaatgcagcatatcccaattggaggtgggatatttatgt

SEQ ID NO: 2113 - DNA, 719 bp, Castanea mollissima
tacacggtagagcctccgagaaacttcgcagggcatggatttccagtggctcaggagaagggcctgagcttgaaatcaaagccagattcatgagcattgagtggagtgggaagtttggatggccaaaacattttcagcttccatgaactaagaatttgtttctgaaagcatggccaagcatcatccagatttgattatgtgccgaaagcagccaggaattgctattgggcgactttgtgagaaatgtgatgggaagtgtgtgatctgtgattcctatgtccgcccttgcacacttgttcgagtttgtgatgaatgcaactatggttccttccagggtcggtgtgtaatctgtggaggagtgggaatttctgatgcctactactgcaaagagtgcacgcaacaggagaaagatagggatggatgtccaaaaattgttaatttagggagtgccaaaacagacctattctatgaacgtaagaagtatggttttaagaaaagatgaagagcgttggatagacgtgtctggaactttcgaactgctttaatttagtgtgagactacgaatcttgacatctatgcgtgcttttagaatgcttttatgtactaaaatattgatgaagatgacataatagtttttgaaatgctggatatatagttaaaaacttaaaaagtcgtggagagtttgttttcttacccattaaccaaaaaaacaaaaaaaa

SEQ ID NO: 2114 - DNA, 528 bp, Cichorium intybus
gggccgtctgacatcttgtaacctctcttctgccggctttttatcttcccaaaatttgcgtcccggcttctcaagcttcataaggaattgagacccttttgaagaaaccatggcgaaacatcatcccgatttaatcatgtgcagaaagcagccaggaattgccattgggcggctttgtgaaaaatgtgatggcaaatgtgtaatttgcgactcttacgtgcgtccatgtacacttgtacgtgtttgtgatgaatgcaactacgggtcctttcagggtcgttgtgtgatatgtggaggtgttggtatttctgatgcttattattgcaaagagtgcacgcaacaagagaaagatagggatgggtgccctaagattgtcaatttggggagtgcgaaaaccgatctgttctatgaacgtaaaaaatacggatttaagaaacgttgattgtggttgaagatgttattgggttgttgaatgttttgatgattttatgagttggaatatgtgcatttgatgctttttgttgaaaa

SEQ ID NO: 2115 - DNA, 950 bp, Citrus sinensis
cccaggaaaattttggggaaggtgaagagaagaagagcaatttttttggattctttttatattttttaggcagccagctaactatttacaaaaaccctctttttgttgattcgaagcaatctcaacattttcttctccaagcaagcggacgttagcatctggacttcgagtcttctgtgcaggtcctaagaacttataggagctaccagctttttgtcgtagaaaccatggccaagcatcatcctgatttgatcatgtgcaggaagcaaccagggatagccattggaaggctctgcgagaaatgtgatgggaagtgtgtgatttgtgattcctatgtgcgtccttgcacccttgtgcgagtctgtgatgaatgcaattatggttcctttcagggtcgatgtgtcatctgtggaggggtgggaatctctgatgcatactactgcaaagagtgcacacagcaagagaaggacagggatggttgtccaaaaattgtcaatttgggcagtgcgaaaacggacctgttttacgaacgtaagaaatatggttttaagaaaagatgatgatagcccgctaattgtttttgtagcaagagcattttatctaccattatatacaattcttgacgatgatggattttgaggtgtttgaagttggaactaagatgtgttgcatctgtaaccacgagtcattagagtgacttattatcttaacctctattcattactgaagcacctgcttatattctaatgggttcggattgtatttgaacatatctgtaatggaaacttctgcttaagtaacctcatttgtttctattaggacttggttttcagtttaataagcatgagtgatctcagtagtggatcagttgatggttatgtgtactttgtttggccacggtcaatcttattttgctattaaggaaatttgatgacttaatttcaaaaccc

SEQ ID NO: 2116 - DNA, 686 bp, Gossypium hirsutum
ccaatttcatttatacgttttcaaatccacacagatcctcatctttctctctgcttcgagactctccggaacatcaccaaagccgactttcagaccttggaacaactaggaacaagtttgggcagtcatggctaagcaccatcctgatttgatcatgtgccggaaacagccggggattgcaataggacgattatgtgagaagtgtgatggcaagtgtgtaatctgtgactcttatgtccgcccttgcacgcttgtgcgagtttgcgatgaatgcaactatgggtcgtttcaaggtaggtgtgttatctgtggaggggtggggatatccgatgcatattactgtaaggagtgtactcagcaagagaaagatcgcgatggttgtccaaaaattgttaatctcgggagtgctaaaacagacttattctatgaacgtaaaaaatatggttttaagaaaagatgattgatgtttacctgctgtgattaggtcttgctgtgcttatgtcacagggaatgccggattttagaatatgttggtatcacagagagacttaagctctttagaattatgttattttaagaactgtagttgattgtactaggggcctaatttatttacacagaatctggtatggaaatatctggttgcattgtttatggagttctattgctgatttacacttattgat

SEQ ID NO: 2117 - DNA, 709 bp, Gossypium hirsutum
gtatcaacgcagagtacatggggactgaatctgcttctcgacttctctggattgtccctcttttctcccttcacattgggaacgagtttgggtagccatggcaaagcaccatcctgatttgatcatgtgccggaaacagccggggattgcaataggacgattatgtgagaagtgtgatggcaagtgtgtaatctgtgactcttatgtccgtccttgcacgctcgtgcgagtttgcgatgaatgcaactatgggtcgtttcaaggtaggtgtgttatctgtggaggggtggggatatccgatgcatattactgtaaggagtgtactcagcaagagaaagatcgcgatggttgtccaaaaattgttaatctcgggagtgctaaaacggacttattctatgaacgtaaaaaatatggttttaagaaaagatgattgatgtttacctgttgtgattaggtcttgctggtgctaatgttgcagggatgtcggattttagaatatgttggtaccacagagagacattaggtctttagaattatgttattttaagaactatagttgattgtaccaggggcctaatttatttccacagaatctggtatggaaatatctggttgcattctatatgaagttctattgctgatttacacttattgatttgtagtttatcctatgtatgtacatgtgtggtttgtgggtgagcttttgcta

SEQ ID NO: 2118 - DNA, 638 bp, Vigna unguiculata
ggatacattgtaacagaagactgcctgttctgtgttcaagcaaaattacactcacttcctctcgctcagaaaccctaatagcctgttctggtgatttatcgtcgatctgtctagcaggttgttgaaaacatggcgaagcatcatcctgatttgattatgtgtcgaaagcagccagggattgccattggacgactgtgtgagaaatgtgatggcaagtgtgtgatctgtgattcttacgtgcgtccttgtacactagtccgcgtttgtgatgaatgcaactatgggtcgtttcagggtcgatgtgtcatatgcggaggagtaggaatatctgatgcctactactgcaaggaatgcacgcaacaggagaaagatagagatggttgccccaaaattgttaatttagggagtgccaaaactgatttattttatgaacgcaaaaagtatggttttaagaagagatgataatggtagtttacttagatgcttgtatctcttaaaactttttgtacgtgtcttgttcggatataagaattagaggatgtgaccttgagtttgtaaacttttatatcttaagatgcttgtttagattgctgctgataaaagaattatgatcatccacttgaactaccacaagatca

SEQ ID NO: 2119 - DNA, 707 bp, Cucumis sativus
cttcttcttcttcacgacgtctcctcctccgtttcagcagctcaccctcgccaccgctgtcgccattgtctttcttcacttcgtgccgccggagcatccacgtagccgtttttcactgattttctcatccactagtcctggttacaagttttactggaactttatagattgttgtggttgcataagcgatggccaagcatcatcctgatttgatcatgtgcagaaagcagccaggaattgcaattggccgcctatgtgagaagtgcgatgggaagtgtgtaatctgtgattcttatgtccgcccctgtacacttgttcgagtttgtgacgaatgcaattacgggtctttccaaggccgttgtgtgatctgtggaggagtaggaatttcagatgcttactactgcaaagagtgtacacagcaggagaaagatagagatggatgcccaaagattgttaatttaggcagtgcaaaaacagatttgttctatgaacgtaagaaatatgggttcaagaaacgatgaagccaaaacacatgtagttatcttcctaagatggatcttactgtaatatgatgaatttctgatatctaatctcaaaactctcgtagacgtgtatgtatatgctgatgagtcagagtgagaacagttgttggggccaaggcaattcataagaattaaaactttgttgcttgtattgtggttttgagt

SEQ ID NO: 2120 - DNA, 619 bp, Cynara scolymus
  misc_feature (182)..(182): n is a, c, g, or t
  misc_feature (615)..(615): n is a, c, g, or t
tcaggtttctttttggcctctcagtcttcattcaggttgtggtaatttaaacaatggcgaagcatcatcctgatctgataatgtgccgaaagcagccaggaattgcgatcggaaggctttgtgaaaaatgtgacggaaagtgtgttatctgcgactcttatgtgcggccatgtacgcttgtncgggtctgcgatgaatgcaactatggctccttccagggtcggtgtgttatatgtggaggtgtcggtatttccgatgcctattattgcaaagagtgcacacagcaggagaaagatcgagacggatgcccgaaaattgtgaacttaggaagcgcgaaaacagatctgttttacgaacgcaaaaaatacgggtttaagaaaagatgatggaatttgtgttgattctactacataccttaaacaactatgagtaggaagttgtgtatttgtgttttgttgattatttagggtcatacttgttggttttattacttgttactatcaatatattgtaacggcataacaaaactagacgatcgcttatatcctatctggaggtgggctgtatgtaaatctgacctttattttaagttaaataaaatgattatgattgttnctgc

SEQ ID NO: 2121 - DNA, 535 bp, Cynodon dactylon
ttaacactatggcaaagcatcatcctgatctcattatgtgccggaagcagcctggcattgctatcggtcggctgtgtgagaaatgcgatgggaagtgcgtcatctgtgactcatatgtgcgcccgtgtacgcttgtccgtgtgtgtgatgagtgcaactatggttcattccagggaaggtgtgttatctgcggaggtgttggcatctcagacgcctactactgcaaggagtgtacgcagcaggagaaagatcgagatggatgtcccaagattgtcaaccttggaagtgccaagactgatctcttttacgagcgtaagaaatatggttttaagaagagataattggggcgatggtttgtcaggctcttttggcctcatgtaacgttctgttatgctggtgcctattgagacaggtgcattgcaagcatgctatgatttgatactaatatgaggatacctgatactctctgtagtctgtaataactaaacattcccgccatttataccctgtaataactaatcatgttttgtgatcg

SEQ ID NO: 2122 - DNA, 517 bp, Taraxacum officinale
cggcggggatcgagttctcctcccattcgcttctacaccctaaattgggtttcttcgtggccatctcaggcttcaacagattctggtgaactagttgtcctcaataatggcgaaacatcatcctgatttgattatgtgccgaaagcaaccaggaatcgcaatcggaaggctctgcgaaaaatgcgatggaaagtgcgtcatctgtgattcttacgtgcgtccgtgcacactcgtacgcgtctgcgatgagtgcaactatggttcatttcaaggtcgctgtgtgatatgtggaggtgtagggatttccgatgcgtattattgcaaagagtgcacacagcaggaaaaagatcgagatggctgcccaaagattgtgaatttaggtagtgcgaaaacagatctgttctatgaacggaagaaatacgggtttaagaaaagatgattttgaaaacttatttgtgtgattgtaaacgttaacatgtagccatttgagttttgtgtattggattttaactgctgg

SEQ ID NO: 2123 - DNA, 655 bp, Taraxacum officinale
catcgcagctcgctggaggatcacttttcagtttcagccgttgcagtatcatgtgaccttccttctacgcctctctgaacccccaaacttttacgtcccggatttctgagcttctatcaggctataatagttaccgggagttatcatggcgaagcatcatcctgatttgataatgtgcagaaaacagccaggaattgcaattgggcgactgtgtgaaaaatgtgatggcaaatgcgtaatttgtgactcatatgtccgtccatgtacacttgtacgtgtatgtgatgaatgcaactacgggtcctttcagggccgatgtgtcatatgtggaggtgttggtatttcggatgcttattactgcaaagagtgtacacaacaggagaaagatcgggacgggtgcccgaagattgtgaatttgggcagtgctaaaactgacctgttttatgaacgtaaaaaatacggatttaagaaacgatgattgtgattgaagatgttgccaagtcatgaaatactttgatgattttaagcaaaagttggaatttgtgtatttgatggtggtggtacattttttatgctttttgttttttgtatggtgttgtttaattgcttggtttgctaaagcttatttttcttattgcaaaaaaaaaaaaaaaaa

SEQ ID NO: 2124 - DNA, 602 bp, Eschscholzia californica
catcctctttctctctcgacaacgccgcgcctccaccattgacggacctctgaccacgtacgcagtgtttgtgaccaaagtctgaggaagcagcaaagcaagcatggccaagcatcacccagatctgattatgtgcaggaagcagccagggatcgccatcggtcgactatgtgagaaatgtgacgggaagtgtgtaatttgtgactcatatgttcgtccttgcactctcgttcgagtctgtgacgaatgcaactatggatcattccaaggtcgatgtgtgatctgtggaggtgtgggaatatctgatgcttattactgcaaagaatgcactcagcaggagaaagaccgtgatggatgcccgaagatcgttaacttaggaagtgcaaaaactgacctcttctatgaacgcaagaaatatgggtttaagaaacgataaagaatgatgtatgattatttgttcgtatacttgtgggtgctgaaatttgatcagaaaacttttccgtggataagaattgggaagtgatgatacgaggcatttcagtaaatgaaatagttcttaccactttctaggctgacttttggtattggtgcgcattatttca

SEQ ID NO: 2125 - DNA, 767 bp, Linum usitatissimum
ccacgcgtccgcgattccggcatctccctcgagctctctgcaaatttcgctgctgcccgcaaaaaacgaggagaagcaagtgcgcgagtgaacttgagcttcgaacagtctttccctttgaattgggcaagtctgtcgtatcagacagccataatcagccatggcaaagcatcatcctgatttgatcatgtgcagaaagcaaccggggatagccattggaagactctgcgagaagtgtgacggtaaatgtgtaatctgcgactcctatgtccgtccttgcacgctggtgcgagtctgcgacgagtgcaactacggttccttccagggtcgctgtgttatctgcggaggagtgggtatatctgatgcatactactgcaaggagtgcacgcagcaggagaaagatcgggatggctgtccgaagatcgtgaatttaggcagcgcgaagacagacttgttctacgaacggaagaaatacggttttaagaaacgatgatgatcatcgaggaggaatatttattttacttttgtattggttgaccttgcttatgatgtaatgttgtgccgagtatctgtagttttgatccgacacttgttggccccaaaactaacgattttatcaagtcagagaactatcgtgacacttgaatggattctacagtatatctgcttcagtgattgcttctctttgtatataggactgctagtgaatctatatgggtacgtagtcgaacagacaattatcgtcctaccgaaaaaaaaaaaaagag

SEQ ID NO: 2126 - DNA, 789 bp, Setaria italica
gtggcatctataagcttctagcagcatcggccgccgccgggaaggcccaaatatatctcgccgctgccgcaagccctagccgccgtccgccgccttcctcgtcgccgtcgtctcgagctctcggcccgctgccttcgaggaacgcggagcgccaccgcacaggacacatcccctacccccaggaggttagcatccgacagcaatggcgaagcatcatcctgatctcatcatgtgccggaagcagcctggcattgcgatcggtcgcctctgtgagaaatgcgatggcaagtgtgtcatttgcgactcatacgtgcgtccatgcacgctggtccgggtgtgcgacgagtgcaactatggctcattccagggaaggtgtgtgatctgtggaggagtcggcatctcagacgcctactactgcaaggagtgtacccagcaggagaaggaccgggatggttgtccgaagattgtcaatcttggaagcgcaaagactgatctcttctatgagcgcaagaagtatggttttaagaagagatgatcgagcagagggagttgctgggttctactggctgcgtgtttgtgttctgtcgcactgatgctgagagtaggttgcctgaggcagcagctttgtatttgtgtttatgatttgatattgatgtgaggatacacccccctgatatgctttgtaataagtagttcaactgtatggtgtaatactctagaagctggattatgcaatttatgtggtacggtgatggccacggttggtcttaaaattctggaacacacgac

SEQ ID NO: 2127 - DNA, 800 bp, Setaria italica
gtggcatctataagcttctagcagcatcggccgccgccgggaaggtccaaatatatctcgccgctgccgcaagccctagccgccgtccgccgccttcctcgtcgccgtcgtctcgagctctcggcccgctgccttcgaggaacgcggagcgccaccgcacaggacacatcccctacccccaggaggttagcatccgacagcaatggcgaagcatcatcctgatctcatcatgtgccggaagcagcccggcattgcgatcggtcgcctctgtgagaaatgcgatggcaagtgtgtcatctgcgactcatacgtgcgtccatgcacgcttgtccgggtgtgcgacgagtgcaactatggctcattccagggaaggtgtgtgatctgtggaggagtcggcatctcagacgcctactactgcaaggagtgtacccagcaggagaaggaccgggatggttgtccgaagattgtcaatcttggaagcgcaaagactgatctcttttatgagcgcaagaagtatggttttaagaagagatgatcgagcagagggagttgctgggttctactggctgcgtgtttgtgttctgtcgcactgatgctgagagcaggttgcctgaggcagcagctttgtatttgtgtttatgatttgatattgatgtgaggatacacccccctgatatgctttgtaataagtagttcaactgtatggtgtaatactctagaagctggattatgcaatttatgtggtacggtgatggccacggttggtcttaaaaattctggaacacacgaccatttctagc

SEQ ID NO: 2128 - DNA, 883 bp, Vitis vinifera
gcgtcagcattattcagattgagtacgctccacacccggtgcacgttagtagcttccgaccgctcgaccgacacccgctcaggtcacagggacattcaagggctgagagcttgttgtagaaagcatggccaagcatcatcccgatttgattatgtgccgaaagcagccaggaattgcaattggacggctttgtgaaaagtgtgatgggaagtgtgtgatctgtgattcctatgtgcgtccttgcacacttgtgcgagtttgcgatgaatgcaactatggatcctttcagggtcgatgtgtcatctgtggaggagttggaatctcagatgcctactactgcaaagagtgtacacaacaagagaaggatagggatgggtgtccgaaaattgtcaatttagggagtgccaaaacagacctgttctacgaacggaagaaatatggttttaagaaacgatgagattgacattgggtaattttcttgctacgtgttctctctgtgccctcatattctatagactgagatgatgcattttaaggtgttgaaacaaagttttggggcttcattttgtattcgtaggactttgccagtttctgagaattgtagctggagggtactaatcatcgtaaaccctatcaatcatggcctataatgaattgattgaactataagtgtggattctgtagtttttctcttacctactctatttttactacatcttggtttcctacactccagatttcaattttttactgtagagattttctctctcattcataattaggtttcttatgcgggctcatgatcaaccctttccattgtattgactcagtatgcggagattggttttttcaacacttttttaagtagttgggaatattattt

SEQ ID NO: 2129 - DNA, 746 bp, Ipomoea nil
gtcgtgaaagttctagcttcatcgcaaaaccactcgccggtttcatatacgcggctacctgtccccaatctcgacttgtttctttggaccggatcctcaacagctgctacgattttgaggttttacatcagcttgggtataaaacggtcttgctggaagtatggccaagcaccatcctgatctgatcatgtgcaggaagcagccaggaatagccattggacggctttgtgagaaatgtgatgggaaatgtgtcatttgtgattcttacgttcggccttgtacacttgttcgtgtgtgcgatgaatgcaactatggttcttttcagggtcgctgtgtcatctgtggaggggttgggatttctgatgcttactactgtaaggagtgtactcagcaggagaaagatcgtgatggttgtcctaaaattgtcaatcttggaagtgccaaaactgatctcttctacgagcgtaaaaaatatggtttcaagaaaagatgattgctgctccaaagaaataatgccaaattgcaatttcattcagtgtttaccattctcttgtcatgtagtttgtactcttaattttaatgtggtagacatccaagaaagaaagttagtgatgtgtttagccaacctttggtttactatgatctttttttctgtcagtaccgagtgggtgtcctatcgtggttttgcaacacgaactagaaacactggcctgaattgtcttgttggttgtaattcttaaacaatt

SEQ ID NO: 2130 - DNA, 652 bp, Lactuca sativa
gcatcgactcgttgacgttgtgcatctttctggtgggtttcttcgtgggtgtatcagttgtcatcaggttgtggtaagttaaaaaaagttgtaagggaaaggaaagaatggcgaagcatcatcctgatttgatcatgtgcagaaagcagccaggaattgcaattggaaggctatgtgaaaaatgtgatggaaagtgtgtgatatgtgattcttatgtgcgtccttgcacacttgtacgtgtgtgtgatgagtgcaactatggttcctttcagggtcgttgtgttatatgtggaggtgtaggcatttctgatgcatactattgcaaagagtgcacacaacaggagaaagatcgagatgggtgcccaaaaattgtgaatttaggtagtgcaaaaacagatctgttttatgaacgaaaaaaatatgggtttaagaaaagatgatctacaaattgcctatgtaatatcatttgcttgtaaaaccttaacatataaccatttaggcatttaagtatttggtcttgtttgtgtattagatgttatacattcgatagttggttattatcctctttgaataacttgtttgtgtattatatgtatttgcaagactttattatctttgacatgccatctgtaggccatgttttttaagcata

SEQ ID NO: 2131 - DNA, 744 bp, Lactuca sativa
gctactgcagcatcccgtctgacatcttgcacctttcttcatcgggttttaaatccccaaaatcttgcgtcccaccttttcaagcatcatcaggcagaagtagttgtaatggcaaagcatcatccggatttgatcatgtgcaggaagcagcctggaattgccatcgggcggctttgtgaaaaatgcgatggcaaatgcgtaatttgtgactcgtatgtgcgtccatgtacacttgtacgtgtatgtgatgaatgcaactatggatccttccagggtagatgtgtcatttgtggaggtgttggtatctctgatgcttattattgcaaagaatgcacgcaacaagaaaaagatcgggatggctgcccgaagattgtcaatttgggcagtgctaaaactgacctgttctatgaacgtaaaaaatacggatttaaaaaacgatgattgtgattgaagaatgaagaatgaataatgaagaatgaagaagatgttgatgagtcgtgaaatgttttggtgattttaaacttggttagaatatgtgtattttgatggtgatgtgttctctaattgattacctactatgttatatttttaactcgtctggttgtattgtgtttgatgtgtattggattgacaccaagagagaaagagaagtctggttatccacaatgcaacaagttggattgtgtttggtgggctttagactgatattggaattgatggatcgatgcttgtactttgtttgaa

SEQ ID NO: 2132 - DNA, 612 bp, Glycyrrhiza uralensis
gcttccacttctctctctttcgctcaacactcttgttctgagttctggagaagcaacaccgtttaacactcctctactcagcatagcatcgagcaggttgaagaaaatatggccaagcatcatccagatttgatcatgtgccgtaagcagccaggaattgccattggacgattgtgtgagaaatgcgacggcaagtgtgtgatatgtgactcttatgtgcgtccatgtacacttgtcagggtctgtgatgagtgcaattacggatcatttcagggtcgatgtgtcatatgtggaggagtagggatatctgatgcgtactactgcaaggaatgcacacagcaggagaaagacagggatggttgccccaaaattgttaatttagggagtgccaaaaccgatttattctatgagcgcaaaaagtatggttttaagaaaagatgaggatggtggattcaacatacatttgtatttctattaagcattttactcaatgtgtgctttgctcggatatcagaaccataggatatgtatgagaccttgttcatgtaatcttctaccatctgatacaatttttgaagattttagtgcatgaatagttaactatcgatcata

SEQ ID NO: 2133 - DNA, 362 bp, Lotus japonicus
gttgtttaaaatatggccaagcatcatcctgatttgattatgtgtcggaagcaacctggcatcgccattggacgattgtgtgaaaaatgcgatggcaagtgtgtgatatgcgactcatatgtgcgtccttgtacactagtccgggtttgtgatgagtgcaactatggatcatttcaaggtcgatgtgtgatatgtggaggagtaggaatatctgatgcttactactgcaaggagtgcacacaacaagagaaagacagggatggttgccccaaaattgtcaatttagggagtgccaaaactgatttattctatgaacgcaaaaagtatggttttaagaaaagatgattagggaagattactaa

SEQ ID NO: 2134 - DNA, 756 bp, Lotus japonicus
ggtcccaacggcaccactctgcaacgctctttgttcacaagtgtgtggacaccatcgagctcttctccatctctggctagtttcgaagcatcgttttctggttgtttaaaatatggccaagcatcatcctgatttgattatgtgccggaagcaacctggaatcgccattggacgattgtgtgaaaaatgtgatggcaagtgtgtgatctgtgattcatatgtgcgtccttgtacacttgtccgagtttgcgatgaatgcaactacggatcatttcagggtcgatgcgtcatttgtggaggagtaggaatatctgatgcctactactgcaaggaatgcacacaacaggagaaagacagggatggttgccccaaaattgttaatttagggagtgccaaaactgatttattctacgaacgcaaaaagtatggttttaagaaaagatgatgaggtcagattacggagacatttgtacctctgaaacttttttcccttttggtgttttgctccgtatcgaaagctcagcatatgagacatagtgcatgaaaacttttatcttgtacaatgtttaagtgattggcgagttaactaatgatcataagagttagtcttgtgctatcaacatgaacagtgacaagactatgatatgttcagttagcagctgtcttcagcttgaggtttaacgtaatttgtgcttgtatttatatcacctttatattgctgattttgaaattcctgttatcctgataaactgttac

SEQ ID NO: 2135 - DNA, 704 bp, Medicago truncatula
aagacagtggtatacaacgcagagtggccattacggccggggccctctttcactttccctacagacacacacccttgttccaaggcaaagcgacgccgtttaacaccactctactctgcacagcatctagcaggttgttgaaaatatggccaagcatcatcctgatttgatcatgtgccgcaagcagccaggaattgctattggacgattatgcgagaaatgtgatggcaagtgtgtgatatgcgactcgtatgtgcgtccatgtacacttgtaagggtctgtgatgagtgcaactatggatcatttcagggtcgatgcgtcatatgtggaggagtaggaatatccgatgcatactactgcaaggaatgcacacagcaggagaaagacagggatggttgccccaaaattgtcaatttagggagtgccaaaactgatttattctatgaacgaaagaagtatggttttaagaaaagatgaagatgatgggttcaacatttatgtttctattaaactttttactcaatgtatgccctgtttctattgaactttttactcaatgtatgccatgatttgatattaacaccatttgcatgtaaacttttatatcggatacaatcattgtatgttttagttatatcttgggtgtttaagatcataacatacaaattacgaaattgataagtagatttttttttttggttac

SEQ ID NO: 2136 - DNA, 791 bp, Cucumis melo
aaaaatgaataaaatgtaagagaaaaaccctaaactctttcatctgtgctcaaagcccacttcttcttcttcctcttcttcttcttcttcaggacgtctcctcctccttttcagcagctcagcctcgcctccgcggtcgccgtctactttcttctgttcgtgccgccggagcctcccctagcggttttttactgattttctcacccattattactggttacaaattttactgggacttgatagattgttgcggttgcataagccatggccaagcatcatcctgatttgataatgtgcagaaaacagccaggaattgcaattggccgcctatgtgagaagtgcgatgggaagtgtgtaatctgtgattcttatgtccgaccctgtacgcttgttcgtgtttgtgacgaatgcaattacgggtctttccaaggccgttgtgtgatctgtggaggagtaggaatttcagatgcttactactgcaaagagtgtacacagcaggagaaagatagagatggatgcccaaagattgttaatttaggcagtgcaaaaacagatttgttctatgaacgtaagaaatatgggttcaagaaacgatgaagcaaaaacacattgagtttccttcctaagatggatcttactgtaatatgatgaatttctgacatctaatctcaaaactctcttagacatgtatgtatatgctgatgagtcagaatgagaacagttgttggggctaaggctattcataagaattaaaactttatcgattgtattgtgtctttgagtacaactgt

SEQ ID NO: 2137 - DNA, 890 bp, Tropaeolum majus
tcggccttacggccgggggaactgcaaagcctcctcaccagtcaccaagctactctggtctccgatcaccctcctccgtttctcgctgcacttctccgtgttcaatttcgtcggctctggtttgggaagtggcggaggatctgaatctctgtacggctgggctttatacggtggagctatttcaacagattgtacctgcagctttaatactccagtcagtttccgagggttgaggaatttaggaacttctcgaacaaaacatggccaagcatcatcctgacttgattatgtgccgaaagcaaccaggtattgccatcgggcgactttgtgaaaagtgtgatggaaagtgtgtgatctgcgattcctatgtacgtccgtgcactctagtgcgagtttgcgatgagtgtaactatggttccttccagggtcgatgcgttatctgtggtggagttgggatatctgatgcttactactgcaaagagtgcacacaacaagagaaagatcgagatggttgtcctaaaatcgttaatctgggaagtgccaaaacagatctcttctatgagcgtaagaaatacggtttcaagaaaagataagagtatgttttcggtagagttcttctttgatgaggaaatttactacactttcgagtttgcatttgttgtttttggatacaagtattatagatcagtcgattagatatattaatccttcgtcttttagagcttaaaactcgtccaagaagaagcggttgcgcgttcaaactcgactttgatggttgtgtatttttttttgggattatagtcatgactatgattgcatttataatgtgaaacaacttttcgaccatggacgatttataatatcattcagcggacgaagatttcgtttac

SEQ ID NO: 2138 - DNA, 662 bp, Tropaeolum majus
cggccgggggctcagaccaccgttctatccaaacttcacaattctctcccttcgtttgattccaccaccagctgcggcggatctcacactctcctcagttaggtttctgtccaccaaaaaagcaccagtagcttcgacattccctgccagtttctgacggttgaaaactaggaacatcacaaagaaaacatggctaagcatcatcctgatttgatcatgtgccgcaagcagcctggtatcgccatcggtcgactttgtgagaaatgtgatgggaagtgtgtaatctgtgattcgtatgtgcgtccttgtacgctagtgcgagtttgtgacgaatgcaactacggatccttccaggggcggtgcgtaatctgcggtggagttggaatctctgatgcatactactgcaaagagtgcacacaacaagaaaaggatagagatggttgtcccaagattgttaatctggggagcgccaaaacagatctcttctatgagcgtaagaaatatggattcaaaaaaagataaggaaatgtttctgtagtcagtatccacttcacttcacttctctactttactgatctatttctaagatttgggtatgtgatgtcgatgaatgtttccgaaatgtgatagcatagttctcttggattccgaaaaaaaaaaaa

SEQ ID NO: 2139 - DNA, 829 bp, Quercus alba
agagtccagaggctgagaaaatcataaaaccttaaaagagatcgatcaatcctcctggaactaagatcgtgtagcggaaagcatggccaagcatcatccagatttgattatgtgccggaagcagccaggaattgctattggacgactttgtgaaaaatgtgatggaaagtgtgtaatatgtgattcctacgtgcgcccttgcacacttgttcgagtttgtgatgaatgcaactatggatcctttcaaggtcgctgtgttatttgtggaggagtgggtatttctgatgcctactattgcaaagagtgtacacagcaggagaaagatagggatggatgtccaaaaattgtcaatttagggagtgccaaaacagatctattctatgaacgtaagaaatatggttttaagaaaagatgatgagaattggatggacatatgtgtactgctattaaactgctttttattttctcagtttgagatgaagaatcttgatatgtcgggattatgagcatagtatagacacatatgtaggcttttacattgcttttattatgcttaagcattgctgaagacggcagatttgaaatgctggagctattttaaagtattgagtttgttttcgtagatactactgagttttcacttgttatttacaaaagcttctgtgaggactactatgattgttttctgttgtgtacatgagctgccacatctcaattattgacatcttgatgttgaaattggattctagatcagagtgggtagatcttataggaagttttaactttatttgagaggttagactaacttaacccttaattgattctcttt

SEQ ID NO: 2140 - DNA, 688 bp, Quercus alba
aagtaacaactaaacagcagaccagagtccagaggctgagaaaatcataaaaccttaaaagagatcgatcaatcctcctgaaactaagattgtgtagtggaaagcatggccaagcatcatccagatttgattatgtgccggaagcagccaggaattgctattggacgactttgtgagaaatgtgatgggaagtgtgtaatatgtgattcctatgtgcgcccttgcacacttgttcgagtttgtgatgaatgcaactatggatcctttcaaggtcgctgtgttatttgtggaggagtgggaatttctgatgcctactattgcaaagagtgtacacagcaggagaaagatagggatggatgtccaaaaattgtcaatttagggagtgccaaaactgacctattctacgaacgtaagaaatatggttttaagaaaagatgatgagaattggatagatgtgtacttctgttaaactgctttttatttactcagtttgagatgaagaatcttgatatgttgggattatgagcatagtatagacacatatgtaggcttttacattgcttttattatgcttaagcattgctgaagacggcagatttgaaatgttggagctattttaaattattgagtttgttttcgtagatactactgagttttcacttgttatttacaaaagcttctgtgagga

SEQ ID NO: 2141 - DNA, 1008 bp, Quercus alba
gcatggatttccagtggctcaggagaagggcctgagcttgaaatcaaagccagattcatgagctttgagtggagtgggaagtttggatggccaaaacattttcagcctccctgtgaatttcagttggactgttttgtgacatctagttgttcctctacttctgtttgacaaaaatttggtttgaatggataattatgggaattttagatgaaaaattggaagttttatattgagttatgtcctgagatgatggtcagctgtctaaatccaagcagtcaatgttgctctatatgtttcgatgctaaacattaatattgcaaactgggattttgttctccagaggccatgctctttccttattcctaattataaattaattttgacaatgtttgcctttttttttgtttgtatatattctagatcaaatatgccaggcatggatttttaatgcgttttagtgtttacttattcctgttcaggaactaagaatttgttgctgaaagcatggccaagcatcatccagatttgattatgtgccgaaagcagccaggaattgctattgggcgactttgtgagaaatgtgatgggaagtgtgtgatctgtgattcctatgtccgcccttgcacacttgttcgagtttgtgatgaatgcaactatgggtcctttcagggtcggtgtgttatctgtggaggagtgggaatttctgatgcctactactgcaaagagtgtacgcagcaggagaaagatagggatggatgtccaaaaattgttaatttagggagtgccaaaacagacctattctatgaacgtaagaaatatggttttaagaaaagatgatgagcgctggatagacgtgtctggaacttattaattgcttttatttagtgtgagactacgaatcttgatatgtaagcagtgcttttagaatgcttttatgtactaaaatattgatgaagatgacataatagtttttgaaatgctggatatatgttaaaaagtcgtcgagtg

SEQ ID NO: 2142 - DNA, 696 bp, Avena sativa
ctctactccgccttcgtcgtcgccgtcgtctctttcggggtttcggcgcttcgcctgcgggggaagcaaggaggaagggcagccgccgcgacttcttccttctgaaggttagcatctgacagccatggcgaaacatcatcccgatctcatcatgtgccgcaagcagcccggcatcgcgatcggccgcctgtgcgagaagtgcgacggcaagtgcgtgatctgcgactcatacgtgcgcccctgcacgctggtccgtgtctgcgacgagtgcaactacggctcgttccaggggaggtgcgtcatctgcggaggagtgggcatctcggacgcctactactgcaaggagtgcacgcagcaggagaaggaccgggacgggtgccccaagatcgtgaacctggggagcgccaagaccgacctcttctacgagcgcaagaagtatgggtttaagaagagatgaagcggggtggatcttttctcgggtcgtttcggcctgatcttcctgtgcggtggtgttggtgccaaggagggtaggtttgctgaggcggcgatggtgctgtgtgcgcgttatggttttggtactagtgcgagaatacatccctgatatgatctgtgtaatgaccattttctgctgtatgggactaactttccactgcttatgcagtgcgtgctcgacgtttaataacctgtctgacgttt

SEQ ID NO: 2143 - DNA, 778 bp, Carica papaya
gctccgtcttcagaacaggttcgaggggggtctctgtaaaagctagaaatttagagtgccctttctctaaaggatcgttttccgttgtcctattgctcttttctttcactgactgtaaacagagtctaggagcttgctgcagaaagaatggccaaacatcatcccgatttgatcatgtgccggaagcagccaggcattgccataggacgactttgtgagaaatgcgatggaaagtgtgtcatctgtgattcctatgtgcgtccttgcacacttgtgagggtttgtgatgaatgcaactatggatcattccagggccggtgtgttatctgtggaggagtgggaatttctgatgcctactactgcaaagagtgtacgcagcaagagaaagacagggatggttgtcctaaaattgttaatctaggaagtgcaaagactgatctattttacgagcgtaagaaatatggtttcaagaaaagatgaggattttgtacgaagaatcaactagtattctaaatcctgtagtgatgttccaaatatagagatctccaattcaaatgcaggagacttctcgtagacatctctattcatggtaattgttatgaactttgaatgatcagagtgtgatggtgactactgatagtctagcggatttagttatactcgagttacctctgcagttttccaaatgaaccatgcttggtgcattagatgtcacaattaaaatctttggtggttggacttattgtttccattattttgctttgccatttggattatc

SEQ ID NO: 2144 - DNA, 760 bp, Arachis hypogaea
acactatttttgttctcgccattctctttttcgctgcccaattcttttctccattccagttaagcgacaccgttcaagccttcacttctcagttctcagcacagtttggttagaggttatctatatactcgccatctagcagggtgttgagaatatggccaagcatcatcctgatttgattatgtgccgaaagcagccaggaattgccattggacgactttgtgagaaatgcgatggcaagtgtgtgatttgcgactcttacgtgcgtccttgtacacttgtccgggtttgtgacgaatgcaactatggctcatttcagggccgctgcgtcatatgtggaggggtgggaatatctgatgcttactactgcaaggaatgcacacagcaggagaaagatagggatggctgccccaaaattgttaatttagggagtgccaaaaccgatttattctatgaacgcaagaagtatggttttaagaaaagatgatgaaggtgtaagagtgagatattttaatctgtctaaaactgttttgtatgtacttcctgagatatcatattagaaccgttggagttgagactttgagcatagaactatattttcttatgcaattgttggtgatgtaagtgcatgacttgtttactaaggatcatgcaattaatggaatgatttgaacaagttcaggtactgtgctgtgaattgtgtgcaattttgagggaaagattatttggtaaatggattaagaaaaatagtatttatgct

SEQ ID NO: 2145 - DNA, 960 bp, Arachis hypogaea
ttacggccggggttcctaacttaaaaaaataatatgagtgtgagccctattgatttagtttttctcctccttggcttcagcaaagtcggcaacattccttgaagactaaaggctcctcttggcagcacagatttacttgcaggttatattatatatatactcagcatttagcaggctgttgaaattatggccaagcatcatcctgatttgattatgtgccggaaacagcctggaattgccattggaagactttgtgagaaatgcgacggcaagtgtgtcatatgcgactcttacgtgcgtccttgtacacttgtccgggtttgcgatgaatgcaactatggatcatttcaaggtcgctgcgtaatatgtggaggggtagggatatctgatgcctactactgcaaggaatgcacacagcaagagaaagatagggatggctgccccaaaattgttaatttagggagtgccaaaaccgatctattctatgaacgcaaaaagtatggctttaagaaacgatgatgggcgtgtaattctttttttcctcccaatatttgtctcttttccctaaacttatcataaattcataaccatgggatttgagagcttgagcacagactattatgttgcaaaattgtttgtaatgtaagtgcatgactagtgtaccactcacggatcacacaatacaattgctgggaatttaaactctgttaggtgcaatcttgtgacttgtcagcatctctgaagattactctggaaaagtattccatgattagtaatatgttttacatttttcaatattgtaatattatgtctttatctgtaatcacataagtccaacaagagctgtaatgtttgatgaccatataatgctcatgtttttattgcttaattctagagggtagggataaccttgtatgcaatataccaaaatagatgaatgaatgttagtaatgttgctaa

SEQ ID NO: 2146 - DNA, 1214 bp, Capsicum annuum
gcacgaggctagctctgacacttatatataatatttttaatattatttaacgaacattaataaatataacataaaaaatcccagagaaaggataatgttacatatatagtgttccacacatgacactgaagttccagtgaaagtagtacaatgagctctcactttattttgaaattacaacttattttaaacacacaacacttgatattatatcttattccttttagagaattaagtatcatatgttcattagttgggaccgccattgttaacattttcaccttcgccagtggcagaacggccacaattgctctggcaaccaactccacagtatgcccgagtcgaaccacagtacccgtattggctgcagcacaacctgtttgcacaggcacgccctccagcttgtcttccacattgttgagcacttgttgtggttaacaacaaggccaatagcaccaaaattaccacctgaaacttcattgttttttcccttctctttatgcttctttcttacttgacttttatttttcttctggtgatgagtaatgtaattgaacaaaccccctgcggctttgggttctagtcttctagaagcttctggtcttcgattgaggttaagacgtcactgctagaaatatggccaagcatcatcctgatttgatcatgtgccggaagcagccaggaatagccatcgggcgactttgtgagaagtgtgatgggaaatgtgtgatttgtgattcatacgtccgtccttgcacacttgtccgagtttgtgatgagtgcaactatggatcctttcaaggtcgttgtgtcatctgcggaggtgttggcatttctgatgcttactattgcaaggaatgtactcagcaggagaaagatagggacggttgtccaaagatagtcaatctcggtagtgccaagaccgatctgttttatgaacgtaaaaaatatggtttcaagaagaggtgagggctggatacttctttctacccttcgatgaagttcgctactggagttttgtactagtatgacggtgtcaagtcaaaattaggcattcgagtacaggctatgtaacttgttcactatatttccatggatcatgctgtattacatggtggtatcacaataaacccatgcaacaatatcccaacgttaattgactgttcgaacatctaattcctttctatcgtgattgttttttctgtaaaaaaaaa

SEQ ID NO: 2147 - DNA, 714 bp, Cajanus cajan
cccgggtgattcaagctgcagagtactcgggggctcgtttgatgggtccattctctctcgtttctctctttcttccaccgcaacacaacccttgttgttctgtgctcagacgaagcgacaccgttttgcactttcttctcagcacagcatctagcaggttgttgaaaatatggccaagcatcatcctgatttgattatgtgccggaagcagccagggattgccattggacggctgtgtgagaaatgtgatggcaaatgtgtgatctgtgactcttatgtgcgtccttgtacacttgtccgagtttgtgatgaatgcaactacggatcatttcagggtagatgtgtcatatgcggaggagttggaatatctgatgcctactactgcaaggaatgcacacagcaggagaaagatagagatggttgccccaaaattgttaatttagggagtgccaaaactgatttattttatgaacgcaaaaagtatggttttaagaaaagatgatcagggtagattactgacgtttgtatttcactaaaaaatgtttggatgtgttttgctcggatgtaagaaccatataggatatgagaccctgtgaacataaacatttacattggataattattttaatgcatgactagttggctactgataaaagatttaagccattatggaagtatcaacatggactacaataagactatcgtttgtatttg

SEQ ID NO: 2148 - DNA, 740 bp, Populus trichocarpa
aacctcgtgtcgtgcctcgattgttctcttacgagcccatccagaaagactcctagcaaaattatcgaaagctcctttctccaggtttccctctctctgctgaaagagaagcaacagagtctcaaatcgattccagcaggtacacgcagtaactctaagatcttgaagagatcatggccaagcatcatcctgatttgattatgtgcaggaagcagccaggaattgctattggacgcctttgtgagaagtgtgatggaaaatgtgtaatctgcgactcctatgtgcgtccttgcacacttgtgcgagtttgtgatgagtgcaactacggatccttccaaggtcgatgtgttatttgcggaggagtgggaatctctgatgcctactactgcaaagagtgcactcagcaggagaaggatagggatgggtgtccaaaaattgttaatttagggagtgccaaaacagatctgttctatgaacgtaagaaatatggttttaagaaaagatgatgagcagtggatgacatctgtagtgccttttttcctatctggtgcccgcaatctaaaatgttgaaacagttttttaggtcttgagattgtatctgctgatattacctctagttgtgttgaaaacaatattgattactgaagtgaagttgtttcttaatgcaatggacttggattgtattggagcaatgtctagtcttttgtgatttcatgaattttcgcttgctgtttataatc

SEQ ID NO: 2149 - DNA, 716 bp, Populus trichocarpa
gttctcttataagcccatctacaaactcccaaacagaaagtgttctctcgctccctctctgcaaaaagagaagcaacagtctcaaatcgattccagcaggtgcaagtagcaacactaagatcttgaagaaatcatggcgaagcatcatcctgatttgattatgtgccggaagcagccaggaattgctattggacgcctttgcgagaagtgcgatggaaaatgtgtaatctgcgactcctatgtgcgtccttgcacacttgtgcgagtatgtgatgagtgcaactatggatccttccaaggccggtgtgttatttgtggaggagtgggaatctcagatgcctactattgcaaagaatgcactcaacaggagaaggatagggatgggtgtccaaaaattgttaatttagggagtgccaaaacagatttgttctatgaacgtaagaaatatggttttaagaaacgatgatgagcagtgggtcacatctttagtgctttccccccctcactggtgcgctcaatctaaaatgtcgaaactagttattaagtcttgagttgtatctgctgatattacccctagtcgttttgaaaacaatattgattactgaagttgtcgcttaatgcaatggacctggattgtattggagccatatcttgccttttatgtgtcatgaattctatcttcttgtttataatctaattgacttggatttatttcc

SEQ ID NO: 2150 - DNA, 459 bp, Prunus persica
ggaacatggcaaagcatcatcctgatctgattatgtgccggaagcaaccaggaatagctattggaaggttgtgtgaaaagtgtgatggtaagtgtgtaatctgcgactcttatgtgcgtccatgcacgcttgttcgggtctgcgatgagtgcaactatggatccttccaaggaaggtgtgttatctgcggaggggttggaatttctgatgcttattactgcaaagagtgtactcagcaggagaaagatagagatgggtgtccgaaaattgtgaatctgggaagtgccaaaacagatcttttctacgaacggaaaaagtacggtttcaagaaaagatgatcattagcagggcaagtttcgcttagcttcgtgaaatcactctgttttgttcaacattgaggctagcctgtattgccataaggtgcttttgcttgggaaatgtgcttcttactgcttgtat

SEQ ID NO: 2151 - DNA, 368 bp, Prunus persica
aatacaaaatagagagggatggccaagcatcaccctgatctgattatgtgcaggaagcaacccgggatcgccatcgggcggctgtgcgagaagtgtgatggcaagtgcgtcatctgtgattcctacgttcgtccttgcacacttgtgagggtttgtgatgaatgcaactacggatcttttcaaggccggtgcgttatctgtggaggagttggaatttcagatgcctactattgcaaagagtgtacacaacaagagaaggatagggatggatgtccaaagatagtaaatttaggcagtgccaaaactgacctcttttatgaaagaaagaaatatggatttaagaaaagatgatcataagcatcatcaca

SEQ ID NO: 2152 - DNA, 974 bp, Oryza sativa
ttaattgggccgtagcgttattcctgcggctgcgcgttccagccgttggattggattcttgagcaatctggacggagatcctctcgtttgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggttagcattcgacagccatggcaaagcatcatcctgatctcatcatgtgcaggaagcagcctggcattgctattggtcgtttgtgcgagaaatgtgatggcaagtgtgtcatctgtgactcgtatgtgcgcccatgtacgcttgtccgagtctgtgatgagtgcaactatggttccttccaggggaggtgtgtcatctgtgggggggtcggcatctcagatgcctactactgcaaggagtgcactcagcaggaaaaggaccgagatggatgtcccaagattgtcaatcttggaagcgccaagaccgatctcttctatgaacgaaagaagtatggttttaagaagagatgatcaggaagttggatttgtctggtccatttcctcgctgtgttttcagtcgcactgatatggttgttaaggacttaaggcggacatctttgtattctatggaatatggtctagattcttaaggctgcatgtgcagtacgtacctgatgttaatgaccatgattgttgacatgagatgtgaaccgagatacttttaagtcttataattatgtaagccactgattgtagggaataagtgaatgctttagctgttcgaacgacctgatatggttatcaactgggaagcaatgatacttatctaggagctgagatgcagctgaggtta

SEQ ID NO: 2153 - DNA, 905 bp, Oryza sativa
gggacccctctcgctccctcgcgattcccccactctccttctcgcggagcaattaaaggacacaacgcgtcgcgaggtcgcgccgccgcgaaaccccacttcttcttcgccgccggccgcctcgcctcgcctcttcctccccgcagcatcatcctctctcccccggttccccggcggcggcggcgagcggcctcgcagcttcgccaagtccccactccctccatccccaggttagcatttgacagccatggcaaagcatcatcctgatctcatcatgtgcaggaagcagcctggcattgcgattggtcgtttatgtgagaaatgtgatggcaagtgtgtcatctgtgactcctacgtgcgcccgtgtacgcttgttcgggtctgtgatgagtgcaactatggatccttccagggaaggtgtgttatctgtggaggggttggcatctcagatgcttactactgcaaggagtgcactcagcaagaaaaggaccgagatggatgtcctaagattgtcaaccttggaagcgccaagaccgatctcttctatgagcgcaagaaatatggttttaagaagagatgatcaggaaggtggatttgtctggtccttctggtctcgctgtgatttttgttgcacggatataactgctaagtcaacagctttgtattcatggtctgctttgatactaatatgagatagcatcgctgatgtttgctgtaatgttacttgtatgaaatggtctacattctcaagtctgcatttgcacttatgcagtaggtacctgatgttaatgactatgattgttgacatgaaatgcgaactgagatatggagtacattttagtcttatattgtgtatactatgcattagctgttcgaacgacctgatatatggttgtcagctgggg

SEQ ID NO: 2154 - DNA, 713 bp, Carthamus tinctorius
cgggggaggaccgctgatcaattcagctaggtggttaaaatagcatcgggccaaattgtaaaacccccttttctataagcttctggaggcctcgcttcaagaacccccgaacatctttgtaatctttttctgctgctgcctattctatcaggctgttatagtttcaaggagctgagagcctgttgaggaaatcatggccaagcatcatcctgatttgatcatgtgcaggaagcagccaggtatcgccattggccggctttgtgaaaaatgcgatggcaaatgcgtaatttgcgactcttatgtgcgtccatgtacacttgtccgtgtgtgcgatgagtgcaactatgggtcctttcagggtcgctgtgtgatatgtggaggtgtgggtatttctgatgcttattactgcaaagagtgcactcagcaggagaaagatagagatgggtgcccgaagatcgtgaatttgggaagtgctaaaacggatctcttctatgaacgtaaaaaatatggatttaagaaacgatagctggtacagtttactttgaatgactgtatttgagatgatattaaggcttaagagatgatgtagaactccttgaccatttgaacctgagtaagaatttgtgtatttgatggtggcagtatgttctatgcttgacttataaggcttgaggtctaatctcaccgctatgctattatgaaccttgctcttt

SEQ ID NO: 2155 - DNA, 717 bp, Solanum phureja
atcttcaattttcctcttgagtcctttctctgcagctaaacccctacggctttcggttccagaaacttcgctcatcgattcaggttaagacgtcactgttagaaatatggccaagcatcatcctgatttgatcatgtgccggaagcagccaggaatagctattggtcgactttgtgagaaatgtgatgggaagtgtgtgatttgtgattcatacgtccgtccttgcacacttgtccgagtttgtgatgaatgcaactatggatcctttcaaggccgttgtgtcatctgtggtggtgttggtatttctgatgcttactattgcaaggaatgtactcagcaggagaaagatagggatggctgtccaaagatagtcaatcttggtagtgccaagactgatctgttttatgaacgtaaaaaatatggtttcaagaagagatgaaagtcggatacctctttcacccttcggtgaagttcactactggagtttcgtactagcatgattgtgtcaaaattaggcatttgagtatagcctatgtaacttactcactatattgccttggaacttgctgtattacatactgatatcacaggtttaacccattgtaatttcgttttgtgcaagggtatgcgcaacagcatgccaacgctaatcgactttcaatcttgtctctttttggtgtaatttgtgaaaattttactccagtttattttctatca

SEQ ID NO: 2156 - DNA, 610 bp, Glycine max
cttctctctctttcgctttcaccgcaacacaaccctcgttgttccgtgttcaggtgaaacgacaccgttttacccttcctcttctcggcacagcatctagcaggttgtagaaaatatggccaagcatcatcctgatttgattatgtgccggaagcagccagggattgccattggacgactgtgcgagaaatgtgacggcaagtgtgtgatctgtgactcttatgtgcgtccttgtacgcttgtccgagtttgtgatgaatgcaactatggatcatttcagggtcgatgtgtcatatgcggaggagttggaatatctgatgcctactactgcaaggaatgcacacagcaggagaaagatagagatggttgccccaaaattgttaatttagggagtgccaaaactgatttattttatgaacgcaaaaagtatggttttaagaagagatgatgaaggtagattactgaggcatgcgtatttctctaaaactttttgtatgtgtattgttcggatataagaaccggatgtgaaaccttgagcttgtaaacttttttatggtacaattatgaatcatgatataataaatgcttgactagtttgctactggtaaaa

SEQ ID NO: 2157 - DNA, 699 bp, Glycine max
gggccttttttggttctggattgttcagtgaagttccatttccttctccgctccattcttctccctcccttgcttctttctctttcgcttccaccgtaacacaaccctcgttgttccgtgttctggcgaagcgacaccgttttacacttcctcttctcggcacagaatctagcaggttgttgaaaatatggccaagcatcatcctgatttgattatgtgccggaagcagccagggattgccattggacgactgtgcgagaaatgtgatggcaagtgtgtgatatgtgactcttatgtgcgtccttgtacacttgtccgagtttgtgatgaatgcaactacggatcatttcagggtcgatgtgtcatatgcggaggagttggaatatctgatgcctactactgcaaggaatgcacacagcaggagaaagatagagatggttgccccaaaattgttaacttagggagtgccaagactgatttattttatgaacgcaaaaagtatggttttaagaagagatgatgaaggtagaatactgaggcatttgtatttctctaaaacttttttgtacgtgtattgtttggatataagaaccataggatgtgaaaccttgagctcgtaaacttttttatggtacaattatgatataaatgcttgactagtttgctactgatcaaagaattagccaatagccattatgg

SEQ ID NO: 2158 - DNA, 743 bp, Fragaria vesca
gactcacagtgaagaagaaggagcagcagcaacctcctctagtcttctccagcctcggactagcatagagttgttgtaggaacatggcgaagcatcatcctgacctgattatgtgccggaaacaaccaggaatagctattggacggttgtgcgaaaagtgtgatggtaagtgtgtgatctgcgactcctatgtgcgtccctgcacactggttagggtctgcgatgagtgcaactacggatccttccagggacggtgtgttatctgtggaggtgttggaatttctgatgcttattactgcaaggagtgtacccagcaggagaaagatagagatgggtgtccaaaaattgtgaatctgggaagcgccaaaacagatctgttctatgaacggaagaagtatggtttcaagaaaaggtgaccgttcagaggtgaagtcttgcttagcttagtgagatcattctgtttgtgctcagacattgtcgctagcttatgttactatcagatggatttgcataggaaatcttcttgttgctgcttgtattcgtctttatgcatatttcactgctttaatggttgacccttttggttgcattttcttgtggtatatgttaccatggccagtctgtgacatctagttgaggaatgtaaaatgttgaatcagttcttgatcattgctgttacacagtgacttctatccatgaatgctttttactcgggtttaaaattgtccgctattaattcccac

SEQ ID NO: 2159 - DNA, 895 bp, Fragaria vesca
gtctctcgctctctctaggttcttctaaagttgtgttcttaagaacaaagaatagcagaaccttggtccattgttcctcagagttcgattaaggctcttctccgtaacacagattacagcatagtgagtgatggccaagcatcaccctgatttaatcatgtgccggaagcaaccaggaattgccatcgggcggctctgcgagaagtgtgacggtaagtgtgttatatgcgactcttatgtgcgcccttgcacgcttgtgagggtttgtgatgaatgcaactacggatcatttcagggtcgttgtgttatttgtggaggagtcgggatttctgatgcttactattgcaaagagtgtacgcagcaggagaaagacagagatggatgcccaaagattgtcaatttagggagtgccaaaacggatctcttttatgaacggaagaaatatggttttaagaagagatgatgaagggattatggttgttggggttggggcagagctgaatacactttgcttttgaaagaaaatatattggatacaatcgtatttgagccatgttttctattctcattcttagtttggtcggaaaagaaggaaggaaaacctcaatgtacaactagtcctagacacctacctttgtaaacattttaatttatgttaataattcgcatgactaggggctgttagtctattatattcgggattcttacatgatcaaaatgcacaaaaaccgtattttacaaacttccttttcccatgcttcattttaaatgttgttaatccttgttccttgtttagcctcttcatgttatcttaatattttgatgtcatgcaggctacatgttaaaggaggaatggaggatcaaccatttctcactacagtatgaattctggtca

SEQ ID NO: 2160 - DNA, 786 bp, Saccharum officinarum
tatctcgccgcggccgttagccctagccgccgtccgccgccttcctcgtcgccgtcgtctccagctctccgcacgctgcctgcgagaagcgaggcgagccttcgtacatcacctacgtgaaaggttaaaatccgacagcaatggcgaagcatcatcctgatctcatcatgtgccggaagcagcccggcatcgcgattggtcgcttgtgtgagaaatgtgatggcaagtgtgtcatctgcgactcatacgtgcgcccatgtacgcttgtccgggtctgcgatgagtgcaactatggttcattccagggaaggtgtgtgatctgtggaggagtcggcatttctgacgcctactactgcaaggagtgtacccagcaggagaaggaccgggatggttgtcccaagatcgtcaatcttggaagcgccaagacagatctcttctacgagcgcaagaagtatggttttaagaagagatgagaagatcgagctgtgtgtggttctccttggctgtgtgttctgttctatcccactgaatactgatactgagagtaggtagctgaggcagcagctttgtattcctgttatgatttgataaggccagtctcaatggggttttatcagagtttcatgggcattaattatgctgatgtggcactatattaatgaagaaagagaagcttaaagttcatgggagtaaagagagtttaatggggatgaaactcttctacactggtttccaaaatctggatgggttggaaacaggggatatgaaaatccccactgaaactgg

SEQ ID NO: 2161 - DNA, 674 bp, Helianthus annuus
attcgatttgaactttgaaatagcatttgagccaaattgtgattcccactttctccataacctcccagaagcctccaggattcgctctgtaaatcactgcgtcatctcccaaaaccccaaaatttgctctctcgcgctttatcagggtagttgaggaaaaatcatggcgaaacatcatcccgatttgatcatgtgcaggaagcagccaggaattgcaattggacggctttgtgaaaaatgtgatggcaaatgcgtaatttgtgactcttatgtgcgtccatgcacactcgtgcgggtctgtgacgagtgcaactatggctctttccaaggtcgctgtgtcatatgtggaggtgttggtatttctgatgcgtattactgcaaagagtgcacacagcaggagaaagatagggacgggtgtccgaagatcgttaatctgggaagtgctaaaacggacctgttttacgaacggaaaaaatacggtttcaagaaacgttgatgaacaactttgtttaatgattgtaaccaagcatgagatgaagtatcctctcatttatccaatataatatgcttgtattagagtgcttttggttgtattttggattcatgagacaaattgcaggtcatacaacactgttgagttagaatttgtggatttgatgatgtttttttgttct

SEQ ID NO: 2162 - DNA, 709 bp, Panicum virgatum
cgggggtggaaggcccaaatttatctcgccgcggcccaaagccctatccgccttccgccgccttcttctcgagcctcggcgcgctgccttcgaggaactagaagcgccaccgcgcagggcacatcccctagctctaggagattagcatctgacagcaatggcgaagcatcatcctgatctcatcatgtgccggaagcagcccggcattgcgattggtcgcctgtgtgagaaatgcgatggcaaatgcgtcatctgcgactcatacgtgcgcccatgcacgcttgttcgggtctgcgatgagtgcaactacggctcattccagggaaggtgtgtgatctgtggaggagtcggcatctcagacgcctactactgcaaggagtgtacccagcaggagaaggaccgggatggttgtcccaagattgtcaatcttggaagtgccaagactgatctcttctacgagcggaagaagtatgggtttaagaagagatgattgagttgctgggttctattggccgcgtgttgtgttccgtcgcactgatactgagtttaggctgctgaggcagcagcgttgtattcgtgttatgatttgatattgatgtgagaatacacccctgatttgatattgatgtgagaatacacccctgatatgctttgtaataacaagttcaactgtatgatctaaagactccaaaggactgcttaatgcaaa

SEQ ID NO: 2163 - DNA, 734 bp, Panicum virgatum
cgggggcggaaggcccaaatatatctcgccgcggcccaaagccctagccgccgtccgccgccttcttcgtcgccgtcttctcgagccctcggcgcgctgccttggaggaacgaggagcgccaccgcacagggcacatcccctacccgtaggagattagcatcgaacagcaatggcgaagcatcatcctgatctcatcatgtgccggaagcagcctggcattgcgatcggtcgcctgtgtgagaaatgcgatggcaagtgcgtcatctgcgactcatacgtgcgcccatgcacgcttgttcgggtctgcgatgagtgcaactacggctcattccagggaaggtgtgtgatctgcggaggagtcggcatctcagacgcctactactgcaaggagtgtacccagcaggagaaggaccgggatggttgtcccaagattgtcaatcttggaagcgccaagactgatctcttctacgagcggaagaagtacgggtttaagaagagatgattgagaggagggagttgctgggttctattgtgttctgccgcactgatactgagagtaggctgctgaggcagcagcgttgtattcatgttatgatttgatattgatgtgagaatacacccctgatatgctttgtaataactggttcaactgtatggtctaagaccccaaagactacttaatgcatatgcaacttgtgcttggtggttacatccatggatagacttgaaaatc

SEQ ID NO: 2164 - DNA, 717 bp, Panicum virgatum
ggcggaaggcccaaatatatctcgccgcggcccaaaagccctagccgccgtccgccgccttcttcgtcgccgtcttctcgagacttcggcgcgttgcgttcgaggaacgaagagcgccatcgcacagggcacatcccctacccctaggagattagcatccgacagcaatggcgaagcatcatcctgatctcatcatgtgccggaagcagcccggcattgcgatcggtcgcctgtgtgagaaatgtgatggcaagtgcgtcatctgcgactcatacgtgcgcccatgcacgcttgttcgggtctgcgatgagtgcaactacggctcatttcagggaaggtgtgtgatctgcggaggagtcggcatctcagacgcctactactgcaaggagtgtacccagcaggagaaggacagggatggttgtcccaagattgtcaatcttggtagcgccaagactgatctcttctacgagcggaagaaatatgggtttaagaagagatgattgagaggagggagttgctgggttctattggccccatgttgtgttctgtcgcactgatactgagagtaggctgctgaggcagcagtgttgtatccatattatgatttgatattgatgttagtatacacccctgatatgctttgtaataactagttcaactgtatggttaagactacaaagactgcttaatgcatagtatgcaacttgtgcttgatgg

SEQ ID NO: 2165 - DNA, 560 bp, Panicum virgatum
gctccctcggccgcgccgcggcggccgtcctgctccgcctctcttccgccggttagcatctgacagccatggcgaagcaccatcctgatctgatcatgtgccggaagcagcccggcatcgccattgggcggctgtgcgagaagtgtgacggcaagtgtgtcatctgtgactcatatgtgcggccatgcacgctggtacgcgtctgcgatgagtgcaactacgggtcgttccaagggcgttgtgtcatctgcggtggtgtgggtatctcggatgcctactactgcaaggagtgcacgcagcaggagaaggaccgggacgggtgccccaagattgtcaacctcggtagcgccaagactgatctgttctacgagcgcaagaagtatgggttcaagaagaggtgatgggagaaactgttgctttcatgttctcttggcctcgtgatgagttgtgttcgtcgataccgggagtaggatgtagtggcaacagtttgcttttcgcattatgttaatggtgaagaatggtgccttgaaatgtgaagtgagatgtgccttttctgttca

SEQ ID NO: 2166 - DNA, 499 bp, Nicotiana tabacum
tcactctctgcagataaaaccccgtggctttcggttccagaagctttcattcctcgaatcaggttaagacctccccgcaagaaatatggccaagcatcatcctgacttgatcatgtgcaggaagcagccaggaatagctattgggcgactttgtgagaaatgtgatggaaagtgtgtgatttgtgattcctatgtgcgtccttgcacacttgtccgagtttgtgatgaatgcaactatggatcatttcaaggtcgttgcgtcatctgcggaggtgtgggcatttccgatgcatattattgcaaagaatgcactcagcaggagaaagatagggatggttgtccaaagattgtcaatctgggtagtgctaaaacagatctgttttatgaacgcaaaaaatatggtttcaagaagagatgagggtatggattcttgttttttcgtatcggtgttgttcactacaatgagtttcttactagtatgaaggtatcaaaagtaggc

SEQ ID NO: 2167 - DNA, 765 bp, Solanum lycopersicum
atcttcaatattcctctcgagtcatttctctgcagctaaacccctgcggctttaggttccagaaacttcgctcatcgattcaggttaagacgtcactgctagaaatatggccaagcatcatcccgatttgatcatgtgccggaagcagccaggaatagctatcggtcgactttgtgagaaatgtgatgggaagtgtgtgatttgtgattcatacgtccggccttgcacacttgtccgagtttgtgatgaatgcaactatggatcctttcaaggccgttgtgtcatctgtggtggtgttggtatctctgatgcttactattgcaaggagtgtactcagcaggagaaagatagggatggctgtccaaagatagtcaatcttggtagtgccaagaccgatctgttttatgaacgtaaaaaatatggtttcaagaagagatgagagggtcggatacctctttcacccttcggtgaagttcactactggaattttgtactagcataattgtgtcaaaattaggcatttgagtatagcctatgtacttactcactatattgccttgcaacttgctgtattacatactgatatcacaagtttaacccattgtaatttcgttttgtgcaagggtatgcaacaaaatgccaacgctaatcgacttccgatctagtttcttttgggtgtaatttgtgaaaattttacttcagttaattttctatcatgatgtacactgtactcttgttctttagtcagcatgttgatgggatttg

SEQ ID NO: 2168 - DNA, 712 bp, Juglans hindsii x Juglans regia
ttctcacatttccacttcccctccgactgcgcagcctcgtcaacattacaccaaaggagcagagcattgcccttcgccctcggcgcggtttagctgtggactcgaatccggcaacacaccctcgcccacacacctgcctgcccctctcagttttcttcgaagtcaaacagaggcagagctttgcccttccttcccatcgtacagccagggattttgcgtgttctttataacttctcattaaagaactagctggtatcagaaagcatggccaagcatcatccagatctgattatgtgccggaagcagccaggaattgccattggaagactttgtgagaaatgtgatgggaagtgtgtaatctgtgactcctatgtgcgcccttgcacgcttgtgcgggtttgtgatgaatgcaactatgggtcctttcagggtcgctgtgttatctgtggaggagtggggatttctgatgcctactattgcaaggagtgtacgcagcaggagaaagatagagatggatgtccgaaaattgttaatttaggtagtgcaaaaactgacctattttatgaacgcaagaagtatggttttaagaaaagataatgatgagcagtggatagaaaaatatctggtgcttttgaactgccttttcttttttggttgctctgtttgagatgacgactcttgatatgttggaaccacctgatgatttccttcc

SEQ ID NO: 2169 - DNA, 1148 bp, Triticum aestivum
aagcttcttgtagcacccacccctcgaaaaaggaagcagcatcactctccgccgcgccgcgagacctagccgagcccgtcgtgtatcgtcgtcgccgccgccaggagcacggagcgacaccgccgtcgcagccagcgcttcctctcgaaggttagcatctgacagccatggcgaagcatcatcctgatctcatcatgtgccggaagcagcctggcattgctattggtcgcctgtgtgaaaagtgtgatggcaagtgtgtcatctgtgactcgtacgtgcgcccatgtacgcttgtccgggtctgcgacgagtgcaactacggctcgttccagggaaggtgcgtcatctgtggcggagttggcatctcagacgcctactactgcaaagagtgcacgcagcaggagaaggaccgagatgggtgccccaagattgtcaacctaggaagcgccaagaccgatctcttctacgagcgcaagaagtatggttttaagaagagatgaatcgcatacatggatttggcgcgtcctccgggcctcacattctatgctgttacactaataccagaagcaggttgctggggcaacggcattgtgtccgtgttatcgtttgatcctgatatacaagaatgcgtccctgatatgctctgtaatgactagttctgttgtatggttcaaaactctagactgcctatgcagtatgcacttgatgtgaatgaccatgaatgtttgacttgaaatgtgtgctgggatggccttttgtatgttacttaattgcctcagctactctgaagacctgagatatggctgtaatgtaaaaatgcatgctggtaggtgatcattcctgatgtgtttatgaacttgtgatatatagtcagctggaagtacggattcaactggtgggctggaggataatactgtggtgttaatttcgcgggacgaagcgggatgccgcttgcaccccaagctgaaagtaatcttaatcaatgccgttcttgctgggcgtatggacgtaccatgtatgcactttcaggattgtgtacttggataagggataacctaagcgactatgtatcttcagtattttgttcttgtatacaaattctatatatagatctaatagacgtaaaaaaaaaaaaagaacaaaaggga

SEQ ID NO: 2170 - DNA, 866 bp, Triticum aestivum
attcggcacgagggtaagcttctagcggcatcggccaccgccgccgccagaatctattccgcccgcctagcctcgtcgacgtcgtctcggggtctcggcgcgtcgcctgcggggagcaaggagcaagcgccgccgcagcgagctcgtccttccgaaggatagcagcatccgacagccatggcgaagcatcaccccgatctgatcatgtgccggaagcagcccggcatcgccatcggccgcctgtgtgagaagtgcgacggcaagtgcgtcatctgcgactcgtacgtgcgcccctgcaccctcgtccgcgtctgcgacgagtgcaactacggctcgttccaggggaggtgcgtcatctgcggaggggtgggcatctcggacgcctactactgcaaggagtgcacgcagcaggagaaggaccgcgacgggtgccccaagatcgtgaacctggggagcgccaagaccgacctcttctacgagcgcaagaagtacggttttaagaagcgatagacgaacgaggctggttcgtcaggccctttggggggcctcattttgtgctgttgtggcatgctggcatttgatcgataccaagagtaggtttgccgaacgaacagcgctgtattcatggtatggtttggtactgataggagaatacaaccctctgatctttgatctgtaataactgtttgtgatgtatggtctgaagtgagtctagctggactctcaactgcttatgcggtggcatgcgccgtgacttgaaatgtggatcgagatgactggcttcccgtgccgtgtcattgtcttggccgttgcaagttgcgacgacgtgacatggttgttatcggaaataagcaagcggcagccga

SEQ ID NO: 2171 - DNA, 755 bp, Zostera marina
cacacattgattccaaccttactctcaccaacattccagttcctcccatttctcttactcgacttcttcatcttctcctcaacgtgttcgttgtcgaccggacaccatcgatcaagatcatttcgagaagctacgcatcagatttccagatttcttcatctgagttgaatttgttccgtattgcctgaccgaagaagaaggaagcatcaagcatggcaaaacatcatccagatctgatcatgtgccggaaacaacctggaattgctattgggcggctgtgtgaaaaatgtgatggtaaatgcgtgatctgtgactcttatgtaagaccttgcacactagtccgtgtttgtgatgagtgtaactacggttcatttcaaggtcgttgtgttatctgcggaggtgttggcatatctgatgcatactactgtaaagagtgtacacagcaggagaaggatcgagatgggtgtcctaagattgttaatcttggaagtgccaaaactgatctcttctatgaacgtaaaaagtatggttttaagaaacgatgatgtgccaaaattggaatttttcatcatctcaattctcaaacaatcctaaataacatccgtctaaatttccaatttctgatttccctcacccttcttaatgtattatcagtacctttgatttagcgtttttgcctaatgttttcaattttgcttgaatactaaattcatcttcaaaaagaaaagtagactatgctcatttttttacagtgc

SEQ ID NO: 2172 - DNA, 855 bp, Setaria italica
tttctcaggtttgcatcctacagccatggcaaagcaccaccccgatctcatcatgtgccggaagcagcccggcatcgccatcgggcggctgtgcgagaagtgcgacggcaagtgcgtcatctgcgactcgtacgtgcggccgtgcacgctggtccgcgtctgcgacgagtgcaactatgggtcattccaggggcggtgtgttatctgcggtggtgtgggcatctcggacgcctactactgcaaggagtgcacccagcaggagaaggaccgggatggttgccccaagatcgtcaacctcggtagcgccaagactgatctgttctacgagcgcaagaagtatgggttcaagaagaggtgatggagaagatggtgctgtcaggttcgtttggcctcttgttgagttgtgtccatcgataccgggagtaggatttagtgccccaagatcatcaacctcggtagcgccaagacttatctgtcctacgagcgcaagaagtatgggttcaagaagaggtgatggagaagatggtgctgtcaggaaatggggagtcagtgattcatcctagtttctcaaatgtacaaggcaaatccggagggacaactgaaagatttgtgacaagttttcttggatagcaacttctaggatttagttcaaatttgttacagatatattcaagttgagtttggttttgtttattctgacatgtcatagtgttagtcatcctgtaagagaggcagcacatcttattgcaaaatgttcagaatgctgttggtccagtttggcactgcaaaaggttttagaggtaatccaatccaaatgaactttgttggacaactaaattgttgctcccattttct

SEQ ID NO: 2173 - DNA, 672 bp, Avena sativa
ccgtcgtctcgtcgtcgccgcgaggagcacggagcgacacaccgccacagcgagggcatcctctcgaaggttagtacgtgacagccatggcgaaacatcatcctgatctcatcatgtgccgcaagcagcctggtattgctattggtcgcttgtgtgagaagtgtgatggcaagtgcgtcatttgtgactcgtacgtgcgcccatgtacgcttgtccgggtctgcgacgagtgcaactacggctcattccagggaaggtgcgtcatctgcggtggagttggcatctcagatgcctactactgcaaagagtgtacacagcaggagaaggaccgagatggatgtcctaagattgtcaatctagggagcgccaagactgatctcttctatgagcgtaagaagtatggttttaagaagcgatgaatgacatgcgtttgtcaggtcctctgggccatttgtgctgttacgataataccaagagtaggttgctgaggcaacaacactgtattcatgttatgatttgatactaatacgagaaaacatctcctgatatgctctgtgataactatttctatcgtatggtctaaaactctagactgcttatccaatatgcactcgattgttatgaccatgaatgttaacttgaaatgtgaattaagatggctagaaaaaaata

SEQ ID NO: 2174 - DNA, 1300 bp, Vitis vinifera
cacgaccttacttgaacaggatctgttctataggctcgtacctctgtatccttgagttctaaggagacaggaacctcagtctggtggatgaacaatgaccgtgcgatcagagcgtgattaactgcttaacctgctttgttgggtcagggctgtagaggatcgttctcagccgagctttggctcgactgggatggtcgcacggttgtctgacagactcaaaagtttttatctttttggaattttttgggccactaaatgggcctttaaggcccaccccatcactcagactttatccaacccgactctcttaaggccaatcccaccgactccgactttacccaaccgggtcacggattgtctcgattgttctcatattttctgcatattcctccttcctccatgcgtcagcattattcagagtgagtacgctccacacccggtgcacgttagtagcttccgaccgctcgaccgacacccgctcaggtcacagggacattcaagggctgagagcttgttgtagaaagcatggccaagcatcatcccgatttgattatgtgccgaaagcagccaggaattgcaattggacggctttgtgaaaagtgtgatgggaagtgtgtgatctgtgattcctatgtgcgtccttgcacacttgtgcgagtttgcgatgaatgcaactatggatcctttcagggtcgatgtgtcatctgtggaggagttggaatctcagatgcctactactgcaaagagtgtacacaacaagagaaggatagggatgggtgtccgaaaattgtcaatttagggagtgccaaaacagacctgttctacgaacggaagaaatatggttttaagaaacgatgagattgacattgggtaattttcttgctacgtgttctctctgtgccctcatattctatagactgagatgatgcattttaaggtgttgaaacaaagttttggggcttcattttgtattcgtaggactttgccagtttctgagaattgtagctggagggtactaatcatcgtaaaccctatcaatcatggcctataatgaattgattgaactataagtgtggattctgtagtttttctcttacctactctatttttactaaatcttggtttcctacactccagatttcaattttttactgtagagattttctctctcattcataattaggtttcttatgcgggctcatgatcaaccctttccattgtattgactcagtatgcggagattggttttttcaacacttttttaagtagttgggaatattattttaatctggaagtcttg

SEQ ID NO: 2175 - DNA, 352 bp, Malus domestica
aggtatggccaaacatcaccctgatctgattatgtgccggaaacaaccggggatcgccattggacggctttgcgagaagtgtgatggcaagtgtgtggtctgcgactcctacgtccgtccttgcacccttgtgagggtttgtgatgaatgcaactacggatctttccaaggccggtgtgtaatctgcggcggagttggaatttccgatgcctactattgcaaagagtgtacgcagcaggagaaggatagggatggatgtccaaagattgtgaatttaggtagtgcgaaaaccgacctcttttacgaacgcaagaaatatggctttaagaaacgatgatcgtaattaagcatc

SEQ ID NO: 2176 - DNA, 706 bp, Eucalyptus grandis
atttgcttaaatgcaatctagtttacttttctgtttttctttttttaaactgtgaagtgaaggtccttgtgctcaagcctgattatacattcaatcgcagcttgaaggcggttggagctgagcgctatcaggagataggatggccaagcatcatccagatttgatcatgtgcagaaagcaacctggaattgcaattggacgcctttgtgagaagtatgatgggaaatgtgtcatctgcgactcttatgttcgtccttgcacccttgttagagtgtgcgatgagtgcaactatggctcctttcagggtaggtgcgtcatctgtggaggagtgggaatatccgacgcttactactgtaaggagtgtacgcagcaggagaaggatagggatgggtgtcccaagattgtcaatttaggaagtgccaaaacagatctattctacgagcggaaaaaatatgggtttaagaaaagataattgatcgtattgattgtatcccttattctcatttcatttgcttgtccatacctggatttgtcgatcgtgcttgtactgatggtgttgtggacagcatgatgtgatcacgtgaggctgcaaataggtctattttcaaagccatgtgtttccaacacattcgttttttttgctcgatgctctgtgaagcaactagtgcattaagttattaaagtttcatcgtgagatgtgctaagg

SEQ ID NO: 2177 - DNA, 894 bp, Eucalyptus grandis
cggggctggaaaggtgccatttttcaggtcggtgattccagagagaggtccctgctgaagccgccgcaccgccggcgacaccgctgacggcgatcttcaccctcccgcgcacgcacatatcagccttggacagagcttcctaccggccaggtttggcagctagaggcttgttgcagagaacatggccaagcatcatcctgatttgatcatgtgcaggaaacagccaggaattgccatcggacgactctgcgagaaatgtgatggcaagtgtgtcgtctgtgattcctacgtccgcccatgcacgcttgtacgcgtgtgtgatgagtgcaactatggttcttttcagggccgctgcgtcatctgtgggggagtgggaatctctgatgcttactactgcaaagagtgcacgcagcaggagaaggacagggatgggtgtccaaaaatcgtcaatctaggaagtgctaaaaccgatctcttctacgaacgcaagaagtatggttttaagaaacggtgatgctcatgcgatgctatgataccggctcaccacaatccaatgatcggctatttcgaagaggattgagttgctatgaaggcggtgggcaaacctgtttagcctaacttgtcagcaatgtaattcagaagcatgtgatggatattgttcttgaaggagatgatactttctgttttggcctctgaattagtcatagtattcaggatttctgtggagtgactatggaaaaatttgagtgtgccatgttctaaaacattattctattttttttttttggtcggttaaaacattattctatttagcagcaacaagaactgatacagacatacactgcttgtttttgctttgttaactaggaacctgaacttgattggggataacaa

SEQ ID NO: 2178 - DNA, 731 bp, Euonymus alatus
gtcccctctgattttgtagcatctcggtgaaacctagatcgccattatcagtcggtgcaggtttctgacgtagtaaggcactaagaaagcttcttgttgctatcatggccaaacatcatcctgatttgattatgtgccggaaacaaccaggaattgctattggacgactttgtgagaaatgtgatgggaagtgtgtaatctgcgactcctatgtgcgaccatgcactcttgtccgaatttgtgatgaatgcaattacgggtcattccagggccgatgtgtcatctgtggaggagtgggaatctctgatgcttattattgcaaagagtgtacgcagcaggagaaggatagagacggatgtccgaagattgttaatctagggagtgccaaaaccgatctcttctatgaacggaaaaagtatgggtttaagaaaagatgatgcacaactctcagtcgttttttgtttgtatacttggatgcaacccactttaaacttgtcaaagctatgttttagataattgattttgtatctgacaattgatgttagaaaacacttgttatttgaaactcttatcagttatgaagcagcctttagcttcctactttccacctgatttagccatgtacttccttctgaatgtaggagcataatttttcaggaggatatttcattttagccatgtacttcctcctggggcttgattgttggtagttatctattcatggtattcac

SEQ ID NO: 2179 - DNA, 646 bp, Euonymus alatus
cccttcgtttctctctgggtcgacgctgattttgtagcttcatccgtgaaacccaagagccattatcagtcgttggaggtgtctagcatagcgaggcactaagagaactttttgtcataatcatggccaaacatcatcctgatttgattatgtgtcggaaacagccaggaattgccattggacgactctgtgagaaatgcgatggaaagtgtgtaatctgcgactcctatgttcgaccctgcactcttgtccgaatttgtgatgaatgcaattacgggtcattccagggccgatgtgtcatctgtggaggagtgggaatctctgatgcttattattgcaaagagtgtacacagcaggagaaggatagagatggatgtccgaagattgttaatctagggagtgccaaaaccgatctcttctacgaacggaagaagtatggctttaagaaaagatgatgaacaactgtatctgtccatgtttgtcacatggatgtgacacactttaaacttgtcaaagctttgctttagataattgaaattgtatctgattatcaggatttagctatttgatctacccagtatggatatgtttgaatgtttaacataattcatgatgatatttcattttatctatgtatttgcttctg

SEQ ID NO: 2180 - DNA, 632 bp, Euonymus alatus
ccttcgtttctctctgggtggacgctgattttgtagcttctccgtgaaacccaagagccattatcagtcgttggaggtgtctagcatagcaaggcactaagagaactttttgtcgtaatcatggccaaacatcatcctgatttgattatgtgccggaaacagccaggaattgcgattggacgactctgtgagaaatgcgatggaaagtgtgtaatctgcgactcctatgttcgaccctgcactcttgtccgaatttgtgatgaatgcaattacgggtcattccagggcagatgtgtcatctgtggaggagtgggaatctctgatgcttattattgcaaagagtgtacacagcaggagaaggatagagatggatgtccgaagattgttaatctagggagtgccaaaaccgatctcttctacgaacggaagaagtatggctttaagaaaagatgatgaacaactgtatctgtccatgtttgtctcatggatgtgacacactttaaacttgtcaaagctttgctttagataattgaaattgtatctgattatcaggatttagctatttgatctgcccagtatggatatgtttgaatgtttaacataattaatgatgatatttcattttatctaag

SEQ ID NO: 2181 - DNA, 562 bp, Flaveria ramosissima
tcatctctctccaatctcccagaaacctcgagtattcgcttttaagctattgcttcatcttcactcaacatcattcattcgctctatcaattgtctccatcttcatcagggtgctatagcttctgctagctgaggaaatcatggcgaaacatcatcctgatttgatcatgtgcaggaagcagccaggaattgccattgggcggctttgtgaaaaatgtgatggcaaatgtgtaatttgtgactcttatgtgcgtccatgcacactcgtgcgtgtctgtgatgagtgcaactatggctccttccagggtcgctgtgtcatatgtggaggtgtgggtatttctgatgcatattactgcaaagagtgcactcaacaggagaaagatagggacgggtgccccaagattgttaatctgggaagtgctaaaactgacctgttttacgagcgccaaaaatatggatttaagaaacgatgataaacaactttttgttctaatcattgtaacatcaagcatgagatgaattatcatctcatatatccaaaataatgcttgtattagagtgc

SEQ ID NO: 2182 - DNA, 589 bp, Linum usitatissimum
ggaagcaagtgaacttgagcttcgaacagtctttcccctttgaaattgggtagctacaatatctgacagagataatcagccatggcaaagcatcatcctgatttaatcatgtgtagaaagcaaccagggatagccattggaagactctgcgagaagtgtgacggtaaatgcgtaatctgtgactcctatgtccggccttgcacgctggtgcgagtctgcgacgaatgcaactacggttccttccagggtcgctgtgttatatgcggaggagtcggtatatttgatgcatactactgcaaggagtgcactcagcaggagaaagatcgggatggctgtccgaagattgtgaatttaggcagtgcaaagactgacttgttctacgaacgaaagaaatacggttttaagaaacgatgatgctcaggctaatcttcatgagggtttagctattattgcgcactctttatcaatggtattgtaatgttgtgccgagtatctgtagttctgatcgcttgttgggtcccgaaactaacgatttttatcaagtcagagaactatcttacacttgaatggattccaaaagtatctgtgt

SEQ ID NO: 2183 - DNA, 570 bp, Fraxinus spp
ggtagctccgagtatcctctcagttatatgcggtgattctctacaacggagtagacattttctctgctataatctaatcctctgcctcagtgaatatttaaggaagtgtcggagagggtatggctaagcatcatcctgacttgattatgtgtcggaaacaaccagggattgccataggaaggctttgtgagaaatgtgatggcaagtgcgtgatatgtgattcctacgtgcgtccttgcacgcttgttcgggtatgcgacgagtgcaattacggatctttccaaggccgttgtgttatctgtggcggggtgggaatttctgatgcctactactgcaaagaatgtactcagcaggaaaaagacacggacggatgcccaaaaattgtcaatttgggtagtgccaaaaccgatctgttttatgaaaggaagaaatatggcttcaagaaaagatgatgctcttttatatggtttgtgatggtcggggtgggagttgtaggcagtcagggtaaacaaccatttcgaaaatattaatgcgtctttgtcgtgctattctgcagtttagatcacattt

SEQ ID NO: 2184 - DNA, 809 bp, Pteridium aquilinum
cacacattgtattgtagtaccttggagaggggtacgtagactcacaagtttagaatgtcggacatgggaggagtaagactagttaaggttagagagagagagagagagagagagagaagagggtctacagacacagacagacagacacgccccacacacatacacacagaggcatggcgaagcatcatcctgacctgataatgtgccgcaagcagccaggcatcgccatagggcgactgtgtgagaagtgcgatggcaagtgcgtcatatgcgactcgtatgtgcgcccctgcacgctcgtgcgtgtctgtgatgagtgcaactatgggtctttccaaggtcgctgcgtcatctgcgggggtgccggcatctccgacgcatactactgcaaagaatgcactcagcaagagaaagacagagatggttgccccaagattgttaacctcggcagtgcaaaaactgacctcttctacgagcgcaagaaatacggcttcaagaaacgataggtcaggctccgttgctcattgttctgcatgtgcctcatatgatggtaggcatgtgaaattgtctgcactgtgtgttttgtgttatagcccatgtgtgggcacacacacatatgtgcagtatgtaatgaccattgataggctgatgaaaagagttacatgacataattaatggtgcaagaagtgcgtctttccataacatttatacgcagggtttggggtatgtactatgactatgcttgtatgctctatgagctctcatttcttatatttctctgagggttgtcgtacccatcttgttaaaaa

SEQ ID NO: 2185 - DNA, 520 bp, Eutrema halophilum
gtcaagacactgttctcgtagctatggcgaagcatcatcctgatttgatcatgtgccggaaacaaccaggcattgccattggaaggctgtgcgaaaaatgcgacgggaaatgcgtgatttgcgattcttacgtgcgtccgtgtacgctagtacgcatatgtgacgaatgcaactacgggtcattccaaggacggtgtgttatatgcggaggtgttggaatctctgatgcttattactgcaaagagtgtacacaacaggagaaagacagagatggttgtcccaagattgtcaaccttgggagtgcgaaaacagatctcttctatgaacgtaagaaatatggattcaagaaacgatgatattgggtttattttgctattgcacgatcctctgattgcttgaactatttgggatctcttattgttatgtgtaaacttatctctgtttactcccattgcttaaaactaatgtgttcctgagaatataaagatattggatacagattcagagattatgctttgtt

SEQ ID NO: 2186 - DNA, 580 bp, Eutrema halophilum
aggtcaaaaaatcttactagaggagcaagaaagttgttttagcagccatggccaagcatcatcctgatttgatcatgtgccggaaacaaccaggcattgccattgggcgattgtgcgagaaatgtgatggcaaatgcgtaatatgcgattcctatgtgcgcccctgtacgctggttaggatttgtgatgaatgcaactatggttcattccagggaaggtgtgtcatatgcggaggggttggaatctcagatgcttactactgcaaagagtgtacacaacaggagaaagatagagatggctgtccgaagattgtcaatcttgggagtgccaaaactgatctcttctatgaacgtaagaaatatggattcaaaaaacgatgattgttgattactcagctattcgttattatccttaggcaagtgtctgtactcgtctgtgttaagagaaatttaggcatggattcaaaaactattgtttgttgctcttgtgtcttattgtttagtcggacgtgctatcttgtttttatggttggttaatgtctttaagtggttttgaagaatgtgattgttcctctgcatca

SEQ ID NO: 2187 - DNA, 452 bp, Eutrema halophilum
aggtcaaagaatcttactagaggagcaagaaagttgttttagcagccatggccaagcatcatcctgatttgatcatgtgccggaaacaaccaggcattgccattgggcgattgtgcgagaaatgtgatggcaaatgcgtaatatgcgattcctatgtgcgcccctgtacgctggttaggatttgtgatgaatgcaactatggttcattccagggaaggtgtgtcatatgcggaggggttggaatctcagatgcttactactgcaaagagtgtacacaacaggagaaagatagagatggctgtccgaagattgtcaatcttgggagtgccaaaactgatctcttctatgaacgtaagaaatatggattcaaaaaacgatgattgttgattactcagttattatcctaggcaagtgtctgtactcgtctgtgttaagagaatttatccgatgaa

SEQ ID NO: 2188 - DNA, 569 bp, Eutrema halophilum
cactgttctcgtagctatggcgaagcatcatcctgatttgatcatgtgccggaaacaaccaggcattgccattggaaggctgtgcgaaaaatgcgacgggaaatgcgtgatttgcgattcttacgtgcgtccgtgtacgctagtacgcatatgtgacgaatgcaactacgggtcattccaaggacggtgtgttatatgcggaggtgttggaatctctgatgcttattactgcaaagagtgtacacaacaggagaaagacagagatggttgtcccaagattgtcaaccttgggagtgcgaaaacagatctcttctatgaacgtaagaaatatggattcaagaaacgatgatattgggtttattttgctattgcacgatcctctgattgcttgaactatttgggatctcttattgttatgtgtaaacttattaatgtgttcctgagaatataaagatattggatacagattcagagattatgctttgttgttcttttatataatctagacttgagtggtctttttttagacttatgttgatgtccaaatagtttcttgcattgtgcattgt

SEQ ID NO: 2189 - DNA, 427 bp, Eutrema parvulum
gtcgaaattttaatagaggaccaagaacgctgtttaagcaaccatggccaagcatcatcctgatttgatcatgtgccggaaacaacctggtattgccattgggcgattgtgcgagaaatgtgatggcaaatgcgtgatttgcgattcctatgtgcgcccctgtacactggttcggatttgtgatgaatgcaactatggttcattccagggacggtgtgtcatatgtggaggggttggaatctcagatgcttactactgcaaagagtgtacacagcaggagaaagatagggatggctgtccgaagattgttaatcttgggagtgcgaaaactgacctgttctacgaacgtaagaaatatggattcaagaaacgatgattgttgattactcagctattcattatgctaggtaattgtctgtactcgtct

SEQ ID NO: 2190 - DNA, 651 bp, Eutrema parvulum
tgcttctttcattcaccttcttccttcatctttggcgctctggaaatttctcgtggctaagtttcttctttgattggctcaagtttgatctcccttgacttgtaagtcactgtttgactagccatggcaaagcatcaccctgatctcatcatgtgtcggaaacaacccggcattgccattggacgcttgtgcgagaaatgcgacgggaaatgcgtgatttgtgattcttacgtgcgtccgtgtactctggttcgtatttgtgacgaatgcaactacgggtcattccaaggccggtgtgtgatatgcggaggagttgggatctcggatgcttattactgcaaagagtgtacgcaacaggagaaagatagagatggttgccccaagattgtcaaccttgggagtgcgaaaaccgatttgttctatgaacgtaagaaatatggattcaaaaaacgatgatatgggtaattctcgattgcatgatcctttgattgcttgaactattttggatctcttctgctatgtgtaaactttgtctgttgacctcccgttgcataaaactaatatgttgcagagattctaaagatattggatacaaaaccagaaactatgctattgttcttgatcatctatacttgagtggtctttagtaga

SEQ ID NO: 2191 - DNA, 553 bp, Eutrema parvulum
caggtcgaaattttaatagaggaccaagaacgctgtttaagcaaccatggccaagcatcatcctgatttgatcatgtgccggaaacaacctggtattgccattgggcgattgtgcgagaaatgtgatggcaaatgcgtgatttgcgattcctatgtgcgcccctgtacactggttcggatttgtgatgaatgcaactatggttcattccagggacggtgtgtcatatgtggaggggttggaatctcagatgcttactactgcaaagagtgtacacagcaggagaaagatagggatggctgtccgaagattgttaatcttgggagtgcgaaaactgacctgttctacgaacgtaagaaatatggattcaagaaacgatgattgttgattactcagctattcattatgctaggtaattgtctgtactcgtgtttaggcatggattcaaagaaaagactattgtatcttactcttgtgtcttattgattaagcggatgtgttatcttggttaatgtctctaagtgattgtgagaatgtaattattcctctgcaaca

SEQ ID NO: 2192 - DNA, 672 bp, Tripterygium wilfordii
gttcaacgttatttacaagatttttttctgtctcggatcatatagtggttgattgaacattcatttgaaacagtgaactgaatatatctcttatacaattttcctgtctctgacttttggtatgaattgtgtcactgttgaattttttctgtttctgtaggtttctaaggtattaaaagcttcttgttgctatcatggccaaacatcatcctgatttgattatgtgccggaaacagccaggcattgccattggacgactttgtgagaaatgcgatggaaaatgcgtaatctgcgactcctatgtgcgaccctgtactcttgtccgaatttgtgatgaatgcaattacgggtcattccagggccgatgtgtcatctgcggaggagtgggaatctctgatgcttattattgcaaagagtgtacacaacaggagaaggatagagatggatgtccaaagattgttaatctagggagtgccaaaaccgatcttttctacgaacggaagaagtatgggtttaagaaaagatgatgaacaactctctgtctgtccatgtttgtcacatggatgtgaccttgtcaaagatgtgctttagataattgatcttgtatccgactatcattgttggaaaaacactcgctatttgaaactcctatcggttataaaacagcattta

SEQ ID NO: 2193 - DNA, 711 bp, Linum usitatissimum
cccgcaaaaaacgaggagaagcaagtgcgcaagtgaacttgagcttcgaacagtctttccctttgaattgggcaagtctgtcgtatcagacagccataatcagccatggcaaagcatcatcctgatttgatcatgtgcagaaagcaaccagggatagccattggaagactctgcgagaagtgtgacggtaaatgtgtaatttgcgactcctatgtccgtccttgcacgctggtgcgagtttgcgacgagtgcaactacggttccttccagggtcgctgtgttatctgcggaggagtgggtatatttgatgcatactactgcaaggagtgcacgcagcaggagaaagatcgggatggctgtccgaagattgtgaatttaggcagtgcgaagacagacttgttctacgaacggaagaaatacggttttaagaaacgatgatgatcatcgaggaggaatatttattttacttttgtattggttgaccttgcttatgatgtaatgttgtgccgagtatctgtagttttgatccgacacttgttggccccaaaactaacgattttatcaagtcagagaactatcgtgacacttgaatggattctacagtatatctgcttcagtgattgcttctctttgtatataggactgctagtgaatctatatgggtacgtagtcgaacagacaattatcgtcctaccgaaaaaaaaaaaaaga

SEQ ID NO: 2194 - DNA, 712 bp, Arabidopsis lyrata
ggggcacataagaatttgatcccacacctttgtgacaacgcctcggcgctctggaactttctcgtcgcaacattctcttgactggctcaagtttgacctcctgttaattgagcactgttttggtagctatggcgaagcatcaccctgatttgatcatgtgccggaaacaacccggaattgccataggaagactgtgtgagaaatgcgacgggaaatgcgtgatatgtgattcttacgtgcgtccgtgtactctggtacgtatttgtgatgaatgcaactacgggtcattccaaggtcggtgtgttatatgcggaggggttggaatctcagatgcttattactgcaaagagtgtacgcaacaagagaaagacagagatggttgtcccaagattgttaaccttgggagtgcgaaaaccgatctgttctatgaacggaagaaatacggattcaaaaaacgatgatcaatgtatggggggggttttcccgattactggatttcttatactactatgtctgttgcataaaactaaatatgtattcatcatacattatgctttcttattcttgataatctagacttgagttgtctttattggacttatcttagtgtccaaatagtctcttgcattgtgtatcgtgtttgatttcggctgtgtttgcaagtcgcaaacagagtaactattttagcaaagaatttattgttctcagttca

SEQ ID NO: 2195 - DNA, 608 bp, Arabidopsis thaliana
agagccatctcttgttcggatcggcggctcggagatcagggatcgctagttcagacaccttctcttcttcttcgttctccttcgaggtcaaaatcttcttaatcgaggaagagcaagatcttctttaagcagtcatggccaagcatcatcctgatttgatcatgtgccggaaacaacctggcattgctattgggcgactgtgcgagaagtgtgatggaaaatgcgtcatatgtgattcctatgtccgcccgtgtactctggttaggatttgcgatgaatgcaactatggttcgttccaagggcggtgtgtcatatgcggaggagttggaatctcggatgcttactactgcaaagagtgtacacaacaggagaaagatagagatggttgtcctaagatagtcaatcttggcagtgccaaaactgatctgttctatgaacgtaagaaatatggattcaaaaaacgatagtagtttgttgttacttgagctattgatcttttatttattgatgctaggaaagtgtctgtacttgtcttgtttgtgttaaggaaattttatccggtgaagtaatttaagacatgggttcaaactaaggattatggtttgttg

SEQ ID NO: 2196 - DNA, 642 bp, Arabidopsis thaliana
attgctctttttgcttcgtcgtcgatcttggcgctctggaaatttctcgtcgcaacgttcttctctattggctcaagttagatctccctttacttgtatcaaacactgttccagtaagccatggcgaagcatcaccctgatttgatcatgtgccggaaacaacccggaattgctattggacgactgtgtgagaaatgcgatgggaaatgcgtgatttgtgattcttatgtgcgtccgtgtactctagtacgtatttgtgatgaatgcaactacgggtcattccaaggtcggtgtgttatatgcggtggcgttggaatctcagatgcttattactgcaaagagtgtacacagcaggagaaagacagagatggttgccccaagattgttaaccttggcagtgcgaaaaccgatctcttctatgaacgcaagaaatacggattcaaaaaacgatgatagttcggtatttcgtgatttgtacggtcctttgattacttgatttggatctcttatgctatgtgtaaacttgtttgttgacccccgttgcataaaacatatattccaataaaacctgaagatattggatacaaaacctaagttatgctttgttttatgattttcttaagttacacatgtttctctcga

SEQ ID NO: 2197 - DNA, 567 bp, Bruguiera gymnorhiza
gctaaaaaagaccagtgctctgaaggaagcgattgttctggaaagaaccagagagcataggagattgaaggtgaaggaaactcgtatttgagtaacgggaaagaatggcaaaacatcaccctgatctgattatgtgccgaaagcaaccaggaattgccattggacggctctgtgagaaggatgatggtaagtgcgtaatttgtgattcttatgtgcgtccttgcacattggtgcgtgtctgcgacgagtgcaactacggatcgttccaagggcgctgtgttatctgtggaggagttggtatttctgatgcatattactgcaaagagtgcactcaacaggaaaaagacagagatgggtgtcctaagattgtgaatttgggaagtgctaaaacagatctattttatgaaaggaagaaatatggcttcaagaagagatgagatgtagattcatgcactgaagcttgcataaaggtgtttgtaagaagtactatccctaatggtaggcttctcttgttgcacggcagttgggttgattgggttagagcaatcgttatgttgttttttaatt

SEQ ID NO: 2198 - DNA, 663 bp, Brassica napus
gcggagggcccaaatatatctccccgcgtccgctagccctatccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatctcggaagcgccaagacggatctcttctatgagcgcaagaagtatggttttaagaagagatgaccgagaagatggagctgtgtgtggttcactttggctgtgtggtctgttctatggcactgaatactgagagtaggcagctgagacagcagctttgtattcctgttatggtttgataattgatactcgcatggaaatacagctgtgatatgcgttgtaataactaagtccaactgtatgatgccagagactgcttatgtaatctgtgcttgatggc

SEQ ID NO: 2199 - DNA, 334 bp, Ricinus communis
catggccaagcatcatcctgatttaatcatgtgtcggaaggagccaggaattgccatcggacgactttgtgagaaatgtgatgggaaatgtgtaatatgcgactcttatgtgcgtccttgcacgctagtgcgggtttgtgacgagtgcaattacgggtccttccaaggtcggtgcgttatatgtgggggagtgggtatatctgatgcttactattgcaaagagtgcacccagcaggagaaagacagggatgggtgtcctaaaattgttaacttagggagtgcgaagacagatctgttctatgaacgtaagaaatatggattcaagaaaagatga

SEQ ID NO: 2200 - DNA, 368 bp, Ricinus communis
gaccttgaagcatggccaagcatcatcctgatttaatcatgtgtcggaaggagccaggaattgccatcggacgactttgtgagaaatgtgatgggaaatgtgtaatatgcgactcttatgtgcgtccttgcacgctagtgcgggtttgtgacgagtgcaattacgggtccttccaaggtcggtgcgttatatgtgggggagtgggtatatctgatgcttactattgcaaagagtgcacccagcaggagaaagacagggatgggtgtcctaaaattgttaacttagggagtgcgaagacagatctgttctatgaacgtaagaaatatggattcaagaaaagatgataagttagtagtgtactaactgta

SEQ ID NO: 2201 - DNA, 638 bp, Cichorium intybus
cattggcgggggtatgatcgttatctttgtactcgctgtcgacggtgcctcaaaattgggtttcttcgtggacatatcagtcttcatcaggttgtggtatcttacagttaaaaagttattgttggggaagcaatggcgaagcatcatcccgatttgatcatgtgtagaaagcaaccaggaattgcaattggaaggctctgtgaaaaatgtgatggaaagtgtgtgatctgtgactcttatgtgcgtccatgtactcttgtacgggtctgtgatgagtgcaattacgggtcgtttcagggtcgttgtgttatttgtggaggtgttggtatttcagatgcgtactattgcaaagagtgtacacagcaggagaaagatcgagatgggtgcccaaaaattgtgaatttaggtagcgtaaaaacggatctgttttatgaacggaaaaaatatgggtttaagaaaagatgatctagaaactgatttgtgggttatcctatattgtttgtagacattaacagtttgtatacattggatgatttggtcgcatggagtcttgttggttcttatactgcttgatcctcttgagtaccttgtgcacgtggtttgttgtattaattcaatacttcttttttattggtcct

SEQ ID NO: 2202 - DNA, 618 bp, Cleome gynandra
gcgaccgaccgaccgaccggcttgttcattgcgcccgtctcctcctttttggttccaacgtacgttcgggaaatctctcgtccctgatcgtcgaaaacgttcatcttcttctccggctcaggtctaaaaccataacagaggaccaaagacagttgtagggaccatggccaagcatcaccctgatttgatcatgtgccgtaaacaacctggcattgccattggacgattgtgcgagaaatgcgacggaaaatgtgtgatttgtgattcttatgtccgcccatgtactctggtacgtatttgtgacgaatgcaattacgggtccttccagggacggtgtgttatatgtggaggcgtaggaatctcagatgcttactactgcaaagagtgtacgcaacaggaaaaagatagggacggctgtcccaagattgttaatctgggaagtgcgaaaactgatttgttttacgaacgtaagaaatatggatttaagaaaagatgattggtggtcttgttcttgcacgtccattgcaatccgaccaaaccaatcttatatgtttggtcagtacagaaatccgaaccattaaggtttccataaaaggctgatgatattatgtttctatt

SEQ ID NO: 2203 - DNA, 1047 bp, Coffea canephora
cggccgggggaaaagcctagtaaatatttaattatgaatctctttcatagaaagaaagaaataaagcccagtttctaatctgttatgggctcttctgtcggttgagtttacgggtcaaaacatccgacctgattcaccagtttaggaatcaggaggcggagcctaacctagacttttgtttttcggatacggttcaagttactatccattccattgcgtattctatagtcgggcctctgtgttcacgcaccttgacagattagcagctgccttcctcaatcttccagctgatagataattcgggacttgctgacggaggcgtgccttttccgtcggaaactctccatagcattcttgctgggacgaggttactaattggatttgggatctgggatttatctgttgaaaacatggccaagcatcatcctgatttgattatgtgcaggaagcagccggggatagccattggacggctttgtgaaaaatgtgacggaaagtgtgtagtctgtgattcttatgtgcgcccttgcacgctggtccgagtttgtgatgagtgcaactacggatcatttcagggtcgctgtgtcatctgtggaggagtgggaatctctgatgcctactactgtaaagagtgtacccaacaagagaaagatcgggatgggtgtcctaaaatcgttaatcttggaagtgctaagacagatttgttttatgagcgtaagaaatatggcttcaagaaaagatagaaggtataggttcatcattgcttcactaattgggggtgtattggaattgtggtactactgtaagatagaagtgcaaaatcatatctttatatctacttttgtgggaagtaaatgatctgaaatttctctctctatagtatgcaatctctgtctaggccttgcaaaagctgaacttcctttccggctggtaattctctgaagtttgttcactttataaacagctaacggttttttaggtttgatgtttcttatggtgtatcaacaacttatcgcacttgatattgttatggataggtgtattccg

SEQ ID NO: 2204 - DNA, 594 bp, Cynara scolymus
  misc_feature (54)..(54): n is a, c, g, or t
  misc_feature (209)..(209): n is a, c, g, or t
  misc_feature (507)..(507): n is a, c, g, or t
atcccattttgtggccttacaagggatcgcgttatcctgtaatctttcttctgncgactgtctcactgttcatcaggctattatagtttcagggagttgagagcctgttgaggaaatcatggccaagcatcatcctgatttgatcatgtgcaggaagcaaccaggaatcgccattggccggctttgtgaaaaatgcgatggcaagtgtntaatttgcgactcttatgtgcgtccatgtacacttgtgcgtgtgtgcgatgagtgcaactatgggtcctttcaaggtcgctgtgttatatgtggaggtgtgggtatttccgacgcctattactgcaaagagtgcacacagcaggagaaagatagagatgggtgcccgaagatcgtcaatttggggagtgctaaaacggatctgttctatgaacgtaaaaaatatggatttaagaaacgataatgagtacatttttcttcgaatggttgtagttgaagatgatatcaatttttcacagntgatgtaaaacaccttgaccatttgaactcggagttagaatttgtgtatttgattgtgtcggtatgttttatgccttttcttttttc

SEQ ID NO: 2205 - DNA, 584 bp, Adiantum capillus-veneris
cagcacacgcggggcaagcaggcactcacgagcagccatggcgaagcatcatcctgatctgataatgtgtcgcaagcagccgggcatcgctatagggcgactctgcgagaagtgcgatggcaagtgcgtgatttgcgattcgtacgtgcgcccctgtactctggttcgagtgtgcgatgagtgcaattatggctccttccaagggcgctgcgtcatctgcggaggtgctggcatttctgatgcttactactgcaaagagtgcacccagcaggagaaggatagagatggttgccccaaaattgtgaaccttggcagtgccaaaactgatttgttctatgaacgtaagaagtatggtttcaaaaaaagataggtcagtgcaagctcgcaaccttctgctttgtcgtgccttatgaggttggggtgctgcatacatacagctgaaatgtgtcatgcttattgtgggctatgatagcatgttcttgcagatgtaagagtgcaaagaatgacactttttaattgtgaggtttgcacccattcagatagacatactgtattgatgttaaattatctcctattgctggtgg

SEQ ID NO: 2206 - DNA, 546 bp, Festuca arundinacea
ggcacgaggcgccgccgccgccccgcgagacctagccgagctcagcctgcctcctctccgtcgtctcgtcgtcgccgcgaggagcacggagcggcacaccgccacagcgagctcatcctctcgaaggttagcacctgacagccatggcgaaacatcatcccgatctcatcatgtgccggaagcagcctggcattgcgattggtcgcttgtgtgagaagtgtgatggcaagtgcgtcgtttgtgactcgtacgtacgcccatgtacacttgtccgggtctgcgatgagtgcaactatggctcattccagggaaggtgtgtcatctgtggtggagttggcatctcagatgcctactactgcaaggagtgtacacagcaggagaaggaccgagatggatgtccgaagatcgtcaatctaggaagtgccaagactgatctcttctacgagcgtaagaagtatggttttaagaagagatgaatgacatggatatgccaggtcctcggcctggcatttgtgctgttatgaggcgagaacatccctgatatgt

SEQ ID NO: 2207 - DNA, 622 bp, Setaria italica
tccacctcttctttcaccgtttctcaggtttgcatcctacagccatggcaaagcaccaccccgatctcatcatgtgccggaagcagcccggcatcgccatcgggcggctgtgcgagaagtgcgacggcaagtgcgtcatctgcgactcgtacgtgcggccgtgcacgctggtccgcgtatgcgacgagtgcaactatgggtcattccaggggcggtgtgttatctgcggtggtgtgggcatctcggacgcctactactgcaaggagtgcacccagcaggagaaggaccgggatggttgccccaagatcgtcaacctcggtagcgccaagactgatctgtcctacgagcgcaagaagtatgggttcaagaagaggtgatggagaagatggtgctgtcaggttcgtttggcctcttgttgagttgtgtccatcgataccgggagtaggatttagtggtagtagctttgctttcgcaaaatgttaatggtggtgatggatggtggcttgaaatgtgaactgaaatgtgctttttctgccccataatttgcatctgatttctggtaactgatgtatggctgtcatatgggaaacaaaagattaccttatgaattgcagttgagcaa

SEQ ID NO: 2208 - DNA, 1260 bp, Eragrostis curvula
  misc_feature (4)..(4): n is a, c, g, or t
  misc_feature (6)..(6): n is a, c, g, or t
  misc_feature (9)..(9): n is a, c, g, or t
  misc_feature (232)..(232): n is a, c, g, or t
  misc_feature (740)..(740): n is a, c, g, or t
  misc_feature (742)..(742): n is a, c, g, or t
  misc_feature (745)..(746): n is a, c, g, or t
  misc_feature (749)..(753): n is a, c, g, or t
  misc_feature (755)..(756): n is a, c, g, or t
  misc_feature (759)..(765): n is a, c, g, or t
  misc_feature (767)..(767): n is a, c, g, or t
  misc_feature (769)..(774): n is a, c, g, or t
  misc_feature (776)..(776): n is a, c, g, or t
  misc_feature (778)..(779): n is a, c, g, or t
  misc_feature (781)..(782): n is a, c, g, or t
  misc_feature (785)..(788): n is a, c, g, or t
  misc_feature (793)..(793): n is a, c, g, or t
  misc_feature (795)..(798): n is a, c, g, or t
  misc_feature (801)..(805): n is a, c, g, or t
  misc_feature (807)..(808): n is a, c, g, or t
  misc_feature (810)..(814): n is a, c, g, or t
  misc_feature (817)..(822): n is a, c, g, or t
  misc_feature (825)..(827): n is a, c, g, or t
  misc_feature (829)..(830): n is a, c, g, or t
  misc_feature (832)..(836): n is a, c, g, or t
  misc_feature (838)..(838): n is a, c, g, or t
  misc_feature (845)..(845): n is a, c, g, or t
  misc_feature (872)..(872): n is a, c, g, or t
  misc_feature (877)..(877): n is a, c, g, or t
  misc_feature (1014)..(1014): n is a, c, g, or t
gggncnaanatatctcgccgcgaccgcaagccctagccgccggcagctgccttcctcgtcgccgttgtccggagctctcggcgcttcgcctgcgaggagccattcccgtggcgcatccctctgtaggaggctagcatttgacagctatggcaaagcatcatcctgatctcatcatgtgccggaagcagcctggcattgctatcggtcgcctatgtgagaaatgtgatggaangtgtgtcatctgcgactcatacgtgcgcccatgtacgcttgtccgggtctgcgatgaatgcaactatggttcattccagggaaggtgtgttatctgcggaggcgttggcatctcagacgcttactactgcaaggagtgtacgcagcaggagaaggaccgagatggatgtccaaagattgtcaaccttggaagtgccaagactgatctcttctacgagcgtaagaagtatggttttaagaagagatgattgggacgatggttttgtaaggttgtattggcctcatgtaacgttctgttatcctgatgcctattgagagagcattgtaatcatgctatgatttaatactgatatgaggatacccctgatagtctctgtattaagaatgatgcctgtgatgctatctgtaataactaatcatgttgtgtaataactaaacgtgatactgtgagactctaaatacctgctcatgttcaatgaccaaaaaaaaaaaaaaaaaaaaaaaaaaanantcnncgnnnnnannacnnnnnnntnannnnnncncnncnnccnnnngggcngnnnnaannnnncnncnnnnnccnnnnnnccnnnanngnnnnnantaaattncccgggccgcccttttaaaaaagagancgtcnggtttgtgggtgggcggcgcgggtagatagaaacaaggccgccccccggggggcgggaggggacaaaacgacaacatactcgccctcataagactggatggaatatttgcggctgccgctcaaaaaaaaaaaaaagngggggggacgggcgaggaacctcgaatagactaatgtcctgagtacacaggatagccctgaaaaaggacacacaagatcaaactttaattcaaatcggatgggcatatgattacacacaatttccaagaaagaacacggaattcaccggtcgtagatacaaatactagtaaattttttacaaaaggaatcacagcagcaactacttatatataaatgtcagatcgctcagctccttaaaccgctcc

SEQ ID NO: 2209 - DNA, 831 bp, Zea mays
cgcgtagttgacagccgtccgattggaatgagtcccggttttggacggagtgggcgagtggcatctttcttctataagcttctagcagcatccgccaccgccgcggaggcccaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatctcggaagcgccaagacggatctcttctatgagcgcaagaagtatggttttaagaagagatgaccgagaagatggagctgtgtgtggttcactttggctgtgtggtctgttctatggcactgaatactgagagtaggcagctgagacagcagctttgtattcctgttatggtttgataattgatactcgcatggaaatacagctgtgatatgcgttgtaataactaagtccaactgtatgatgcaagagactgcttatgtaatctgtgcttgatggtaatggttatgaatggacttgaaatattggcacgatagctgtcatcatatatgttactgctctaagaa

SEQ ID NO: 2210 - DNA, 767 bp, Zea mays
aaccagaccttattccctcccctcccctcccctccctttctcccctgactcctgctctactggatcctccgcctccatcgcctctcgcgcctccatcgacctcggcgcctcgtccgtcctgctccacctcttcttacgccgggttaacatttgaggcatggcgaaacaccacccggacctgatcatgtgccggaagcagcccggcatcgccatcgggcggctgtgcgagaagtgcgacggcaagtgcgtcgtctgcgactcgtacgtgcggccgtgcacgctggtccgcgtctgcgacgagtgcaactacgggtcgttccaggggcggtgcgtcatctgcggcggcgtgggcatctcggacgcctactactgcaaggagtgcacgcagcaggagaaggaccgggacgggtgccccaagatcgtcaacctcggtagcgccaagaccgacctcttctacgagcgcaagaagtacgggttcaagaagaggtgacggatcagtcagttgagcatccgtgatgtgcttctcgtggttctgtgtctgagcagcgtagcgtgactgatcatatgggcacacaatgcagttgtgtaccatgtgcatgtatgtgttcagaaaattttctgttgacagattgaagctggagagtacgctcaagtttgacactgttacgtattctcttttttttaccgtatcactcatctactctcctgatacaagacatttgggcaagtttgtttggatactaaggataacttattgcacaaatcaa

SEQ ID NO: 2211 - DNA, 705 bp, Medicago truncatula
atcctctttcctccaaacccttccttcttcattctctcacgcagaaaagaagtttcttcagcttcaacaagaaccctcagcctctagcagtttgttgaaagtatggccaagcatcatcctgatttgatcatgtgccgtaagaccccaggaatagccattggacgattatgtgagaaatgtgatggtaagtgtgtgatatgcgactcttacgtgcgtccatgtaccctcgtccgggtatgtgatgaatgcaactacggatcatttcagggtcgatgtgttatatgcggaggagtaggaatatctgatgcttactactgcaaggaatgcacacagcaggagaaagatagggatggttgccccaaaattgttaatttaggaagtgccaagactgatttgttctatgaacgcaaaaaatatggttttaagaaaaggtgatgagaagagattcaacattttgtatttctgtcaaacttttgtactaaatgtatgttttgctcggttattagaacaatgagcacttgtgcatcgaaacttttatttgatacaatttgttgtcaatttaagtgatcatagcatatgaatggcaatgaagtaccaacttgaactacaactgaaccattactctttgtttgaatttttttggtgaacacatggttcctcctaccaatggaaatcaataattgttggtgtttgttttggtttttt

SEQ ID NO: 2212 - DNA, 954 bp, Pennisetum glaucum
cggccgttccgctccacctcttctttcaccgtttctcaggtttgcatccaacagccatggcaaagcaccaccctgatctcatcatgtgccggaagcagccaggcatcgccatcgggcggctgtgcgagaagtgtgacggcaagtgcgtggtctgcgactcgtacgtgcggccgtgcacgctggtccgcgtctgcgacgagtgcaactatgggtcgttccagggccggtgcgttatctgcggcggcgtgggcatctcagatgcctactactgcaaggagtgcacccagcaggagaaggaccgggatgggtgccccaagatagtcaacctcggtagcgccaagactgatctgttctacgagcgcaagaagtacggattcaagaagaggtgatggagaagatggtgctgtcaggttcgcttggcctcttgatgagttgtgtccgtgataccgggggtaggatttagtggtagtggctttgctttcatattgttaatggtggcgatggagggtggcttgaaatgtgaactgaaatgctttttctgccccataattttcatctgattcgggtaactgatgtatggctgtcatatgggaaacaaaagattagcatatgaattgcagttgagcatgcctgatttgcttgacacggtgcaatctattagctggaagtaacctgattaatgaatgagaatatggctcagaatgtaccatgtttatgtttcagaactgtggcaaggagaagcaagttttgcagtcaggaatgacacagtatcacctttttgaaatatatgaaatcaccatcatgaaataggcatcggaccagtgattcccttaatcaactcctctgatgcaagaaatggggagtcagggattcattcatcctaaacccagtttctcaaatgtacaaggcaaatccggaggtcatatttgtgacaagttttcttggatagcaact

SEQ ID NO: 2213 - DNA, 711 bp, Mimulus guttatus
aatactcgcaattacaaactcgtctgcctactgccctttccctcctcggaaaattctctggaagttgtgcacaaatttctcaaatacaaaggtttcgctgcagattgctgaggaacactttttttttttccttattgaagaaactgaggaacacttaaggttcttgaaaaactatggcgaaacatcatcctgatctgattatgtgcagaaagcagcccggaattgcaatcgggcgcctttgcgagaaatgcgatggcaaatgtgtaatttgcgattcctacgtacgcccttgcactctagttcgagtttgtgacgagtgcaattacgggtcatttcaaggtcgttgcgtcatatgcggaggtccgggcatttcagatgcgtactattgcaaagagtgcacgcagcaagaaaaagatagggatggctgtccgaagatagtcaatctcgggagtgctaaaactgacctattctacgaacgcaaaaaatacggttttaaaaagagatgattttattctgagggtggaatttattttcgtggatttgtatacttctaagggtgttgtattttgttttgtactatgaacttcatgtcgaaggaggtgatattcgtaggtaacgaaagatagttaggatttttcgtattttcgtattttcttattttcagggagttaattattatgtgctacaagtcagcccttatttttcttatta

SEQ ID NO: 2214 - DNA, 640 bp, Avena sativa
ccgtcgtctcgtcgtcgccgcgaggagcacggagcgacacaccgccacagcgagggcatcctctcgaaggttagtacgtgacagccatggcgaaacatcatcctgatctcatcatgtgccgcaagcagcctggtattgctattggtcgcttgtgtgagaagtgtgatggcaagtgcgtcgtttgtgactcgtacgtgcgcccatgtacgcttgtccgcgtctgcgacgagtgcaactacggctcattccagggaaggtgtgtcatctgcggtggagttggcatctcagatgcctactactgcaaagagtgtacacagcaggagaaggaccgagatggatgtcctaagattgtcaatctagggagcgccaagactgatctcttctatgagcgtaagaagtatggttttaagaagcgatgaatgacatgcgcttgtgaggttatctgggctatgttgcacaaatgccaagagcagctgaagcaacggcattgtattcgtgtcatgagtcgatacaaatactgtatgtccctgatatgttgtgtaataattgtttatgttgtatggtcgaaactctagactgctgagatggccttgatgtttatgaccatgaatgttatgttgcacaaatgcacttgatgttt

SEQ ID NO: 2215 - DNA, 1251 bp, Rhizophora mangle
actcttcgagcgaagccgagaaatcaaagaaaagatctgtagtggtgaagcaagttctggaaagaaccagggaggattggatattaaaggaaattcttatttggaactaagaaagaatggccaaacatcatcccgacttgattatgtgccggaagcagcctggaattgccattggacggctgtgcgagaaggatgatggtaagtgcgtgatctgtgattcttatgtgcgtccttgcacattggtgcgggtctgtgatgaatgtaactatggatcatttcaagggcgctgtgttatctgtggaggagttggtatttctgatgcatattactgcaaagagtgcactcaacaagaaaaggacagagacgggtgccccaaaattgtgaatttggggtctgctaaaacagatctattttatgaaagaaagaaatatggatttaagaagagatgagaagtagagataagcattgttacagattgcttgcagctggcataaagttatttacatgcagtatccactcttattgctaggcttgtctagcaagttgtaggagttgggttgatggcccaccccgatttcaggagaaagcagaattcttgctacagtgtttaccaggaacgttggtggttattatcaaacgtggaaataatatgaaacagtcagttggaaacccaagtgtttattgcaagctcacactgggaaataccccgccaaggcaaacaaatgttgtatctactggtccaaatccagagtgggatgagagctttgcttggacctttgagagtcctccaaaaggccagaagcttcatatctcatgcaaaaataggagcaaaatgggaaagaaatcgttcggaaaagtaacaattcagattgatcgggttgtaatgctgggagcagttgctggggagtacactctgttgcctgaaagcaaaagcggggcctcaagaaatctggaaatagagttccagtggtctaacaagtagtaactgttaatgaaccagcaattacacaaagtggaaaattgagttatgcaattgtttttttaacactctcctgtcatttttgctttccaaattgggttatttatctcgtcggtgtaaatatctttgcgagagattgtgttgtagatgttttgccttaaaatcaggccatttgttcagatgcattcttttgtaacctagttttcccttcgattcttttgcctggaatgaaccgtatgaacaaacagtaaaaagctctctgtaacttttgt

SEQ ID NO: 2216 - DNA, 807 bp, Triphysaria pusilla
tgagctcgccataaatttccctaaatttgaccaagtatatgccccttcttcctttctatacctatttactctcaagcgcggaaagcttccagagcctgtgattcaaatatcttaggtttttgcttgaattggtgtgcggcgctttctagaacaatggcgaaacatcatcctgatctgatcatgtgccgaaagcagcctggaattgcgatcgggcgtctttgcgagaaatgcgatggaaaatgtgtcatttgcgactcgtatgttcgcccctgcaccctcgttcgagtgtgtgacgaatgcaactacgggtcatttcaaggtcgctgtgtcatctgtggaggtaacgggatttctgatgcgtactattgcaaggagtgcacgcagcaagaaaaagatcgggacgggtgcccgaagatagtcaatctcgggagtgcgaaaacggatctattttacgagcgcaagaagtatggttttaaaaagagatgatcctccaaggtatgttttagaagcttttacttaatttgaaggatattggattttgtggtgtatgagtttttcattttggggtgagaagttgtttaatctgcttaatgatagatatacgaatgtctatggtatatgcatgttaaaaccctcagcccttttcttgttttctttctattaatctgttcgaatgtgatgatataatcattacgtatgtctatgatgtatgcactatgcatgttaaaacccttctctcttttcgtgttttttattctttttattaatctgttcaaatttggtgattacaaaaaaaaaaaaaaaaaa

SEQ ID NO: 2217 - DNA, 779 bp, Triphysaria pusilla
cggaaataccgccattacgtgccggagaaattataaatagttgcccccttcttccttctattcctatttactctccagagcctgtgattcaaatttctcaaatagcttaggtgagtgttttttgttgttgaattctacacagcaacagacatctgcacatttaactggcctcatcgttcactcgactaattttttattgtgtgtgatttcttagggtttggcttgaattggtgtgcgacgcttgcttaaggaaatcacccatttgaagaacaatggccaagcatcatccagatctgatcatgtgccgaaagcagcctggaattgcgatcggccatctctgcgagaaatgcgatggaaaatgtgtgatttgcgactcgtatgtgcggccctgcaccctcgttcgagtttgtgacgaatgcaactatggatcgtttcaaggtcgctgcgtcatctgtggaggtgtcgggatttctgatgcgtactattgcaaggagtgcacgcagcaagaaaaagatcgggacgggtgcccgaagatagtcaatcttgggagtgcgaaaacggatctattttacgagcggaaaaagtatggttttaaaaagagatgatcctccacgctaagttttagaagctttaacttattttgaaggatattgggttttgtggtgttaagagtttttcattttgggggtgagatattgttttctctgcttaacgatacatatacttatgtctgatatatgcatgttaacaaccttagccatttttctgttttttttctt

SEQ ID NO: 2218 - DNA, 502 bp, Fraxinus spp
acattgcactgatttctgctcaacttcttcatcgacgaaattggacgtgaatatttcaaggaagcgtcgaagagggtatggctaagcatcatcctgacttgattatgtgtcggaagcaaccagggatagccataggaaggctttgtgagaaatgcgatggtaagtgcgtgatatgtgattcctacgtgcgtccttgcacccttgtgcgggtatgtgatgagtgcaattatggatctttccaaggccgttgcgttatctgtggagggtggggatttctgatgcctactactgcaaagaatgtactcagcaggaaaaagaccgggacggatgccccaaaattgtcaatttgggcagtgccaaaactgatttattctatgaacgaaagaaatatggattcaagaaaagatgatgcctttcaatagggtttttggtcgaggattaggccgtgttaaactattctgttaccattttatatcactattctagtatttgtagtaaacac

SEQ ID NO: 2219 - DNA, 517 bp, Brassica napus
gaagtcaggtcccaaagagacttgtttcagcagacatggctaagcatcatcctgatttgatcatgtgccggaaacaacctggcattgccattggccgattgtgcgagaaatgtgatggcaaatgcgtggtctgcgattcctacgtgcgcccgtgtacgctggttcggatttgtgatgaatgcaactatggttcgttccaaggacggtgtgtcatatgcggaggtgttgggatctcagatgcttactactgcaaagagtgtacacagcaggagaaagatagagatggttgtcccaagattgtcaatctcgggagtgcgaagactgatctgttctatgaacgtaaaaaatatggattcaagaaacgatgacaagtgtctctgtactcgtctttgtttaggcatgaactcaaagaaacaaatgtttgttagttgttactcttgtgtcttatttagctggacgtgctatctttgttctggttggataatgtctagaatgtgattgttcctctgcaacacta

SEQ ID NO: 2220 - DNA, 439 bp, Cephalotaxus harringtonia
tagcagtcaactatggccaagcatcatcctgatctcattatgtgccgaaagcagccaggaattgcgataggtcgactttgtgagaaatgtgatggtaaatgtgtaatttgtgattcttatgtgcgaccttgtacccttgttcgagtgtgtgatgaatgcaactatggatcctaccagggaaggtgtgtgatttgtggtggattaggcatttctgatgcatattactgcaaggaatgcacacagcaggagaaagatagggatggatgcccaaaaattgttaatcttggaagtgcaaaaacagatctattttatgaacggaagaaatatggtttcaagaagagatagtttcagggatcatccgcagcactgatgtattgatcattgtagtccatgctttatattatattctaggctgtacactggaatacttgtagttttc

SEQ ID NO: 2221 - DNA, 740 bp, Unknown
  Sequence found in Organisms: Euphorbia peplus, Euphorbia esula
taagagcctgttaaattctctccaggcgtttcccgagaaaccctaagctcctaactcttccccctatcgaatcttgccgtagccgcctgttcattctccttccgagttctggcgctgctgtctcctttcttctttccagcttcggtccggcgtattttacgtttcttcgttcaccggtgttgatttacagggttatagatcatggcgaagcatcatcccgacctgattatgtgtaggaagcaacccggaatagctatcggaagactttgtgaaaaagatgatggcaaatgtgtaatatgtgattcctatgtgcgcccttgcacgctagttcgaacttgcgatgagtgcaactatggatcattccaaggtcggtgtgtcatctgcggtggagttggtatctcagatgcctattactgcaaagagtgcactcaacaggagaaagatagggacggatgtcccaaaattgttaatttaggaagtgctaagactgatcttttctacgaacgaaagaaatatggttttaagaagaggtgatgagaatcctgaatcctaaacccttgtgcctaaaaggggtgctgtaaagcaggattttaaccgtaataattttgaagttttagaggacctgatagacttttatgtgttggaagaatggtgttgtattgtacttcaagcttgcgtttgtcattcaacttccttgtttttagaactcatatatgaagaagggtaaacaattaatttct

SEQ ID NO: 2222 - DNA, 462 bp, Euphorbia peplus
tgacatttacaggttatatagatcatggcgaagcatcatcctgatttgatcatgtgcaggaagcaaccaggaatagctattggtagactttgtgagaaagatgatggaaaatgtgtaatatgtgattcctatgtgcgtccttgcacgctggttcgaacttgcgatgagtgcaactatggatctttccaaggtcgatgtgtcatttgtggcggagttggtatctcagatgcctactattgcaaagagtgcactcaacaggagaaagatagggacggatgtccaaaaattgttaatttaggaagtgccaagactgatctgttctacgagcgaaagaaatacggttttaagaagagatgaagatgtagatgtagactgacttgtgtacttgtgttggctttgtctaaaccataaacctcgaatcctgaaccgctatgactaaaagagatgatgtaaagcaggtaa

SEQ ID NO: 2223 - DNA, 561 bp, Utricularia gibba
cggggtcgtgcggtcatcacatttgtctctccacttgtcgttttctcattcctagcatagccttcctcttcgcctctcacttttgcgagtaggatcgagcaacagctgctgtaagaatggcgaagcatcaccccgacttgatcatgtgccggaagcaacctggaatcgccattggcaggctgtgcgagaaggacgatggcaaatgtgtgatatgtgattcatatgtccgcccctgcactctcgtcagggtatgtgatgaatgcaactacgggtccttccaggggcgctgcgtcatctgcgggggcgtggggatctcagatgcctactactgcaaagagtgcactcagctggaaaaagacagggatggctgccccaagattgtgaatttgggaagtgctaaaaccgatctcttttacgaacggaagaagtacgggtttaagaagagatgaaggctccaggttcatctccttctgtcgcaaccgcacccattgtagcgtcatcgcattgcttcttcatgcttgaatcctactgcttttgagatatctctaactggtctgaaaa

SEQ ID NO: 2224 - DNA, 653 bp, Utricularia gibba
gggcggggtcggcaagatataatgaaggtgaaattgattgaggattagggcacgggattgcggtcaagagcggagggattgtttcgtcgcgcactgtaattgcaggaaaaaatggctaagcatcatccagacttgatcatgtgccggaaacaaccagggatagccattggcaggttgtgcgagaaagacgatggaaaatgtgtgatatgcgactcatatgttcgcccctgcactctcgtcagagtatgcgatgaatgcaactatggatccttccaggggcgctgcgtcatctgtggcggtgtggggatctcagatgcttactactgcaaggaatgcactcagctggaaaaagacagagatggctgccccaagattgtcaatttgggcagtgccaaaaccgatctcttctacgaacggaagaagtacggatttaagaagaggtgaagtctcctcactgaggctcttctccttcatcactgcacttctgatctgtatggcactccctggtgtttcaaatctgttgcttttgagatactggggactcatgaactacctctgaaaacattctgtagtaatgataatgctctttcagcagtttttttctaggcaaaaccaagtcatccttttaatgaagatgcatttcaatgattttg

SEQ ID NO: 2225 - DNA, 608 bp, Brassica oleracea
agcctcgttcgttccagacctttcttggttggttgatctttggcgctctggaaatttctcgtcgcaacagtctcttgatttgctcgagtttgatctcccgttaactgtctgtgtttcactagccatggcaaagcatcaccctgatctgatcatgtgccggaaacaaccaggcattgccatcggaaggctgtgcgagaaatgcgacggcaaatgcgtggtttgtgattcttatgtgcgtccctgcactctggtgcgtatctgtgacgaatgcaactacgggtcattccaaggccgctgtgttatctgcggaggtgttgggatctcggatgcttactactgcaaagagtgtacgcagcaggagaaagacagagatggttgccccaagatcgtcaaccttgggagtgccaagaccgatctcttctatgaacgtaagaaatatggtttcaaaaaacgatgatgtattttccgatttatccgatcctatgctttcttgaagtacttggatctcttatgctatgtatgtgtaaacttgtgtgttgcctatgttcaagagaatcttaagttgatggggtacaaaaccagacatataatgctttcttgttcttgat

SEQ ID NO: 2226 - DNA, 638 bp, Brassica rapa
ggttcccggcggccgtctctctccctaactcttgtgacaccttcttcttcttcttcctcctcttctccttcgaagtcaggtcccaaagagacttgtttcagcagacatggctaagcatcatcctgatttgatcatgtgccggaaacaacctggcattgccattggccgattgtgcgagaaatgtgatggcaaatgcgtggtctgcgattcctacgtgcgcccgtgtacgctggttcggatttgtgatgaatgcaactatggttcgttccaaggacggtgtgtcatatgcggaggtgttgggatctcagatgcttactactgcaaagagtgtacacagcaggagaaagatagagatggttgtcccaagattgtcaatctcgggagtgcgaagactgatctgttctatgaacgtaaaaaatatggattcaagaaacgatgacaagtgtctctgtactcgtctttgtttaggcatgaactcaaagaaacaaatgtttgttagttgttactcttgtgtcttatttagctggacgtgctatctttgttctggttggataatgtctaaaatgtgattgttcctctgcaacactacatcatcatcctcttgtttgagtaaatttcgaatctctgacagaacatgt

SEQ ID NO: 2227 - DNA, 715 bp, Musa acuminata
tcgcatcgacgggatcgagttgaatcacatcataagcggtccgctagggcggttattgacaaagtagcatcaaattaaggatcatggctaagcaccatcccgatcttattatgtgccggaagcagccaggaattgccattggccacctgtgcgagaagtgtgatggcaagtgtgtcatctgcgattcatatgtgcgaccatgcacacttgtacgtgtctgcgatgagtgcaattatggttctttccagagcaggtgtgtcatctgtgggggtgttggcatatccgatgcatactactgcaaggagtgcactcagcaagagaaggatcgcgatggctgtcccaagatagttaatctaggcagtgccaagacggatctcttctacgagcggaaaaagtatggcttcaaaaaaagatgaagagaacaaagttttcatgcctgatcctcttaagaacatcttgtatcctaattatgcttttgagatctaagattttacattgttcatgctttccgttaggccatagtaacatgaaacacattattagatttggtgaagcaaactgtctgtaggcatccaaacgaatgtaatttggttgtcgtgttgcatggtagtcacatcggctagttttagcatgatcctaagcatttgtttttattagatgtaaactgacccttgaattttagaagcaaccagtcggtctatgttctccttgctgc

SEQ ID NO: 2228 - DNA, 604 bp, Musa acuminata
ggagacgcgaggtgaaccatcgacgatcggagagctctttcttcgaagacgcgagtggcagtaacacccaaggatcatggccaagcaccatcctgatctcattatgtgtcggaagcaaccggggattgctatcggtcgcctgtgcgagaaggatgatgggaagtgtgtcatctgtgattcatatgtccgcccatgtacgctcgtgcggatctgcgatgagtgcaactatggttcatttcagggaaggtgtgtcatctgtggaggagttgggatttccgatgcctactattgcaaagaatgcacccaacaggagaaagaccgtgatgggtgtcccaagattgtcaatctgggaagtgccaaaactgatcttttctatgaaagaaagaaatatggatttaagaaaagatgatctgttttctcttctacttaggactactatgttgttaatgttgtaacaactatatgcagaagactaagcactcggtacacaacgcagttatgggactgtttgagaaagattagaaaggaactatatgcataagctgacaaatgatgtaagtgcattttctgtagtttgaaactggttacctatcatatatgaact

SEQ ID NO: 2229 - DNA, 697 bp, Brassica napus
ggcctcgttcgttccagacctttcttggttggttgatctttggcgctctggaaatttctcgtcgcaacagtctcttgatttgctcgagtttgatctcccgttaactgtctgtgtttcactagccatggcaaagcatcaccctgatctgatcatgtgccggaaacaaccaggcattgccatcggaaggctgtgcgagaaatgcgacggcaaatgcgtggtttgtgattcttatgtgcgtccctgcactctggtgcgtatctgtgacgaatgcaactacgggtcattccaaggccgctgtgttatctgcggaggtgttgggatctcggatgcttactactgcaaagagtgtacgcagcaggagaaagacagagatggttgccccaagatcgtcaaccttgggagtgccaagaccgatctcttctatgaacgtaagaaatatggtttcaaaaaacgatgatgtattttccgatttatccgatcctatgctttcttgaagtacttggatctcttatgctatgtatgtgtaaacttgtgtgttgcctatgttcaagagaatcttaagttgatgggggtacaaaaccagacatataatgctttcttgttcttgataatctagactcgggtggtctgtacttgtttttatgttatgattatcctaattgaatgtatgtgataactaacaaagttttttaatttg

SEQ ID NO: 2230 - DNA, 718 bp, Brassica napus
ggcctcgttcgttccagacctttcttggttggttgatctttggcgctctggaaatttctcgtcgcaacagtctcttgatttgctcgagtttgatctcccgttaactgtctgtgtttcactagccatggcaaagcatcaccctgatctgatcatgtgccggaaacaaccaggcattgccatcggaaggctgtgcgagaaatgcgacggcaaatgcgtggtttgtgattcttatgtgcgtccctgcactctggtgcgtatctgtgacgaatgcaactacgggtcattccaaggccgctgtgttatctgcggaggtgttgggatctcggatgcttactactgcaaagagtgtacgcagcaggagaaagacagagatggttgccccaagatcgtcaaccttgggagtgccaagaccgatctcttctatgaacgtaagaaatatggtttcaaaaaacgatgatgtattttccgatttatccgatcctatgctttcttgaagtacttggatctcttatgctatgtatgtgtaaacttgtgtgttgcctatgttcaagagaatcttaagttgatgggggtacaaaaccagacatataatgctttcttgttcttgataatctagactcgggtggtctgtacttgtttttatgttatgattatcctaattgaatgtatgtgataactaacaaagttttttaatttgtacaatgaaagtattaaatta

SEQ ID NO: 2231 - DNA, 609 bp, Brassica napus
gggttgatcttgggcgctctggaaatttctcgtcgcaacagtctcttgatttgctcaagtttcatctcccgttaactgtctctgtttcactagccatggcaaagcatcaccctgatctcatcatgtgccggaaacaaccaggcattgccatcggacgactctgcgaaaaatgcgacggcaaatgcgtggtttgtgattcttatgtgcgtccctgcactctggtgcgtatctgtgacgaatgcaactacgggtcattccaaggccgctgtgttatctgcggaggtgttgggatctcggatgcttactactgcaaggagtgtacgcagcaggagaaagacagagatggctgccccaagatcgtcaaccttgggagtgccaagactgatctcttctatgaacgtaagaaatatggtttcaaaaaacgatgatgatgatgatgtattttccgatttatccgatcctatgcttgcttgaagtacttggatctcttatgctatgtatgtgtaaacttgtgtgttgcctatgttccagagaatcttaagttgatggggtacaaaaccagacatgatgctttcttgttcttgataatctagactcgagtggtctgta

SEQ ID NO: 2232 - DNA, 647 bp, Brassica napus
gatctttggcgctctggaaatttctcgtcgcaacagtctcttgatttgctcaagtttcatctcccgttaactgtctctgtttcactagccatggcaaagcatcaccccgatctcatcatgtgccggaaacaaccaggcattgccatcggacgactctgcgaaaaatgcgacggcaaatgcgtggtttgtgattcttatgtgcgtccctgcactctggtgcgtatctgtgacgagtgcaactacgggtcattccaaggccgctgtgttatctgcggaggtgttgggatctcggatgcttactactgcaaggagtgtacgcagcaggagaaagacagagatggctgccccaagatcgtcaaccttgggagtgccaagactgatctcttctatgaacgtaagaaatatggtttcaaaaaacgatgatgatgatgatgtattttccgatttatccgatcctatgcttgcttgaagtacttggatctcttatgctatgtatgtgtaaacttgtgtgttgcctatgttccagagaatcttaagttgatggggtacaaaaccagacatgatgctttcttgttcttgataatctagactcgagtggtctgtattagacttgtttttatgttatgattatatcctaattgaatgtt

SEQ ID NO: 2233 - DNA, 630 bp, Brassica napus
ggatcctggatcgcataaactcgtgtgacacctacttcctcctgctcctcttctccttcgaggtccgaaagagccttgtttcagcagccatggccaagcatcatcctgatttgatcatgtgccggaaacaacctggcattgccatcgggcgattgtgcgagaaatgtgacggcaaatgcgtggtctgcgattcctacgtgcgcccgtgtacgctggttaggatttgcgatgaatgcaactatggttcgttccaaggacggtgcgtcatatgcggaggtgttgggatctcagatgcttactactgcaaagagtgtacacagcaggagaaagatagagacggttgtcccaagattgtcaatctcgggagtgcgaagactgacctgttctatgaacgtaagaagtatggattcaagaaacgatgacaagtgtctctgtactcgtctttgttttggcatgaactcaaagaaaagacaaatgtttgtttgttgttactcttgtgtcttattgattagctggacgtgctatctttgttatggttggttaatgtcttagaatgtgattgtttctctgcaacactaaaacatcctcttgtttgagtaattcgaatctctgacagaacatgtattcaag

SEQ ID NO: 2234 - DNA, 613 bp, Brassica napus
ggtgtgacacctacttcctcctgctcctcttctccttcgaggtccgaaagagccttgtttcagcagccatggctaagcatcatcctgatttgatcatgtgccggaaacaacctggcattgccattgggcgattgtgcgagaaatgtgacggcaaatgcgtggtctgcgattcctacgtgcgcccgtgtacgctggttaggatttgcgatgaatgcaactatggttcgttccaaggacggtgcgtcatatgcggaggtgttgggatctcagatgcttactactgcaaagagtgtacacagcaggagaaagatcgagacggttgtcccaagattgtcaatctcgggagtgcgaagactgacctgttctatgaacgtaagaagtatggattcaagaaacgatgacaagtgtctctgtactcgtctttgttttggcatgaactcaaagaaaagacaaatgtttgtttgttgttactcttgtgtcttattgattagctggacgtgctatctttgttatggttggttaatgtcttagaatgtgattgtttctctgcaacactaaaacatcctcttgtttgagtaattcgaatctctgacagaacatgtattcaagaacc

SEQ ID NO: 2235 - DNA, 766 bp, Manihot esculenta
attgcgttgcgtcctccccaacctaaaggtgcggagagcagtgtcgaaacttcaacccctcgccatcgccgtcgcctcaggttataagcatagggtagaaactagggccttgaagcatggcaaagcatcatccagatttgattatgtgccggaagcagccaggaattgcaataggacgactttgtgagaaagatgatgggaaatgtgtaatatgtgattcttatgtgcgtccttgcacactggtgcgaatttgtgatgagtgcaattatggatccttccaaggtcgatgcgttatctgcggaggggttggtatatccgatgcctactattgcaaagagtgcacacaacaggagaaagatagggatgggtgtccaaaaattgttaatttggggagcgctaaaacagatttgttttatgaacgcaagaaatatggttttaagaaaaggtgaagagctgtagtttacgtccctgctgtccatgttgcaaaccacggatgaaaccaatcttaacggtcctaaataatttgaagtttgtactttgtacctaaagatgttgcatgtggtcatcatgaaactgtgttgtgaggatcgcgtgtatttttgttacgttatgtagttaaaagttggaaccttgaagtacctgttggatgcaaaatgaatggcaaaaagtgtcatccccatggtgcgctgattgttttttcattgtatgcttttctttttatttttgggtcaaagatcaccagattcattaaaaaaggccaaagccc

SEQ ID NO: 2236 - DNA, 921 bp, Ricinus communis
gactccgcgtctctctggattgttctcgtcttgtccgagctgctgctgtttctctggcctcctccttagattagcaactgcgactgccaattaccggtgctgctttcaatcttctactccaccattctcagctcgggttaggttttgggctgaaatagttattgggcctcgaaagaaggaagtaagaatgtgaatggaaaaccgttcatatatatacaagtgaaagctaaatactctgccaacaaaacacttgctgagggctacccactacccagtgttattctcctttccatcaatctacgaagacccatcaccgggcagcaggtgagaaactaggacctgaactatggccaagcatcatcctgatctgatcatgtgccggaagcagccaggaattgccattggacgactttgtgagaaagatgatgggaaatgtgtgatatgtgattcttatgtgcgtccttgcacacttgtacgaatatgtgatgaatgcaactacggatccttccaaggtcggtgcgttatctgtggaggcgttggtatctcagatgcctactattgcaaagagtgcacacagcaggagaaagatagggatggatgcccaaaaattgttaatttaggaagtgccaaaacagatctgttctatgagcgcaagaagtatggttttaagaaaagataagttgtgggtttcatctgtggtaatatgatatgcctatcagtcttggtagacgaggaaagaaccgaatctaaactgttgcaaagttaagtttgtatctaacaatggtatagctgctttgaagatttgtgttgcttatggtcttgtaatactcttgaacagaattgtgtttgaaccatgtatcttaattctagagcagctgcttactatcaagatgtctaatagaccgtgtgaggtaattgagg

SEQ ID NO: 2237 - DNA, 1005 bp, Ricinus communis
tccgcgtctctctggattgttctcgtcttgtccgagctgctgctgtttctctggcctcctccttagattagcaactgcgactgccaattaccggtgctgctttcaatcttctactccaccattctcagctcgggttaggttttgggctgaaatagttattgggcctcgaaagaaggaagtaagaatgtgaatggaaaaccgttcatatatatacaagtgaaagctaaatactctgccaacaaaacacttgctgagggctacccactacccagtgttattctcctttccatcaatctacgaagacccatcaccgggcagcaggtgagaaactaggacctgaactatggccaagcatcatcctgatctgatcatgtgccggaagcagccaggaattgccattggacgactttgtgagaaagatgatgggaaatgtgtgatatgtgattcttatgtgcgtccttgcacacttgtacgaatatgtgatgaatgcaactacggatccttccaaggtcggtgcgttatctgtggaggcgttggtatctcagatgcctactattgcaaagagtgcacacagcaggagaaagatagggatggatgcccaaaaattgttaatttaggaagtgccaaaacagatctgttctatgagcgcaagaagtatggttttaagaaaagataagttgtgggtttcatctgtggtaatatgatatgcctatcagtcttggtagacgaggaaagaaccgaatctaaactgttgcaaagttaagtttgtatctaacaatggtatagctgctttgaagatttgtgttgcttatggtcttgtaatactcttgaacagaattgtgtttgaaccatgtatcttaattctagagcagctgcttactatcaagatgtctaatagaccgtgtgaggtaattgaggcatatcatttgattttattttattttttgtttctgcatgatgcattttttgaattagacctttctgtctcaaggtcttccatggtca

SEQ ID NO: 2238 - DNA, 849 bp, Ceratodon purpureus
taaggattaggttgaagtgctgaaggttacgtcgaagctcggaatctcggccatctgcgtggaggaacgcttcgctatacttcaatttgatcaaacatctcgcaagtgcccattgatgagttattcgtgagagaaaactaggcagataggacttgcttaaagcgacaggtttcgacaggaaagcgacaagcgttggagcagagggaagaggaacaaggattttggtcaccatggcaaagcatcatccggatttgatcatgtgcaggaagcagccggggatcgccatcggcaggctatgcgagaagtgcgacgggaagtgtgtgatctgcgattcatacgtgcggccgtgcacgctcgtgagggtttgcgacgagtgcaactacgggtcgtatcaggggcggtgtgtgatttgtgggggattgggaatctccgacgcatattactgcaaggagtgcacgcagcaggagaaggaccgggacgggtgtccgaagatcgtgaacttggggagtgccaagactgatttgttctacgagcggaagaaatatgggtttaagaaaagatagtttgcggctggtgttccgcggtggagcattggtcttcgtgacatgtgtcggttgtaacttttgggtcgcgctggacaggcacaccaggttcagcaatctgagctgctgctattgctgatgagtgtgtcgtgcgtgtcaagattggtgggaagtcaccttttgaagaatcgaaattccagggttgatagattcgggcatgcctttttaatgcaacaagggcaatctcaggaccactttacgtttaacgatgatcggccgcttttgtacgtaatgacatttaagtgaa

SEQ ID NO: 2239 - DNA, 777 bp, Cryptomeria japonica
  misc_feature (67)..(67): n is a, c, g, or t
gaacctttctagagagaactgtaacaactgtatgaatgtgaaatacaagagaaagagcaggtggaantaggggagcatatattgaacagcaaaagagaaaatccaccaggcaatctctgtgagctcagctatttcaggtcaagacacagtacaatctagcagtcaaccatggccaagcatcatcctgatctcattatgtgcagaaagcagccaggaattgctataggtcgactttgtgagaaatgtgatggtaaatgtgtaatttgtgattcttatgtgcgaccttgtacccttgttcgagtttgtgatgaatgcaactacggatcctaccagggaaggtgtgtgatttgtggtggattaggtatttctgatgcatattactgcaaggaatgcacccaacaggagaaagatagggatggatgcccaaaaatagtcaatcttggaagtgcaaaaacagatctattttatgaacggaagaaatatggtttcaagaagagatagtagcaggggttttttttgagtatctattcattgatcattgcagtacatgctttattttaattatctagcctgtacactggaatacttgtattttttctttaaaaagagttgtacatggaggtacactaaatgaacttgttggcgatatggtgtaatcatccaaagcttatttagttttgagaatggtgtcttactatgtgttgaaacttgaaatgctttttctcatatttccagataggatttgtatttgttgtatgaaattacacgttcttatgg

SEQ ID NO: 2240 - DNA, 1318 bp, Gnetum gnemon
agtctcctgcagttggaatgcatattccaggttccacagaacatctcccactggctggcctgtccgggctagcaaaaccaggaacagaagcaaaagcagcaccagcacgaagaagaagaagaagaagaagcagtaatggccaagcatcatccagatctgataatgtgccggaagcagccggggatcgcgatcgggcgtctgtgtgagaaatgcgacggcaagtgcgtgatatgtgattcgtacgtgcggccgtgcacgctggtgcgcgtctgcgacgagtgtaactacggctcgtaccagggtcgctgcgtcatctgcggtggtctcggcatctccgacgcttactactgtaaggaatgcactcagcaggagaaggaccgcgacggctgtcccaagatcgtcaatcttggtagcgccaagaccgatcttttttacgagcgtaagaaatacggcttcaagaaacgatgataatagctatgccctagtttgtgcgctggatggattgttgttttgttgcagtggatgaatttctttgcacaatcctttttcgtctcgtcgtaaccctagcagttacgaaatgtgttcctttttacacagaacttgcgcctttacctatattttcgaaaagaaaaactgtgaagctttataggagaaagtttgatttaggaaactgtaagaactggtcactggtttgaagtattgattttgttgcaacgaaagttcttttggtaattttatagggggatgttggttacagagaatttttacaaattttcagcgcatctcttcttccaaagcggcatacagtgacttcaatagttaaaaagttttaaacaaaggggggtggatcaaagaaaattgacaagcacatgtaccatgacatgtacatgaaagtgaagggtaatgtgttcaagaataagcgtgtactgatggagagtattcacaagtctaaggctgagaaggctagagagaaaaccctcactgaccagtttgaggcaaaacgtgcaaagagcaaggcctcacgtgaaagaaagcttgcaagaagagaagaaaggcttgcccagggtcccgttgaatcaaaggcagtgcagagtgcaggagcatcgaagaagtgaggaagagtcgaactagaaatggttgttaattttgttgctgaaaatttttgaatccaaaattcagtgtacatgaatgaggatataggagtttcgggtctctgaaattgtttgttaatagaaaggcatgttggattgtgaaccctacaatggaaacataaatttcaaaagatttgcttatttagctatgaagattcttattttgc

SEQ ID NO: 2241 - DNA, 634 bp, Guizotia abyssinica
atctcaacaaaactcccagaagcctcgacgaatcgctctgagcatctttcttctgccatttcttaacacccaaaatttactgtctcgatctttatcaaggtgttttagtttctgttagtcgaggaaatcatggcgaaacatcatcctgatctgatcatgtgcaggaagcagccaggaattgccattggacggctatgtgaaaaatgtgatggcaaatgtgtaatttgcgactcttacgtgcgtccatgcacactcgtgcgcgtctgtgatgagtgcaactatggctccttccagggtcgttgtgtcctatgcggaggtgtgggtatttctgatgcatattactgcaaagagtgcacacaacaggagaaagacagggacgggtgccccaagattgttaatctgggaagtgctaaaaccgacctgttttacgaaagaaaaaaatacggatttaaggaacgatgataagcaactacttttgattattgtaacaccaagcatgagatgaattatcatctcatttatcctacataatgcttgtattagagtgcacttctggttgtattttggatccatgagacaaattgcaggtcatggaacacttatgaattagaatttgtggattttatgggctttt

SEQ ID NO: 2242 - DNA, 621 bp, Jatropha curcas
attcccgacttaattttcagtatcaagagaggtgagtcaaaaccctaaccatccccgtcggcgcaggacgacaggcgtggtgttacgttttgagaatctctataacgtaaggatttcccaccagatttgcaggttataggcaacagcagaaaataggaccttgaagcatggccaagcatcatcctgatttaattatgtgccggaagcagccaggaattgccattgggcgactctgtgagaaagatgatgggaaatgcgtgatatgtgattcttatgtgcgtccttgcactcttgtgcgaatttgtgatgagtgcaactatggatccttccaagggcgatgtgttatctgtggaggagttggtatctcagatgcctactattgcaaagaatgcacacaacaggagaaagatagggatgggtgtccaaaaattgttaatttagggagtgccaaaacagatctgttctacgaacgcaagaaatatggttttaagaaaagatgataaggtaagctgtgggtcacttctgttgtgctttatgtcttctgtcttactcctcgctactgtactttgaaaaatccaatctaaaactattctaaacattattatgtatagttgttacccg

SEQ ID NO: 2243 - DNA, 728 bp, Marchantia polymorpha
atccgccgagctgacgggacgaggctcgctcgaggcttcgaggattctcgttcccgctcgcgctgcaatttgcgctcgctcgccatttcggaagtggagcgcgggttcaggagctggccaggagagcgtcgaaggtgaggcgaggtgctgcggccatagctcggtaggaagtggagcgagatggcgaagcatcatccggatttgattatgtgcaggaagcaaccgggaatcgcaatcgggcgcctgtgcgagaaatgcgatggaaagtgcgtcatctgcgattcttacgtgcggccttgtaccctcgttagggtttgcgatgagtgcaactacggatcgtatcagggcagatgtgttatatgcggaggcttgggaatatcggatgcgtactattgcaaagagtgcacgcagcaggagaaggaccgcgacggttgtccgaaaattgttaatcttggaagtgccaaaacggatctgttttacgagcggaagaagtacgggtttaagaaacgatagcgaagcgccaaatttcccgatttctcaacaggtgtcgggagattgaggattccaattttgtcataggtagctgggtttccgaaacatcacggagcgaggcccggtgtgggcttctctcctgcgtaacattaatgtcaaagagcgtaagtgtgactatatttcagactctatgtatatgacctgccgggtgacttaaaatggagggttgagactcc

SEQ ID NO: 2244 - DNA, 1016 bp, Pinus taeda
gagtgcattttgttataagatgaacgcttagtgatgacagcatctgttattagatggatgcgtatgattagaacattttgcttctgtacaacatcttaatgccattgaacgattgatacattttattggaatcctctgcgcaggtgaactttgattttatttacagcgtctgccttggagagagacaggagttgaaagggtttttatttagggggtcgcgttcccagtctgggcgaatttcagtcgcacaggatcgttctctgggcttcgggcacaacttctgagtggtaaagagggaaaggaagaggacactttcacgcggcagatcctcctctgcatattttcacggtgtacagtttagcacaagaattatatcagttaaacatggctaagcaccaccctgatctcatcatgtgtcgtaagcaaccagggattgccattggtcgtctttgtgaaaagtgcgatggtaaatgtgtgatttgtgattcctatgtgcggccatgtactcttgttcgagtctgtgatgaatgcaactatggatcctaccagggaaggtgtgtgatttgtggtggtttaggcatttcagatgcatattactgcaaggaatgcacacagcaggagaaagatagggatggatgtcccaaaattgtcaaccttggaagtgcaaaaacagatctattttatgagcgcaagaaatatggttttaagaagagatagcactggagttctattaccttaataatgtagtgacattgtagtaagtcatttatagacttagttgttatctaaggattctaggttagtggtttttggatatgtataagtggtataatagtaattgtaccagaagtagtcagataatatatctgttgaaactccaactcaagttgccttgtagtattttagcacctgtgcttgacagattttaaatcttttaactactagtgtattttgcactgaaaggagaactgattttgctcagggaactatggcttttgccactgttgaacatatta

SEQ ID NO: 2245 - DNA, 1124 bp, Pinus taeda
cctttgtgatgagtgcattttgttataagatgaacgcttagtgatgacaacatctgttattagatggatgcctatgattagaacattttgcttctgtacaacatcttaatgccattgaacgattgatacattttattggaatcctctgcgcaggtgaactttgattttatttacagcgtctgccttggagagagacaggagttgaaagggtttttatttagggggtcgcgttcccagtctgggcgaatttcagtcgcacaggatcgttctctgggcttcgtactttcgctagtgagtgagatctgttccgatttcgtggatcttttcgcaactgtatggtttgttttcgctaaatctctatgcttttgcattcaagcgggcacaacttctgagtggtaaagagggaaaggaagaggacactttcacgcggcagatcctcctctgcatattttcacggtgtacagtttagcacaagaattatatcagttaaacatggctaagcaccaccctgatcttatcatgtgtcgtaagcaaccagggattgccattggtcgtctttgtgaaaagtgcgatggtaaatgtgtgatttgtgattcctatgtgcggccatgtactcttgttcgagtctgtgatgaatgcaactatggatcctaccagggaaggtgtgtgatttgtggtggtttaggcatttcagatgcatattactgcaaggaatgcacacagcaggagaaagatagggatggatgtcccaaaattgtcaaccttggaagtgcaaaaacagatctattttatgagcgcaagaaatatggttttaagaagagatagcactggagttctattaccttaataatgtagtgacattgtagtaagtcatttatagacttagttgttatctaaggattctaggttagtggtttttggatatgtataagtggtataatagtaattgtaccagaagtagtcagataatatatctgttgaaactccaactcaagttgccttgtagtattttagcacctgtgcttgacagattttaaatcttttaactactagtgtattttgcactgaaaggagaactgattttgctcagggaactatggcttttgccactgttgaacatatta

SEQ ID NO: 2246 - DNA, 969 bp, Pseudotsuga menziesii
ttgtattcaagcatttttcggtagcagttaaatcttttcatttgagcagtgtatacgttttaaagggattcagcctgagaagaggaaaggcaaagaggaccccttcatgctgtaaatcttattctgttccctcaatactgtagtttctcaagtttcagattttagttcaggaactataacagtcaatcatggctaagcatcatcctgatctgatcatgtgccgaaagcagccaggcattgccataggtcgtctttgtgagaaatgtgatggtaaatgcgtgatttgtgattcttatgtacggccatgtactcttgttcgagtgtgtgatgaatgcaactacggatcctaccagggcaggtgtgtgatttgtggtggtctaggcatttctgatgcatattactgcaaggaatgcacacagcaggagaaagatagggatggatgtccgaaaattgtgaaccttggaagtgcaaaaacggacctattttatgagcggaagaaatatggtttcaagaagagatagttgcaggccttttctgcaatactcaagatcattgttatcttagaatttcaggctggtcatttttggatatatataagtggcagaatagtaattgtagcataagcagaagcagttagatagtatatatttgaaattccagctgaaaccgccttggagcattccagcacccgtggttgagagtgttttaaactaatatcgacaaaactttcacactgaaaaggaaactgagcttctttggggcaatattgcctccaccattactgaacaggttacaaatacaaacatccctcaatttaatattcctattctgattgtttttaaactatcagtttagtttgtatgtgtaaatttttcgtttctcagagccaacctttccctaggtcccttttccttatattttatttagtgtcagcatcatggtttcatactttctttatatgtgaaaggc

SEQ ID NO: 2247 - DNA, 635 bp, Raphanus sativus
  misc_feature (574)..(574): n is a, c, g, or t
atatcgtcgctggagttcctagatcgcatagtttccttgcgcgtgtaacaccttcctactcctcctcttctcctccgggttcaggtcgaaatcttaggagaagaccaagcagccatggccaagcatcaccctgatttgatcatgtgccggaaacaacctggcatcgccattgggagattgtgcgagaaatgtgatggcaagtgcgtggtctgcgattcctacgtgcgcccctgtacgctggtcaggatttgcgatgaatgcaactatggttcgttccaaggacggtgcgtcatatgcggaggggttggaatctcagatgcttactactgcaaagagtgtacacagcaggagaaagatagggatggttgtcccaagattgtcaatctcgggagtgccaagactgatctgttctatgaacgtaagaagtatggatttaagaaacgatagattgtttgattattactcggggtattcatttattgtcctaggtaaagtgtctgtacttgtctgtgtttagacattgattcaaagaaaagaccattgtttgttactctttgtggctttatcgattagncgaacgtgataactttgttatggttgtttaatgtctagaatgtgattgttcctctgcaaca

SEQ ID NO: 2248 - DNA, 627 bp, Raphanus sativus
  misc_feature (116)..(116): n is a, c, g, or t
  misc_feature (232)..(232): n is a, c, g, or t
tttttatttccagcggccgtctcttctccgctcatatcgtcgctcggagctcctagatcgcgtagtttccttgcgcgtgtgacaccttcttcctcctccgggttcaggtcgaaatnttaggagaagaccaagagccatggccaagcatcaccctgatttgatcatgtgccggaaacaacctggcatcgccatcgggcggttgtgcgagaaatgtgatgggaaatgcgtggtntgcgattcctacgtgcgcccctgtacgctggttcggatttgcgacgaatgcaactacggttcgttccaaggacggtgcgtcatatgcggaggggttggaatctcagatgcttactactgcaaagagtgtacacagcaggagaaagatagggatggttgtcccaagattgtcaatctcgggagtgccaagactgatttgttttatgaacgtaagaaatatggatttaagaaacgatagattgtttgattattactcggggtattcatttattgtcctaggtaaagtgtctgtacttgtctgtgtttaggcattgattcaaagaaaagaccattgtttaaaactctttgtggctttatcgattagccgaacgtgataactttgttatggttgtttaa

SEQ ID NO: 2249 - DNA, 723 bp, Raphanus sativus
  misc_feature (625)..(625): n is a, c, g, or t
ggctcctgcttcgttctttccagacctttcttggttgcttcgtctttggcgcttctcgtctcaacagtctcttgatttgctcaagtttgatctcccgttaactgtctctgtctcactagccatggcaaagcatcaccctgatctgatcatgtgccggaaacaaccaggcattgccatcggaagactgtgcgagaaatgcgacggcaaatgcgtggtttgtgattcttacgtgcgtccctgcactctggtgcgcatctgtgacgaatgcaactacgggtcgttccaaggccggtgcgttatctgcggaggggttgggatctcggatgcttactactgcaaagagtgtacgcaacaggagaaagacagagatggttgtcctaagatcgtcaaccttgggagtgccaagaccgatctcttctatgagcgtaagaaatatggtttcaaaaaacgatgatgataatatgggttgtttccccgattcgcaggacaagcgtgtgcttgctagaacactatttggatgtcctatgctatgtgtaaacttgttgattaatgttccagagaatctaaagatgttgggggtacaaaaaccagaaataatgctttgttcttctttgatgatgttaangtagacttgagtggtctttgttagacttattgttatgttcaaatagtcccttgcattgtgcattgctatgtccttggactggatagccattttatgta

SEQ ID NO: 2250 - DNA, 676 bp, Raphanus sativus
gggacacttcttatttccagcgtccgtctttcttccgctcatatcgtcgctcgtcgctcctggatcgcatagttcccttactcctgtgacaccttcttcttctccttcgaagtcaggtgagaatcttaagagaaggagacttgtttcagcagccatggccaagcatcatcctgatttgatcatgtgccggaaacaacctggcatcgccattgggagattgtgcgagaaatgtgatggcaagtgcgtggtctgcgattcctacgtgcgcccctgtacgctggttcggatctgcgatgaatgcaactatggttcgttccaaggacggtgcgtcatatgcggaggtgttggaatctcagatgcttactactgcaaagagtgtacacagcaggagaaagatcgagatggttgtcccaagattgtcaatctcgggagtgcgaagactgatttgttttatgaacgtaagaagtatggattcaagaaacgatagattgttttgattactcaggggtgttcatttattatcctatgtaagtgtctgtactcgtctgtgtttaggcattgattcaaagaaaagaccattgtttgttactctttgttatggttgtttaatgtctagtatgtgattgttcctctacaaaaacgacaacatcctcttgtccgagtaattttttgatta

SEQ ID NO: 2251 - DNA, 686 bp, Rhizophora mangle
gacaaatgatcagttgtgctgaagcgagttctggaaagaacaggagagtatcggatattgaaggacactcgtattagggaaacaggaaagaatggcaaagcatcatcctgatttgattatgtgccgaaagcaaccaggaattgccattggacggctttgtgagaaggacgatggtaagtgcgtaatctgcgattcttatgtgcgtccttgcacattagtgcgtgtctgcgacgagtgcaactatggatcattccaagggcgctgtgttatctgtggagttggtatttctgatgcatattactgcaaagagtgcactcaacaggaaaaagacagagatgggtgtcctaagattgtgaatttgggaagtgctaaaacggatctattttatgaaaggaagaaatatggcttcaagaagagatgagatgtagagaccagcattgaagctagcataaagccatttgtaagatgtactatccctaatgctaggcttctattgttgcgcagcagttgggttgattgggttagggcagtcattatgttgttttttatatctggtttgttatggtaaaattgtggcactcccatcattaatgtttttcaatggactaattttctttggactttaacctgtgttgaaggagtttaacttgcataaatattatttgtgaataagattagtctttgat

SEQ ID NO: 2252 - DNA, 843 bp, Sciadopitys verticillata
cggacgcgaagctttgagagactcagagggcattcggactcgaacctttattaatttatcgactttacaactgtcaaattggagaattcatcaattacagaggtcaatcacagtacaatctagcagttaactatggccaagcaccatcccgatctcattatgtgccgaaagcagccgggaattgccataggtcgcctctgcgaaaagtgtgatggtaaatgcgtaatttgtgattcttatgtgcggccttgtacccttgttcgagtttgtgatgagtgcaactatggatcctaccagggaaggtgtgtaatttgtggtggattaggcatttctgatgcatattattgcaaagaatgcacacaacaggagaaagatagggatggatgtccaaaaattgtcaatcttggaagtgcaaaaacagatctattctatgaacgaaagaaatatggttttaagaagagatagtttcagggctttctgcaatccttttgtattcatcactagtaatacatgcttggattgttgatatttacaatagtgatgtgtccgtgttgatatttaattggagctcaacacataagcaattagataaatacagatttttgatgttaatgaacttgtttcagcaacatggtatagtcatctgaaacatctgtacttttgataatgattttaattgttactgactattggtatcgttttgcaaatgtaatatcatggtgaacactcctttccacaataaaatgagaggtctcaagacctacaataaaatgagaggtctcaagaccaagtcctccccacgggtgagtcagtaatggctgatgtaatgttaatcatataatc

SEQ ID NO: 2253 - DNA, 606 bp, Sequoia sempervirens
gttactaggtagaacatattgaacaggaaaagagaaaaacacgcgaggcaatctctgtgagctctagtatttcaggtcaagatacagtacaatctagctttcaaccatggccaagcatcatcctgatcttattatgtgcagaaagcagccaggaattgctataggtcgactttgtgagaaatgtgatggtaaatgtgtaatctgtgattcttatgtgcgaccttgcacccttgttcgagtttgtgatgaatgcaactatggatcctaccagggaaggtgtgtgatttgtggtggattaggtatttctgatgcatattactgcaaggaatgcacccaacaggagaaagatagggatggatgcccaaaaattgttaatcttggaagtgcaaaaacagatctattttatgaacggaagaaatatggtttcaagaagagatagttgcaggttttttgagtatcaattattgatcactgcagtacgcgctttatttttcttatctagtctctacactggaatacatgtattttttcattaaaaagaattgtacttggaggtacactacaagaaatcagataatacacactcacaactgaaatgaacttgtc

SEQ ID NO: 2254 - DNA, 491 bp, Selaginella moellendorffii
atcatttgtagggttcttcacgagagagaaaaaggaagcgtgcgccatggcgaagcatcatccggatttgatcatgtgccgcaagcagccgggcattgcgatcggtcgcctgtgcgagaagtgcgatggcaagtgcgtgatctgcgattcctacgtccggccgtgtaccctagtccgcgtgtgcgacgagtgtaactatggatcctaccaggggcgctgcgtcatctgtggaggattggggatctccgacgcttactactgcaaggagtgcacgcagcaggagaaggatcgagatgggtgtcccaagatcgtcaacctgggcagcgccaagaccgatctcttctacgagcgcaagaaatatggattcaagaagcggtagcctcggtgctacaatccaatcgatcgttaaaggtcagtcggttggattgctagcttctctgtagctactggaaaattttctagaacacaaggctgtatttctcgttgcttct

SEQ ID NO: 2255 - DNA, 558 bp, Selaginella moellendorffii
gttcttcgcgagagagaaaaaggaagcgcgcgccatggcgaagcatcatccagatttgatcatgtgccgcaagcagccgggcattgcgatcggtcgcctgtgcgagaagtgcgatggcaagtgtgtgatctgcgattcctacgtccggccgtgtaccctagtccgcgtgtgcgacgagtgtaactatggatcctaccaggggcgctgcgtcatctgtggaggattggggatctccgacgcttactactgcaaggagtgcacgcagcaggagaaggatcgagatgggtgtcccaagatcgtcaacctgggcagcgccaagaccgatctcttctacgagcgcaagaaatatggattcaagaagcggtagcctcggtgctacaatccaatcgatcgttaagggtcagtcggttggattgctagcttctctgtagctactggaaaattttctagaacacaagggtgtatttctcgttgctcctactcttgtcctcttgttcgcttcttcttgtttgtagatttgtcgttgggtttctcgctggtcgtgtctttgatcttctt

SEQ ID NO: 2256 - DNA, 1082 bp, Picea glauca
  misc_feature (1061)..(1061): n is a, c, g, or t
cggttacagagatcaatttggattcaaagttaaatgtcccgatagatatgtgaagtgaagcagtggcagcaacctcaagtctccatagggttcggtattccagcattttctggtagcaggtgaaccttctcttttgagcaggtgtgtatgtttgaaagggcttcctcaagtctccagagggttctatattcaaacattttttggtagcaggtgaaccttctcttttgagcagcgtgcatgttttaaagggcttcagtgtgagaagaggaaggcgaaggggaccccttgatgctgtaaatcattttctgcacccccagtcctgaagattctcagttttagtacaagaaatataacagtcaaccatggctaagcatcaccctgatctcatcatgtgccgaaagcagccaggaattgccataggtcgtctttgtgagaaatgtgatggtaaatgtgtgatttgtgattcctatgtgcggccatgtactcttgttcgagtgtgtgatgaatgcaactatggatcctaccagggcaggtgtgtgatttgtggtggtctaggcatttctgatgcatattactgcaaggaatgcacacagcaggagaaagatagggatggatgtcccaaaattgtgaaccttggaagtgcaaaaacggacctattttatgagcggaagaaatatggtttcaagaagagatagctgcaggctttttctgcaatacttaaaggagttttattactttattgatgtattgatcattgccatcttagtattccaagctggtcatttttggatatataagtggcagaagagtaattgtagcataagcagttagataaaatatatttgaaattccaactgaaattgccttggcgcattccagcacctgcggctgacagcatttttaactaatattgacaaaacttccgctgacagcgtttttaactaatattgacaaaacttctgcactgaaaaaagaactgaccttgtttggggcaatatggcctctattgaatatattacaaatgtatccctcaatttaatattcgtattgtgattttattntaaactgagtttaacttgtga

SEQ ID NO: 2257 - DNA, 972 bp, Pisum sativum
tggacaaacatcatcctgatttgatcatgtgccgtaagcagccaggaattgctatcggacgattgtgagagaaatgtgacggcaaatgtgtgatatgcgactcttatgtgcgtccatgtacacttgtcagggtctgtgatgagtgcaactatggatcatttcaaggtcgatgtgtcatatgcggaggagtaggaatttcagatgcatactactgcaaggaatgcacacagcaggagaaagatagggatggttgccccaagattgttaacttaggtagtgccaaaactgatttattctacgaacgaaagaagtatggttttaagaaaagatgaaaagggtggattcaacattttgatttctgttaaactttttctgttctctgttctctctctttttcatcacctccgccaccgcataaggttcatagttcaggcaaaacgaatcgcttaacaccactcttctactcaccacagcatctagcaggttgttgaaaacatggccaaacatcatcctgatttgatcatgtgccgtaagcagccaggaattgctatcgaacgattgtgtgagaaatgtgacggcaaatgtgtgatatgcgactcttatgtgcgaccatgtacacttgtcagggtctgtgatgagtgcaactatggatcatttcaaggtcgatgtgtcatatgcggaggagcaggaatttcagatgcatactactgcaaggaatgcacacagcaggagaaagatagggatggttgccccaagattgttaacttaggtagtgccaaaactgatttattctacgaacgaaagaagtatggttttaagaaaagatgaaaagggtggattcaacattttgatttctgttaaactttttactcaatttgtgccttgatcggatatcagcaccatagaacgagaccttgtgcatgtaaaacattaatatcaagtacaatcattgtttgtttagttacaagtatc

SEQ ID NO: 2258 - DNA, 440 bp, Senecio madagascariensis
tattagcttccgaaatttaagactctgtcaagaaaatcatggcgaagcatcatcctgatttgatcatgtgcaggaagcagccaggaattgccattggacggctttgtgaaaaatgtgatggaaaatgtgttatctgcgactcttatgtgcgtccgtgtacactagtgcgtgtctgtgaagagtgcaactatgggtccttccagggtcgttgtgtgatctgtggaggtgtgggtatctccgatgcttactactgcaaagagtgcacacagcaggagaaagacagggatgggtgcccgaagattgtcaatttggggagtgctaaaactgacttgttctatgaacgtaaaaatatgggttcaagaaacgatgataactgtatttttctaaaaatgattgtacttgaagatgagaccaaatatccaggcataagatgagactag

SEQ ID NO: 2259 - DNA, 562 bp, Euphorbia peplus
tggaagaatcgcggcgcgcctgcccaaccagacatagtggaatctaggaccttggaccatggccaagcatcatcctgatttgattatgtgcaggaagcagcctggaattgccattggaagactttgtgagaaggatgatgggaaatgtgtgatatgtgattcctatgtgcgtccttgcactctagtgcgaatctgtgacgagtgcaactacggatctttccaaggtcgatgtgttatctgtggaggagttggcatctcagatgcttactactgcaaagagtgcactcaacaggagaaagatagggatggatgccccaaaattgttaatttaggaagtgcaaagacagatctgttctacgaaagaaagaaatatggtttccagaagaggtgaagggttagatgtaggttgacttttgtttgcccatgtacatctacatgggaaagacttaatctgaagtgcctgaactttggcgtagtacttaagtggtgttgctaaattggactatatttctgcacttttaaagcagctgctaagaacctaatagacttattgagtatgagt

SEQ ID NO: 2260 - DNA, 1176 bp, Phalaenopsis aphrodite
gtagttagggttttttgcagagaggtttttctgtggttgaaatttcctcttgtgccctataacatctaactttcctagtcggccgccattgttagcgcttagcgggcaaaagtgaagcgagagagcgagaagggaaaacacacaagctgtaagcaagaagaggcgggagcggcttcgcaggagctcgatctcttgtgcgaacactagaaggagcttggaagccatggcaaagcatcatcctgatctgatcatgtgccggaagcaaccgggcatagcgatcggccggctgtgcgagaaggatgacggcaagtgtgtcgtttgcgactcttatgttcgtccttgcacgctcgtgcgaatctgcgacgagtgcaactatggttcgttccagggccgttgtgtcatctgcggcggcgtcggcatctcggacgcgtattattgcaaggaatgcacgcagcaggagaaggaccgcgacgggtgtccgaagattgtcaacctgggcagtgccaagactgatctgttctatgagaggaagaaatatggattcaagaaaaggtgatatttttcatgtttttagttgagtcacttgaacactgttgctttatatagaatgatgagtggcatctgacatttgaacatttgtttgtggttttttaacatttaatgggagcgtagttttaagctgttcgaaggaaaatggtgaaaaaatattaatttacattgtaatttcagtttttttttgccctaaaccagacctaatttttctgtgcggattcctaatgtagctgtacgtgcggcgcaagttattcctgagttattttcaggttatttttcaataattccaaaataatccagaaataactcgcggtttttattttgggttatgaatgtaaatattaaaagtgtaagtgttggagatgtaaatacattaggatattgtagcatgtatatgaatgccacaaattatatttgttgatgaggtaagagatgatgtgcataacttattctatgagaggataaattctcaaataaatcaaatacacatgaaaattttcagaaaacaaaataatatataatttttaaggaatagaacaaaggacatattatagaagtctcaatgcactcttaatgtgcttaataattcgagtaccacctccttaaagccaactagtgctagaa

SEQ ID NO: 2261 - DNA, 692 bp, Phalaenopsis aphrodite
tttttgtgccctataacatctaactttcctagtcagccgccattgttagcgcttagcgggcgaaagtgaagcgagagagcgagaagggcaagcacacaagctgtaagcaagaagaggcgggagcggcatcacaggagctcgatctctcgtgcgaacactagaaggagctaggaagccatggcaaagcatcatcctgatctgatcatgtgtcggaagcaaccgggcatagcgatcggccggctgtgcgagaaggatgacggcaagtgtgtcgtttgcgactcttatgttcgtccttgcacgctcgtgagaatctgcgacgagtgcaactatggttcgttccagggccgttgtgtcatctgcggcggcgtcggcatctcggacgcgtattattgcaaggaatgcacgcagcaggagaaggaccgcgacgggtgcccgaagattgtcaacctgggcagtgccaagactgatctgttctatgagaggaagaaatatggattcaagaaaaggtgatatttttcatgtttttggttgagtcactcgaacactgttgctttatatagaatgatgggtgatatctgacatttgaacatttgtttgtggtttttttaacatttaattggagcgtagttttaagctgttcgaaggaaaatggtgaaaaaatattaatttacattgtaatttcagtttttttt

SEQ ID NO: 2262 - DNA, 589 bp, Lippia dulcis
acctagaacgatctgaattcatttttcacctcttcagcgcacagttcaccggcactcatagctgcagaggaagacttgcagggagcaatatggctaagcatcatcctgatttgattatgtgtcgcaagcaaccaggaatagcaataggcaggctgtgtgagaaagatgatggtaaatgtgtgatatgcgattcctatgtgcgtccttgcactcttgtaaggatatgtgatgaatgcaactatggatcttttcaagggagatgtgttatctgtggaggcgtcgggatttcagatgcctattattgcaaagaatgcactcagttggagaaagacagggatgggtgtccaaagatagtcaatttgggcagtgcaaaaactgatctgttctatgagaggaagaaatatggctttaagaagagatgatgagagtgatggtttttcagtgttctggaggaagaaatatgaatggtggttctgttttgttgttatgaacatttttgatatccttgtggagaacttgtattcgtaatgttgccttgctcgaatttgatcatgacactttttcgcattatgaagtaatagaactgatt

SEQ ID NO: 2263 - DNA, 667 bp, Lippia dulcis
caaagggaaattagaaatcgaacgcagtaacctcttttttgggtatttcaattcgcactcttcgccgccgcagaggatagtgatcaaagtgttgaagaagtatggctaaacatcatcccgacttgatcatgtgtcgtaagcaaccgggcattgccatcggaaggctgtgcgagaaagatgatggcaagtgtgtgatatgtgactcctatgtgcgcccttgcacccttgtgaggatatgtgatgagtgcaactatgggtctttccaaggccggtgtgttatctgtggtggggtggggatctcggacgcctactactgcaaggagtgcactcagctggagaaggacagggatgggtgccccaagatcgtgaatctgggtagtgctaaaacggatctattctatgagcgcaagaagtatggcttcaaaaagagatgatgatgatgataaccatcataacagatgactgctgatagtagtttctgagttccttagttactgtgagctcatttatatgtttgaatcattctaaatgtcagtgagtttctgctggggatggcattttgataatgctaatttgcacccatgcaatcactattgataatctatctacctacttgcttttgtggttgaaaaatgtatgaaatttgaattgataaactagtatttca

SEQ ID NO: 2264 - DNA, 594 bp, Brassica rapa
ggggcacataagaatttgatcccacacctttgtgacaacgcctcggcgctctggaactttctcgtcgcaacattctcttgactggctcaagtttgacctcctgttaatcgttcactgtttcagtagccatggcaaagcatcaccctgatctgatcatgtgccggaaacaacccggcattgccatcggacgactgtgtgagaaatgcgacgggaaatgcgtggtgtgtgattcttacgtgcgtccctgcactctggtgcgtatttgcgacgaatgcaactacgggtcgttccaaggacggtgtactatttgcggaggggttgggatctcggatgcttactactgcaaagagtgtacgcagcaggagaaagacagagatggttgtcccaagattgtcaaccttgggagtgccaagacggatctcttctatgaacgtaagaagtatggattcaagaaacgatgaagatgtattggtttgcccgattgctggatctcttatgctatgtctgttgcatgataaaactaatatgtattgggtataaaaaacccatacattatgctttctttttcttgataatctagactttattggacgg

SEQ ID NO: 2265 - DNA, 608 bp, Ocimum basilicum
cgtttgaaatcagctcccagccatcgccgccgaagagagtactctaggaagtgtttcagcaaaatggcgaagcatcatcctgatttgatcatgtgtcgtaagcaaccaggaatcgcgattggaaggctgtgcgagaaagatgatggcaaatgtgtgatatgcgattcctatgtgcgtccttgcacgcttgtgcggacatgtgatgagtgcaactacggttctttccaaggccgttgtgttatctgtggtggggtggggatctcggacgcctactactgcaaggagtgcactcagctggaaaaggaccgcgacggttgcccaaagatagtcaatcttgggagtgctaaaacggatctgttctacgagcgtaagaaatatggcttcaagaagagatgatgatgacgacgatggttgtgacttgtgactgcagctagtagtttcccctatcctttgttattatgatctctgttatgtttgaagcattctcgacacaatatataatttcatggatcatcgtcggatttgtgatgggaagtggaatcttcacctgtgatattatgactgtatgaacttatttgcttttatggtaaaagtgatgagctttttct

SEQ ID NO: 2266 - DNA, 621 bp, Brassica napus
tgcaaattcccttttatttatcaacccactagcgccatatcagaatttgatccaacgccacacctttatcgattgaacttggcgctcgggaactttctcgctcgcgacattctcttaactggctcaagtttgatctcctgtaaatcgtcactgtttcagtagccatggcaaagcatcaccctgatctgatcatgtgccggaaacaacccggcattgccatcggacgactgtgtgagaaatgcgacgggaaatgcgtggtttgtgattcttacgtgcgtccctgcactctggtgcgtatttgcgacgaatgcaactacgggtcgttccaaggccggtgtactatatgcggaggggttgggatctcggatgcttactactgcaaagagtgtacgcagcaggagaaagacagagatggttgtcccaagattgtcaaccttgggagtgctaagacggatctcttctatgaacgtaagaagtatggattcaagaaacgatgaagatgtattggttctcacgattactggatctcttatgctatgtctgttgcataataaaactaatatgtattgggtattaaaaaacccatgcattatgctttcttattcttgataatctagactt

SEQ ID NO: 2267 - DNA, 694 bp, Brassica napus
ggggcacataagaatttgatcccacacctttgtgacaacgcctcggcgctctggaactttctcgtcgcaacattctcttgactggctcaagtttgacctcctgttaatcgttcactgtttcagtagccatggcaaagcatcaccctgatctgatcatgtgccggaaacaacccggcattgccatcggacgactgtgtgagaaatgcgacgggaaatgcgtggtgtgtgattcttacgtgcgtccctgcactctggtgcgtatttgcgacgaatgcaactacgggtcgttccaaggacggtgtactatttgcggaggggttgggatctcggatgcttactactgcaaagagtgtacgcagcaggagaaagacagagatggttgtcccaagattgtcaaccttgggagtgccaagacggatctcttctatgaacgtaagaagtatggattcaagaaacgatgaagatgtattggtttgcccgattgctggatctcttatgctatgtctgttgcatgataaaactaatatgtattgggtataaaaaacccatacattatgctttctttttcttgataatctagactttattggacttatcttagtgtctaaatagtctcttgcgttgtgtatcgtgtttgatttcatcacaccacagtagaagtaggcatgttcttggactcttaatcatgttttga

SEQ ID NO: 2268 - DNA, 683 bp, Liriodendron tulipifera
  misc_feature (565)..(565): n is a, c, g, or t
  misc_feature (586)..(586): n is a, c, g, or t
agggcccaacatgcacgttgcgaccagcaataacccgagagagagagagattgggaggaaacattgaggcccaggcacttgtcggagaaaagttcgcggagtcatcgttgtacagtcggcctccatttcttctcaattacaaaggcttctgaggaattaggaccacttacaccatggccaagcaccatcccgatcttatcatgtgccgaaagcaaccgggaattgccatcgggcgtttgtgcgagaagtgtgatgggaaatgtgtggtctgtgattcatacgtgcggccttgcacgctcgtgcgcgtctgcgacgaatgcaattatggctccttccagagcaggtgtgtcatctgtggagggttggggatttctgatgcatactactgcaaggagtgcacacagcaggagaaagacagggatggttgtccgaagattgtcaatcttgggagcgctaagactgatctcttctacgagcgtaagaaatatggtttcaagaaaagatgaagtaaaagaaattctggctactttccctcctcttctttttcttctttttactagtaagncatgttcattgcacctgaggnaaccatagagctacaatccatgccctacagtaatttgttattctgaattacattttgagctgcgcagaaacaaaacttccaggtggtttgggaacta

SEQ ID NO: 2269 - DNA, 725 bp, Mimulus guttatus
ctacgcagttcagtcggcactctcactcagcgcgctacagcgaatattttctagaaagagtctgcaggaagatggctaaacatcaccccgatttgatcatgtgccgaaagcaaccaggaatagccataggcaggctatgcgagaaagacgatggcaaatgtgtaatatgtgattcctatgtgcgtccttgcacccttgtgagaatatgcgatgagtgcaactacggatcttttcaggggaggtgtgttatctgtggaggagtggggatttcagatgcttactattgcaaagagtgcactcagatggaaaaggatagggatggttgtccgaagattgtcaatttgggcagtgctaaaactgacttgttctacgagcgcaagaaatacggcttcaagaagaggtgattgataccgtgtggttgcattgttgtggtttttccttcccgttacttcggttctttaatgttctagtttatgtaataagaactattgaaatgcttgtcggtagtgcgtatttgagtattcgtaatgctgactttcactcaagtgatatgatgaaactgtaggggcttattgaagtggtattacttctaagtgagaacaaactattgaatctctctgttgagagttttcggaattctctctgatattatgcagtgttcgtagaagattttgtttttgttattgtttttatatgcatgtttcttctcttaggtgagtgttgct

SEQ ID NO: 2270 - DNA, 939 bp, Physcomitrella patens
gtcgaggaaggtcaccgagagattgcgtgcagttttgtgccgaagaaggatcgtagcattaatcagtttggatttcattcactcttcgtgattcttcactcaccgcagtgggcaatcccaagggaagtttctggaactgtccgtgaatcatattaagagcaggaagagcaggaagtcgtcaagtttgctggagctatggcaaagcatcaccccgatttgattatgtgcaggaagcagccggggattgctatcggcaggttgtgtgagaaatgcgacgggaagtgcgtgatttgcgactcgtacgtgaggccgtgcacgcttgtgagaacttgtgacgagtgtaactatggctcgtatcaagggcggtgcgtcatttgtggaggccttgggatttcagacgcctattattgcaaggagtgtactcagcaggagaaggaccgggatggttgtcctaagattgtgaacctcggaagtgcgaaaaccgatttgttctatgaacggaagaaatacggtttcaaaaaaagatagtccctacgctttcacgaactctcttcttcggaatggatttgtttgtggcggaagaacagagcaggtatcttgaatggccgtgtgaggtattacgtctagagttgagattaccgtcagtttcaatcgaccaagataggaaaggaggtctcaaattacagtggcagataattaggtcttttttagcgttgaagttttgtgtctagggatcataggtgcagttcggtgcgtgtactgttaacgttcgagagtactttagctaacctcaacgttagggttattgccttggttacgccgttgatgtaagtaatgacaactaggcaaatagcgtctcgtatcttacctttatcaggcaactgacgaaggatgtcttggtattacctggggattcgataaacgtggatttaattatca

SEQ ID NO: 2271 - DNA, 1023 bp, Populus trichocarpa
agtccgttcttctctttgttccaatctgccgaacccaagtctgcaatttcattcaacagctaaggtgtggagggaaccagggctttgtggaaagcaacatggcaaagcatcatcctgatttgattatgtgcaggaagcaacctggaattgccattggacgactctgtgaaaaggatgatgggaaatgtgtaatctgcgactcctatgtgcgcccctgcacgcttgtgcgaatctgtgatgagtgcaattatggatccttccaaggtcgatgtgttatttgtggaggagtgggaatctccgatgcttactattgcaaagagtgcacccagttggagaaagatagggatggatgtcccaagatcgtcaatttagggagtgccaagacggatctgttctatgaacgcaagaaatatggttttaagaaaagatgataagcaatgggtttcacctgtagtgttttttttctgccattgttcaccagaattcggcgagcccaaatgtcactgccagtcattgtgaaacgctattgatctaatggacttgggttgtaccataacaatgtccagtattctcctccttttattgtctgactacttcaaacccggtgttttatggtctaatgaacttggattgtgtgagatgtgaatttagttttggctacaaactgttggaagctttcatgtattttacctgctcctcattttctcggttgtttgaagggtagtccttagaagtggctagatgaatcgagatatccgatgttgaaagtttgattttctcattgttgaggtgaagacacgctttagctttacggtctcccaaagtaatcgttgaggtacctgatgataatagaggttttctgatgcttgtccattcagttattaaaaagttgctgtagaacaattccatatcctgcggtggaggaatagtgagtactctaggcagcaggactaacactgatttcagggccaaactacttacctgtgccgactttcatatccaagagatcttctgctggctaac

SEQ ID NO: 2272 - DNA, 699 bp, Raphanus sativus
ctcgttttatttctcttctgacctttttggttgatcttggaaatttatcgactcaacattctcttgattttcgcaagtttgatctctcgttacttgtcactgtttcagtaagccatggcaaagcatcaccctgatttgatcatgtgccggaaacagcccggcattgctatcggacgactgtgtgagaaatgcgacggaaaatgcgtggtttgcgactcttacgtgcgtccgtgcactctggtgcgtatttgtgacgaatgcaactacgggtcgttccaaggccggtgcactatatgcggaggggttgggatctcggatgcttattactgcaaggagtgtacgcagcaggaaaaagacagagatggttgtcccaagattgtcaaccttgggagtgctaagacggatctcttctatgaacggaagaaatatggattcaaaaaacgatgatcaatgtatggggggggttttcccgattgctggatctcttatactactatgtctgttgcataaaactaatatgtattcatcatacattatgctttcttattcttgataatctctagactcgagttgtctttattggacttatcttagtgtccaaatagtctcttgcattgtgtatcgtgtttgatttcggctgtgtttgcaagtcgcaaacagagtaactattttagcaaagaatttattgttctcagttca

SEQ ID NO: 2273 - DNA, 601 bp, Salvia sclarea
ctactagaccttggctgtcactcagagaaaaatcgggacgccgtcacctccatttttgggatttcaattcgcacccttcgccgttgcagaggataagtgaagaaactgctgcagaatcatggctaagcatcaccctgatttgatcatgtgtcgtaagcagccgggaattgccatcggaaggctgtgcgagaaagatgatggaaaatgtgtgatatgcgattcctacgtgcgcccctgcacgcttgtgaggatatgcgatgagtgcaactacgggtctttccaagggcggtgtgtgatctgtggcggggtggggatctcggacgcctactactgcaaggagtgcactcagctggagaaggacagggacgggtgccccaagatcgtcaatctgggaagtgctaaaacggatcttttctacgagcggaagaaatatggcttcaaaaagaggtgatgatgatggtggtgatgacagatgactgctgatagtaggatctcagttccttagttattgtgagcaaggattcttagagagtgtcagtgacattctgttggagagtggcattctgataatctacgaactctacttgattttatggttaaa

SEQ ID NO: 2274 - DNA, 988 bp, Brassica napus
cccagtctccatcaacgaaataatcccccttctccgatttaacaaataaaaacttatcaaagagtgatgtgtgaaaactgtgtggccgcgctttattttttgcattaaccaattattaatttatttaatttttgttgcagattataccggttgtggagaagggtacaagtgtattattatataaaatatatggtgtatgtgtggaagttaggtcaatttgttagatggtgaattataattttattttgcatcatacaatgcaaattcccttttatttatcaacccacaagcgccatatcagaatttgatccaacgccacacctttatcgattgaacttggcgctctggaactttctcgtcgcaacattctcttgactggctcaagtttgacctcctgttaatcgttcactgtttcagtagccatggcaaagcatcaccctgatctgatcatgtgccggaaacaacccggcattgccatcggacgactgtgtgagaaatgcgacgggaaatgcgtggtgtgtgattcttacgtgcgtccctgcactctggtgcgtatttgcgacgaatgcaactacgggtcgttccaaggacggtgtactatttgcggaggggttgggatctcggatgcttactactgcaaagagtgtacgcagcaggagaaagacagagatggttgtcccaagattgtcaaccttgggagtgccaagacggatctcttctatgaacgtaagaagtatggattcaagaaacgatgaagatgtattggtttgcccgattgctggatctcttatgctatgtctgttgcatgataaaactaatatgtattgggtataaaaaacccatacattatgctttctttttcttgataatctagactttattggacttatcttagtgtctaaatagtctcttgcgttgtgtatcgtgtttgatttcatcacaccacagtagaagtaggcatgttcttggactcttaatcatgttttga

SEQ ID NO: 2275 - DNA, 817 bp, Cedrus atlantica
cgacttataactgcattgcgaagtctgaggcagaaacttacatctcgttcgtggttacgctcgtgcctttgcttttcgaaaccatcgggacttcctgctcttgcttcaatcccttccaattatttttgcacagggaatataacagtcaaccatggctaagcatcatcctgatctcatcatgtgccgaaaacagccaggaattgccataggtcgtctttgtgagaaatgtgatggtaaatgtgtgatttgtgattcctatgtgcggccatgtactcttgttcgagtgtgtgatgaatgcaattacggatcctaccagggcaggtgtgtgatttgtggtggtctaggcatttctgatgcatatactgcaaggaatgcacacagcaggagaaagatagggatggatgtcccaaaattgtgaaccttggaagtgcaaaaacggacctattttatgagcggaagaaatatggtttcaagaagagatagttgcaggccttttctgcaatgcataaaggagtttattacttcaacgatgtattgctcattgttatcttaggattctagtctggtcatttggatacatataaatgacagaagagtaattgtagcataagcagtaagatagcatatatttggaattccaactgaaattgccttggagcattccagcacctgtggttgacagtagtttttaactaatattggcaaaacttccacactgaaaaaagaactgtccttgtttggggaatatggcgtctacatatattaaacatattacaaatgtatccctcaatttagtatttgtattgtgattttaaac

SEQ ID NO: 2276 - DNA, 628 bp, Gossypium hirsutum
agagtaagcaatgaatggatgataatatttcgattaaacctcttcttctatgaatctataaccagcgctttctacatctcggatttgggcttcaatttagttactgagtgatggccaagcaccaccctgatttgatcatgtgcaggaagcagccaggtattgcaataggacgactatgtgagaaatgtgatggcaaatgcgtaatttgcgactcctacgttcgtccttgcacgctgttgcaggtttgcgatgaatgcaactatggttcgttccaaggtaggtgtgttatctgtgtggtgtaggaatatctgatgcatattattgtaaagagtgtacacaacaagagaaagatcgagatggttgtccgaaaatcgttaatctagggagtgctaaaaccgacttattctatgaacgtaaaaaatatggttttaagaaaagatgattgatggataaaatttgtttccttggtgattatgttttgttggtgcttatgtagctaggaatgaacgaatgacgaattctatttgctgatttgcactcttatgtgattcatatttatacaaatggttcgattttgagatgttaaaaaaaaaatactgtgatttatttgatagaaaatactgtttct

SEQ ID NO: 2277 - DNA, 615 bp, Cycas rumphii
agccatggccaaacatcatcccgatcttataatgtgccgaaagcagccgggaattgccataggccgtctttgcgagaagtgcgatggtaaatgtgtgatttgtgattcgtatgtgcggccatgtacgcttgttcgtgtctgcgacgaatgcaactatggatcttaccagggcaggtgcgtgatctgtggtggtttggggatttccgatgcatattactgcaaggagtgcacacagcaggagaaagacagggatggatgtccgaagattgtgaatcttggtagtgcaaaacagatctattttacgaacggaagaaatatgggtttaaaaagagatagcggcactcttgttgtgttaacaaataagtgggggtgggagttcactttcttatatgttgctcactggggtcactgtaatgtcttatactttaggtcggttatgttggggttttatcttttagcacagaggcggtggaccagaaattttgagtgattgtggcgggatcacgatgttctaacatatagtcttaatatcagaattgtatttttcatgactccttggagcttggattgagctgtgtaccataaatgattttagctctattatttcaacttgta

SEQ ID NO: 2278 - DNA, 372 bp, Pisum sativum
tggacaaacatcatcctgatttgatcatgtgccgtaagcagccaggaattgctatcggacgattgtgagagaaatgtgacggcaaatgtgtgatatgcgactcttatgtgcgaccatgtacacttgtcagggtctgtgatgagtgcaactatggatcatttcaaggtcgatgtgtcatatgcggaggagtaggaatttcagatgcttactactgcaaggaatgcacacagcaggagaaagatagggatggttgccccaagattgttaacttaggtagtgccaaaactgatttattctacgaacgaaagaagtatggttttaagaaaagatgaaaagggtggattcaacattttgatttctgttaaacttttt

SEQ ID NO: 2279 - DNA, 782 bp, Pinus pinaster
atgcatcaatgtatataaccgtggcagcaacgtctctagagggttctggattcaagcatcgtttcgtagcaggtgaacctttccttttcttttgagcagtgtgttgctttaaagggcttcagtgtgagaacaggaaggcgcagggagtcatttttatgctgttctgcaggcccggtggtgtgggttcccagttttcgtacaagaattattacagtcaaccatggctaagcatcatcctgatctcatcatgtgccgaaagcagccaggaattgccataggtagtctttgtgagaaatgtgatggtaaatgtgtgatctgtgattcctatgtgcggccatgtactcttgttcgagtgtgtgatgaatgcaactatggatcctcccagggcaggtgtgtgatttgtggtggtctaggcatttctgatgcatattattgcaaggaatgcacacagcaggagaaagatagggatggatgttccaaaattgtgaaccttggaagtgcaaaaacagatctattctatgagcggaagaaatatggtttcaagaaaagatagtttcaggctttttcagcaatactcgaaggagtttaagacttcaatgatgtattgaaatttgatcattgctatcttagaattccaggctgatcatatttggatatatatatgtggcagaagagtaattgtagcataagaagttggataatatatgtttgaaattctaactgaaactgccttggaacatttcagcccctgtggttaacagcgtttttaacaaatattcacg

SEQ ID NO: 2280 - DNA, 647 bp, Beta vulgaris
  misc_feature (29)..(29): n is a, c, g, or t
  misc_feature (31)..(31): n is a, c, g, or t
  misc_feature (33)..(33): n is a, c, g, or t
  misc_feature (35)..(35): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (51)..(51): n is a, c, g, or t
  misc_feature (77)..(77): n is a, c, g, or t
  misc_feature (106)..(107): n is a, c, g, or t
  misc_feature (123)..(123): n is a, c, g, or t
  misc_feature (125)..(125): n is a, c, g, or t
  misc_feature (159)..(159): n is a, c, g, or t
  misc_feature (179)..(179): n is a, c, g, or t
ggccccgaggcaaaaaccttcactctctntntntntcctangtngtngttncatcgtttagagaaactaaggtcctngttagttagaatatggcaaagcatcatcnngatcttatcatgtgcngnaaacagccaggcattgcaattggacggttgtgtnagaaatgtgatggaaaatgngtaatttgtgattcatatgtccgtccatgcacactcgtccgagtttgtgatgaatgcaattatggatcgttccaggggagatgtgttatctgtggaggtgtcgggatatcagatgcttattactgcaaagaatgtactcaacaggagaaggatagagatgggtgtccgaaaattgtgaatctaggaagtgcaaaaacagatctcttctatgaacggaagaaatatggtttcaagaaaagatgatattacttctataagattctatattgtttcactttgcttcttttagactgccatttaagactgaatttacaagtttgtattatctggttacttcttctggtatgtagaggagtcactctgtaactttgccttatccatcaaattagctgacttgacttgtgaatttggatgatagaattggatattgctgttataaatgtaggaaggctcagttcatacagccgc

SEQ ID NO: 2281 - DNA, 753 bp, Theobroma cacao
acttgacaagtcctaacaactgtcaacttattggctatttagagttgcaggaattacgcagcgtgttgattaaagcatggccaagcaccatcctgatttgatcatgtgccggaaacaaccaggtattgccattggacgactttgtgagaaatgtgatggaaagtgtgtaatctgtgattctttagtgcgtccttgcacgcttgtgcgggtttgtgatgaatgcaactatgggtcatttcaggggaggtgtgttgtctgcggaggactggggatatctgatgcatactactgcaaagagtgtacacagctggagaaagatcgggatggttgtcccaaaatcgtcaatctggggagtgccaaaacagacttgttctatgaacgtaagaagtatggtttcaagaaaagatgattgcttgatattttaccttcagtgattctcttttgccccagcttttgtatttggaaataatagatttaaaaatgttggattcattgttaagactttggtttctggatttgttgttgttcaatatgttttctcaggaactgtaaattaactgtataacaggcctgatttgcatttacagcttactgtatgcttatggatttctatttgtgccttttgctaggtacatgtgcaagcttattggatcttggattttacaatatgaagtaactctctttatttttataagcttcgccccttgctcaagatttggacctaataccttttaatagaaaatcttaagttct

SEQ ID NO: 2282 - DNA, 602 bp, Raphanus sativus
  misc_feature (190)..(190): n is a, c, g, or t
  misc_feature (272)..(272): n is a, c, g, or t
  misc_feature (424)..(424): n is a, c, g, or t
  misc_feature (451)..(451): n is a, c, g, or t
  misc_feature (488)..(488): n is a, c, g, or t
  misc_feature (545)..(545): n is a, c, g, or t
gggacccgacccgactcgttttatttctcctctgacctttttggttgatcttggaaatttatcgactcaacattctcttgattttcgcaagtttgatctctcgttactttgacatcattttaggtttctgaacagacggtagtccatggcaaagcatcaccctgatctgatcatgtgccggaaacagccnggcattgctatcggacggctgtgtgagaaatgcgacgggaaatgcgtggtttgcgactcttacgtgcgtccgtgcactctgntgcgtatttgtgacgaatgcaactacgggtcattccaaggccggtgcactatatgcggaggggttgggatctcggatgcttactactgcaaagagtgtacgcagcaggagaaagacagagatggttgtcctaagattgtcaacctcgggagngctaagacggatctcttctatgaacgnaagaaatatggattcaaaaaacgatgatcaatgtatnggggtttcccgattactggatttcttatgctactatgtctgttgcataaaactaaanatgtattcatacattatgctttcttattcttgataatctagacttgagttgtcttta

SEQ ID NO: 2283 - DNA, 505 bp, Malus domestica
tctcagtcagccagccgagcccaactcccccaatcgggccaatcccctcttagagtagcatcccctcatccgagtcctctccagctatcttcggaacatggcgaagcatcatcctgacctaattatgtgccggaatcaacctggaatagctattggaaggttgtgtgaaaagtgcgacggtaagtgtgtaatttgtgactcttatgtgtgtccttgcacacttgttctggtttgcgatgagtgcaactatggatctttccagggaaggtgtgttatttgtggaggggttggaatttctgatgcttattactgcaaagagtgtactcagcaggagaaagattgagatggctgcccgaaaattgtgaatctgggaagtgccaaaacagatctgttctatgaacgcaaaaagtatggtttcaagaaaagatgataattagcaggtcaagtttcacttggcttctggaaatcattttgttttgttcttcattgaggcttagccaatatt

SEQ ID NO: 2284 - DNA, 3106 bp, Ceratodon purpureus
ttagtgatctgctgctttgagcctgagtcttgagtggagggaggaggacaggcgatggcgaagcaccacccggacctgattatgtgccggaagcagccgggcatcgccatcggcaggctgtgtgagaagtgcgacggcaagtgcgtggtgtgcgactcgtacgttcgcccctgcacgctggtgcgtatctgcgacgactgcaactacggctccttccagggccggtgcgtcatctgcggcggccagggcatctccgacgcttattactgcaaggagtgcacgcagcaggagaaggaccgcgacggctgccccaagatcgtcaacctcggcagcgccaagaccgacctcttctacgagcgcaagaagtacggcttcaagaagcgatagccctctccatgggatcaccgcggattgagtcccgcacttggagctaagctagggtaccaatttaatgttcgtattttttttatataattttttccctcctctcttcatcttggttctttttgcgtttgggcgactagcctaggtttagttttggtgtgtagaggtcgaggattgattcgggtgaggtgatgatgtgtattgatgcgtaataattgaagcgggtagcgcagttagagaacgatgagaggtggtctggctggagcgtggaaaccaggcactgcgaagcctgctccactggtggtgaccattgaggatttgaatgatgatgccagtttcgctattcacgcgagtgtgcagaaacagaggcaccagttgcctgtgtacaaacagagggagaatctccttttccttgttgagaatcatggcaccacggttgtggtaggggagactgggagtggaaagacgactcagattccgcagcttttggtcgaagctgggtgggcagaaggtggccgagcaattgcatgcacgcagcctcgccagattgcggcgcagacgattgcagcgagagtggcagaggagatgcgggtcacgctcggtacgcaggttggctattccgttaggtttgatgaagttgcaactcggggtgtgactaaaatcaagtatatgactgatggtgtgttgttgagagagatgatgacggatcctttgctctcaatctacagcgtcatcatggtggacgaagctcatgaaaggagtattgccacagatatactccttggacttctaaaaaagattattaggcgacgccctgagttgcgtttaattgttgcttcagctaccatggacactaccgctttccgtgacttttttaatacaagcggggagaagttgcaaacatcgagccttggagggtcattgcccaatcgaacccctgccgttctgtttgttgagggaaggactcattcggtacttgtacattacagtgacgaacccgttaaggactatctccaagctgcggtctcaacggcgatatctattcacaagattgaaggaccaggagacattctagtgtttcttacaggcctagatgacgtgaatgctgctgtgcaaatgatcagtgaggaagctgagaagttgccacgtgcattggtggcccttcctctttatgcagggttgcctgcttctgaccaggagcttgtctttcggccttcgttatcttcgcggcggaaggttgtcttggccacaaacattgcagagacgtcggtcactataccagggattgtgtatgtaattgacagtggcttttcaaagcagaaattttacaaccccatcacaaatgttgaagcattagtcgcagcccctgtatctcaagcctcagctgaacaaagggctgggcgagcaggtcgtgaacgtccgggaaaatgctttcgcttatacactgaagaaacttttgcgaccatgaggccacagggtgtgcctgaaatccagaagtcaaatcttctatctacagttcttcaactgaaggcgttgggaatagacaatgttatgcagttcgattggttagcaccaccacctgcggagtgcatggtcagggcactcgaacttctatatgcacttggtataatggatgagtatgccaaactcacctcacctctgggttatcaagtctcagaacttccacttgatcccatgtcagctaaaatgttgcttactgcagtggaaattgggtgtcagaaggagggtctcacgattgctgctgtgatgtcagtccaaacgatttgggcatctggcagggagagaaaggagatggatgaagctcgtgcacaattcggagttgctgaaggggacatggtgtcttacttgaatgtttacgaaggatatttgcgagcaaagaaccagaggcaatggtgctacgaaaattgcgtcaactatcacgctatggcgaaggttgtaaaggtgaggttccagctcagcagattgctgctacaacttggaggaatcaaacaacaacatgatggagatgtgaagctggttacgaaggcaatcacagcaggttttttctccaatgctgcccgtcttgaggcggaaggaggaaatacataccgttctttgaggggtaatcaggaactattcattcacccatcctctgtcttgttcagagcctcaccgaagtgggtggtgtttcagtcaattattttcctggagcggcattacatttggaatgtcacggctattgacccagcatggctttctgaatcggcccctcatttttaccagcttggtcgagtgtgaggttgatatatgagtggaaggaggatatgatcccaaagagatagcgcctggttacgtttaaatggagttattatgtattcttgccagtttttgtaatgagagcttagacccaaatgtcggtgttttatgtcaattagtctgcggttatctcggagactccatttgcgttgtgttcatgtaatggctatggggtgatgttgtgttcatgtgatgttgtacagtgcagtactggtccatgcgcatcgaaatcaggactgtattccaactcacgggaaataatgaaaagactccggtttcagttgttagcgcaggtaatcgctgtggtagtgttacatgtcaaggagttgttcgtgttcacatcgcgattgtgtacagtatccaccaacaagtttacgttcaaattttcgaactccaagttccagtg

SEQ ID NO: 2285 - DNA, 794 bp, Orobanche aegyptiaca
ttttacgtcttctccactctccagagttcaatcggcgacgagatctgcagtgaatatttctatttctagaaagagttgcagaaggtatggctaaacatcatcccgatttgattatgtgccgcaagcaaccgggaatagccataggcaggttgtgcgagaaagacgatggtaaatgtgtggtgtgtgattcatacgtgcgtccttgcacacttgtacgtatatgtgatgaatgcaactacggatcatttcaaagccgttgtgttatatgtggaggtgtgggaatctctgatgcctactactgcaaagagtgcactcagcttgaaaaggacagggatgggtgccccaagattgtcaatttgggtagtgctaaaaccgatttgttctatgagcgcaaaaaatatggcttcaagaagagatgaagctgccggattgcggatttcgaatcctcctctttaaatgttcgattatgttttaatgaactttcttggtgtgctcgttaaaagaatgatattcatgattctggcatacgtttgaatatgaaatatgatgatgaagtgatgtaatggatgccttgttagagaattttatgaatgcataactgttgttatgtaggttttttattgtatgtaatttgtgattcttgtcctgtgcaaatttaagtctttctttagagcttactggtgaaacacactttgcatttggatgagaagatatgggtttgttatggtattggaggaagttggattttgagatcttccatggtgactcaaaaataatatgctacaaggatttag

SEQ ID NO: 2286 - DNA, 627 bp, Populus trichocarpa
agtaatctacctagaataaataagaaatgtagctctcatcttctttttgttcctatctgcctatcctagctagcttgcaggagatcaagcatattagaaactaagagcttttggaaagcgagcaacatggcaaagcatcatccagatttgattatgtgtcggaagcagccaggaattgccattggaagagtttgtgagaaagatgatgggaaatgtgtcatctgcgactccctggtgcgtccctgcacacttgtgcgaatttgtgatgagtgcaattatggatccttccaaggtcgatgtgttatttgtggaggagtgggaatctctgatgcttactattgcaaagagtgcacacagctggagaaagatagggatggatgtccaaaaatcgttaatttagggagtgcgaagacagatctgttttatgaacgtaagaaatatggttttaagaaaagatgataagcaacgggttacatctctagtggtttttctctgccattgttaacctgaatttcccgagacagaaataaaattgatggacaatgttgtagttcttgaattgtattactgattgttactgccagtcattgcgaaacgctattgattatgttgcctttgatccaattg

SEQ ID NO: 2287 - DNA, 350 bp, Prunus persica
atggccaagcataatcctgacctaattatgtgccgcaagcaacccggaatagccatcggaaggttgtgtgaaaagtgtgacggcaagtgcgtaatctgcgattctttggtgcgcccttgcacgcttgttcgggtgtgcgatgagtgcaactatggatcattccagggccggtgtgttgtgtgtggaggggttggaatttctgacgcttactactgcaaagagtgtactcagctggaaaaagacagagacgggtgtcccaaaattgtgaatttgggaagtgccaaaaccgatctgttctatgaacgtaaaaagtatggtttcaagaacagatgatcacttgacgattaatt

SEQ ID NO: 2288 - DNA, 666 bp, Zamia vazquezii
  misc_feature (62)..(62): n is a, c, g, or t
  misc_feature (226)..(226): n is a, c, g, or t
  misc_feature (322)..(322): n is a, c, g, or t
  misc_feature (393)..(393): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (569)..(569): n is a, c, g, or t
  misc_feature (579)..(579): n is a, c, g, or t
tcggttgggcctaccgagtgagtgtatcagcggcctacccaataccttcaggccgagttttnttgtacgatttcaagcgcaatttttttgaggtgtaggacaggaagcgtcagaatctatctatggctaagcaccatcctgatcttattatgtgccgaaagcagccaggaatagccataggccgcctttgtgagaagtgcgatggaaaatgtgttatatgtgattngtatgtgcggccgtgcacacttgttcgcgtttgtgatgaatgcaactatggatcctaccagggcaggtgtgtgatttgcgggggtctggggatttntgatgcatattattgcaaggagtgcacgcagcaggagaaagacagggacggatgccctaagattgtcaatnttggaagtgctaaaacagatctattttacgagcggaagaaatatgggttcaaaaagagatagcgatgctattgttgtgcaatatcaaagtgtgaggttngtnttntgtggttactgtaacgtctcacacattaggttagttatgttgggtggaccggaatcttctttgagttattntgaaggtatntgaatgttctaacatatagagccagtattacaattgtgtatcttttgactccaaataacatagattcaggtgtatcattcattgaaa

SEQ ID NO: 2289 - DNA, 401 bp, Euphorbia peplus
tctcctgatttacaggttatagatcatggctaagcatcaccctgatctgattatgtgcaggaagcaacctggaatagctattggaagactttgtgaaaaagatgatggaaatgtgtaatatgtgattcgtacgtgcgtccttgcacactagttcgaacctgtgacgagtgcaactatggatcattccaaggtcgatgtgtcatctgtggaggagttggtatctcggatgcctattactgcaaagagtgcactcaacaggagaaagatagagatggatgtcccaaaattgttaatttaggaagtgccaagactgatctgttctatgaagaagaatatggttttaagaagaggtaagagaatccgaatcctaaaccgttgtgcctaaagaggtgctgtaaagc

SEQ ID NO: 2290 - DNA, 352 bp, Malus domestica
gaacatggcgaagcatcatcctgacctaattatgtgccggaagcaaccgggaattgccattggaaggttgtgtgagaagtgtgatggcaagtgtgtgatctgtgattctttggttcgtccatgcacacttgttcgggtgtgggatgagtgcaactacggatcgttccaaggacggtgtgttgtgtgtggagggcttggaatttctgatgcttattactgcaaagagtgtactcagctggagaaagatcgagatggctgtcccaaaattgtcaatctaggaagtgccaaaacagatctattctatgaacgcaaaaagtatggtttcaagagaagatgatgacttcactattaa

SEQ ID NO: 2291 - DNA, 512 bp, Heritiera littoralis
cttctcgtcttcttgtctgctctgagactctccggcaaatcacgataagcagctttgctaattgctatcccctcacagttactgggacaactaggaacgagttgcttcaatcatggccaagcaccatcctgatttgatcatgtgcaggaagcagccaggtattgcaataggacgactctgtgagaagtgtgatggcaagtgtgtaatctgtgactcctatgttcgtccttgcacgctggtgcgggtttgtgatgaatgcaactatggatcgtttcagggtaggtgtgttatctgtgggggagtgggaatatctgatgcatattactgtaaggagtgtactcagcaagagaaagaccgggatggttgtccgaaaattgttaatcttgggagtgctaaaactgacttattctatgaacgtaaaaatatggttttaagaaaagatgattgatggttaattgtatctgtattgattatgttttgctggtgcttacatagccgggaatgacagattt

SEQ ID NO: 2292 - DNA, 369 bp, Platanus occidentalis
ccctgatctgatcatgtgtaggaagcagccgggaatagccatcggacgcctctgtgagaagtgtgatggcaagtgtgtcatctgtgactcgcttgtgcgtccctgcacccttgtgcgggtctgtgatgaatgcaattacggatccttccagggccggtgcgtcgtctgtggaggggtgggcatatctgacgcttattactgcaaagagtgtacacagcaggagaaagacagggatgggtgtccaaagatagtcaatttggggagtgccaaaacagatctcttttatgaacgtaagaagtatggctttaagaaaagatagaaggatatatggacaatttcgtttccctttctctcttcaagcttatactt

SEQ ID NO: 2293 - DNA, 1268 bp, Volvox carteri
cttacttcaccaaagagtcttttatcatatacataccttgatgctctcacttaagtcggtcttgaaatttgtgtgaatcagattgaaggtagcttccctagcaggaaacgcgcttttggaaaataccgtgttgtattgccacacatcttagaatagtaggtggacgtcgcagttgtggagcagcgctgtgtcatttcacgccggcgggtgctcatttctgctgcccggttctagctgacaagacgccatggctaagcatcaccccgacttgattatgtgcatgaagcagcctggcgttgctatcggtcgcctgtgcgaaaaatgtgacggcaagtgcccaatctgcgattcgtacgtgcggccttgcacgctggtgcgcgtctgcgacgaatgtaattacggatcttacgaaggccggtgtgtcatttgcggcgggataggtatctcagatgcctactactgcaaggaatgtaccttgcaagaaaaagaccgagacggctgccccaaaatcatcaaccttggctcggccaaaacagacttattctacgagcggaaaaagtacggctttaagaaacggtagcacccgagccttaaggattgttgtgacagccatccgccagccctctccccccgccagtggctcccacctgccctctcaagcttttattagggccaagtgtaacgcgcccaggcggtgtcccgtcgacttcagtcggttggcgtgcttgcttgccgtctggcgtgtttgcttatcgagacggaaggattgggatgttggtgggacaaagttggctacgtgcttactggggttgcctcggggcttgtttgcacttaatttctatcggcaacgatagagcccttttaccgtagaggcagggctgtcggcggctatctggggttgattaacgaaaccagttacagattgcggcggccagcggccgtgaagccatcgaagcctctggataatggaaacagagcagctcgtggtggtggagcccaacaacggggacaacacgttaagtgtgaatctgcacgtgaaatatttatctcagattggtcactgggggggggctttaggcgcacgagtcgtgtgttcgttcataagggttcgtgtgtgtcttggtgtttaaggggaggggaaaaagacaagcgacgcatacagatgtgggggaagtttcggacggcgtgaagcgacctgaacgtgtgaaggatttctcactgaaatgggcggttcaggccattcgtaacctttttaaaaagcggttcgg

SEQ ID NO: 2294 - DNA, 414 bp, Fagopyrum esculentum
tcgccagtcgccaccgccttggttgttgtcagcaataagctttctctttctgctgctgccgagtgttcttcaatccgccgtttaagttttgagaatcattcaccgaaagcatggcaaagcatcatcctgatttgataatgtgccgcaaacagccaggcattgccattggtcgattgtgtgagaaatgtgacgggaagtgtgtgatatgtgattcctacgtgcgtccttgcacacttgtgcgtgtttgtgacgaatgcaactacggatcctttcaaggtcgttgtgttatatgtggaggtgttggcatctcagatgcctactattgcaaagaatgtactcaacaggagaaagacagagatggttgtcccaaaattgtgaacttgggcagtgctaagacagacttgttttacgaac

SEQ ID NO: 2295 - DNA, 1120 bp, Chlamydomonas reinhardtii
ttctgcttgtcaatactccatttaaattgattgcagcgagtcagtgtgactgtgcggtctaacttgtccaaaaccagcgcttatttctgctcaactgtttttctactgttatctccgtttgctaaatcttatttcgcgtttaaacggggaaggcagccgacgtgcggagcagcctcgcgcggtcttgccgggcgcgtgaagagccatggcgaagcatcacccagatcttattatgtgcatgaagcagccaggcgtggccattggccgcctctgcgagaaggatgatggaaagtgcccaatttgcgactcctatgtgcgcccgtgcaccctggtacgcgtgtgcgacgagtgcaactacggatcttacgagggccgctgcgtcatctgcggcgggataggcatttcggacgcctactactgcaaggagtgcacgttgcaagaaaaggacagagacggctgcccaaagatcatcaacctcggctccgctaaaaccgacttattctacgagcggaagaagtacgggttcaagaagcggtagcaccgcccgcggagtccgtgcttgttggcgcggagtcggggacgcgccggggcctgatgaattgggcgatgttgctgtgctgcacactgcccccggcaggtttgattgtgccgcggcatggagctgccttattgcaagtacctggtcagagttcaatgtgtacaaacggcgattgacatgtgtgcggacagggctggttggatgtgggcagagcctccctgggcgctggtgtcagtcatggagctagctttggtgttggcattgacggaggaaagcggataatatggagggttacatgcgaaagacaagccctgggctgttgcgtgggtgctggggctaaagttgtgccccccggtgggtgccagttaagggctggtgcagtcctggcagcctgcatgggcggcgccgcaaatgacaatggctaccagctttgtgacaggttggaaatgggctaagtctctgtatagaaatgggggctttgactattacggcaggtgaaaactcgatgtacggtacaggacgggcaccagcatgcggaccgtggtgcccgccgatccgcctcatgtaatttgtatgttgatt

SEQ ID NO: 2296 - DNA, 691 bp, Solanum tuberosum
cttgatatcgaattccatcaggcagaggacgagacagaacgcataaacattttggaatcgtggtctagccggttaagatttaacaagtatttattatttatcggtattcgattttcctgttcgacattaaaaagtaacctaacagtatggctaaacatcatcctgacttgatattctgtcgtaagcaacccggtgttgctataggacgattatgtgaaaaatgtgatggtaaatgtgtaatctgtgactcatatgtcaggccatgtacattggtgcgcatatgcgatgaatgcaattatggttcataccagggtagatgtgttatatgtgggggacctggagtatcggatgcatactattgtaaggaatgtacagttcaagaaaaagatagagatggatgcccaaaaattgtaaatttgggaagttcaaaaacagatttattttacgaacggaaaaaatatgggttcaaacgaagatagaactactgagttttcatttgtatttttaataatgaatgcaattattttagattagctcttaaaataatttaaaaatgaatttcatgtttttgtttttgactccgttcagtaatgtatatgtatatataactgattaaaatttaaagttataagcaaaattactcaaaaaaaatataatttcaaaatatttcatcaatatagcattgtattct

SEQ ID NO: 2297 - DNA, 384 bp, Ambrosia trifida
aataataagaataaccgcgtcacatcttcaaacccccaataatatttgctctctcgctcttcttcaccagggtagttgaggaaatcatggcgaaacatcatcctgatttgatcatgtgcaggaagcagccaggaattgcgattgggcggctctgtgaaaaatgtgatggcaaatgtgtaatttgcgactcttatgtgcgtccatgcacactcgtgcgtgtctgtgatgagtgcaactatggctccttccagggtcgctgcgtcatatgtggaggtgttggtatttctgatgcatattactgcaaagagtgcacacagcaagagaaagacagggacgggtgccccaagatcgttaatctgggaagcgctaaaacggacttgtttt

SEQ ID NO: 2298 - DNA, 484 bp, Silene vulgaris
gttccaatcttgagtgaaagatggcgaagcatcatcccggatctgatcttctgtcgcaagcaaccaggagtggcaatcggtcgtctctgcgacaaatgtgatggccgttgtgtgatctgcgattcgtacgtccgaccgtgcacactggtgcgcatctgcgacgagtgcaactacggatcttaccaaggacgctgcgtcatctgcggcggcgtcgttgtcagcgatgcgtactactgcaaggagtgcactatccaggagaaagatagagacggttgtcccaaaatcgtcaacttgggaagtgcgaagacggatctcttctacgagacggaaaaagtacaacttcaagaaaaactaacccaggtggtgtgatgaggtggcttgggacagcgaattgttgtttccgttgttcattattttgttctacattgtctaccacctacatcgacctgggcttttgtgtttcaccattcttcgtcttctattc

SEQ ID NO: 2299 - DNA, 464 bp, Brassica juncea
tgatcatgtgccggaaacaacctggcattgctattgggcgattgtgcgagaaatgcgatggcaaatgcgtcgtctgcgattcctacgtgcgcccgtgtacgctggttcggatttgcgatgaatgcaactatggttcgttccaaggacggtgtgtcatatgcggaggtgttgggatctcagatgcttactactgcaaagagtgtacgcaacaggagaaagatagagatggttgtcccaagattgtcaatctcgggagtgcgaagactgatctgttctatgaacgtaagaaatatggattcaagaaacgatgacaagtgtctgtactcgtctttgtttaggcatgaactcaaagaaaagacaaatgtttgttgttactcttgtgccttattgattagctggacgtgctatctttgttatggttggttaatgtttagaatgtgattgttcctctaaaaaaagatctg

SEQ ID NO: 2300 - DNA, 478 bp, Brassica juncea
cgatctcatcatgtgccggaaacaaccaggcattgccatcggacgactctgcgaaaaatgcgacggcaaatgcgtggtttgtgattcttatgtgcgtccctgcactctggtgcgtatctgtgacgagtgcaactacgggtcattccaaggccggtgtgttatctgcggaggggttgggatctcggatgcttactactgcaaagagtgtacgcaacaggagaaagacagagatggttgccccaagatcgtcaaccttgggagtgccaagacggatctcttctacgagcgtaagaaatatggtttcaaaaaacgatgatgatgatgatatatgggtatttccggatctatttggatctcttatgctatgtgtaaacttgtgtgttgattatgttccagaggatcttaagatgctggggtacaaaaccagacatgatgctttcttcttcttgataatctagacttgagtggtctgtattca

SEQ ID NO: 2301 - DNA, 457 bp, Ipomoea batatas
gaaaagttctagcttcatcgcaaaactgactcgccggtttcatatacgcggctacctgtccccaatctcgacttgtttccttggaccggatcctcaacagctgctacgattttgaggttttacatcagcttgggtataaaacggtcttgctggaagtatggccaagcaccatcctgatctgatcatgtgcaggaagcagcctggaatagccattggacggctttgtgagaaatgtgatgggaaatgtgtcatttgtgattcttatgttcggccttgtacacttgttcgtgtgtgcgatgaatgcaactatggttcttttcagggtcgctgtgtcatctgtggaggggttgggatttctgatgcttactactgtaaggagtgtactcagcaggagaaagatcgtgatggttgtcctaaaatagtcaatcttggaagtgccaaaactgatctcttctaa

SEQ ID NO: 2302 - DNA, 416 bp, Distylium racemosum
aaacaacagtcaaatctaggagtcagttatggctaaacatcatcctgatctcattatgtgccgtaagcagcctggaattgctataggtcgcctttgtgagaagtgcgatggaaaatgtgttatctgcgattcttatgtgcggccttgtaccctcgttcgagtttgtgatgaatgcaactatggatcgtaccagggaagatgtgtgatttgtggtggattaggtatatctgatgcatattactgcaaggaatgcacacaacaggagaaagatagagatggatgtccgaagattgttaatcttggaagtgcaaaaacagatctatttatgaaagaaagaatatggttttaagaagagatagtatctggttctcctgcaaaactaatgtaatgattgcagtagtaaatgttttaattag

SEQ ID NO: 2303 - DNA, 556 bp, Brassica juncea
atgtgccggaaacaacccggcattgccatcggacgactgtgtgagaaatgcgacgggaaatgcgtggtgtgtgattcttacgtgcgtccctgcactctggtgcgtatttgcgacgaatgcaactacgggtcgttccaaggacggtgtactatttgcggaggggttgggatctcggatgcttactactgcaaagagtgtacgcagcaggagaaagacagagatggttgtcccaagattgtcaaccttgggagtgccaagacggatctcttctatgaacgtaagaagtatggattcaagaaacgatgaagatgtattggtttgcccgattgctggatctcttatgctatgtctgttgcatgataaaactaatatgtattgggtataaaaaacccatacattatgctttctttttcttgataatctagactttattggacttatcttagtgtctaaatagtctcttgcgttgtgtatcgtgtttgatttcatcacaccacagtagaagtaggcatgttcttggactcttaatcatgttttgattgaatacaaaattact

SEQ ID NO: 2304 - DNA, 489 bp, Arabidopsis lyrata
gagcaagatcgtgtataagaagccatggccaagcatcatcctgatttgatcatgtgccgcaaacaacctggcattgctattgggcgattgtgcgagaaatgcgatggaaaatgcgtcatatgtgattcctatgtccgcccttgtactctggttcggatttgcgatgaatgcaactatggttcgttccaaggacggtgtgtcatatgtggaggagtaggaatctcagatgcttactactgcaaagagtgtacacaacaggagaaagatagagatggttgtcctaagattgtcaatcttggcagtgcgaaaactgatctgttctatgagctagtctcttcggctcgactcacgttctcattttcagaaaatgaaaagatgatgatggtgaaaggtagatcattgatggtgagcaccaacgactacgacgggccatcggccaacgccagacacaatccaccagggaggcgtggaggaggacggagaggttaa

SEQ ID NO: 2305 - DNA, 443 bp, Cirsium arvense
aaaacagcgatacgttatcaagtaattcaccatggaccaaacatcatcctgatcttatattctgaccgaaaaacaaccaggagtggctattgggcgtctctgtgagaagtgtgatggcaagtgtgtcatctgtgattcctatgttcgtccttgcactttagtacgaatttgtgatgaatgcaattatggatcgtatcaaggacgttgcgtcatttgtggtggtcctggtgtatccgatgcttactactgtaaggaatgtacagttcaagagaaagatagagatggttgcccaaagatcgttaaccttgggagctcaaaaacagatctattctacgagagaaagaagtatggatttaaaagacggtagcccagttagtgtaagtaaaatacattcctccaaaaccagtttcaacaggccaggcttcttttggtgttatatattc

SEQ ID NO: 2306 - DNA, 446 bp, Brassica rapa
  misc_feature (3)..(4): n is a, c, g, or t
  misc_feature (170)..(170): n is a, c, g, or t
gcnngaaacaacctggcattgctattgggcgattgtgcgagaaatgcgatggcaaatgcgtcgtctgcgattcctacgtgcgcccgtgtacgctggttcggatttgcgatgaatgcaactatggttcgtttcaaggacggtgtgtcatatgcggaggtgttgggatctcngatgcttactactgcaaagagtgtacgcaacaggagaaagatagagatggttgtcccaagattgtcaatctcgggagtgcgaagactgatctgttctatgaacgtaagaaatatggattcaagaaacgatgacaagtgtctgtactcgtctttgtttaggcatgaactcaaagaaaagacaaatgtttgttgttactcttgtgccttattgattagctggacgtgctatctttgttatggttggttaatgtttagaatgtgattgttcctctaaat

SEQ ID NO: 2307 - DNA, 674 bp, Brassica napus
gggtcgctcggagatcctaggcatcagcactagtctccctgaactcgcgtgacacctctcttcttcctcctcctcctcttcttcttcatggtccgaaagagcctcgtttcaccagccatggctaagcatcattctgatttgatcatgtgccgaaaacaacctggcattgccattgggctattgtgccagaaatgtgacggcatatgcgtggtctgcgatgtcctacgtgcgcccgtgtacgctggctaggatttgcgatgaatgcaactatggttcgatccaaggacggtgcgtcatatgcggaggtgttgggatctcagatgcttactactgcatagagtgtacacagcaggagatagatagagacgggtgtccgatgatcgtcaatctcgggagtgcgaagactgacctgctctatgcacgtaagaagtttggattcaagaaacgatgacatgtgtctctggtactcgcctttgttttggcatgaactcaaagaaaagacaaatgtttggtcgttgtccctcttgtgacttattgatttagctgacctgctatctttgctattgctggctaaagtcttataacgcgatcgattccctgcaacactcaaacctcctcctttttgggttattccaatctctgcctaaacatggattcactaaccattctttggt

SEQ ID NO: 2308 - DNA, 644 bp, Pennisetum glaucum
aggttagcatccgacagcaatggcgaagcatcatcctgatctcatcatgtgccggaagcagcccggcattgcgatcggtcgcctgtgtgagaaatgcgatggcaagtgcgtcatctgcgactcgtacgtgcgcccatgcacgcttgtccgggtgtgcgacgagtgcaactacggctcattccagggaaggtgcgtgatctgcggaggagtcggcatctcagacgcctactactgcaaggagtgtacccagcaggagaaggaccgggacggctgtcccaagattgtcaacctcggaagcgccaagactgatctcttctacgagcgcaagaagtatggttttaagaagtggggcagagggggttgccgggttcttaactggctgcgagttctgtcgcactgatgctgagagtaggttgcctgaggcagcagcttatgtagttgtgtttattgatttgatattgatgtgccgatacacctcctgatatgctaatatgtaataactagtgcaaccgtgctgtatggtgtaatactctagaagctggattatgcaatttctgaggtacggcaatggccatggaacacatgaccgtttgtagtatgtcaattgcatcgtcagttgtaaggacattttattggtgcacggg

SEQ ID NO: 2309 - DNA, 365 bp, Fragaria vesca
ctggaaattatggccgcgaagcatcatccggacctgataatgtgtcgaaaacaacccggaatagcgatcggaaggttgtgcgaaaagtgtgatggtaagtgtgtgttgtgcgactctatggtgcgtcctttcactcttgttcggatctgcgatgaatgcaactacggatcgttccaagggcggtgcgtcgtgtgtggaggggttggaatttctgatgcttattactgtaaagagtgtagtcagctagagaaggatagagatgggtgtcctaagattgtgaatcttggaactgcaagaacagatctaatttatgaacgcaaaaagtatggtttcaagaaaagatcatgaagagcaagttccaagct

SEQ ID NO: 2310 - DNA, 567 bp, Pteridium aquilinum
aagcaggccaggcatagcgattggccgcttgtgcgagaagtgcgatggcaagtgtgtgatttgcgactcctatgtgcggccctgcacgctggtacgtgtgtgcgatgagtgcaattatgggtcgttccaggggcgctgtgtcatctgcgggggcgctagcatctccgatgcctactactgcaaggaatgcacccagcaggagaaggaccgagacggctgccccaaaattgtcaacctcggcagcgccaaaaccgacctcttctacgagcgcaagaaatacggcttcaaaaagagatagaggtcagaggggctctctctgcttatatgccatgcttacctcatctttcatatgtgcactatgtggcgctggcctcctctttcgtatgcacacacatgcattgattgtgtggtttatgcgtcatgcttgcatacgtattgggtgctacatgcacacaacacacttacgtgaatacgcacatggttgttgacatgtgtgaaacatgatgtctcctatgttaccgccattgttcagttatgcgcagcagtttgacatttctgaaaaaagaa

SEQ ID NO: 2311 - DNA, 563 bp, Plantago ovata
gctcagatatttgctaccggcgatttttcttcttcttctctctgctcaggtttgctaaggaactatggcgaagcatcatcctgatctgatcatgtgccggaagcaaccaggaatcgcaattggtaggctctgtgagaaatgtgatggaaaatgcgtgatttgcgactcctatgtacgtccttgcactctagttcgtgtttgtgatgaatgcaattatggatcctttcaaggccgttgtgtcatctgtggaggcgtaggaatttctgatgcttactactgcaaagagtgtacacagcaagagaaggatagggatggctgcccgaaaatagtcaatcttggaagtgcaaaaacagatttgttctacgaacggaaaaatatggttttaagaaacgatgacctgcaggctgcattgctcaacttttatatctagtgctgtaggtttctatgttgtaattcgacttaattgataatctgggtgtgatgtgtatggattcacctcattattataacagtaccctgtacccctgataggtcttttctgatctaagaagatcaactatcat

SEQ ID NO: 2312 - DNA, 434 bp, Podocarpus macrophillus
ggtcaaatcattgtataatctagtagtcaactatggctaagcaccatcctgatctcatcatgtgccgaaagcagccaggaattgccatagggcgcctctgtgagaagtgtgatggcaagtgtgtaatttgtgattcttatgtgcggccttgtacccttgttcgagtttgtgatgagtgcaactatggatcataccaaggaagatgtgtgatttgtgggggacaaggtatatctgatgcgtattactgcaaggagtgcacgcaacaggagaaagatagggatggatgccccaaaattgttaatctgggaagtgcaaaacagatctatttatgagcggaagaaatatggtttcaagaaaagatagttcagctattctgcattattaattatattgattaatgtagtaaacactttatatctatcatcgtgtttgtc

SEQ ID NO: 2313 - DNA, 593 bp, Amborella trichopoda
ccattttaagctttgcagtcagatcccggcttccatcgccttctcacaacaaattggtgctcttcttccagggaggcagcgaggaaagcacgcaatctcattaggaagtcatggccaagcaccaccctgatcttataatgtgccgaaagcaaccagggatagcaatcgggcgtctctgtgagaagtgtgatggcaagtgcgtgatttgcgactcctatgttcgtccatgcacgcttgtgcgtgtatgcgacgagtgcaactattggtccttcccagggacgatgtgttcatattgccgaagaattggcatttcaaaatgcatactattgccaggaatgcacccaaaaggggaagggccgagatgggtggcccaagattgggaacttgggtaatgctaagactgatctcttctatgtaaagaaagaaatatgggtttaagaaaagattaccatttgggttttggtccaattaaccaatattgactaacttttggtatatactttaacttgggattgggtggtgcctggtttattactggctttggtcctaacttggtaaggatctatatggttcacatattattaatgatttgg

SEQ ID NO: 2314 - DNA, 339 bp, Ostreococcus lucimarinus
cagtcgaaacaccaccccgatttgatcatgtgcaggaagatgcccggaatatccatcggacggttgtgcgagaagtgcgatgggaagtgcgtgatttgtgattcacacgtgcgcccggcgacgctggtgcgggtgtgcgatgagtgtaactacgggacgaatcaagggcggtgcgtgatttgcggcgcagtcggcgtgagcgacgcgtactattgcaaggggtgcacactcatggagaaggatagggatggatgcccgaagattatcaatctcggggcggcgcgtacggacttgttttacgagcggaagaagtacgggtttaaaccgcgcgatgggtga

SEQ ID NO: 2315 - DNA, 419 bp, Nicotiana tabacum
  misc_feature (12)..(12): n is a, c, g, or t
  misc_feature (310)..(310): n is a, c, g, or t
  misc_feature (350)..(350): n is a, c, g, or t
  misc_feature (399)..(399): n is a, c, g, or t
tatagtgttaanacctcaccgcaagaagtatggccaagtcatcaccctgatttgatcatgtgcaggaagcagccaggaatagctattgggcgactttgtgagaaatgtgatggaaaatgtgtgatttgtgatccctatgtgcgtccttggcacacttgtccgagtttgtgatgaatgtcactatgaatccatttcagggccgttgtgtcatctgcggaggtgtgggcatttctgatgcatattattgcacacagaatgtactcagcaggagaaagatagggatggttgtccccaagattgtcaaatctgnggtagtgcctaagaacaggatctggttctatgaacggcanacacaatatggtttcacagaagagaatgagcgattggaattctatcctnggttcctaccggtacctggg

SEQ ID NO: 2316 - DNA, 399 bp, Artemisia annua
agcactgtaggttttctacaagctcccacacacagagtgaacagattcgaaagaagcagcgcgtcagtctcacccatcttcaccaggctcttatagtttctgggagtcaagagcctgttcattgaaacatggcaaagcatcatcctgatttgatcatgtgcaggaagcagccaggaattgcaattgggcggctttgtgaaaaatgtgatggaaaatgtgtaatttgtgactcttatgtgcgtccttgcacacttgtgcgtgtctgtgatgagtgcaactatgggtcctttcaaggtcgctgtgtcatatgtggaggtgtaggtatttccgatgcctactactgcaaagagtgcacacagcaggagaaagatagggatggctgcccgaagattgtcaatt

SEQ ID NO: 2317 - DNA, 433 bp, Hevea brasiliensis
cgcctgagcccatgtatagttaaacctctgctgttaagtgtgggtgtcggtttcgattagggtttgtagaaaacaaaatcaatttcattttgctgtacctctgacggtgcggagatcggctcaggttatagttatacagtagaaactaggacctcgaattatggccaagcatcatccggatttgattatgtgccggaagcaaccaggaattgccattggaagactttgtgagaaagatgatgggaaatgtgtgatatgtgattcctatgtgcgtccttgcacactggtgcgaatttgtgatgagtgcaattatggatccttccaaggtcgatgtgttatctgtggaggggttggtatatccgatgcctactattgcaaagagtgcacacaacaggagaaagatagggatgggtgtccgaaaattgttaattta

SEQ ID NO: 2318 - DNA, 545 bp, Populus trichocarpa
cctttgcgagaagtgcgatggaaaatgtgtaatctgcgactcctatgtgcgtccttgcacacttgtgcgagtatgtgatgagtgcaactatggatccttccaaggccggtgtgttatttgtggaggagtgggaatctcagatgcctactattgcaaagagtgcactcaacaggagaaggatagggatgggtgtccaaaaattgttaatttagggagtgccaaaacagatctgttctatgaacgtaagaaatatggttttaagaaacgatgatgagcagtgggtcttgagattgtatctgctgatattacccctcactggtgcactcaatctaaaatgtcgaaactagtttttaagtcttgagattgtatctgctgatattacccctagtcgttttgaaaacaatattgattactgaagttgtcgcttaatgcaatggacctggattgtattggagccgtatcttgtctcttatgatgtcatgaattctatcttcttgtttataatctaattgacttggatttatttccaggcatgttggcaatta

SEQ ID NO: 2319 - DNA, 667 bp, Flaveria ramosissima
aaactcatctctctccaagctcccagaaagctcgagtattcgcttttaagctattgcgtcgtcttcactcaacatcattctttcgctctatcaattgtctcgatcttcatcaggttactagcttctggtagctgaggaaatcatggcaaaacatcatcctgatttgatcatgtgcaggaagcagccaggaattgccattgggcggctttgtgagaaatgtgatggcaaatgtgtaatttgtgactcttatgtgcgtccatgcacactcgtgcgtgtctgtgatgagtgcaactatggctccttccagggtcgttgtgtcatatgtggaggtgtgggcatttctgatgcatattactgcaaagagtgcacacaacaggagaaagatagggacgggtgccccaagattgttaatctgggaagcgctaaaaccgacctgtttacgaacgcaaaaaatatggttttaagaaacgatgataaacaactttttgttctaatcattgtaacaccaagcatgagatgaattatcatctcacttatccaaaataatgcttgtattagagtgcttttggttttacgagacagatagcaggtcatgaaacaacttttaagtttacagtttgttggatttgtatgatattatttctatattgtgtcgtgtgattggtcg

SEQ ID NO: 2320 - DNA, 506 bp, Actinidia deliciosa
cctggcgttgagacgtttctgaaggttcgcatctcgtatatctgttgcagccaggtattgccattggacgattatgtgagaaatgtgatggaaaatgtattatttgtgactcttatgtgcgtccgtgcacactcgtgcgggtttgcaatgaatgcaactatggatcttttcagggttgctgtgtgatctgtggaggaatgtgaatttctgacgcctactattgcacacagcaggacaaagatagggatggttgtccagaaatagtcaatttgggtagtgccaaaacagatctgttctatgagtataaaaaatatggttttaagaaaagatgattgtacttgaactattttcttcccaagttgtttccacttgtcatgaatgtactagaatgcttggtgatgacattcggaaatgttggaaccacgttctaagtcttacgtagttatgtatttgctgatattattaggtctgaaataaagagaggcagtggacaagttgcaatttaa

SEQ ID NO: 2321 - DNA, 2932 bp, Zea mays
aatattattagtggggcaaaaagacacaaatccgaaaccctcgcatcggcctgtacctagccgccgtcgccacagagccctcatctcgtccgtcctcggcggcctccgcggagcagccgtcgctggagcctggagaccaaagatccggccagatctgatgtcaggagggactggctcatccgggcgcgcggccccgcggtacgccccggatgacccgacgctgcccaagccgtggcgcggcctcgtcgacggcaccaccggctacctctactactggaacccggagacgaacgtcacgcagtacgagcggcctgtgccccccgagagccagctcctcccgcctccgcctccgttgccacccccgcctccacggagccgcgaccgccgcgacaggtccagatcccgatcccgcaccccaccccggcgcgaccacagggaccgcgaccgtgaccgtgacaggcgccacgacgagcacgcgtcctccaagacggcgtcttcccaccaccatccggctccggtagccgtcgccgacgatccttccaccgaggcataccgccgccgccatgagatcaccgtcacgggggataatgtgccgactccaataacttcatttgaggctggtggcttcccgtcagaaattctgaaggagatacaacgtgctggattcgcaagcccaacacctatccaagcccagtcatggccaattgctatgcaaaatcaagatgtagtagctattgcaaagactggatcaggcaaaactcttgggtatctacttcctgggtttatgcatatcaagcgcctgcagaacagcactaggaatggcccaacagtgctagttttggccccaacaagggaacttgcaacacagattctggatgaagctgtgaaatttggaagatcttcaagaatttcttgcacgtgcttatatggtggtgctcctaaaggtcctcagttgagagatttagatagaggggttgatgttgttgttgcaacacctggaaggttaaatgacatcttggagatgcgaaaggtaagtcttaagcaagtgtcatatcttgttctggatgaggctgatcgcatgctggacatgggctttgagccacaaatacggaagatagtgaaagagatacctcaccgtcggcaaacccttatgtacaccgctacatggcccaaggaagtccgaaggattgcagatgatcttcttgttcatcctgtacaggtgacaattggaagtgttgattcacttgttgctaatagttctattactcagcatgtagagatcataacaccctcagaaaaacaacggcgcctggagcagatattacgatcccaggattcaggttcaaagatattaatattttgtaccaccaagaggatgtgtgaccaacttgcaaggacactcaccaggcagtttggagcttcggccattcatggtgacaagtcccaaagtgaaagggagaaggttctgaatcagtttcgatctgggcggtctcccattttagtggcaactgatgttgctgcgcgaggtttggacatcaaagatatcagggtagtgatcaactatgacttccccactggtgttgaagactacgttcacaggattggcaggacaggaagggctggtgccactggtgttgcatatacatttttttgtgatcaggattcaaaatatgctgctgacctaatcaaaattctggaaggggcaaaccaacgagtgccccgtgatttagaggatatggcttctcgtggcggtggacgaggtaggaagaggaaccattgggcatcccgccctgacaggggtggttcacgttctgaactggattcaaggtacagcagcagagatggactagcatcttctgggaaatcagagagtggtcgcggcagtcgtggaagggatgataatggtagccgtggcaggtacgaccctggtgaaaccgatgggcgatctcgtaggtctactagaggccgcagtagaagccgtagcaaaagtgacagtagaagccgtagcccaagtcccaagaagtcacgtcgtcatgaaggtagacgtagcaggactaagagcaggagcaggagcaggagccgtagaaatcatggcgctagccacagcaagagtcgcagccctgtcgctagccgtaggtatgaaaagactgcttcaggatctgctcggcctaactcggggcatgcagagcacaaaagccctccaagatctcactctagggatgaccatgtgaaccactctgaccacaaggatgaccacaaggatgaccacatggaagatgggaagatggaaagggttgatcttgatcgctcgcccagcccacacgatgacaagtctgctccatatagtcctgtgtacaatggcaaagccagtggctcaatgagccccaacggtcagccagaggcaggtgccaaatttgttgaaccttctgggaaacctgagcctgcatctccagtgcgctgcagcaaaggcagagatgatgatgaggaaggtatcatagacgaggatggagagattggtgaggatgatccgcgtgcaaatgcagctgtgcagaatggtaataactgacggagagtggcctgcatcttctgtgacaaccaagacttatctgttatgcaaaatgcagtcattcccatctgcaagtcctgaatacggaaatgcatttgtgtgccattaaatatctcgtagaacatgtgatactgatgcctctgccatcgatgaaccaaaactgttgatgcatgtcatgtcatgttgttaaacttaatgacattgttgtgttctggtgttttacagccagttctgtaagtgatttatgataaaatatattgtcaggtctggaagtggtagtttatgataactagcaaagttatgttgctacggtttctatttataaagtatagaatataaaatacaaagacatgtgttctgttggtt

SEQ ID NO: 2322 - DNA, 2814 bp, Setaria italica
attagggctaaaaaaacacaagccgaaaccctcgcttcgccctgcccctcgccgccgccgccgccgcagccacacccctcatcccggctgtcctccgcggcctccgcccccaggcgtcgccggaggccacagatccggccagatccgatgtcgggctcatcagggcgcgcggccccgcggtacgcgccggacgacccgtcgctgcccaagccgtggcgcggcctcgtcgacggcaccaccggctacctctactactggaacccggagaccaacgtcacgcagtacgagaagcccatgccccccgaggaccagctcccgccgcctccgcccccgctgcctcccccgcctccccggagccgcgaccgccgcgacaggtccagatcccgctcccgcaccccgccccggcgcgaccacagggaccgcgaccgcgaccgtgatcgtgacaggcgccacgacgagcacgcgtcctccaagtcggcgtcttcccaccaccatcctgctccggccgccgtcgccgatgatccgtccaccgaggcgtaccgccgccgccacgagatcactgttacgggggataacgtgccggctccaatgacttcatttgaggctggtggctttccgccagaaattctgaaggagatacagcgtgctggatttgcaagcccaacacctatccaagcccagtcatggccaatcgccatgcagagccaagatgtagtagctattgcgaagactggatctggcaaaactcttgggtatctacttcctggattcatgcatatcaagcgcctgcagaacagcacaaggaatggtccaacagtgctagttttggcaccaacaagggaacttgcaacacagattctggatgaagctgtgaagtttgggagatcagcgagaatttcttgcacgtgcctatatggtggtgctcctaaaggtccacagttgagagatttagatagaggagttgatgttgttgttgcaacacctggaaggttaaatgacattctagagatgagaagggtaagccttaagcaagtgtcgtatcttgttctggatgaggctgaccgtatgttggacatgggctttgagccacaaatacggaagatagtgaaagagatacctcaccgtcgtcaaacacttatgtacactgctacttggccaaaggaagtccggaggattgcagacgatcttcttgttcatcctgtccaggtgacaattggaagtgttgatgaacttgttgctaatagcgctattactcagcatgtggaggtgataacaccctcagaaaagcttcgacgtctggaacaaatattgcgatcccaggattcaggttcaaaagtattaatattttgtaccaccaagaagatgtgtgaccaacttgcaaggacactcaccaggcagtttggagcttcggccattcatggcgataagtctcaaagtgaaagagagaaggttctgaatcattttcgatctgggaggtctcctattttggttgcaacagatgttgctgcgcgtggtttggacatcaaagatatcagggttgtgatcaactatgacttccccactggtgttgaagactatgttcacaggattggcaggacaggaagggctggagccactggtgtcgcatatacatttttctgtgatcaggattcaaaatatgctgctgacctcatcaaaatcctggaaggggcaaaccaaaaggtaccccgtgatttagaggacatggcttctcgtggtggtgggcgaggtaggaagaggaaccgttgggcatcccgcccagacaggggtggttcacgctctgaactggattctaggtacagtggcagagatgcctctgggagatcaccacgtggcggtcgtggaagggatgattatggtggtcgtggcaggcatgactatggtgaaactgatgggcgatctcgcagatctgctaggggtcgcagtagaagccgtagcagaagtgacagtagaagccgtagcccaagtcctaagagggcacggcgtcatgaggctacacgtagcaggaccaagagtcgcagtcgaagcaggactaagagtcggagcaggagcaggagcaggagctatactagaaaccgccgtgctagccgcagcaggagccgtagtcctgttggtagtcgtaggtatgaaacagctgctgctgtctctgggtctgctcggcctaactcagggcactcagagcacaaaagccctccaaggtcccagtctgggaatgaccaccatgtgaaccactctgaggacgaccatcacatggaagatgggaagatggaaaaggttgatcttgatcgctcgcccagcccgcaagatgacaaatctgctccttatagtcctgtatacaatggcaaagccagtggttcaaagagccccaacggtcagccagatggtaatgccaaatctgtcgaagcttctgaaaaacctaaccctgcatctcctgtacgccacagcaagagcagagaggatgaggaggaaggtgttatagatgaggatggggagatagctgaggatgatcctcgatcaagtgctgcagctacacagaatggtgataactgattctgtgaatgtagaatggcggcgtggctcctgcatcagcttgtgacaagaagacaatttatgcaagctaactattcgctaagttgagaacgtggaaatgcatttgtatctcgttaaattactgtaccagtttttatggttgcggagcatgttatggtgatacctgtgccgtttgtgaaccaaaaccagcgatatttatgccatattatgttgtgtttattgtcatcatagatcgtttgttgctgg

SEQ ID NO: 2323 - DNA, 2815 bp, Zea mays
gcatcgtcctcgtcgccgccacagagcccctcgtctcggccgcccttcgccgcctccgcggagcaggcatcgcaggagaccaaagatccggccagctctgatgtcaggagctagtggctcaaccgggcgcgcggccccgcggtacgccccggatgacctgacgttgctcaagccgtggcgcggcctcgtcgacggcaccaccggctacctgtactactggaacccggagacgaacgtcacgcagtacgagcggcctatgccccctgagaatcagctgcccccgcccccgcccccgttgcctcccccgcctccccggagccgcgaccggcgcgacaggtccagatcccgatcccgcacccctcccaggcgcgaccgccgcgaccgcgaccgtgacgacgagcatgcgtcctccaagacggcgtcttcccaccaccatccggctccgatagccgtcgccgactatccgtccaccgaggcataccgacgccgccatgagatcaccgtcacgggggataacgtgccggctccaataacttcatttgaggctggtggcttcccatcagaaattctgaaggagatacaacgtgctggatttgcaagcccaacacctatccaagcgcagtcatggccaattgctatgcaaaatcaagatgtagtagctattgcgaagactggatcaggcaaaactcttggttatctacttcctggatttatgcatatcaagcgcctgcagaacagcactaggaatggtccaacagtgctagttttggccccaacaagggaacttgcaacgcagattctggatgaagctatgaaatttggaagatcatctagaatttcttgcacgtgcctatacggtggtgctcctaaaggtcctcagttgagagatttagatagaggggttgatgttgttgttgcaacacctggaaggttaaatgacattttggagatgcgaagggtaagtcttaagcaagtgtcatatcttgttctggatgaggctgatcgcatgctggacatgggctttgagccacaaatacggaagatagtgaaagagatacctcaccgtcggcaaacccttatgtacaccgctacttggcccaaggaagtccggaggattgcagatgatcttcttgtccatcctttacaggtgacaattggaaatgttgatgaacttgttgctaatagtgctattactcagcatatagaagtcataacaccctcagaaaaacaacggcgcctggagcagatattacgatcccaggtttcaggttcaaagatattaatattttgtaccaccaagaggatgtgtgaccaacttgcaaggacactcaccaggcagtttggagcttcagccattcatggtgacaagtcccaaagtgaaagggagaaggtcctgaatcattttagatctgggcgctctcctattttagtggcaactgatgttgctgcgcgaggtttggacatcaaagatatcagggtagtgatcaactatgacttccccactggtgttgaagactatgttcacaggattggcaggacaggaagggctggtgccactggtgttgcatatacatttttctgtgatcaggactcaaaatatgctgctgacctaatcaaaattcttgaaggggcaaaccaacaggtgccccgtgatttagaggatatggcttctcgtggtggtgggcgaggtaagaagaggaaccgttgggcatcccgctctgaaaggggtggtccacgatctgaactggattcaaggtacagcggcagagatggattagcatcttccgggagatcagagagtggtcgtggcagtcatggaagggatgattatggtagccgtggcaggtatgactctggtgaaactgatgggcgatctcgtaggtctgctagaggtcgcagtagaagtcgtagcccaagccccaagaggtcacaccatcatgaagctaggcgtagccgaagcaggagcaggagccgaagctgtagaaactttcgtgctagccgcagcaagagtcacagccctgttgctagcagtaggcatgaaaaggctgctgttatttcaggatctactcaacctaacttggggtatgcagagcacaaaagccctccaagatctcactctggggatgaccatgtgaaccaccctgaccaaaaggatgaccacatgggagatgggaagatggaaagggttgatcttgatcgctcgcccagcccacaatatgataagtctgctccatatagtcctgcgtacaatggcaaagccagtgactcgatgagccctaatgttcagccaaaggcagatgccaaatatgtcaaaccttctgggaaacctgagcctgcatctccattgcgccacagcaaaggcagagatgatgatgaaggtatcatagacgacgatggagagattgctgagggtgagatgatgatgaaggtatcatagacgaggatggagagattgctgagcgtgatttgcgtgcaagtgcagctgtgtagagaatggtaataactgacggagaatggcctgcatcttctgtgacaacaagactgttatgcaaactgcagtcgttcccatctgcaagagtccagaatgtagaaatgcatttgtgccattaaatgtctcgtaggacctatgataatacatctgccatatatgaacaaaaactgttgatgtatgtcctgttgtttgttaaacttcaatgacttgtgttctggtgtcttactgctagttctgttaagtgatttatgataaaacatattgtcaggtctggaagtgataaatttatgatacttgtcaggtctggaagtagtttattatatt

SEQ ID NO: 2324 - DNA, 2856 bp, Oryza sativa
tagggctacagaagaaaacccgaaaccctcgccttctccctccccggcgccgccgccgccgccgcactaatccgccggagaccgggagatcgggccagatccgccggtggagatgtcggcagggaccgccccggccgcgccgcggtacgcgccggacgacccgtcgctccccaagccgtggcgcgggctcgtcgacggcaccaccggctacctctactactggaacccggagaccaacatcacccagtacgagaagccgctgccgcccgaggaccagctcccgccgcccccgccgctccccccgccgcctccccgctccggccgaggcgaccgagaccgcgaccgccgcgaccgctcccgatcccgcaccccgccgcggcgcgaccaccgggaccgcgaccgggaccgcgacaggcgccacgacgaccacaggtcggcgccttcccaccaccatcctcttccggccgccgccgccatcgccgccgatgatccctccaccgaggcgtatcgccaccgccacgagatcaccgttgtcggggacaacgtgccagctccgataacttcgtttgagactggtggattcccaccggaaatcctcaaggagatacaacgtgctggattctcaagtccaacgccaatccaagctcagtcatggccaattgccttgcagtgtcaagatgttgtagctattgcaaagacaggatctggaaaaactcttgggtatctacttcctggatttatgcatattaaacgcttgcaaaacaacccaaggtctggtccaacagtgctagttttggcaccgacaagggagcttgcaactcagattttggaagaagctgtgaaatttggcagatcatcaagaatttcttccacgtgtctatatggtggtgctccaaaaggcccccagctaagagatttggatagaggggtcgatgtcgttgttgctacaccaggaaggttgaatgacatcctagaaatgcgaaggataagccttaagcaagtgtcgtaccttgttctagatgaagctgaccgtatgttggacatgggatttgaaccacaaattcggaagatagtgaaagaaattcctcctcgtcggcaaaccctcatgtacactgctacttggcctaaggaagtccgacgaattgcagaggatcttcttgttcaccctgtccaggtgaccattggaagtgttgatgagcttgttgctaatagtgctattactcagaatgtggagctgatcacaccgtccgaaaagcttcgccgtctggagcaaattttgcgatcccaggattcaggttcgaaggtactaatattctgtaccactaagagaatgtgcgaccaacttgcaaggacacttactaggcaatttggagcttctgccattcatggtgataagtcccaaagtgaaagagagaaggtcctgagccattttagatctgggcgatctcctattttggttgcaacagatgttgctgcacgaggcttagacatcaaagatatcagggttgtgatcaattatgatttccccactggcattgaagattatgttcaccggattggcaggactggaagggctggtgccactggtgtggcctatacgtttttctgtgaccaggattcaaaatatgctgctgatcttattaaaattctggaaggcgcaaaccaacgtgtgcctcgtgacttggcggacatggcctctcggggtgggcgtggtggtaggaagcgtaaccggtgggcaacccgctctgataggggtggttcgcattctgaactggattctaggtatggtggaagagatggtctgtcagggtcttctggcagattggatagtagtcgcagtagtcgcaggcatgactatggtgatgatggacggtctcgcaggtctgggagaggtcgcagtaggagccgtagcagaagtgacagtgataggtatagccgaagtcctaagaggtcacgccgtcatagccgtagcaggaccaggagtcggagccgaagcaggagcaggagctacactaggaaccgtcgtgctagccgcagcaggagccgtagccctggtgctagccgtaggcatgaaagaagcgctactggctctgggtctgcactgccagactctgggcacggtgagcgcaaaagaacaccagaagctgacccatcaagaaaccatacaaaccactcagacccgaaagatgaccgacacccagaggatgggaaggtgggaaaggttgatctcgatcggtcgcctactccacaagacaagtctggcccatatagtcctgcttacaatggaaaaaccagtcgctcagtgagccctggtaatcaggtggaaggaaacaacaaagctgcggaggtttctaagaatcctgatccttcatcgccaccccatcatggtaagaccagggaggacgaagaggaaggtatgatagatgaagatggagagatagctgatgatcctcgggcaaatgcaaccgtgcagaatggcggtgataattgactctttggtcccaaaagaatttaacaaactgctgagcagccactacagatgatctgcgtgacaaagctcaaaatgttaaaaattgtctgaagctgtcttttcgtagtcaaaacttaagttatgaaactatccgtgtcgtagagagctggagattgttttgtgcctgagttgtcttataacattatatactttgtagaccctgtcgaagtagatcatgtgaagtgaagttggtagctctgttatttgtgaaccaataccggaggtgcaaatcatgcaagattatgcaaatgtctcatggcggttcatggcttcatgccctatttggctactgatctaagattgcctttacttggaatatgctggtt

SEQ ID NO: 2325 - DNA, 1299 bp, Panicum virgatum
  misc_feature (745)..(745): n is a, c, g, or t
  misc_feature (956)..(956): n is a, c, g, or t
  misc_feature (1091)..(1091): n is a, c, g, or t
gtccgggcgaaagcagcagccgaaaattgtggccgcgaacggcgacgaccgcgccgacggccacgagctcctcgcctcccccggccgcgtcctctccctccgccccagctaggccctcccctcccctcccctcactccgcgtccggcatccagggctccaggctccaggccgccccccttgcatctcgcattcgcggcggtggtttcagggcaacgttatggaatgcttaacaacaagttttgcaagaaatgtgggaaaagagcacaacttcgtatgttcaagtaagttggcatctgagaaccaatgggttcccagaaggatttgctgctatgcccccagtttgacaaacttcagtcaacggcataagttcactgctatcgcatatcccatgagcccaattattggaagacgttcacgctggagatcctttgcggcaagtttgaacttagaagatggccctgcaccctccgactcaacatcatcttcatcggaccagactgctgatggtgatgcacctgaaaatctgctttcacaaaagctgagttctgatgagttgaagactcttttggctgattcagaacgaagtaagcttttgagaaggctcagcgaagcaaatcaatataaccggttcctcaagagacagctgcaactgaaggatgatgctgtcataatgttcaaaagtgaacttgctgctttggaactagaactgcaggctctggttggcctagctgaagagattgctanttttgatgttccgttaaggtctaggaagataaatggaaaatatattcaatctcttcttctctccagattagaggctgttcatggtaaaattatggaacaggtaaaggatgttgactctttaaagccccaggaaatttctgtatactgggttggcatggctgagaatgtgcaaattatgggctcattcgatgggtggtcccaaggtgagacnatgtccatggagtattcaggtgactatggaagattctctgcaactctgaagctaagacctggaaggtatgagatcaagttcttggttgatggggagtggagattgtcacctgaataccccatggctggcgagggnatgatgcagaacaatattcttgtcgtggagtagcagaattttctcttctagtagcatcttagtaattcggtagatcagaaacaatgccgaagtgtatcaactttccttccttcccctgtaatatgttgctaccgtgcggttgcgtcacagaactcaaatgttttgtgaaatgcaagcctccagagtccagatgcatgctttccttttc

SEQ ID NO: 2326 - DNA, 1439 bp, Setaria italica
tgtgaatccaacccactggccgctggtgccccctcgttcagagagagtctcggaagacgaaaagcagcagccaaaaattgtggccgcgaacggaggcgaccgcgccgacggccacaccgcacgagctcttcgcctccgtccctcttcccctccccgccgccggcctctcgctccgcccctggcaggaggcaggtcctccgcctcaccccgcgtcctgtatccagggctcaaggctccagcttcaggccgcccccttacatctcgcattcgcggaaggtagtttcagggcaacgttatggaatgcttaacagcaagttttccaagaaatgtgggaaaagagcacaacttcgtatgttcaagtaagttggggtctgaaaaccaatgggttcccagaaggatctgctgctatgtccccagttcgacaaactccagtcaacagcacaagttcactactacgacatatcccatgagcccaactattggaagacgttcacgctggagatcctttgcagcaagtttgaacttagaagatggccctgcaccctccgactcaacttcttcagatggtgatgcatctgaaaatccgctttcccaaaagctgagctctgatgagttgaagtctcttttggctgattcagaacgaagtaagcttttgaggaggctcagtgaagcaaatcaatataaccggttcctcaagagacagttgcaactaaaggatgatgcagtcgtaaagttcaaaagtgaacttgccgctttggaactagaactgcaggctctggttggcctagccgaagagattgctaattttgatgttccgttagggtctaggaagataaatggaaaatatattcaatctcaccttctctccagattagaagctgttcatggtaaggttatggaccagataaaggatgttgactctttaaagccccaagaaatttctgtatactgggttggcatggccgagaatgtgcagattatgggctcgttcgacggatggtcccagggtgagacaatgtccagggagtattcaggtgactatggaagattctctgcgactctgaagctaagacctggaaggtatgagatcaagttcttggtcgatggggagtggagattgtcacctgaataccccatggctggcgagggactgacgcagaacaatattattgtcgtggagtagcagatttttctcctctagcattttagtaattctgtagagctaaaaccgtgccgaagtgtatccccatgccttcttacacctgtaatattttgctaccgtgctgttgcctcacagaactcaatgttttgtgaaacgcaagcctccagaagcatgatgtatatttggcactcaagattatctagccctctgttcatatctagtggtgtatattcaacattaccttgatcactaccaattaataacaaatcttaacgga

SEQ ID NO: 2327 - DNA, 1408 bp, Setaria italica
gccgctggtgccccctcgttcagagagagtctcggaagacgaaaagcagcagccaaaaattgtggccgcgaacggaggcgaccgcgccgacggccacaccgcacgagctcttcgcctccgtccctcttcccctccccgccgccggcctctcgctccgcccctggcaggaggcaggtcctccgcctcaccccgcgtcctgtatccagggctcaaggctccagcttcaggccgcccccttacatctcgcattcgcggaaggtagtttcagggcaacgttatggaatgcttaacagcaagttttccaagaaatgtgggaaaagagcacaacttcgtatgttcaagtaagttggggtctgaaaaccaatgggttcccagaaggatctgctgctatgtccccagttcgacaaactccagtcaacagcacaagttcactactacgacatatcccatgagcccaactattggaagacgttcacgctggagatcctttgcagcaagtttgaacttagaagatggccctgcaccctccgactcaacttcttcagatggtgatgcatctgaaaatccgctttcccaaaagctgagctctgatgagttgaagtctcttttggctgattcagaacgaagtaagcttttgaggaggctcagtgaagcaaatcaatataaccggttcctcaagagacagttgcaactaaaggatgatgcagtcgtaaagttcaaaagtgaacttgccgctttggaactagaactgcaggctctggttggcctagccgaagagattgctaattttgatgttccgttagggtctaggaagataaatggaaaatatattcaatctcaccttctctccagattagaagctgttcatggtaaggttatggaccagataaaggatgttgactctttaaagccccaagaaatttctgtatactgggttggcatggccgagaatgtgcagattatgggctcgttcgacggatggtcccagggtgagacaatgtccagggagtattcaggtgactatggaagattctctgcgactctgaagctaagacctggaaggtatgagatcaagttcttggtcgatggggagtggagattgtcacctgaataccccatggctggcgagggactgacgcagaacaatattattgtcgtggagtagcagatttttctcctctagcattttagtaattctgtagagctaaaaccgtgccgaagtgtatccccatgccttcttacacctgtaatattttgctaccgtgctgttgcctcacagaactcaatgttttgtgaaacgcaagcctccagaagcatgatgtatatttggcactcaagattatctagccctctgttcatatctagtggtgtatattcaacattaccttgatcactaccaattaataac

SEQ ID NO: 2328 - DNA, 1189 bp, Saccharum officinarum
ccgaagaggcgaaagcgacgggcagaaaactcaaaaccgtggccgcgaacacagacgaccgcgccgacagccacgagctcttcctcgtccccctgcccccacccctgcccctcggcgcggcctcttcctccgcccctagccagacgctcctccgcccctgtccgcgtccggtgctcagtcagggctcccgctccagcccgccgcccccctcgcgtcgcgcattcgcgggaggtggtttcagggcattatggaatgcttaacagcaagttttgcaagaaatgtgggaaaagagcacagctttgtatgttcaagtaagttggtgtctgaaaaccaatggattcctaaaaggatttgctgctatgcctctagcttgacaaactccagtcgatgccgcaagttcactaatatggcataccccatgagcccaattattcgaaaaaggtcacgctggagatcctttgctgcaagtttgaacttagaagatggccctgcaccctctgacttgacgtcatcttcatcagagcagactgctgatgctgatggaactaccaacggtgatgcatctgaagatctgctttctcaaaagctgagctctgatgagctaaaggctcttttggctgattcagaacgaagtaagcttttgagaagactcagcgaagcaaatcaatataaccgattcctcaagagacagttgcaaataaaggatgatgcagttgttaagttcaaaggtgaacttgctgttttggaactagaactgcaggctctggttggcctagctgaagagattgctaattttgatgttccgttagggtctaggaggataaacggaaaacatattcaatctcatcttctctccaggttagaagctgttcatgataagattatggaacagataaaggatgttgactctttaaagacccaagaaatttctgtctactgggttggcatggctgagaatgtgcaaattatgggttcattcgacggatggtcccagggcgaggcaatgtccatggagtattcaggtgactatggaagattctctgcgactctgaagctaagaccctgaaggtatgagatcaagtttttggttgatggggaatggagactgtcacctgaatatcccactgctggaaatggaatgacggaaaacaataatcctaatggtggagtaaccagaactttctcatgt

SEQ ID NO: 2329 - DNA, 2385 bp, Zea mays
cttccctgtcgctctctccccgttctggttttcgtctaatctagattggatgggatgatgattcgaggcgttagcttattttagctgtaatcccagactaaaccctggctcgttggttcggcggcctcccggtgagaatcgcatctccaatcaggtggatggagacgaagaaagtggagtctgtccctggtcataatcacgcggggagtggatgataagatcataaaaatcagacaatcatcggtcacaactcatactgttgtgtctttttttcccctgagccaccgaggccaggagtgattgattggtttaagctcagcgcacccagagtctgtgacattcatgggtagtgcctgttcgaggaagaggggccagctggtccaagaggatgatctctacagtgcgaggttctccaagagcggcagcttcaagtggctgctgcatacgctgccccgcagcaactttgctgatgtgcagcggagagcacagggcccagctccaaaccggtgcccgtcgcttgtggagctgtgcgtggccaaagtctgcaaggacataaatatgtattctgatttatccctgctgcccagagatcttagtcagcagatattcaatgagctggtggaatgtggatgcctcacggaggcatcgcttggggctttccgtgattgcgatttgcaggatatttgtctgggagactaccctggagttactgatgcttggatggaagtagtggcttctcaagggcagtccttgctatctgttgacctctcttgctcggatgtcactgatagtggattcaatcttcttaaagattgctcaagcatgcaaagtttggcatgtgattattgtgatcaaatctcagaacatggacttaagacattatcaggcttttcaaacttgacatcactgagcattaagaaatgtgctgctgttactgctgaaggagcaaaagcctttgcaaacttagttaatttggtaaacttagacctcgagcgttgtccaaagattaatggtgggcttatacatttaaaaggcttgaaaaaactggaaaaactgaatctgagatactgtaatggcatcacagattcagacatgaaatatttgtcagatctcacgaatttgagagagctacagctctcttcctgcaaaatatctgcttttggtgtttcttatctgagaggtttgcacaagctaggtcatctaaacctggagggctgtgcagttactgcagtttgtttggaggttatatctgagcttgcttcgttggtcttgttgaatctgagtcggtgtggcatatgcgatgaaggctgtgagaacttgaaaggtcttacaaaattgaaggctctaagtttagggttcaaccaaattacagatgcatgtttaattcatttaaaagatttggtcaacttggagtgcttgaacttggactcatgtaagattggtgatgagggtctatttcacctaaaaggcctcatacagctaaaaaacctggagctttcagacactgaagttggaagcaatggacttcgtcatctttctggtctgcgtaatttgcagagcatcaatctctctttcacattggttactgacattggtttgaagaagatctctggcttgagttcactgaagtctcttaatcttgacaatcgccaaatcacagatactggtttagcgtctcttacaggtctcactggattgacacacctcgacctatttggagctcgcataactgattctggcatgagctgcttcagatttttcaagaatattcagtccctggaggtctgcggtgggttgattacggatgctggcgtgaagaacatcaaggacctgaaagctctgacgttactcaatctgtctcaaaacggcaagctcacggacaaaaccctggagctgatctccggcctgactgcgctggtgtcgttgaacgtgtccaactcccgggtctccaactcgggcctccaccacctgaaaccgctgcagaacctgcgctccctatccctggagtcctgcagggtgacggcaagcgagatggataagctccggctggtcgccctccccaaccttatcagtgtgcggccggagtgatacgaccgccagcgctcccacagcgacctgtaactgtggagcaagtggcgcctggctagagcaggccgccttgtacatacttttgcaagaacgaggtgtctgtacatattgttcgtcgtgtcgtgtcgtgtcagtgtgcctgatggcaacgggctaatacgtccgtgccaacgtgtgcatggtatcccacggaccctgtgatggtaaggagcagttgtaaatatgccgtgcttcctctccatgtggggtgctgctgtataaatagattggtgcattgctaaatacctctgcttggta

SEQ ID NO: 2330 - DNA, 2400 bp, Panicum virgatum
tgtccctctcctcgctctccctttccctttcgcgggttcatttaggctctagatgcgacgatgattcgaggcgcgaagcttattttgaccttaatccgaggctaaaccctggcgcggtggctcagcggcgtctcggatggggacgaagaaagtgaagtctgtcattggtcgtaatcacgcggggaatagatgataaggtcgtaaaaaatcacacaatcatcagccagaagccacactgttgtgccttcttttgagcccatcgagggccaggagtgactggtttccgttcagtgcgcgccgcacgagccgtggacatgggcagcgcctgctcgaggaagaggggccagctggtccacgaggatgatctctacggcgccaggttctccaagagcggcagcttcaagtggctcctgcacacgctgccccgcagcaactctgctgatgtgcatagaagagcgcaggagggaacgccgggccggtgcccgtcgcttgtggagctgtgcgtggccaaagtccgcgaggacatgagtagctactctgatttctccctgctgcccagggatcttagtcagcagatattcaatgagctggtggagtgcggaggcctcacggaagcatcgcttggggctttccgtgattgtgatctgcaggatatttgtctgggagagtacccgggagtgactgatgcttggatggaagtagtggcttctcaagggcagtccttgctatctgttgacatctcttgctcagatgtgactgatagtggattgaatcttcttaaagattgctcgagcatgcaaagtttggcatgtgattactgtgatcagatctcagaacatggacttaaaacattattaggcttttcaaatttgacatcactgagcattaagaaatgtgctgctgttactgctgaaggagcaaaagcctttgcaaacctagttaatttggtaaacttagaccttgagcgatgcccaaagattcacggtgggcttgtgcatttgaaaggcttgagaaaactggaaaaactgaacctgagatactgtaattgcatcaccgattcagatatgaaatatttatcagatctcacaaatttgagagaactacaactatcatcctgcagaatctctgattttggtgtatcttatctgagaggtctacacaagctagctcatctaaacctggagggctgtgcagtcactgcagcttgtttggaggttatatcaggattggcttcacttattttgctgaatttaagtaggtgtggcatatgcgacgaaggctgtgagaacttggaagatcttgtcaaattgaaggctctaaatttagggttcaaccacattacagatgcctgtttaattcacttaaaagatttgatcaacttggagtgcttgaatttggactcatgcaagattggtgatgagggtctatttcacctgaaaggcctcgtgcagctaaaaaacctggagctttcagacactgaagttgggagcaatggacttcgtcatctctctggtctacgtaatttgcagagcatcaatctctcttttacattgattactgacattggtttgaagaagatttctggtttgagttcactgaagaatcttaatcttgacaatcgccaaatcacagatactggtttagcagctcttacaagtctcactgggctgacacaccttgacctatttggagctcgtataactgacgcaggcacaaactgcttcagatttttcaagaatcttcagtccctggaggtctgtggtgggtcgatcacggatgcgggcgtgaagaacatcaaggacctcaaagctctgacgctgctcaacctatctcagaatggcaacctcacggacaaaaccctggagctgatctctggcctgactgcgctggtgtcgctgaacgtgtccaactcccgggtgtccaactcgggcctccaccacctgacgccgctgcagaacctgcgctccctgtccctggagtcctgccgggtgacgccggccgagatcaagaagctccggctggccgccctccccaacctgatcagcgtgcggccggagtgatacggccaggcaggcactgtcgcagcagcgatctgtaactgtaagcaaatggtggcctggctggagcatgccgccctgtacatatttttgcaagaacaagcttgagcagtctgtacatattggtctttgtgtcgtgtcggcgtgcctgacggtcgccggactagactactccgccctatccccatataccccaggaatttgtgatgggaaggaacaattgtaaatatgccgtgcttcctctccatgtggggtgccgctgtgtaaatagtggattggtgcacttctagatgctacttttgcttggtcgtaaaatcatggtaccataggctttgctccaaaa

SEQ ID NO: 2331 - DNA, 1878 bp, Saccharum officinarum
ttccccgttctctctcgtgtgggttcgtctaatctagattagatgcgataatgattcgaggcgctagcttattttagctggaatcccagactaaaccctgactccttggttcagcggcctcccggtgagaatcgcatatccgatcaggatggagagaagaaagtgaagtctgtccctggtcacaatcacgcggggagtggatgataagatcataaaaaaaatctgacaatcatcagtcacaactcatattgttgtgttttttccctgagccaccgaggccaggagtgattgattggtttaagttcagcgcacgccggaagcggtgacatcatgggtagtgcctgttcgaggaagaggggccagttggtccaagaggatgatctctacagtgcgaggttctccaagagcggcagcttcaagtggctgctgtacacgctgccccgcagcaactctgctgatgtgcagcggagaacacagggcccagccccaggccggtgcccgtcgcttgtggagctgtgtgtggccaaagtctgcaaggacataaatacgtattctgatttctccctgctgcccagagatcttagtcagcagatattcaatgagctggtggaatgtggatgcctcacggaggcatcgcttggggctttccatgattgcgctttgcaggatatttgtctaggagactaccctggagttacagatgcttggatggaagtagtggcttctcaagggcagtccttgctatctgttgacctctcttgctcggatgtgaaggatagtggatagaatcttcttaaagattgctcgagcatgcaaagtttggcatgcaattattgtgataagatctcagaacatggactcaagacattatcaggcttttcaaacttgacatcactgagcataaagaaatgtgctgctgttactgctgaaggagcaaaagcctttgcaaacttagttaatttggtaaacttagacctcgagcgatgtccaaagattcacggtgggcttgtacatttaaaaggcttgaaaaaactggaaaaactgaatatgagatactgtaattgcatcacagattcagacatgaaatatttatcagatctcacgaatttgagagagctacagctctcttcctgcaaaatctctgattttggtgtttcttatctgagaggtctgcacaagctaggtcatctaaacctggagggctgttcagttactgcagcttgcttgaaggttatatctgaactggcttcgttggtcttgttgaatctaagtcggtgtggcatatgcgatgaaggctgtgagaacttggaaggtcttacaaaattgaaggctctaaatttagggttcaaccacattacagatgcatgtttaattcatttaaaagatttgatcagcttagagtgcttgaacttggactcatgtaagattggtgatgagggtctatttcacctgaaaggcctcatacagctaaaaagcctggagctttcagacacagaagttgggagcaatggacttcgtcatctctctggtctacgtaatttgcagagcatcaatctctcttttacattggttactgacattggtttgaagaagatctctggcttgagctcactgaagtctcttaatattgacaatcgccaaatcacagatactggtttagcatctcttacaagtctcactggattgacacaccttgacctatttggagctcgcataactgattctggcatgaactgcttcagatttttcaagactcttcagtccctggaggtctggggtgggttgattacggatgcccgtgtgaaaaacatcaaggacctgaaagctcttacgttactcaacctatctaaaaatggcaacctcacggacaaaacccta

SEQ ID NO: 2332 - DNA, 2494 bp, Brachypodium distachyon
ctccgtgtcgtggtcagttcgccactctctcacgagacttcgccggattgggtacgatggcgattccaggcgctgggtttgttgagctctaaatccgaggcccaaacctgcctacccggatttggtagttttgggtgaccgaattccacatccgatcggaatggtggggaagaaagcgaagtttgtgccaaatcgtagtcacaccagggatggatgctgaagaatgatgcagtcatcagcactcagcaccaaccaaccagcacttctatatgcaccttgtgaggccatccatggactgtgacattgtgtacccatcgatagccttgaggcagtgattgggttctgttcagtatacgaacttcagtcatgggcagtgcttgctcgaggaagagagggcaattggtccatgaggatgaactgtacagtgtgaggttctcgaagagtggcagcttcaaatggctgctacacacgctgtcccgcagcagctctgatgtgctccggaaggcgcagagacctgggccaggtcactgcccttcgctagtagaactctgtgtggccagagtccgtgaggatataagtaggtattcagatttctcgatgctgcctagggatcttagccaacagatattcaatgaactggtggagtggagctacctcactgaggagtcactggaagcttttcgtgactgtgctttgcaggatatctgtctggaagagtaccctggagtgaaggatgcttggatggaagtagtcgcttcgcaagggcaatccttgctatccgttgacatctcttgctctgatgtaactgatagtggattggatgttctcaaggattgctcaaatatgcaaagtttggcatgcaattactgtgatcaaatctcggaacatggacttaaaacattgtcaggcctctcaaacttgacatcgctgagccttaagaaatgtgctgctgttaccgccgaaggagcaaaggcctttgcagacttagttaatttggtaaacttggaccttgagcgatgtccaaaaattcatggtggccttgttcatttaaaaggcttgagaaaactggaaacactgaatatgagatattgtaactgcatcacagattcagatatgaagtatttatcagatttaacgaatctgagagagttacaactgtcctgctgcaaaataagtgatattggtgtttcttatctgaaaggtctatccaagctagctcacttaaatctggagggctgtgcagtgactgctgcttgtttggaggctatctcaggattggcttcattgatcttgttaaatctgaataggtgtggcatatatgatgaaggctgtgagaacttggaaggtcttgtcaaattaaaggttcttaatttaggattcaaccacattacagatgcctgtttggttcatctaaaagaattggtcagtttagaatgtttgaacttggactcatgcaagattggtgatgaagggctattacacctgaaaggccttttgcagttacgcagtttggaactgtcggacactgaagtcgggagcaatggacttcgtcatctctctggtctgcgtaatttgcagagcatgaatctctcttttacattggtcacggacattggtttgaagaaagttgctggcttgaattcactgaagtcacttaatcttgataatcgccaaatcacagacaatggcttggcagctcttgcaggtctcactggattaacacaccttgatctatttggagcccgtataactgattctgggacaaactgcttgagatatttcaaggagttacaatctctcgagctctgtggtgggttaattacagatgctggagtgaagaatatcaaggatctcaaagctctaacgctgcttaacctatcccaaaatggcaacctcacggacagaaccttggagctgatttcgggcctgactgctttggtctcattgaatctgtcgaacacccgtgtgtccaatgctggtctccaccatctgaagctgctgcagaatctgcgatcgttgtctctagactcgtgcaaggtgacggcgagtgagatcaagaagatacaattggcctcccttccgaacctgataagtgtgcggccagagtaatctggtaattggcacctttacgcacctgtaaatagccacctgcttagagcaggccatcttgtacataatctgcaagaacgggcttgtgcgtccgtatgctggtcttctaagttatgcgtctgatctggtagactgaaaaatatcgcccaccaaagctgatgggaagaaacaactgtaaatatgtcgtgcttcctccgcatttgggatgctggtatgtaactggtggtgtcgctaagtttctctgcgtggtgttattcagttagatttctgtgctgaactgcttatacttcgtctgaggcttagctgcatatgtatcttgtatccagaatatccagttaaaaataagcatgtctgcatgtgtatgtggaaactttgaatgctccaa

SEQ ID NO: 2333 - DNA, 2375 bp, Oryza sativa
ccccttctcgagtccctctcctcccccctctctctttctcggcgaggattggctgtgtgattagaggtaatttaatcgcgatagattggtttaactctaatccgggagtttgcttggcctagggtttggtggatttgcgtccctgtgagaatttccatatccaatcggaatggggccaaagagagcgaagtctatgccaagtcgtaatcgtgctgggaatggatgacaaagaatcacacagtcacgagctagaatgatatgcgctttttagtccatcaagaagaagtgattggtttgtgatcggtgctcgcatcgtcgccatgggaagtgcttgctctaggaagagaggccagctgcttgttgatgaggaagatctctacagtgcaaggttctccaagagcagcagcttcaagtggctactgcacaccttgccccgcagcggctctgatgtacacaggaaggtgcagggaccagtgcctgtgcggtgcccatcgctaatggagctctgtgtggccaaagtccgcgaggatattgggaagtattctgatttctcgctgctgcctagagatcttagtcagcaggtatttaatgaactggtggagtggaacattctcactgaagagttgcttggagcttttcgtgattgtgcattgcaggacatctgtttggcagactaccctggggtgagggatgcttggatggaagtagcggcttctcaagggcaatcattgttatctgttgatatctcttgctctgatgtgactgatggtggactgaatcaactcaaggattgcatcaacttgcaaagtttgtcatgcaattactgtgatcagatatcggagcatggacttaaaacattgtcaggcctctcaaatgtgacatccctgagctttaaaaaatgttctgctgttactgctgaaggagctaaagcctttgcaaacatggttaatttgggtagcttggaccttgagcgatgtccgaagattcatggtggacttgttcatttaaaaggcttgagaaaactggaaaagctaaatttgaggtattgtaatggcatcacagattctgatatgaaacatttatcagatcttacaaatttgagagagcttcaactttcttgctgcaaaataagtgatcttggtgtttcttatctaagaggtctatcgaagctagctcacctaaacctggagggctgtgcagtaactgctgcttgtttggaggttatttcaggattggcttcattggtattgttgaatcttagtagatgtggagtatatgacgaaggctgtgagcatttggaaggtcttgtcaagttgaaggttctcaatttagggttcaactatattacagatgcctgcttggttcatctaaaagaactgatcaatttggagtgtttgaacttggactcatgcaagattggtgacgaggggctagcacatttgaaaggacttctgaaactaagaagcttggaactttcagacacagaagttgggagcaatggacttcgtcatctctctggcctacggaatttgcagagcatcaatctctcttttacattggttacggacattggcttgaagaaaatttctggcctgaattcactcagatcccttaatcttgataatcgccaaatcacagataatggtttggcagctcttacatgtctcactgggttgacacaccttgatctatttggagctcgtataactgatgctgggacaaactgcttgaaatatttcaagaatctacagtcccttgaggtctgcggtgggttaattacagatgctggagtgaagaatatcaaagacctcaaagctctgacgctgcttaacctatctcaaaatggcaacctcactgacaaatccttagagctgatttcccgcctcactgccttggtctccctgaacgtgtcgaactctcgggtgtcgaattctgggctccaccatctgaagccactccagaacctgaggtccttgtctctggagtcctgcaaggtgaccgcgattgagatcaagaagctccagttggctgccctgcccaatctcgtcagtgtgcggcccgagtaatctggtagctgcacatgtgtccacatgtaaatatccacctgcttagagcaggacaaatgtacatattcccacaagaacaagctcgagtgatctgtacgtcagtcctgcttgtatcggtgtgtctggtcgccctggtgctgaagggtctgatggatggcctagtggtgaagggctggcacgtatttaggccgtgtaaatatgtagcggtgctgatgggaaggaacaactgtaaatatggcgtgcttcctctgcattttcgatgttatgtaatgtttcgtgttatcgtgttaatgaactggtattgttgct

SEQ ID NO: 2334 - DNA, 2495 bp, Setaria italica
cctgtcgcctcttcccttctctctcgcgggttcgttttagtttagatgcgatgatgattcgaggcgcagagcttattttaaccttaatccggggctaaaccctggcccggcggctcagcggcttctcggtgagaatcccgtatccgatcgggatggagacgaagaaagtgaagtctgtcactggtcgtaatcacgcgggggaatggatgataaggtcgtaaaaaatcacacaggcatcagcctgaagccatactgttgtgtcttcttttgagcccatcgagggtcagggggtgattggtttgcgttcagtgcacgccgcgcacgccgtcgccatgggcctgctcgaggaaaaggggccagctggtccacgaggatgatctctacagcgccaggttctccaagagcggcagcttcaagtggctgctgcacacgctgccccgcagcaactctgctgatgtgcacaggagagggcaggggccagcgccgggccggtgcccgtcgcttatggagctgtgcgtggccaaagtccgcgaggacatgaataggtactctgatttctcccagctgcccagggatcttagtcagcagatattcaatgagctggtggagtccggatacctcacggaggcatcgcttggggctttccatgattgtgatttgcaggatatttgtctgggagaataccctggagtgactgatgcttggatggaagtagtggcttctcaagggcagtccttgctatctgttgacatctcttgctcagatgtgactgatagtggattgaatcttcttaaagattgctcaagcatgcaaagtttggcatgtgattactgtgatcgaatctcagaacatggacttaaaacattatcaggcttttcaaacttgacatcactgagcattaagaaatgtgcggctgttactgctgaaggagcaaaagcctttgcaaacttagttaatttggtaaacttagaccttgagcgatgcccaaagattcatggtgggcttgtgcacttgaaaggcttgaaaaaactggaaaaactgaatatgagatactgtaattgcatcacggattcagatatgaaatatttgtcagatctcacaaatttgagagagctacaactgtcttcctgcaaaatctctgattttggtgtttcttatctgagaggtctacacaagctagctcatctaaacctggagggctgtgcagtcactgcagcttgtttggaggttatatcaggattggcttcgttggtcttgttgaatttaagtcggtgtggcatatgtgatgaaggctgtgagaatttggaaggtcttgtcaaattgaaggctctaaatttagggttcaaccacattacagatgcctgtttaattcatttaaaagatttgatcaacttggagtgcttgaacttggactcatgcaagattggtgatgagggcctatttcacctgaaaggcctcgtgcagctaaaaagcctggagctttcagacactgaagttgggagcaatggacttcgtcatctctctggtctacgtaatttgcagagcatcaatctctcttttaccttggttactgacattggtctgaagaagatttctggcttgagttcactgaagtctcttaatcttgacaatcgccaaatcacagatactggtttagcagctcttacaagtctcactggactgacacaccttgacctctttggagctcgcataactgatgctggcacaaattgcttcagatttttcaagaacctccagtccctggaggtctgtggtgggctgatcacggacgctggcgtgaagaacatcaaggacctgaaagctctgacgttgctgaacctatctcaaaacggcaacctcacggacaaaaccctggagctgatctccggcctgaccgcgctggtgtcgctgaacgtgtccaattcccgagtgtccaactcgggcctccaccacctgaagccgctgcagaacctgcgctccctgtccctggagtcctgccgggtgacgccgaccgagatcaagaagctccggctggccgccctccccaacctgatcagcgtgcgcccggagtgatgcggccggccggccggcactcttgcagcagcgacctgaaactgtaagcaaatggtgcctgactagggcaggccgacctgtacatattatttttttttgtcttttgaactgttgtacatatttttgccaggacaagcttgagcagtctgtacataggtcttttgtcgtgtcggtgtgcctgacgggcgccgggctactgcgtccgtgtaccccctttccccacgaatgctgtgatgggattgggaaggaacaattgtatatatgccgtgctccctatccgtgtgggtgccgctgtgtaaatagaattggcgcactgctagatacggagtaactcctacctttggttggtcgtaaattgatatcgtggtagtcctcaataggataataggctttatgccagttttgatgtgatgacttccgcg

SEQ ID NO: 2335 - DNA, 2407 bp, Triticum aestivum
ccggacctgacctgacctcgcgtcgtcactgtcgctcgcgagacttcgccggattggaatcagatacgacacgacggcgacgatttcagccgccggctccgtcgagctccgctaatccgtggctcagcccagcatcaggtggctccggtggcctgattcgacgcccgatcaggatggcgttgaagaaggccaagtcgtagtcacgcctggaatggatgctagggaatcgagccgtggccaggaagaacacgcacctctgagtctatccatggtctgtgacactgtacgtccatccatagacttgaggcagtgatcaggttttgttcagtgcaagaactcgccatgggcagtgcctgctcaaggaacagaggccaagtggtccatgaggatcaactgtacagcgtcaagttctccaagagcggcagcttcaagtggctgctccacacgctgtcacgcagcagctctgatgtgctccggaaggcgcagggaccgggcccaggtcgccgcccgtcgctggtggaactttgcgtggccagagtccgtgaggacataagtaggtattcagatttctccatgctgcctagggatcttagccagcagatattcaacgaactggtgcggtgtagctacatcaatgaggagttgctgggagcttttcgcgactgtgctttgcaggatatttgtctggatgagtaccctggagtgaaggatgcttggatggaagtaatcgcttctcaagggcagtccttgctatctgttgacatctcttgctctgatgtgactgatagtggattgaatcttctcaaagattgctcaaatatgcaaagtctggcatgcaattactgtgatcgaatttctgagcatggacttaaaacagtgtcaggcctctcaaacttgacatcgctcagccttaagaaatgtgctgctgttacagctgaaggagcaaaagcctttgcaaagttagttaacttggtaaatttggaccttgagcgatgcccaaaaattcatggtggccttgttcatttaaaaggcttgagaaaactggaaacactgaacatgagatattgtaacggcatcacagattcagatatgaagtatttatcagattttacgagcttgagagagttgcaactgtcttgctgcaaaataagcgattgtggtgtttcttatctgagaggtctgtccaaactatcccacctaaatctggagggctgtgcagtgactgctgcttgtttggaagctatatcaggattggcttcattggttttgttaaatctcaataggtgtggcatatgtgatgaaggctgtgagaaattggaaggtcttgtcaaattgaaggttcttaatttagggttcaaccacattacagatgcctgcttggttcatctacgagaattgatcaatttggagtgtttgaacttggactcatgcaagattggtgatgaggggctattgcacctgaaaggccttttgcagttgagaagtttggaactttcggacactgcagttggaagcaatggacttcgtcatctctctggtcttcggaatttgcatagcatgaatctctcttttacagtgattacggacattggtctgaagaaaattgctggcatgaattcactgaggtcacttaatcttgataatcgccaaatcacagacaatggcttggcagctcttacaactctcaccggattaacgcaccttgatctttttggagctcgtataactgatgctgggacaaactgcctcagatgtttcaagggtctgcggtctctggagctctgcggtgggctaatcaccgacgctggagtgaagaacatcaaggacctcaaagacctgacgttgcttaacctatcccaaaacggcaacctcacagacaagaccttggagataatctcgggcctgaccgctttggtctcgctgaacctgtcgagctcccgggtgtccaacgccggcctccaccatctgaggccgctgcagaacctgcgctcgctgtcgctcgactcgtgcaaggtgacggcctgcgagatcaagaagcttcagctggccgccctccccaacctggtaagcgtgcggccggagtagtccggtaatcggcacctccgtccatctgtagatagccactacgagtagagcaggcagaacgtgcctgcgcgtctgtacatacatagtcttgtgagtcacgcgagggattgatctgatgatagactgaactgctgtttatgtcgtctacggtgtgcccattaaagctgatgcgaagaaacaactgtaaatgcgtcgtgcttcctccgcatttgggatggtatgtaaaatgtaatggctcctgtacataacagttggtgtttgcgaagttttgccgcatggtgctacgatcctggttacaattctcagtgcggatcgctttccc

SEQ ID NO: 2336 - DNA, 2327 bp, Hordeum vulgare
tcgtggccggacctgacctcgtgtcgtcactgtcgcccgcgaggcttcgccggattggaaccgggtacgacacggcggcgatggtttcagccgccggccccctcgagctctgctaatccgcggctcggcccggcatccggtggcctaattcgacgcccgatcaggatggcgttgaaggatgccaactcgtaatcgtcacgccctggaatggatgctagagaatcaagccgtcggcacctctaatatgcacctttgagtctatccatggtctgtgacactgtacgtccatccatagacttgagcaagtgatcaggttttcttcagcgcaacaactcgtcatgggcagtgcttgctcaaggaacagaggccaagtggtccatgaggaccaactgtacagcgtcaagttctccaagagcggcagcttcaaatggctgatgcacacgctgtcccgcagcagctccgatgtgctccggaaggcccagggaccgacgccaggtcgccgcccaactctggtggaactttgcgtggccagagtccgtgaggacataagcaggtattcagatttctccatgctacctagggatcttagccagctgatattcaacgaactggtgcagtgtagctacatcaatgaggagttgctgggagcttttcgtgactgtgctttgcaggatatctgtctggatgagtaccctggagtgaaggatgcttggatggaagtaattgcttctcaagggcagtccttgctatctgttgacatctcttgctctgatgtgactgatagtggattgaatctccttaaagattgctcaaatatgcaaagtctggcatgcaattactgtgatcaaatttctgaacatggacttaaaaccgtgtcaggcctctcaaacttgacatcgctcagccttaagaaatgtgctgctgttacagctgacggagcaaaagcctttgcaaacttagttaacttggtaaatttggaccttgagcgatgcccaaaaattcatggtggccttgttcacttaaaaggcttgagaaaactggaaacgctgaacatgagatattgtaacggcatcacagattcagacatgaagtatttatcagattttacgagcttgaaagagttgcaactgtcttgctgcaaaataagtgattgtggtgtttcttatctgagaggtctgtccaaactatcccacttaaatctggagggctgtgcagtgactgctgcttgtttggaagctatatcaggattggcttcattggttttattaaatctcaataggtgtgccatatgcgatgaaggctgtgagaaattggaaggtcttgtcaaattgaaggttcttaatttaggattcaaccacattacagatgcctgcttggttcatctaagagaattgatcaatttggagtgtttgaacttggactcatgcaagattggtgatgaggggctattgcacctaaaaggccttttgcagttaagaagtttggaactttcggacactgcagttgggagcaatggacttcgtcatctctctggtcttcggaatttgcatagcatgaatctctcttttaccgtgattacggacattggtctgaagaaaattgctggcttgaattcactgaagtcacttaatcttgataatcgtcaaattacagacaacggcttggcagctcttacaactctcactggattaacgcaccttgatctttttggagctcgtataactgatgctgggacaagctgcttcagatgtttcaagggtctgcagtctctggaggcctgcggcgggttaatcaccgacgctggagtgaagaacatcaaggacctcaaagccctgacgttgctgaacctatcccaaaacggcaacctcacagacaagaccttggagataatctcgggcctgacgtctttggtctcgctgaacctgtcgtactctcgggtgtcgaacgcaggcctccaccatctgaggccgctgcagaacctgcgctcgctgtcgctcgactcgtgcaaggtgacggcctgcgaggtcaagaagcttcagctggccgccctccccaacctggtaagcgtgcgtccggagtagtcttccggtaacaggcaccttccgtccacgtgtaaatatgaccaccccgagtagagcaggcagaacgggcctgcgcgtctgtacatacatagtcttgtgagttacggcaaggattgatctgatgatagactgaactgtttatgtcgtctgtttatggtgtgcccatcaaagctgatgcgaagaaacaactgtaaatgcgtcgtgcttcctccgcatttgggattggataatgtaatggttcgtgta

SEQ ID NO: 2337 - DNA, 1221 bp, Saccharum officinarum
cagcccgcagccgcaggcttccctagttccgtcagaaatcccccttctcgagtcctccatctcatccctcccaccccaaatacatccaggcggcgccatcagcccggcgacgcgcacgcgaggccgaccatcgaaccctagtcgccagccgagccgctcgcccgccgctctcttgggatcgctcgcccccgccgcgcggccgctctgcgtcgaccctcttattgtctccgtccgacaccgcttggatccgaatagagatggaatcaccgcccctcacagctgaagcgattgcttttaccgagaaaaagatggacatgactttggaggatataatcaagatgtcaaagaaaaagaatcctggaggcaagaaacctcccaggcagccgatcaaaaagcacccattccagaatggcaactctaataaagggaatggcaaggttcaacggtttatggaatctagatcaaccattagacaaggtgttcttgcacagagaaggtcaaatcttggtggaagtcagttctctgctacaaagcaggctgcgaagaaggctgctgctatgccaatgcgcaacggggctgtccgttggaacaagccaagtgcaagtaccttagtgcagaggaggcctgtaggtgatgcttttcagaatgccaaggtcaaggagtcgcagaaccaggcagcaccaaggacgatggatgcactctttgcacagatgaaggcgcaacgcatgaggaccgtaccacagcagcaggcaaatcctgcccctgggcgtcatttcaaccagcagcgacgtgttcagcagcagcagaggcgaggtagaggatatggtggccgtaatgttggcaaccaatgaattcaaggcgtatctgctgcatcgaagccctttctcttcactggtcttttggaccttggaagaaaggacgcccctgggaaaatctaacttggctttgtttattggaggaaaggttgtggacagaatatgaagcaaagtttgtgtggagttttctagttgctggcttccgtttcagcatgtataaaacctatgggaattatttggtactagattatgatgtcgtgtttcttgagttgagtaggttcatctcttcttcaaaagaattaggagtaatttaccttttaccatatgtataaattttaaaataccattcctgtgaggttgacaagctgggtatatgatactcttttcgtttcaaaattataagacg

SEQ ID NO: 2338 - DNA, 1576 bp, Zea mays
tcgtcagcaatcctaatccaaaccgccgcggccacggccgcagccttccatagttctgtcagaaattccccttctcatccctgatccctccaactcccaccccaatacatcctgccgacgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagtgctgtgtgctgtcaggagccgtggggcggcgcgaccgcgctggctgcctggctcggaggcagcttggcagcttgcagtggccagcgcccagcggctgctcgcgcgtaggcgcaggcgcgcacggcgcagcggccagcggcggctcggacgctcggtcagcccctggggcctggctgcctgggctcggtcgctcggaggcaggcagggaggcaggcatcggctctgcctctgctggctgcggctgctcgtggcctcgcgccgtcgcgctcgcgcgcaggggtgggaaactggggccgctgctcggtcgcgcgcaaggagatggaatcaccacccctcacagctgaagcaattgcttttaccgagaaaaagatggacatgactttggaggatataatcaagatgtcaaagaaaaagaatcctggaggcaagaacccccctaggcagccgatcaaaaagcgtccattccagaatgccaacactaataaagggaatggcaaggttcaacggtttatggaatctagatcaaccattagacaaggtgttcttgcacagagaaggtcaaatcttggtggaagtcagtttgctgctacaaagcaggctgcaaagaaggctgctgctatgccaatgcgcagcggggctgtctattggaagaagcctagtgcaagtaccttagtgcagaggaggtcagtaggtgatgcttttcaaaataccaaggtcaaggagtcgcagaaccatgcagcaccaaggacgatggatgcactctttgcacggatgaaggcgcaacgcatgaggaccgcaccacagcagcaggcaaatcctgcctctggacgtgatttcaaccagcagcgacgtgttcagcagcagcagaggcgaggtagagcatatggtggccgtgttgtcggcaaccaatgagcatatttggtgcatcgaagccccttctcttcactggtcttaaggaccttgagggctagtttgggaactctatgtttctctattttctcaagtgaaaatgagctaatttttcttgggaaaatgaggttttcaaactagccttgaatgaaaggacgccgggggaaaatctaacttgactttctttgttggatgaaaggatgtggacagaatatgaagcgaattttgtgtgactctagttgtctgcttctgttcagcatgtacactgacctacggaaattacttgctagattttgatgtcatgtttattgagttgatttggttcgtctcttcaacagaactaggagtattcgccttttaccatatgtataaaattttaaatacctttactgtgaggtagacaagctg

SEQ ID NO: 2339 - DNA, 1116 bp, Panicum virgatum
ctccacctcatcgctgccatacgcatccggctggcaccatcaagccccccgcgacgcgcgtgccgctccggccaccgaaccctaggccgcccgcccgcccgcccgctcgcggtataactcgccgcagccgcgcggcccccctgtcgcgccgccgctcggatccgagatggaatcactacccctaacagctgaagctattgcctttaccgagaaaaagatggacatgactttggaggatataattaagatgtcaaagaaaaagaatcctggaggcaagaaaccccctaggcagccgatcaaaaaacgcccattccagaatggcaactctattcaagggaataccaaggttcaacggtttatggaatctagatcgaccatcagacaaggtgttcttgcacaaaggaggtcaaatcttggtggaaatcagttccctgttacaaaacaggctgcgaagaaggctgctgctatgccaatgcgcaataaggctggcagatggaacaagccaagtacgagtaccttagtgcagaggaggcctgtcagtgatgcttttcagaatgggaaggccaaagagacgcagaaccaggcagcaccaaggacgatggatgcactctttgcacagatgaaggctcaacgcatgaggaccgtgccacagcagcaggcaaatcctgccactgggcatcagttcagccagcagcgacgtgttcagcagcaacagaggcgaggcagaggatatggtggccgtaatgttggcaaccaatgaattgaactaggctttatcagcggcgctaaagcaaggttttcactggtttcttggaagaaaggacgaaacccccctggaaatcttacttgattgcgtttgtttcgcatattttagttatatcggaagctcgtggacagaaattaagtgaagcttgtatgcggttttctagttgctgcttcatgtataatgaccaacataatgtatggaaattattttggtgttagactatgtcaaattttgttagttcaagtgattaggtactttctttctttttttccaaataattaattcgtcctttataccttgtataaatccgaaaataccattactgaaagattgtctgctgaaaatacttc

SEQ ID NO: 2340 - DNA, 1103 bp, Zea mays
gacgcggcccgcagccacggccttccgtaatgtcataactccccttctcgagtccatctccaacctcatccctcccaccccaataatacatccagccggcgccatcaggcccggcaacgcgcaagcggggctgaccatcgaaccctagtccccggccgagccgccctccgccgagccttgcggccgctctgcgtcatccctcttagtctccctccgttcgacacggcttggatccgagatggaatcaccgcccctcacagctgaagcaattgcttatacagagaaaaagatggacatggctttggaggatataattaaaatgtcaaagaaaaagaatcctggaggcaagaaacccccgaggcagccgataaaaaagcatccattccagaatggcaactctaataaagggaatggcaaggttcaaagttttatggagtctagatcaaccattagacaaggtgttcttgcacagagaaggtcaaatcttggtggaaatcagttccctgctacaaagcaggctgcgaagaaggctgctgttatgccaatgcacaagggggctatccgttggaacaagccaagtgcaagtaccttagtgcagaggaggcctgtaggtggtgcttttcagaatgccaaggtcaaggagtccaaccaggcagcaccaaggacgatggatgcactctttgcacagatgaaggcgcaacgcttgaggacggtacctcaacagcaggcaaattcttccccctggagtcatttcaaccagcatcgacgtgttcagcagcagcagaggcgaggcagagggtatggtggccgtaatgttggcaaccaatgaatccaactagacatatctactgcatcggagccctttctcttcactggtcttttggaccttggaagaaaggacgccccttggaaaatcaaacttggctttgtttattggaggggtgacaatgggctctaacttggctttgtttattggaggggtgacatcgggctctaaattttacactaagatttaaggatctgattaagatcaggccctatttctattcatttttaaactaaaatttatttagtgtcctactattttgtgaagcgtttggatc

SEQ ID NO: 2341 - DNA, 1158 bp, Setaria italica
gccttcgtcaaaaattctaagtccacctcatcccggtcggtcgtacacatccggccggcgccatcatcttcccccgcgacgcacacgcgcgtcccaccgccgaaccctaggccgccgcccgcccgcccctcccactgctcctcgcgggatcgcccgccgcgtggtccccgcacgcgtcgactaccgcctcgccgagtctccatccgccgccgctcggatcctagatggagtcacttccactcacagctgaagctattgcttttaccgagaaaaagatggacatgactttggaggatatcatcaagatgtcaaagaaaaagaatcctggaggcaagaaaccccctagacagccgatcaaaaaacacccattccagagtgggaactctaatcaagggaatgccaaggttcaacggtttatggaatctagatcggccattagacaaggttttcttgcacaaaggaggtcaaaccttggtggaaatcagttccctgttacaaagcaggctgcgaagaaggctgctgctatgccaatgcgcaacaaggctgtcagatggaacaagccaagtgcgagtaccttagtgcagaggcagcctgtaggcgatgcttttcagaatggcaaggccaaagagacacagaaccagggagcaccaaggacgatggatgcgctcttcgcacagatgaaggcgcaacgcatgaggaccgtgccacaacagcaggcaaatcctgcccctgggtgtcagttcaaccagcagcgacgtgttcagcagcagcaaaggcggggcagaggatatggtggccgaaatgttggcaaccaatgaactagtcttgatcatcagctgcactgaagcattgttgcactagcttcttggaacaaaggacgaaccccctggaaatctaacttggctgcgtttgtttctcatattttagttattggaagcttgttgacagaatatttagtgaagtttgtctgcagttctctggttccctgcttccgtttcagcatgtataatgtccaacacaatgtatggaaattatttgctgctagattatgctgtcattttttttatttgaactgattaggtacctttctgttccaaagaactaattcgccctttaccatgagtataaattagaaaacgccattaatgtgagattgtc

SEQ ID NO: 2342 - DNA, 1025 bp, Panicum virgatum
cccagcgtatatccacccacccacacaccttcctcgacgaaaaatccccgcctccacctcatcgcggccgtacgcatccggccggcgccgtcagctccccgcgacgctccggccaccgaaccctaggccgcccgcccgcccgcgggatcgctcgccgcagccgcgcgggccccctgtcgcgccgccgctcggatccgatggagtcactacccctaacagctgaagctattgcttttaccgagaaaaagatggacatgactttggaggatataatcaagatgtcaaagaaaaagaatgctggaggcaagaaaccccctagacagccgatcaaaaaacgcccattccagaatggcaactctactcaagggaatgccaaagttcaacggttcatggaatctagatcgaccatcagacaaggtgttcttgcacaaaggaggtcaaatcttggtggaaatcagttccctgttacaaagcaggctgcgaagaaggctgctgctatgccaatgcgcaacaaggctggcagatggaacaagccaagtacgagtaccttagtgcagaggaggcctgtaggtgatgcttttcagaatgggaaggccaaagagatgcagaaccaggcagcaccaagaacaatggatgcgctctttgcacagatgaaggctcaacgcatgaggaccgtgccacagcagcaggcaaaccctgcccctgggcatcagttcaacccccagcgacgtgttcagcagcagcagcagcagcagaagcgaggcagaggatatggtggccttaatgttggcaaccaatgaattggttgggcttcgtcagcggtgccgaagcaagggtttcactggtttcttggaagaaaggacgaacccccctggaaatctaacttggttgcgtttgtttcgcatattttagctatcggaagcatttggacagaaattaagtgaagcttgtatgcacttttctagttgctgcttccgtttcagcatgtataatgaccaacataatgtatggaaattattttagtg

SEQ ID NO: 2343 - DNA, 1063 bp, Pennisetum glaucum
cgacgaccgaccttcttggcgtcgccgggcaaaccgacgcagcccggcaccccacccacacgccttcgtcaaaaatcccaagtccacatcatcccggtcggtcgtacgcatccggccgccgccatcatcttccccgccgcgacgcacacgggagtctcaccgccgaaccctaggccgccgcccgccccgccaccgcgcggcccccgcacgcgtcgaccgcctcgccgagtctccatccgccaccgctcggatccgagatggaatcacttccactgacagctgaagctattgcttctaccgagaaaaagatggacatgactttggaggatatcatcaagatgtcaaagaaaaagaatcctggaggcaagaaaccccctagacagccgatcaagaaacgcccattccagaatggggactctaatcaagggaatgccaaggttcaacggtttatggagtctagatcggccattagacaaggtgctcttgcacaaaggaggtcaaaccttggtggaaatcagttccctgttacaaagcaggctgcgaagaaggctgctgctatgccaatgcgcgacaaggctatcagatggaacaagccaagtgtgaataccttagtgcagaggcggcctgtaggcgatgcttttcagaatggcaaggccaaagagacacagaaccagggagcaccaaggacaatggatgcgctcttcgcacagatgaaggcgcaacgcatgaggaccgtgctacagcagcaggagaatcctgcccctggacgtcagttcaaccagcagcgacgtgttcagcagcagcaaaggcggggcagaggatatggtggccgaaatgttggtaaccaatgatctagtcttcatcagctgcactgaagcactgttgcactatcttcttggaacaaaggacgaacccccctggaaatctaacttggctgcacttgtttctcatgttttagttatcggaagcttgtggactgaatattaagtgaagtttgtctccatttttctagttgcctgcaagtttcagcgtgtataatatccaacataatgtatggaaatta

SEQ ID NO: 2344 - DNA, 909 bp, Setaria italica
acagctgaagctattgcttttaccgagaaaaagatggacatgactttggaggatatcatcaagatgtcaaagaaaaagaatcctggaggcaagaaaccccctagacagccgatcaaaaaacacccattccagagtgggaactctaatcaagggaatgccaaggttcaacggtttatggaatctagatcggccattagacaaggttttcttgcacaaaggaggtcaaaccttggtggaaatcagttccctgttacaaagcaggctgcgaagaaggctgctgctatgccaatgcgcaacaaggctgtcagatggaacaagccaagtgcgagtaccttagtgcagaggcggcctgtaggcgatgcttttcagaatggcaaggccaaagagacacagaaccagggagcaccaaggacgatggatgcgctcttcgcacagatgaaggcgcaacgcatgaggaccgtgccacaacagcaagcaaatcctgcccctgggtgtcagttcaaccagcagcgacgtgttcagcagcagcaaaggcggggcagaggatatggtggccgaaatgttggcaaccaatgaactagtcttcatcatcagctgcactgaagcattgttgcactagcttcttggaacaaaggacgaaccccctggaaatctaacttggctgcgtttgtttctcatattttagttattggaagcttgttgacagaatatttagtgaagtttgtctgcagttttctggttgcctgcttccgtttcagcatgtataatgtccaacataatgtatggaaattatttgctgctagattatgctgtcattttttttatttgaactgattaggtacctttctgttccaaagaactagttcgccctttaccatgagtataaattagaaaacgccattaatgtga

SEQ ID NO: 2345 - DNA, 1429 bp, Zea mays
atcgctctccccctgaacccccaacactactccacaagaccacaaccccgaacccggccggcggcagcacaacatgagaacagcccccccccccccccccccccccccccccttctcgcgcctcctacctctctccagtcggttcccacgccttgccgcgctttacctctgcggcgcactcccgttatcatataacccgcgcgccggctccggcgagattcgaccaaactccatggggctcgagatggtggaggtcatgtccgagactgttcctacggttgtgcctgcggcagcgagggagaacggggtggatatttacccgctcagccgctactacttcggcgccagggacgccgccggcgtgccccgcggcctcgagaccgccgctgaccgcgcgctacggctcaaggcaaacttcgcggcgcacgggctccgcacgagcgtccacggcgtcctcctggtggagctgttcgatcacccgcacgtgctgctgctgcaggtccggaactcctccttcctgctcccgggaggccgcctcaggcctggcgaggaagaggtccgagggctcaagcgcaagctctccagcaagctctccgttgtcgatgatgtggaggccgttgaagaagaagactggcagattgggcagtgcatcgggatgtggtggagatctgaatttgaggccatcccgtttccctacatgcctccacgattccgtgcggcaaaggaatgcatgaagctgttcctgatcaggctgccgatgtcccggcagttcatcgtgcccaggaacatgaagctcctggccgtgcctttgtcccagattcatggcaatgctcaggtttacggtccaattatagccgccattccgagcctactatccaagttctccttcaacgtcatcagcgactgaattgtggaaaccaaccagaatgttgaggggttagtagacgcatgcatacttggctagttgaagtcatagaacagtgtgcgataccgatgggagcttgtattgagaagtagctcatctgtttttgttttttttttttttgtgtgtgcatatgtgtataatgtatccccctcctgggctcttgctgataatgatatgtatgtactgtatgtgtttctcgcgacctgtgtatgaccgtgtgagaaggattcagttctgtacaataactcattttgatttatttttgctcctacagtcctgaacttggaacataattagcacaccattccatgaaacagaagctactaaattcatttttcgggacaggtcatgtaacctgctaaccgctgaaggccaccaacttggatttcgttgagattccgttgggtgagccaaatttacctgcagaggttaagtgtgatccagatctttacacctcaacatagatccacacgtttgattagctataggacaatatgtgataca

SEQ ID NO: 2346 - DNA, 1122 bp, Setaria italica
gcagagctgcagaagcttcccaaatcctcttccccctctggcgtcttctcctccccacctttctattctccagccggttcgcgcgctccaattagcttccctccctttcgcggcgggcggcactgctatataacccgcgcctctgcgcgctccggtgagatcgacatggggctcgagatggaggcggcggctgctcctgcgcctgcggcggcgggggagcaggggctggagatatacccgctcagccgctactacttcggcgccaaggacgccgccggcgcgccccgcggcgtggagacggccgccgaccgcgcgctccggctcaaggccaacttcgccgcccacgggctccgcaccagcgtccatggcgtcctcctggtggagctgttcggtcacccgcacgtgctgctgctgcaggtccggaactcctccttcgtgctccccggaggccgcctcaggcccggcgaggaagagctccaagggctcaagcgcaaactctcaagcaagctgtccatccttgatgaaagcgaaggcgatgctgaggatgaggatgaggatgactggcaggttggggagtgcattgggatgtggtggagatctgaatttgaggccatcccgtttccatacatgccaccaaacttccgcatgccaaaggaatgcatcaagctgttcctgatcaggctgccgatgtcccggcagttcatcgtgcccaggaacatgaagctgctggccgtgcctctgtcccagattcataacaacgctcaggtttatggtccggtcatatctgggattccaaatctactgtccaagttcgcgttgaacgttatcagtgactgagctgcgtgtgcagactgcagacccgagttctgaattttgagaagcggttttcatgttaggctagccatacaacaatgtgatgttcagtcttcagaccacataggaatatacactagcagctcgtcttgtgtgttttgtaacgttttcgttattggtgtgcggataatgtattgatttgtattgtataatgtctcttgccgcctctgctttgccaaaccagttatgtacattaactttgctgattataccaattgatcgtataatgtccaacgtgttttgtacttg

SEQ ID NO: 2347 - DNA, 2112 bp, Saccharum officinarum
tcctggctccgcgccgagcgccgctcgcgccgccgcctcgccgtcgccaactgctacgccgcgtccccgcaggacgccgtcgaccgcttcccggccgtccgcgccgtcgaggtcaagggcaagccccacttcgcggacttcggcctcgtgccgcccgcctggggcgccgccgccgcgccatgggtcgccgccgccgccgacggctggccgctgctcgaggagattagcttcaagcgcatggtcgtcaccgacgactgcctcgagatgatcgcggcctccttcagaaacttccaggtgctgcgcctcgtctcctgcgagggcttcagcaccgccgggctcgctgccattgccgctggttgcagaaatctaagagaacttgaccttcaggagaacgagattgaggattgctctattcattggctcagtctctttccagaatccttcacttctctggtaactctaaatttttcatgcctagagggggatgtcaatatcactgtacttgaacaactagtaaccagatgtcgcaacctcaagactctcaagctcaacaatgctatacctcttgacaagcttgctaacctccttcgcaaggctcctcagattgtagaacttggaacaggaagattctctgcggattaccatccggatctcttttcaaagcttgaagcagcatttgctggttgtaaaagcttaagaaggctctctggggcttgggatgccgttccagaatacctgccagcattttattgtgtatgcgagggcctcacatcactaaatctgagctatgctactgtacgaggccctgaactgattaaattcattagcagatgcaaaaatttgcagctcttatgggtgatggacttgattgaagaccatggtctagctgttgtggcatcatcttgtaataaactgcaggaattgcgggtcttcccttctgctccttttgatgcagttgagcaggtttctttaactgaaaggggtcttgttgatgtctctgctagttgcccaatgttggagtcagtcctctacttctgcagacggatgaccaatgaggcccttattaccatcgcaaagaaccggcccaacttcacttgcttccgcctatgcatcattgatcctcacacaccagactacactacacaccagcctcttgatgcaggttttagtgccattgtggaatcatgcaaggggcttaggcggctttctgtttcaggccttctcacagatagtgtatttaaatccatcggggctcatgctgatcgtcttgagatgctctcgattgcctttgctgggaacagtgatttgggcctgcactacatcctatcgggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggattctctcacagatgagagccctgtcgagacattgtatgtctaccggacaattgcaggtccaaggtccgacacgccagcctgtgtccagattgtctaagtgggggcacctgtggtttacaaaggtactatggaagtgtccattttcaatctcattctgtaccttcaacaccttactagcataactgggattgtctccttgaaatagaaaggctggtgatctcgataatcctatcataatctctgatcagctgtacaactgtttctgcgagtttagggcgagactcggggcccctttcaggtgttaataactgtagggaggagactcgacgagttacaggaactactagatagcgtcttgagaaaacttgggtttgttttcttagcgtgttaagttcttttcatgtataaaaaaatatgggatcattccaatgccacaatgtactgtactattggaacaattgtacctggagcctctactttttttgacctcccctctctaattatgggttgctgttgctccagcttgtgatttgtgaatgcgaaataattcaagcttgtatgtggctctgccttc

SEQ ID NO: 2348 - DNA, 588 bp, Glycine max
acaatccaacatggcttaattgatctctcttcaaactccttgcattctttctttctttacaacaatgactttcgaagagaagacaatttatcaaacctctttagcctcaattcccaactacacccttctagagtgtgtcttggggctatgcttcaaagtgataaccatcctccttcagcttccttatgagtacatagacaacaatccaattcccaccatagtcttcaagggtcgcccaagaaccttccatgccttcataacatgcataatcttcgccttctccggtgctaccaatgcacttgtggcattcaataagtcaagattttctaggctttgtgggtattatgcaatggcttctatggcttctgctttggcaattctcttgtgggcagtgtgctgcacaggcatcaattagaatggctggactttgattctgaaactgctatcgctttataaagagtaaacagtgttgtgttgtatgttgaagatttttggtttcaacctcttaggaaactactggtttatgtgagagccagtaagaatgttagataaaagttttgagcaaaattaaaattaattattgattgg

SEQ ID NO: 2349 - DNA, 824 bp, Cajanus cajan
tgccatccactatggcttaattgatctctttaaactcgttgcactacttttaaccgcaatgactttcgaagagaagaccatttatgaaacctctttagcctcaattccccactttaccgttctagagtgtgtcttaggactctgctttacagtaatcaccatcctccttcagcttccttatgagtacatagacaacaacccagttcccaccgtaatcttcaagggtcacccaagaatattccatgctttcataatatgcataatctttgccttctcaggttcaaccaatgctcttgtggcattcaataaatccacattttctaagttttgtgggtattatgccatggcttctatggcttctgctatggcaattctcttatgggcagtgtactgcacatgtatcacttagaaagactggaattttgattatgggactgctatagctagaagaacaaatatgctgtgtggtatctcgaagatttttaggttcaatctcctaggaagcaacgtttatgtggccaagataaaactttggagcaaaatttaaataaagtgatatttgattgattatttattggatacataaataaaattgtaatgcataaacatattaaagtttattatcgttacatgttagaacttagaagaatataagtcttcagctctgttccatggatttatgtacttttgatcatgtggtatgtttcaacttttttaagttggagtttcttgcaattgacccaataagtccaacagcatttaacgaaacgaataaatgaagataatgaaaggaaccaaagaaaatagaacaagagcgtgtttgg

SEQ ID NO: 2350 - DNA, 964 bp, Glycine max
agctaatgaagtgacacatggatcccgaccctatctgtgccttttcctatgtttgcgaattaaatgaagcattcataaaccataactgaagaaaactaaggaaggaaggaagagtgagcgtgaaagatgccttgggcgaggctttcagggtctccaaggctcgacgttgctattgacatgggcaatccatttctcaatctcactgttgatggtttccttaagatcggagctgtcgcagccacgcgatcagctgctgaagatacttatcatattatccaaaaggggaatatctcaagtcatgatttcgagaaaacgttgaagaagatgtgcaaagaaggtgtatattggggaactatagctggcgtttatgttggaatggaatatggggtagagaggatccgtggcaccagagattggaagaatgccatgattgggggtgcagtaactggggccctggtatctgcagccagcaacaacaagaaagacaaaattgcaatagatgccattactggggcagcaattgctactgctgcagagttcataaattaccttacctgaatgaatgaaagtggatgtcttgctggttttcttgcatgttttggaaaaggattgcacactcagtctctctttagtcatactctgtaccggttccgtctttgatattggtgcagttacttctaagatatgctatttatttaactttctataaaacccatgttttgataaattatattggccattcggttttctgcatgttagtagctttgccttgcaatttagtcaagctagacttgtgcaattatgtcaaagcatgttcagttcgatttagtctttgggttttggaataatgaaggttctggatgaacaggttttcaaatttaatccttttctgctgacaggttaatcaagttcatgtttacttatttcaattacagttattgatcatgaaatgaagtgtacatct

SEQ ID NO: 2351 - DNA, 852 bp, Glycine max
atgaaacaatttttgcaataagaggtaacttcatcctagtgtctcatcttgaagacgagctgtgatgaaaaaaaaatataaagaattaatacggaaggatatctgagtagtgagtattagccaatgaattggcacatggatccccaccctatctgtgccttttcctatgtgtgtgaatttaaatgataactgaagaaaactaaggaaggaaggaagagtgagcgtgaaagatgccttgggtgaggctttcagagtctccaaggctcgacgttgctattgacatgggtaatccatttctcaatctcactgttgatggtttccttaagatcggagctgtcgcagccacgcgatcagctgctgaagatacttatcatattatccaaaaggggaatatctcaagtcgtgatttcgagaaaactttgaagaagatgtgtaaagaaggtgtatattggggaactatagctggcgtttatgttggaatggaatatggggtagagaggatccgtggcaccagagactggaagaatgccatgattgggggtgcagtaactggggccctggtatctgcagccagcaacaacaagaaagacaagattgcgatagatgccattactggggcagcaattgctactgctgcagagtttataaattaccttacctgaatgaatgaaagtggatgtcttgctggttttcttgcatgttttggaaagggattgcacactcagtctcttttgtcatcatctgtaccggttccgtcttgatattggtgcagttacttctaagatattctatttatttaactttctataaaacctatgatttgataaattgtattggccaatcggtttctgc

SEQ ID NO: 2352 - DNA, 697 bp, Cajanus cajan
cggaactctgatatatgaaagactgaaagaaagaaagagagaagagaatgccttgggcaaggctttcagggtctcccagagtggatgttgccattgacatgggcaatccattcctcaatctcaccgttgatggtttcctcaagattggaactgtcgcagccactcgcgcagctgctgaagatacttatcatattatccaaaagaggaatatctcaagtcatgattttgagaaaacgttgaagaagatgtgtaaagaaggtgtatattggggaactgtagctggcgtttatgttggaatggaatatggggtagagaggatccggggcaccagagactggaagaatgccatgattgggggtgcattaaccggggccctggtctctgctgtcagcaacaacaagaaagacaaagttgccatagatgcaattacgggggcagcaatagctactgctgcagaattcataaattacctcacctgaatgaatgaaaatggatgtattactggttttcttgcatgttttggaaaagggattgcacaataagtctcatttgtcatcgtgtgcactggttccatcttgatattggtgcaattacttctaagatatgttatttatttagttttctgttaaacctatgttttgatcaattatattggcccgttggttgtttagaaccaaaaaaaaaaaagtaactacta

SEQ ID NO: 2353 - DNA, 691 bp, Pisum sativum
acactcaaagcaaggaagtaacaaaaaagagtgagtttgaaagatgcctcgtagcagtttttcagggtcactgtcttctcccaagctggatgtggttatagacatgggcaatccattccttaaccttactgttgatggtttcttgaagattggagctgttgcagcaacaagatcagttgcagaggatacctttcatatcattcgaaagggaagtatctcaagtaatgattttgagaaatctctgaagaagatgtgtaaagaaggtgcatactggggagctatagccggcgtatatgttggaatggaatatggtgtcgagaggatccgtggcaccagggactggaagaatgccatgttcggaggtgccgtgacaggggctctggtatctgcagcgagcaacaacaaaaaagacaaaattgcagtagatgccattacaggtgctgcaattgcgacagctgcagaattcataaattaccttacctgaaagaacaagactggatgtgttatttcacttggtctccgttgtctttgtgttactggttatgtaataattttgatgcaatgactaataagatgtattcagctcttaacatgttttgtcaatgacatgctcactgttcagctcaattttcagtctctggataaatggattatggtatagggaggactgaggatatacatggtttaaatt

SEQ ID NO: 2354 - DNA, 698 bp, Pisum sativum
ttcctaacactcaaagcaaggaagtaacaaaaaaagagtgagtttgaaagatgcctcgtagcagtttttcagggtcactgtcttctcccaagctggatgtggttatagacatgggcaatccattccttaaccttactgttgatggtttcttgaagattggagctgttgcagcaacaagatcagttgcagaggatacctttcatatcattcgaaagggaagtatctcaagtaatgattttgagaaatctctgaagaagatgtgtaaagaaggtgcatactggggagctatagccggcgtatatgttggaatggaatatggtgtcgagaggatccgtggcaccagggactggaagaatgccatgttcggaggtgccgtgacaggggctctggtatctgcagccagcaacaacaaaaaagacaaaattgcagtagatgccattacaggtgctgcaattgcgacagctgcagaattcataaattaccttacctgaaagaacaagactggatgtgttatttcacttggtctccgttgtctttgtgttactggttatgtaataattttgatgcaatgactaataagatgtattcagctcttaacatgttttgtcaatgacatgctcactgttcagctcaattttcagtctctggataaatggattatggtatagggaggactgaggatatacatggtttaaatt

SEQ ID NO: 2355 - DNA, 2869 bp, Glycine max
gagagtggaaaaataagcttaaaagtgttgtaccaaacaaccctcatctactacctcttttaattttcctcgccttcatcacctacacacttgacttcattctttcactttcaactttcaagtcaaaaggacaaagattttcaagtgtcaaactcttggtaagatttcctatatgcaaaccttcttgtcttgtagctgttgagaatttgggatagttataattctacaaggaaattttccttttgatcattatgcatgtctggccctgtggccacagttgataatttggatggagcactttcttgtgcagagagaacaaaatctcttgatgccatttctgaaatagatcatttatctatatttacaaacggtgaagctggtcattcctctgaagttgctggatttagagtaggggaactctcacttcctaatggagaatcatattctgggtcccttcttggtaacattccagagggtcaaggtaagtatgtatggccagatggttgtgtatacgagggtgagtggagacgagggatgagaaatggatatgggaaaatacaatggccttctggagtaatgtatgatggtgagttctcaggtggctatatccatggtacaggaacatatattggccctgataatctgacctacaaaggtcggtggcgattaaatgttaaacatgggttgggttatcaagtttatccaaatggagatatatttgaaggctcttggattcaaggaacacctgaggggccaggcaagtatacctgggccaacggaaatgtatatttgggaaatatgaaaggtgggagaatgtcaggaaaaggaactctcacctgggtaagtggggactcatttgaaggaagctggttaaatggcatgatgcatgggcttggggcatatacatggagtgatggaggctgctatgttgggacttggacacggggtctaaaagatggcaaaggaaccttctatccgagaggtagctgtcttccatctgcacaagaaatatatctcaatgcattgagaaaaagagggctgttgccagatttgagaaaacagaaacagatacatattcatcatgctgcttcagttgatatgggagatgtcaaggttggtgaaagtcagagatcaaatcgtgtttcatctgataagctcgccaaaggaaacttgttaaatctggaacaatctcgtagcaaaaatatttctctcgaaaggcgctggagtcttgaggtatctattgagaaagtgattgggcatgattcaagattaggatcaacagattctgtagcagaaaatggagataaagtcccaattttggaacgcgagtatatgcaaggtgtgttaataagtgaattagttttaaataatagtttttcatcaatgtctagaagggcaaaacagctccaaaaaaaacttgccaaagaaattaaaagacctggtgaagcaatcattaaaggtcaccggagctatgatctgatgcttagtttgcagctcggaataaggtatactgtggggaagattaccccaatacagagacgagaagttcgagcatcagattttggtcctagagcaagcttttggatgaattttcctaaagaaggttctcaattgacacctcctcatcaatcagagggttttaaatggaaagattactgccctatggtgttcagaaatttgagagagttgttcaagattgatgctgctgactatatgatgtccatttgtggaaatgatgctctgagggaactttcttctccagggaaaagtggtagtgtctttttcctgtctcaagatgatcgattcatgattaagacactgcgaagatctgaagtgaaggttcttctaagaatgcttccagactatcatcaccatgtgaagacatatgataatacacttatcacaaaattttttggtctgcacaggattataccttcgagtggtcaaaagtttcgctttgtcgtgatgggaaatatgttctgcacagaattaaggatccataggagatatgatttgaaaggttcatctcttggacgttcttcggacaagatagaaattgatgaaaacaccactcttaaagatttggatctgaactactgcttttacttggaaccatcttggcaggagtctttattgaagcagattgagattgacagcaagtttttggaattacaacagataatggattacagcctcctcctaggtgttcattatcgagctccccagcagctgcatccatacaaccaaaatagaactgcagatggattgccaattcttgcagaggaagaccctctagaggatgaaggatccaactatccacaaggccttgttctggtccctcggggtacagatgatgatagtgttgttgtagggtcacacattaggggtagcagattgcgagcttcggctgctggggatgaggaggtggatctacttctacccggtacagcaagactacaaatccagctaggtgtgaacatgccagcgagggcagaacagattccaggaaaagaggaaatgcaaatgttccatgaggcttatgatgtcgtactttacctgggtataattgacatattgcaagagtacaacatgactaagaagattgaacatgcatacaaatcaattcagttcgattcattgtctatctcggcagtggatccaacattctactcgcgtcgcttcctggattttattcagaaagtgttcccaccacatgaaatggcaggataacagtttggggattaagttcaaccagttggtttattcagaaagtgtcattgtcacattgcctccttttgtgcatgctgtataattgacttgaatatgtttagattttataaatatgctaaatattaattttggtcttttc

SEQ ID NO: 2356 - DNA, 2886 bp, Glycine max
ggagagtggaaaaataagcttcaagtgttgtaccaaacaaccctcatctaatacctattttaatttccctcgccttcatctcctacacacttgacttcattctttcactttcaactttcaagtcaaaaggacaatagtttcaaggatcaaactcttggtaagatttcctatatgtaacccttcttgtcttctagctgttgagaatttgggatagttataactctataaggaaatactccctttgatcattatgcatgtctggccctgtggccacagttgataatttggatggagcactttcttgtgcagagagaacaaaatctcttgatgccatttctgaaatagactgtttatctatatttacaatcggtgaagctgctcattcctctgaagttgctggatttagagtaggggaactctcacttcctaatggagaatcatattctgggtcctttcttggtaacattccagagggtcagggtaagtatgtatggtcagatggttgtgtatatgagggtgagtggagacgagggatgagaaatggatatgggaaaatacaatggccttctggagtaatgtatgagggcgagttctcaggtggctatatccatggtacaggagcatatattggccctgatagtctgacctacaaaggccggtggcgattaaatcttaaacatgggttgggttatcaagtttatccaaatggagatatctttgaaggctcttggattcaaggagcaccggaggggccaggcaagtatacctgggccaatggaaatgtatatttgggaaatatgaaaggtgggagaatgtcaggaaaaggaactctcacctggataagtggggactcatttgaaggaagctggttaaatggcatgatgcatgggcttggggtatatacatggagtgatggaggctgctatgttgggacttggacacggggtctaaaagatggcaaaggaaccttctacccgagaggcagctgtcttccatctgcacaagaaatatatctcaatgcattgagaaaaagagggctgttgccagatttgagaaaacagaaacaggtacatattcatcatgctgcttcggttgatatgggagatgtcaaggttggtgagagtcagagatcaaatcgtgtttcatctgataagctagccaaaggaaacctgttaaatctggaacaatctcgcagcaaaaatatttctctcgaaaggcgctggagtcttgaagtatctattgagaaactgattgggcatgattcaaaattaggatcaacagattctgtagcagaaaatggagataaagtcccaattttggaacgcgagtatatgcaaggtgtgttaataagtgagttagttttaaataatagtttttcatcaatgtctagaagggcaaaacagcttcaaaaaaaaattgccaaagaaattaaaagacccggtgaagcaatcattaaaggtcacaggagctatgatctgatgcttagtttacagcttggaataaggtatactgtgggaaagattacaccaatacagagacgagaagttcgagcatcagattttggtcctagagcaagtttttggatgaattttcctaaagaaggttctcaattgacacctcctcatcaatcagagggttttaaatggaaagattactgccctatggtattcagaaatttgagagagttgttcaagattgatgctgctgactatatgatgtccatttgtggaaacgatgctctgagggaactttcttctccagggaaaagtggtagtgtctttttcctgtctcaagatgatcgattcatgattaagacactgcgaagatctgaagtaaaggttcttctaagaatgcttccagactatcatcaccatgtgaagacatatgataatacacttatcacaaaattttttggtctgcacaggattattccttcaagtggtcaaaagtttcgctttgtcgtaatgggaaatatgttctgcacagaattaaggatccataggagatatgatttgaaaggttcatctcttggacgttcttcggacaagatagaaattgatgaaaacaccactcttaaagatttggatctgaactactgcttttacttggaaccatcttggcgggagtctttattgaagcagattgagattgacagcaagttcttggaattacaacagataatggattacagcctccttctaggtgttcattatcgagctccccagcagttgcatccatacaaccaaagtagaaatgcagatggattggcaattcttgcagaggaagaccctctagaggatgaaggatccaactatccacaaggccttgttctggtccctcgaggtggggatgatgatagtgttgttgtagggtcacacattaggggtagcagattgcgagctgctggggatgaggaggtggatctacttctacccggtacagcaagactacaaatccagctaggtgtgaacatgcctgctagggcagagcagattcctggaaaagaggaagttcaaatgttccatgaggcttacgatgttgtactttaccttggtataattgacatattgcaagagtacaacatgactaagaagattgaacatgcatacaaatctattcagtttgattcattatctatctcggcggtggacccaacattctactcgcgtcgcttcctggattttattcagaaaatgttcccaccacatgaaatggcaagataaggtttgggggttaaattcaaccagttggtttattcagaaagtgtgtacattgtcacattgcctccttttgtgcatgctgtataattgacttgaatatgtttagattttatataaatatgctaaatggtcttttctattttcatcttttatgttatagtctttt

SEQ ID NO: 2357 - DNA, 1391 bp, Cajanus cajan
gaagcgaaagagtaaagaaggaataatatccatatggctgcaagggggggacacagaattgaaagaggtgcaatcggcaaccaaaatggccgcaatagagagtgcaagagttaaacttggaacccaaggctttgaggtttcaaaattgggattcggatgtctgggccttactggagcctacaatgaccctctcccagaacaggatgccgtatctattatcaactatgcattcaccaaaggaataacattttttgatacatctgatgtttatggagccaccgctaatgaagttttgcttggaaaggctttgaagcagctacctagagaacaggtccagctagccacaaaatttggtattgcgagattagatttttctaatatgcacatcaagggttcgcctgaatatgtgcgctcatgctgtgaagctagtttgaagcgtcttggtgttgaatacattgatctctattatcagcatagagtggacacatctatacctatagaggaaacagtgggtgaacttaagaaactggtggaagagggcaaagtgaggtatattgggttatctgaagccagcccagatacaattagcagagcacacgcagttcatcccatcacagctgtgcaaatagagtggtctctatggactcgtgacattgaggaggaggtagttcctctgtgcagggaacttggtattggaattgtaccatatagtcctcttggtcgtggcttttttggcggcaaaggagttgtggaaaatgttcctgcaacaagctccctgaaagtacatccacgtttccaagccgagaacatgaacaagaataagaatatatatgatcgaattgaaacccttgctaagaagcataaggccactcctgcccagttggcattagcatgggtactccagcaaggcgaggatgttgtacctattcctggaacaaccaagattaagaacctggatcaaaacctaggtgcgttagcagtgaaattgtcagaaagggacctgagagaagtttctgaggcggttcccattgatgatgtagcaggtggtatacactactttggactggaacactttacctggaagtttgctaacacacctcaaaaagattcaagggtttcaacctgaaccactcaacttttcagttagagattctattaagtcatgaattgagggtaacaaggttgacagaggctaatatcaggaagctaccgatacatgctgtagatagtagatgtgcagagaatattactccttctgttttttattcatagtcgtttaaggttttgcacgggatttaagaaaatgattgatattttagttttcaaaaatatttattacttacttttctattctaccctctatttttatagtatttcgttggaaacatatt

SEQ ID NO: 2358 - DNA, 1444 bp, Cajanus cajan
agggaataagcattaggaaacatcatcagtgacgaaattatggcgctgctgattctgacacactgaatgacgaagccaatgaatgagctcatcgtatcgtattcctatataatgcttgcagaggggaagacatgcaataactcaatcaatggcccaacagcggactcaacttggaacccatggctttgaggtttcgaaactgggattcgggtgcatgggccttagtggagcctacaatgaccctctcccagaagaggatgccatatctattatcaactatgcattcagtaaaggaatcaccttttttgatacagctgatgtttacggagacactgctaatgaagtcttgcttggaaaggctttgaagcagctacctagagaaaagatccagctagccacaaaatttggtattgcgagaataagttttactgatatgaggatcaatggttcacctgaatatgtgcgctcgtgctgtgaagctagcctgaagcgtcttgatgttgattacattgatctttattatcagcatagagtggacacctctgtacctatagaggaaacagtgggtgaacttaagaaactggtggaagagggcaaagtgaggtatattgggttatctgaagccagtccagatacaataaggagagcgcatgcagttcatcccatcacagctgtgcaaatggagtggtctctgtggacacatgacattgaagaagggatagtccctctctgcagagagcttggtattggaattgttccatatagccctcttggtcgtggcttttttggtggcagaggagttgtggataatgtgcctgcaagtagccccctgaaaggacatccacgcttccaagcggagaatttagacaagaacaagagtatatatgaccgaattgaaagccttgcccagaagcatcaagccactcctgctcagttggcattagcatgggtactccaccaaggcgaggatgttgtacctatccctggaacaactaagattaagaacctggatcaaaacctaggtgccttagcagtgaaattgtcagaaagggacctgagagaaatttctgaggcggttccaattgatgatgtagcaggtggtagatactacaatggactggaacacatctcatggaagtttgccaacacacctccaaaagattcgaggatctcaatctgaagcacatagagaatacactgagtcgtgaattgagggtaacacggttgacaaaggctggtatcagggagctaataggatatcaataatgtagcccatgtcttgatgaagggctttctacatttatttggtttgttaaagtttttagtataaaccgcaatactttttgtaatgcaacaaacaataggtatttataaatatttacgtacttttatacactattttctttttgtcacatttttttattatataacacctgtcacttaa

SEQ ID NO: 2359 - DNA, 1304 bp, Phaseolus coccineus
gaaaggagtagaaaagaagagactgtgaatctttgaatcaccaactaaacaacaatggaggaagtgcaacacattcaaagagttaaacttgggacccaaggctttgaggtttcaaaattgggattcggatgcatgggcctaactggagcgtacaatgatcctctcccagaagaggatggcatttctattatcaactatgccttcagtaagggaattaccttttttgatacagctgatgtttatggagctaatgccaatgaacttttggttgggaaggctttgaagcagctacccagagaaaagatccagatagccacgaaatttggtattatgggaagagactctaatgttcagatcaagggttcgcctgaatatgtgcgctcgtgctgtgaagctagcttgaagcgtcttgatgttgaatacattgatctctattatcagcatagagtggaccaatctatacctatagaggaaacagtgggtgaacttaagagactggtggaagagggtaaagtgaagtatattgggttatctgaagcgagtccagatactataaggagagcacacgcagttcatcccatcacagctgtgcaaatagagtggtctctgtggactcgtgacgttgaggaagagataatcccactctgcagggaacttggtattggaattgtaccatatagtcctctgggtcgtggattttttgggggaaaaggagttctggaaaatgtgcctgcaattagcaacctgaaaagacatccacgtttccaagcagagaacctggagaagaacaagaatatatatgaacgaattgaaatccttgcaaagaagcatcaggccactcctgctcagttggcattagcatgggttctccaacaaggagaggatgttattcctatccctggaacaactaagattaaaaatctggatcaaaacctaggagccttagcagtgaaactgtcagaacaggacctgagagaaatttctgaggcggttcccactggtgatgtagcaggtactagattctacaatggaatggaccagctttcttggaagtttgccaacacaccttcaaaagattcaagagtctcaacctgacgcactcaactccaccttcagtaagagaatccacatatccaagttacatgaattgagggtaataaggttgatatcaggaagctattaaaatatcaatgatgtctccatgggggacattttagactatttggctggttaaagtttttatttaaactgcaatacctttttgttatacaataagtaataaataataataggttggtatttat

SEQ ID NO: 2360 - DNA, 1262 bp, Glycine max
agaaggttaagttaatttggcggtctcttcggcgataagaccgcaacgttatagccctactcacgagcctttttactctgctcggtatacagggagagtgcaacaacaaacgcaccaggtacgctctctttctctctccctaaatttcaattcaaaccacaaacacaaacccatatccccaaaacctgtgtctgtcaactgcacttagagagagtgagtgacgcaaccagactagcacgcacaacacacaataactgcatatggataggtatcagagggtagagaagcccaaggcagagactcctataaacgagaatgagatacgcgtcactactcaaggaaggatgaggaattacatcacctacgccaccactctcctccaggagaaaggatctagtgaaattgttctcaaagcaatgggacgtgcaataaataagaccgtaatgattgctgaactgatcaagagaaggattgttggtctgcatcaaaacacccaaattggatcaactgatataactgacacatgggaaccactagaagaaggccttcttcctttggagactactcgccatgtttcaatgatcacaattaccttgtcaaagaaagaattggatacgtcatccgcgggataccaacatcctcttccagttgatcaagtaaaacctttaaatgaatatgaagaggaaggaggctcaccaaggatgcgaggaagaggacgtggtcgtggaaggggcaggggtagaggattttacaatgggggtatggaatatggtgatgattgggatggtgggcgtggctatggtggaagagggcgtggccgtgcaagggggcgtgcttttcggggacgaggacgaggctatggtgtgcagccagttgggtactatgactatggtgaatatgatgctcaacctcccccacgtggccgtggacgtggaagggggagaggtcgtggacgtggaagggaccggggaccacctgcttgatcaagtggctgtttcttatcatgtatatgttaaaattagatgttgcctctctgtttagtattttgtgagatttacttatattttggtattatgtgaagcggtcggtgttgcagccatgttcctgcagttttgattatgtagttgtttcccctgtaaccactataattttgctaagttgggtagagtaagttagatatcttttctttgtttaaagactcataaaatcacaattgtaaaattttttaataggagttattgcagtaaggtctttcgaagttt

SEQ ID NO: 2361 - DNA, 1192 bp, Phaseolus coccineus
tctctctctctgttgcacttacaagcctaaatctaaaattcaaatcacagaacaaacaaacaaacccatattcccaaaacctacctgtcaactcaatcagagtgtgagtgagcgagtgagtgatatatcatatcttatccctcttcttgcacgcacaacataactaactatggataggtatcagagggtagagaagcccaaggctgagactcctataaacgagaatgagatacgcgttactactcaaggaagaatgaggaattacatcacctacgccaccacacttcttcaggagaaaggatccgatgaaattgttctcaaagcaatgggacgcgcaataaataagactgtaatgattgctgaactgatcaagagaaggattattggcctgcatcaaaacaccgtaattggatcaactgatattactgacacatgggaaccacttgaagaaggccttcttcctttggagactactcgccatgtttcaatgatcacaattaccttgtcaaaaaaggaactggatacgtcctccacaggataccagactcctcttccagttgatcaagtaaaacctttaaatgaatatgaagaggaaggagaaccctcaccaagtatgcgaggaagagggcgtggtcgaggaaggggccggggtagaggattttacaacggaggtatggaatatggtgatggttgggatggtggtcgtggctatggtggaagaggtcgtggccgtgcaagaggacgagcttttcggggacgaggacgaggctatggtgcccagccagttgggtactatgactatggtgaatatgatgctccacctgctccacgtggccgtggacgtggaaggggaagaggccgtggtcgtggaagggatcgggaaccaaccgcttgatcaagtggttgttgcttatcatgtatatgttaagttagaaggtgttgcatctccgtttagttcttgtgagatttactttaatttcggtattatttgaagctttcaatgttgcagctgtgttactgcagttttgattatgatgtagtttcccatccccgctgtaaccactataattttgcatagttgggtaggttaagttagatatatttttcgttgtttaaatcacaattgtaaaatttcttaataggaattattgcagcaagttttttcgcagttttgatttactgtgattcgttt

SEQ ID NO: 2362 - DNA, 1089 bp, Vigna unguiculata
gctgcttggttggtacactacacttttctttccatacgcagagtgcagccacacctcaccagatggataggtatcagagggtagagaagcccaaggctgagactccaataaacgagaacgagatacgcgttactactcaaggaagaatgaggaattacatcacctacgccaccacactctttcaggagaaagaatccaatgaaattgttctcaaagcaatgggacgagcaataaataagactgtaatgattgctgaactgatcaagagaaggattattggtttgcatcaaaataccgtaattggatcaactgatataactgacacatgggaaccacttgaagagggccttcttcctttggagactactcgccatgtttcaatgatcacaattaccttgtcaaaaaaggaactggatacgtcctccacaggataccaacctcctcttccagttgatcaagtaaaacctttaaatgaatatgaagaggaaggagaagcctcaccaaggatgcgaggaagagggcgtggtcgtggaaggggccggggtagaggaatttacaatggaggtatggaatatggtgatggttgggatggtggacgtggctatggtggtggctatggtggaagaggccgtggccgtgccagagggcgtgcttttcggggacgaggacgaggatatggtgcccagccagttgggtactatgactatggtgaatatgatgctccacctgccccacgtggccgtggtcgtggaaggggaagaggccgtggtcgtggaagggatcggggagtagctgcttgatcaagttgttgttgcttatcatgtatatgttaagttagaaggtggtgcctctctgtttagttctcctgtgagatttactttaattttgttattatttgaagcgttcaatgttgcagccatgttcctgcagttttgattatgtacccgtccctccccctctgtaacctctaattttgcttagttgggtaggtcaagttagatatattttcggttgtttaaagataaaatcacaattgtaaaatttcttaataggaattattgcagaaagtttttttttcttttttcttga

SEQ ID NO: 2363 - DNA, 1195 bp, Medicago truncatula
caaaatcccatatccccaaaacctgtcaactcacagagagtattgctttgacatattcgccccatagccacccagccctcgctctcttccatctcactcacgctcaacacaaacgatggataggtatcagagggtggagaaacccaaggcagatagccctatcaacgaaaatgagatccgcattactactcaaggaaggatgagaaactatatcacttatgctaccactctttttcaagaaaaaggatctgatgaaattgttgtcaaagcaatgggacgtgcaataaataagactgtaatgattactgagctaataaagagaaggattgttggtctgcatcagaacactcaaattggatcaactgatataactgacacatgggaaccactagaagaaggccttcttcctttggagactactcgtcatgtttcaatgatcacaattacgctgtcaaagaaagagctggatacatcctccacaggatatcaacctcctcttccagctgatcaagtaaaacctttgaatgaatatgaagacgaaggagaaggctcaccaaggatgcgaggaaggggaaggggtcgtggaaggggcaggggtagaggaatgtataatgggggtatggaatatggtgatggttgggatggtggacgtggctatggtggcagagggcgcggccgtgcatggggtcatgcttttcgtggacggggacgaggctatggtgcccagccagttgggcagtatgactatggtgaatatgatgcaccacctgcacctcgtggtcgaggtcgtggaaggggaaggggccgtgggcgtggtcgtgatgcgggccgtggtgcagctgtctgatcatctgggtgttggttgtcatgtatatgttcagttagaagagggttgcctctctgcttagttatttgttagattcgcttttaatttggtattattatttgaagcgttcagtgtcgcagtcatgttcctgcagttttgcttttgtagttctttttcttgtaaaacatctatctatacttttaagttaggcaggttgagttaggtatatttactttgtttagaattaaaaaaaaaaaaaaggagtcgaaattgtcacatttttcatatagaaattattgcagcaagattttctaagtgttcctatgtagttgatgtttcatttctataccatgaatttttgaagtctta

SEQ ID NO: 2364 - DNA, 1381 bp, Arachis hypogaea
ttacgggggggggggccggagagtagccctactcatgtgccaagttctcctggaaagaaacagccacataaccccttctgtttcgggccctaacttgaaatctcacaacactcgacctgcctctcctctccctgagactgcgtcacttagctactcagcactcagcactcgccaaacaccaccttagcaaccatatccccttccaatcctcaccttcacacgcttcagcttgatactccccttcccttatctccccttccctttctccttccctctcaacacacacaaagatggataggtatcagagggtggagaagcccaaggcagatagccctatcaacgagaacgagatacgcatcactacacaaggcaggatgaggaactacatcacctacgccaccactctccttcaggagaaaggatctgaggaaattgttcttaaagcaatgggacgtgctatcaataagactgtgatgattgctgagctgatcaagagaaggattgtaggtctgcatcagaacacacaaatcggatcaactgatataactgacacatgggagccactagaagaaggccttcttcctttggagactactcgtcatgtttcaatgatcacaattactttgtcaaagaaagaattggatacatcctcgacagggtaccaaattcctcttccagctgatcaagtaaaacctctaaatgaatatgaagaggaaggagaaggctcaccaaggatgcgaggaagaggtcgaggtcgtggaaggggtaggggcagaggaatgtacaatgggggtatggaatatggtgatggttgggatggtgggcgaggatatggtggcagagggcgtggccgtggaaggggtcgtagtttccggggacgaggacgtggctatggtgcccagccagttgggtactacgactatggtgaatatgatgcaccaccacctgccccacgtggccgtggtcgtggaaggggaagaggccgtggacgtggtcgtaatattagagatggagcaggccggggagcagctgcttgatcaagttgttgtcggttatagtgtatatgtttcagttagaagatggttgcctgtgcttggttctttatgggacatgctttaatattagtttgaagtgttcgtgttgcagccatgttcctgcagttttgtttcttttattttcttctgtaacctctttgatttcccaagttcgttagattcaattagttagctttccattatctcagactacaaagaaggagaatcataattgtaaaattttttaacacgtaattatagcagtaagtctcttaaagtggacctttgtagttttctgtttgcaaattttggatacgaattattagcgataaattagtatacgtaac

SEQ ID NO: 2365 - DNA, 1211 bp, Trigonella foenum-graecum
cttcaccattctattctattcatagattgattacggtgtacaatcgtgttctccttgtcgccctcaatttcaaaccacaaatcaattccatatccccgttttcgccctaacccacccacccacaacactaacgatggataggtatcagagggtggagaagcccaaagcggatagtcctattaacgagaatgagattcgcattactactcaaggaaggatgagaaactatatcacctatgctaccactctctttcaagagaaaggatctgatgaaattgttgtcaaagcaatggggcgtgcaataaataagactgtaatgattactgagctaataaagagaaggattgttggtctgcatcagaacactcaaattggatcaactgatataactgacacatgggaaccactagaagaaggccttcttcctttggagactactcgccatgtttcaatgatcacaattacattgtcaaagaaagagctggatacatcctccacaggatatcaaccgcctcttccagctgatcaagttaaacctttgaacgaatatgaagatgaaggagaaggctcaccaaggatgcgaggaaggggaagaggtcgtggaaggggcaggggaaggggtagaggtagaggaatgtacaatgggggtatggaatatggtgatggttgggatggtggacgtggctatggtggcagagggcgtggtcgtgcgtggggtcatgcttttcggggacgaggacgaggctatggtgcccagccggttgggcagtatgactatggtgaatatgatgcaccacctgtcccgcgtggccgaggtcgtggaaggggtcgtgggcgtggtcgtgatgcaggccgtggtgcacctgcttgatctcctggctgttggctgtcatgtatatgttcagttagaagagggttgcctctctgcttagttaattgttagatttgcttttaatctggtattatttgaagcgttcagtgttgcagccatgttcctgcagttttgcatttctagttcttttctttctcttgtaacatctatctataattttaagttaggcaggttgagttagatatatttactttgtttagaatttgaaaaaaatcagtcgaaattgtcacatgtttcatatagaaattattgccattaagtttttcaaagttccctttgtagttgacgtttcattattgaaaatttggtatgatttatg

SEQ ID NO: 2366 - DNA, 1278 bp, Lotus japonicus
cggtctactggagccactcttctctctcacacacacttctctctcttcctgcgtgcttctacttctattctcttctcttcttcacttcaaccacgccaccatccctttctcccttcgcttcgttcgtagcagcatattcccccaatctacaaaccccaacccactctcgcttccatcaaactcaccgcaacgatggataggtatcagagggtggagaagcccaaggcagatagtcctatcaacgagaacgagatacgcattaccagtcaaggaaggatgaggaattacatcacctacgccaccactctccttcaggagaagggatctgatgaaattgttctcaaagcaatgggacgtgcaataaataagactgtaatgattactgagctgatcaagagaaggattgttggtctgcaccagaacactctgattggatcaactgatataactgacacatgggaaccactagaagaaggccttcttcctttggagactactcgccatgtttctatgatcacaattaacttgtcaaagaaagaactggatacatcctccacaggataccaacctcctcttcctgctgatcaagtaaaacctttaaatgaatatgaagaggatggagaaggctccccaaggatgccaggaagagggcgtggtcgtggaaggggtcggggtagaggattttacaataatgggggtatggaatatggtggtggtgatggttgggacggtggacgtggctatggtggcagaggccgtggctttggtcgtggcagaggtcgtggtttccggggacgaggacggggaggctatggtgcccagccagttgggtactatgactatggtgaatatgatgcaccacctgccccacgtggacgaggacgtggaaggggaggaagaggccgtggtcgtggtcgtaatgcaagctggggagttgctgcttgatcgcatgggtgttggttatgatgtatattttcagttagaagatggttttgcctctttgcttagttctttgtggaatctgcttatactattttggtattatttgaagcgttcgggtgttgcagtcatgttcctgcagttttgtttttctagttctttcctttgtaacaacctctataatttcaagttccgaggttgagttagatattcatatatttcctttgtttagggagtttcaagaaaattaaatttgtataatttttttaaatagaagttactggagttgaatttatctcaaggtcgctttagaaggtatgcactgaaattttggatagg

SEQ ID NO: 2367 - DNA, 1140 bp, Trigonella foenum-graecum
aaatccatatccccaaaacctgcaagctttgacatattcgccccatagccacccaaccctcgctcgcttccatctcactcacgctcaacacaaacgatggataggtaccagagggtggagaaacccaaggctgatagccctattaacgagaatgagatccgcattactactcaaggaaggatgagaaactatatcacttatgccaccactctctttcaagagaaaggaactgaagaaatcgtgctcaaagcaatgggacgggcgataaataagactgtaacgattactgagctaattaagagaaggattgttggtctgcatcagaacactattattggatcaactgatataactgacacatgggaaccacttgaagaaggccttcttcctttggagactactcgtcatgtttcaatgatcacaattacattgtcgaagaaagagctggatacatcctccacaggatatcaacctcctcttccggctgatcaagtaaaacctttaaatgaatatgaagaggaaggagaaggctcgccaaggatgcgaggaagggggcgtggtcgtggaaggggcaggggtcgaggtagaggaatgtacaatgggggtatggaatatggtgatggttgggaaggtggacgtggctatggtggcagaggacgtggccgtgcctggggtcgtgctttccggggacgaggacgcggctatggtgcccagccggttgggtattatgacaatggtgaatatgatgcaccacttgccccacgtggccaaggtcgtggaaggggaagaggccgtggacgtggtcgtgatgctggccgtggagcagctgtttagttagaagagggttgcctctctgcttatttatttattttatttgggattatttgagtcgttcagtgttgcggccatgttcctgcagttttggttttttagttttctcccttgtaacatctataattttttaagttcgacagattgagttaggtatgtttcttttatttagacttatgaaaaaagtcgaatttgttaattttcttatacagaaattattgcggtaagttttgactgaatccaagtttcctttgtagttgatgtttcatttctatacttgaaaattgaaattttgtgctgaggaatatc

SEQ ID NO: 2368 - DNA, 1109 bp, Trifolium pratense
gaaaaagtactatctatcattccttcattcattcacatattcgcccccaaacccatccacccaacctcacaaaccacgatggatagatatcagagggtggagaaacctaaagcagatggtcctattaacgagaatgagatccgcattactactcaaggaaggatgagaaactatatcacttatgctaccacactctttcaagagaagggaactgatgaaatcgttctgaaagcaatgggacgtgcgataaataagacggtaacgattactgagctaataaagagaaggattgttggtctgcatcagaacactgtaattggatcgactgatattactgacacatgggaaccacttgaagaaggccttcttcctttggaaactactagacatgtttcaatgatcacaattacgttgtccaagaaagaactggatacatcctctacaggatatcaacctcctcttccagctgatcaagtaaaacctttaaatgaatatgaagaggatggagaaggctcaccaaggatgcgaggaaggggacgtggtcgtggaaggggcaggggtagaggtagaggaatgtacaataatggtggtatggaatatggtggtgatggttgggatggtggacgtggttatggtggcagagggcgtggccgtgcatggggtcgtgctttccgcggacgaggacgcggctatggtgcccagccggctggttattatgacaatggtgaatatgatgcaccacctcctgccccacgtggccaaggtcgtggaaggggaagaggccgtggacgtggtcgagatgctggccgtggagcagctgcttagttagaagagggtgcctttctgcttagttatttggtattatttgagtcgttcagtgttgcggccatgttcctgcagttttggttttgtagttctttcccttgtaacatctataattttaagttggagaggttgagttagatatatttcttttgtttagactttgaaaaaagagtcgaatttgttaattttcttatatagaaatagaaatgattgcatcaaaattcaagcttgctttgcacttgacgtttcatttctaaaattgaaaaattgaaattttgggtagg

SEQ ID NO: 2369 - DNA, 1404 bp, Manihot esculenta
gagaagaccgggatcacaaagccctactctctctgaactgctttggttatcctttttcttctccaatcatatctcaaacttcactgcttcccttctgcttaagctcttcacttcatttcttccatttcttcataatgcccaatatataaaaaactcttttcaatctgtagattatcttctccgtagacaaagctgcactccaacgattggccaacggagcgccagagccagcgggagagtggtttgcgtagtctctgtaactgtttgattcacactcactcagatggataggtaccagaggattgagaagcctaaggcggaaacgccaataaatgagaatgagattcgcattaccactcagggcaggatgagaaattatattacctatgccaccactctcctccaggagaaagggtccaacgaaataattcttaaagccatgggcagagctataaacaagacagtgatgatcgcagagttaattaagagaagaattgttggtctgcatcagaacactgctattgaatcaactgatataactgacatgtgggagccactggaagaaggccttcttcctcttgagactactcgacatgtttcaatgatcacaatcactttttcaaagaaggagctggatacatcctccacaggatatcaacctcctcttccagttgatcaagtgaagccattgaatgaatttgaagatgaaggagaaggctcgccaataatacgaggaagaggacgtgggagttggggaagaggaaggggcagagggaattacaatgtaggagattataatggtgatggttgggatggtgggcgtggttatggaggcagaggccgaggtcgtggaagaggccgttttttccgaggccgtggccgtggtcgagggcgaggatttgggggtcaatcaagtggttactatgattatggtgaatttgatgctctgcctgcccctggtcgcggttttgcagggcgtggtcgtggcaggggaaggggccgtgggcgtggtcgtactttcagatctgagggccctgaccaagcaggagctgcctgagcagcatctctggggaaactataatattaggtgtgcagttgaaaagttttacatggatgcctgctctgctttttgtcttggtaaatttggtgataatttacgggcattgtccttaagtttagagttttgaaagtgtagaagccatgctgcttgcagttttgtctctgtgtaggttatggagtaggattatttttgtagtttattattgctgatcagatgtttagcatactgggtaaggttgtaaatgttttgttttctccccctataaaggaatgatagagcagtacattcttttattcttaataacaaaaatagatatgctgcatgctgattttaattgaacttct

SEQ ID NO: 2370 - DNA, 1308 bp, Citrus clementina
tgccttgaaactaaacttatatacgaaaaaaaaaaaattattaattaataataagtataaaagacttttttcggggcttaatttgagaaatcaaaagacaaggccaaaaaatatccagaacaggaaccaaaaccagagctcggtaagagtggtcgtttgctaagcctttgtactcagagaaatggataggtatcagagagtagagaagccaaaggctgaagccccaataaatgagaacgagattcgtattacaactcaaggcagaatgagaaactatattacttatgccaccactctcctccaggagaaaggatccaacgaaattgttcttaaagcgatgggcagagctatcaataagactgtaatgattgccgaactaattaagagaaggattgctggtctccatcagaacacttcaattggatcaactgatataacagatatgtgggagccattagaagaaggccttcttcccctagaaactactcgccatgtctcaatgatcacaatcactttgtcaaagaaggatctagatacatcatcaacgggttaccaacctcctcttcctgctgatcaagtgaaaccttggaatgaatttgaagatgaaggagagggttcaccaaggggacgaggtagaggacgcggtggtcgaggaaggggtaggggtagaggaggtttttacaatggagcaggggactataatgtcgatggttgggatggtggacgtggcttcggtggtcggggtcgaggacgtggtagaggtcgttctttcagaggtcgaggatggggttacggtagtcagtcaggtggatattatgattatggggagctagaagctccgcctgtcggtcgcggccggggtcgtggcagggcaaggggccgtgggcgtggtcgtaatcccaggtcgggtggcccatttcaagcagtgggtgcatgagcagtagatgttgctgaagatataatatatgctgttgggatgaaaaatgaatgtggatgcctgctctgcttgtgtttacatgtaagtgttggtgacaattatgggcattgtctttcatttcaagtcatgaagtgttgcagccatcatgctgctgccagttttgtttacaagtaactataggttgtggcctaggaatattttcttacttgtttgctgacaggttttttcacataccaagacagattgtacaattttttcccctttcttgataggaataatagagcagtacattctttcattcttcatattaatagttatacaaatgctaacttctgttgaggatcaagtcactatcttggtttcaatttgcc

SEQ ID NO: 2371 - DNA, 1306 bp, Citrus sinensis
tgccttgaaactaaacttatatacgaaaaaaaaaattattaattaataataagtataaaagacttttttcggggcttaatttgagaaatcaaaagacaaggccaaaaaatatccagaacaggaaccaaaaccagagctcggtaagagtggtcgtttgctaagcctttgtactcagagaaatggataggtatcagagagtggagaagccaaaggctgaagccccaataaatgagaacgagattcgtattacaactcaaggcagaatgagaaactatattacttatgccaccactctcctccaggagaaaggatccaacgaaattgttcttaaagcgatgggcagagctatcaataagactgtaatgattgccgaactaattaagagaaggattgctggtctccatcagaacacttcaattggatcaactgatataacagatatgtgggagccattagaagaaggccttcttcccctagaaactactcgccatgtctcaatgatcacaatcactttgtcaaagaaggatctagatacatcatcaacgggttaccaacctcctcttcccgctgatcaagtgaaaccttggaatgaatttgaagatgaaggagagggttcaccaaggggacgaggtagaggacgcggtggtcgaggaaggggtaggggtagaggaggtttttacaatggagcaggggactataatgtcgatggttgggatggtggacgtggcttcggtggtcggggtcgaggacgtggtagaggtcgttctttcagaggtcgaggatggggttacggtagtcagtcaggtggatattatgattatggggagctagaagctccgcctgtcggtcgcggccggggtcgtggcagggcaaggggccgtgggcgtggtcgtaatcccaggtcgggtggcccatttcaagcagtgggtgcatgagcagtagatgttgctgaagatataatatatgctgttgggatgaaaaatgaatgtggatgcctgctctgcttgtgtttacatgtaagtgttggtgacaattatgggcattgtctttcatttcaagtcatgaagtgttgcagccatcatgctgctgccagttttgtttacaagtaactataggttgtggcctaggaatattttcttacttgtttgctgacaggttttttcacataccaagacagattgtacaattttttcccctttcttgataggaataatagagcagtacattctttcattcttcatattaatagttatacaaatgctaacttctgttgaggatcaagtcactatcttggtttcaatttgcc

SEQ ID NO: 2372 - DNA, 1130 bp, Citrus sinensis
ccaaaaaatatccagaacaggaaccaaaaccagagctcggtaagagtggtcgtttgctaagcctttgtactcagagaaatggataggtatcagagagtagagaagccaaaggctgaagccccaataaatgagaacgagattcgtattacaactcaaggcagaatgagaaactatattacttatgccaccactctcctccaggagaaaggatccaacgaaattgttcttaaagcgatgggcagagctatcaataagactgtaatgattgccgaactaattaagagaaggattgctggtctccatcagaacacttcaattggatcaactgatataacagatatgtgggagccattagaagaaggccttcttcccctagaaactactcgccatgtctcaatgatcacaatcactttgtcaaagaaggatctagatacatcatcaacgggttaccaacctcctcttcccgctgatcaagtgaaaccttggaatgaatttgaagatgaaggagagggttcaccaaggggacgaggtagaggacgcggtggtcgaggaaggggtaggggtagaggaggtttttacaatggagcaggggactataatgtcgatggttgggatggtggacgtggcttcggtggtcggggtcgaggacgtggtagaggtcgttctttcagaggtcgaggatggggttacggtagtcagtcaggtggatattatgattatggggagctagaagctccgcctgtcggtcgcggccggggtcgtggcagggcaaggggccgtgggcgtggtcgtaatcccaggtcgggtggcccatttcaagcagtgggtgcatgagcagtagatgttgctgaagatataatatatgctgttgggatgaaaaatgaatgtggatgcctgctctgcttgtgtttacatgtaagtgttggtgacaattatgggcattgtctttcatttcaagtcatgaagtgttgcagccatcatgctgctgccagttttgtttacaagtaactataggttgtggcctaggaatattttcttacttgtttgctgacaggttttttcacataccaagacagattgtacaattttttcccctttcttgataggaataatagagcagtacattcttt

SEQ ID NO: 2373 - DNA, 1182 bp, Cucumis sativus
gccaccccttttcttctccttctccttctctttctatatattcttccttctttctctttacccaccggggccttcggaaaggcgcttcatttttcaataaaccacccaatacccaatcatcaacacacacacacacagacggagtgctgtagattcttctacctctttccaagcttctcctgacattcacttctttctttcttcttctactactgacctcacccacttacgatggataggtaccagagagtggaaaagcccaagtcagagaatactcctataaacgagaatgagattcgcattactactcaaggaaggatgagaaattacattacttatgccaccactcttcttcaggagaaagggtcaaacgagattgttgtcaagggaatgggcagagctattaataagactgttatgatagctgagttaattaagagaaggattgttggtctccatcagaacacagcaattggatccacggatataactgacatgtgggagccacttgaagaaggccttcttcctctcgagactacaagacatgtttcaatggtgtcaataaccttgtccaagaaggagctagatacatcttctacaggataccaatcacctcttcccgttgaccaagtgaaaccatggaatgaatttgaagatgaaggagatggatcacctagaatacgaggtaggggacgtggtagaggaagaggcaggggtagagggaactacaacggtccatctgagtatcagggagatggttgggatggggggcgaggttttggacctcgaggtcgaggacgtggaagaggtcgtgcatttcgtggaaggggacgtggttatggtcgccaatcagggggatattatgattatggtgaacctatggcaccaccagtaccgggtcgggggcgtggtcgtggcagggggcgggcacgtggtcgtggtggttattatcgatccgatggtccagtgcaagcagctgctgcttgagaggcaaacgtgatcaacgtggttgctggttgcattttgccaatggcctcgatatcgatattttatagttctgtcttctacttttttttgtttgttttcttttcaagttcgtaaattgctgccatggaggtaggagttaatagtttctgtagttttgtcgagataggaagattttcatagttccaaattaacttc

SEQ ID NO: 2374 - DNA, 1341 bp, Cucumis melo
gccaccccttttcttctccttctccttctctttctatatattcttccttctttctctttacccaccggggccttcggaaaggcgcttcatttttttaaaaaaaccacccaatacccaatcatcaacgcacacacacacacacacacggacggagtgctgtagattcttctacctctttccaagcttctcttgacattctcttctttctttcttcttctactactgacctcacccactcacgatggataggtaccagagagtggagaagcccaagtcagagaatactcctataaacgagaatgagattcgcattactactcaaggaaggatgagaaactacattacttatgccaccactattcttcaggagaaagggtcaaacgagattgttgtcaagggaatgggcagagctatcaataagactgttatgattgctgagctaattaagagaaggattgtcggtctccatcagaacacagcaattggatccactgatataactgacatgtgggagccacttgaagaaggacttcttcctctcgagactacaagacatgtttcaatggtgtcaattaccttgtccaagaaggagctagatacatcttctacaggataccaatcacctcttcccgttgaccaagtgaaaccatggaatgaatttgaagatgaaggagatggatcacctagaataagaggtaggggacgtggtagaggaagaggcaggggtagagggaactacaacggtccatctgagtatcagggagatggttgggatggagggcgaggttttggacctcgaggtcgaggacgtggaagaggtcgtgcatttcgtggaaggggacgtggttatggtcgccaatcagggggatattatgattatggtgaacctatggcaccaccagtaccgggtcggggtttcgcaggacgaggtcgtggcaggggtcgggctcgtggtcgtggtggttattatcgatccgatggtccagtgcaagcagctgctgcttgagaggcaaacgtgatcaacgtggttgctggttgcattttgccaatggcctcgatattttatagttctgtcttctattttttttgtttgttttcttttcaagttcgtaaattgctgccatggaggtaggagttgtagtttctgtagttttgttgagataggaaggttttcatagttcgaaattaacttcaagtacatccgaggcaaatggctgtaaattattattaatatttttttcatattcgtattcaataggagagagtggtagtgtagcagcagcgcagtacattctttcattcttacgtgaatttgcatgctgatctatctatatatttttt

SEQ ID NO: 2375 - DNA, 1371 bp, Citrullus lanatus
cctcaaagccctactctcactggttcatactcggccaccctttttcttctccttctctttctatttattcttccttctttctccaaactcacggggccttcggaaggggcttaatttttcaaaccacccaatacccaatcaaacaggtttcactcacattcacgcacacacagagggagtggtgtagattcttctatctctttgcaagcttctccagattcacttactttgtttcttcttctactactcagctcactcacgatggataggtatcagagagtggagaagcccaagtcagagaatactcctataaacgagaatgaaattcgaattactactcaaggaaggatgagaaactacattacttatgccaccactcttctccaggagaaagggtcaaacgagattgttgtcaagggaatgggcagagctatcaataagactgtaatgatagctgagctaattaagagaaggattgttggtctacatcagaacacagcaattggatccactgatataactgacatgtgggagccactcgaagaaggccttcttcctctcgagactacaagacatgtttcaatggtgtccattaccttgtccaagaaggagctagatacatcttcgacaggataccaatcacctcttcccattgaccaagtgaaaccatggaatgaatttgaagatgaaggagagggatcacctagaatacgaggtaggggacgtggtagaggaagaggcaggggtagagggaactacaacggtccatctgagtatcaaggagatggttgggatggagggcgaggttttggacctagaggtcgaggacgtggaagaggtcgtgcatttcgtggaaggggacgtggttatggtcgccaatcagggggatattatgattatggtgaacctatggcaccaccagtaccgggtcggggttttgcagggcgtggtcgtggcaggggacgggctcgtggtcgtggtggttattatcgatctgatggtccggtgcaagcagctgctgcttgagaggcaaacgtgatccagtgtggttgcattttgccgatggcctcgatattttatagttctgtctctttttttgcttcttttttttccttttgaagttcgtaaattgctgccatggaggtaggagttttagtttctgtagtttgttgaggtaggaagattttcatagtgctcctaattaacttcaagtacatccgaggcaaatggctgtaaattaattaatttttttttttatttatttatttatattctctattcaataggagaggtagtgtagcagcagcagtacattctttcattcttaaatgaatttgcatgctaatctactgatctagattttttcatcaa

SEQ ID NO: 2376 - DNA, 1403 bp, Glycine max
gtgtgaaaattgtaagagagaacggaagaggaaacaaagcaacacccgaacgaaccgcgcaaggtaacgaacgtagctgagcaaaagcaagcagtaacaatgccattgtcaacggtcgtttcccccttttgttcttcctcagccaccttcctatccacagttatcgcgcgctcttcactccctccaaaacgcaacgtctccccttccccattttccactctctctcgcagaggcatcgctctgctttccttcctctccctctccctctcagcaccagcctccgccattgaaattggcatgtcaggaccgaagaattggcttaaagaccaaaaaaagaaggcctccaagtacctattggcccctatcgatgcctcccgtcaaatccttcgctctgcctatctcacgctcacggaaactgacgctgcttatacggatgaggatttggagaagattcagcagctctttatatctgctgccagggattgcgtcccacaggaccggaactcattcgtcactttccaagccaacaccggagtagaggtgtgcacgtttcggttgattgtgaagaatgcagcttcgttgcttggaaataaggatcctgtaaagttgaaagctgaagctttgctagataatcttataagatctttcacctctgtcagtgggatggcaagtaaaaccaacattcaacttgcatcagataggaaaaagatagctgatgctgtatcagataccatatctgatcttgacaaatttgagctgggaatcagggattgccttgaaacctaactgtaaaggataacctagcttactttttgatgtggaaagttgatcattaaaaatcatgcaaggaatctattggtgtaatcacaaattttctgttatcaccagtgtgctgtctgccgggaatatcaaactatgcttttgccttacttaaattacttcttattagttctctcaatctaaaatctgtaagtactctgtcaatatgtatctgatattctttttcaatgcattcaatcctctgaatcatttcacagaggaattgagcaggctcttgatagctgtatccttttgatattacagggtgtgttcataatttgcacatactgaatatgtaataactaataaactttggtaatttcttaaacaaaggtaaatgctaggatgttctggaatgatttcttaaaatcagccaaaaaatatatgtatttttacattctccttaaattatgactgtttccctatttgtttggaaatgtatgaggaatttcctgttgtcaacaaaagggatcaaacaaatgcatactatacgattattactgttctaatttggattctgaatttgtcactttttttatggtatgttgtgattttaagcggaaataatatttgttgattgatgc

SEQ ID NO: 2377 - DNA, 993 bp, Vigna unguiculata
  misc_feature (577)..(577): n is a, c, g, or t
agattacgaaagaagaaacgattcgaccttgaagaatcgcgcaaaggtaactagcgagcaaaaacaagcatttgcaatgccgttgccaacggtcgtttccactacttcttctttttctgccatacttctatcaactattacggcgcgctctacactccctccaaaacgcaccgtttccccttcccctctctccgttctctctcgcagagacatcgctctactctccttcctcgcgctctctccacctgcctccgccattgaatttggcatatcaggaccgaagaattggctaaaagagcaaaaacggaatgcctccaagttcctattggcccccgtggatgcctcccgccaaatccttcgctctgcctatctcacgctcacgaaaaccgacgctacttatacggatgaggatttggagcagatccagcagctgtttatatctgctgctagggattgcgtaccacaggaccggaattctttcgtcactttccaagccaagagcggagtagaggtgtgcacatttcggttgattgtgaagaacgctgcttcgttgcttggaaataaggatcctgtaaanttgaaagccgaagctttgctagataatcttataagatctttcaccactgtcagtgggatggcaagtgaaaccaacattcaacttgcatcggatagagaaaagatagcggatgctgtatcagataccatatctgatctcgacaaatttgagcagggaatcagggattgccttgaaagttgaaacctaacttaaagaatagcctatcctacttttttgatgtggaaagttgatccttaaaaaatcacgcaaggagcttattggtgtaataaccaattttctgttatcaccggtttgctgactgccgagaataccaaaatatgcttttgccgtactttaaaatacttatttgttctctcaatctgaaatctgtaagcactctgtcaataatcatatgatattctttttcaatgcattca

SEQ ID NO: 2378 - DNA, 1395 bp, Phaseolus coccineus
  misc_feature (1063)..(1063): n is a, c, g, or t
gaaagaagaaacaattggacccggaagaatcgcgcaaaggtaacgtagtgagcaaaagcaagcatttgcgatgccgttgccaacggtcgtttccaccatttcttctttttcagccatatttctgtccaccgatacggcgcgctcttcactccctgcaaaacgcaccgtttcctcttccccttactcagttctctctcgcagagacatcgctctgctctccttcctcgcgctctctccacctgcctccgccattgacattggcatctcaggaccaaagaattggctgaaagagcagaaacggaaggcctccaagttcctattggaccccgtggatgcctcccgccaaatccttcgctctgcctatctcactctcacgaaaaccgacgctacttatacggatgaggatttagagaagattcggcagctatttatatctgctgctagggattgcgtacctcaggaccggagttctttcgtcagtttccaagccaagagtggagtagaggtgtgcacatttcggttgattgtgaagaatgcggcttcgttgcttggaaataaggatcctgtaaagttgaaagccgaagctttgctagataatcttacaagatctttcagcactatcagtgggatggcaagtgaaaccaacattcaacttgcatcgcatagagaaaagatagcggatgctgtatcagataccatatctgatctcgacaaatttgagcagggaatcagggattgccttgaaagttgaaacctaactttaaagaatagcctctcctactttttgatgtggaaagttgatccttaaaaaatcgcgcaaggagcttattggtgtaaataaccaattatctgttatcaccggtttgctgactgccgagaataccaaaatatgctcttgccgtactttaaaatacttatttgttctctcaatctaaaatctttgtcatcagtttatagatactcctccaatccaaggtacaaagatacgtatatgccttgttgaaagagactgctatttcaatgaggggggagttatgttatggttgctgaagatttttgtgtnctttcaaacttgggagaaaagtaataaatgtattttttaaatgggacaacccccatcttggaaactgccaaatcaagacaagagctacttcacatacctcattaggtgagaatttcgttcagagtttagttttttatttataatcaggtaatatcacaacatatttaataaacattaattttttataatactaaaattcacacatagaaatgtgttgaataagatataacaattgatcacaaaattaaaatgattgtcagctctttattttttaaaaaaattgctctgaacattcaatatttgttgcttcaattttatagagtgaaagattt

SEQ ID NO: 2379 - DNA, 1070 bp, Cajanus cajan
ggggagagaaacaatccgacccgaaaaaaaaaacccgaacgaatcgcggaaggtaaggtgagcaaaatcaagcaagaacaatgccattgccaacggtcgtttcccctttctcatctttctcggccatctttaccgcgcgctcttcactccctccaaaacgcaacgtttccccttacccctttccattctctctcgcagagacattgctctgctttcctttctcgctctcgctccacctgcctccgccattgactttggcatctcaggaccgaagaattggctcaaagagcagaaaaagaaatcctctaagttcctattggcacccgtcgatgcctcccgcgaaattcttcgctctgcctatctcatgctcacggaatccgacgctacttatacggatgaggatttagagaagattcagcagctctttgtatccgctgctagggattgcgtaccacaggaccggaattctttcgtcactttccaagccaacaccggagtagaggtgtgcacatttcggttggttgtgaagaatgcagcttcattgctcggagataaggatcctgtgaagttgaaagccgaagctttgctagataatcttataagatctttcacctcaatcagtgggctggcaaacaaaactgacattcgacttgcatcagatagaacaaagatagctgatgctgtatcaaataccatatcttctcttgacaaatttgagcagggaatcagggattgccttgaaatctgactgtataggaatcggatagcctatactactttttgatgtggaaagttgatcattaaaaaactcacgcaaggctattggtgtaatcagcaattttcttttagcaccgcggtgtgtgactgccgagaatatcgaaatatgcttttgtcctacttaagttacttgttagttctcaatctaaaatctgtaagcactctgtcaagagtcaagacggatctgatattctttttcaatgcatgctcttgttgatagctttatccttttgatatttacagggtatgttcataatttgcaaatactgaatatgtaattaactttcgagtct

SEQ ID NO: 2380 - DNA, 1495 bp, Vigna unguiculata
ggggagtattggtgtttgagaagaaagagtgggagttatggtgacaatggaagaaagtccacggagcccagaggcgaaggtggggttgagagtggaggatctatgggacgttcaggagccacagcttagtcctgatgaaaagctcaatgcttgctttgagagcatccctgtctctgcctttcctttacctccttcaaatcaagaagttgagataaaatcagataccagtctagcagaagcagtgaaattgcttgcacaacacaacattctcagtgcacctgtggtggatgtagatgctcccgaagatgctagttggatcgacagatacataggaatagttgagtttgctggaattgttgtatggattctgcatcagtctgatcccacatctcctaggagtccatccagtggatctgctatttcggctgctgtcaatggaataacctctgcttttgaacatgaagcctcaggccttgaatctgccatgacaacttcaggaaacttttttgaggatctgacttcttctcaactttataaggataccaaggttcgtgacatttcagggtcattccgctgggccccctttctcgctttggagagatcaaactcatttttgaccatgcttttgctgctttccaagtacaagatgaagagtgttcctgttgttgacttaggtgcaggtcgaattcaaaacatcattacacagtcttctgtcattcacatgttggcagaatgtgttggtcttcagtggtttgagagttggggaaccaagaagctatctcaagttggtcttcccatggtcacaccaaatcatattataaaggtttatgaagatgaaccagtgcttcaagcatttaaactgatgaggaaaaagaggattggggggttgccagtgatggaaaggggtggcagcagggcaattggtaacatcagcctgcaagatgttcaattcctcctaactgctccagaaatctaccatgactatagatctattacagcaaaagacttcctgacagcagttagaagctacttagagaagcatgaagggacctttccaatgtcaggtgaactgataacatgcaataaggattgcacaatcaaagaactgattcaactgcttgaccatgagaagattcatagggtctacgttgctgacagtgatgggaatcttgaaggactgatcacgctgagagatatcatctcaaggctagtacatgagccccgtggctattttggtgatttctttgatggggttctcccgatgcctcctaacagcagggtttgacctgcatcccagaagaatgacttctaatgcatcagtaacaaatttatctgtttcccatcatagctcacgacaagatcttagggcaaggcaaggcctttgtaaaaagcaacttgcactttgcaagtttattgctctcattttgagttgggtgaaaccgtgaaatgtgaaattttgtgtaaattcttacgtaataatcagtagttttggtca

SEQ ID NO: 2381 - DNA, 1449 bp, Arachis hypogaea
aaagagaaagagagtgagaaacttgagtgttggttatggctgctacaatggaagatagtccaagaagtccagaggcaaagcttggaatgagagtagaagatctttgggatgttcaagaaccacaactaagtcctaatgagaagctcaatgcttgttttgaaagcatacctgtctctgctttccctccacctccttcaaaccaagaaattgagataaaatcagatgctaccttagctgaagcagttgaaatactagcagaacacaacatcctgagtgcacctgtggtggatgttgatgcacctgaagatgccagctggattgacagatacatagggatagttgaatttgcaggaattgttgtgtggattcttcatcagtctgatcctacatctcctaagagtccatcaagtagatccaatcgaactgcaattgaagctgcaactaatggcatggcttctctacaacttgagggcaaggaccttggatcttctacaacaacttcagggaacttctttgaggatctcacttcttctgaactttataagaataccaaggttagagatatctcaggatcatttcggtgggccccatttctagcactggagaggtcaaactcattcttgaccatgctattgctactctcaaagtacaagatgaagagtattcctgtggtggacttaggtgctggaagaattgatcaaatcattactcaatctgctgtgatacacatgttgggtgaatgtgctggtcttcaatggtttgagagctggggaaccaagaaaatatctgaagttggtcttcctctagtcacaccaaatcatatcatcaaggtatatgaggatgaaccagtgcttcaagcctttagattgatgagaaaaaagaggattggaggtgtgcctgtagtggaaaggggtggcaacaatccagttggtaatataagcctccatgatgttcagttcttgctaactgccccagaaatataccatgattatagagcaattactgccaaggatttcctaacagctgttaaaagctacttgaagaagcatgaaaaggttgtttctatgtcaaggggtttgattacttgcaaaaaggattgtacaataaaagagttgatccaattgctagatcatgaaaagattcacagggtctatgttgtggatgatgatggaaatcttgaaggactcgtcactctaagagacataatctcaaggcttgtacatgagccacgtggctactttggtgatttctttgatggcgttcttcccatgcctccaaatagtagggtttaattttagggttaagaacattttgcatgttacttgaacttaagcagataaatccatttttaacttttgtgagattttgtgtaaatgtaaaagtgctgatggaatcgtactgagttttgtatcatattttcttttgaataagagtaatcataatacccaa

SEQ ID NO: 2382 - DNA, 8237 bp, Glycine max
aatgaagataagatgacaattgagataagagggaatgaaccttaagatatttttacattccaaacactcaaacagggaggatcgatcatttctgatcgagtatgttttctggtttctttcgtcatgctctcagtattctcttgctctttaacttgatcttggttttcttcggactagtatttattgcttacgatttggaatagtgacaagtaaagacaaatcacaacacacggtcatccaattccaagaatagagtttattgcttaggatttggaatagtgacaagtaaagacaaatcacaactcacggtcatccaattccaagaatagagagatgtagttatagtatcaagctgacagaatggagtctgtgttgtccccgatagtggaacgaacgtttaattttgcggtggaccccattattcggcagttggcctacatcctccgttgcaggcaaaatgttgatgaactcttgactagttttgagagtcttgaacttgaaaaagagtccatagatcgtcgatgtgaccaagctcagaataatttacaaaacattgaagccaaagtcaaagaatggtcaaggaaagtagatgagttcaagactgaactagagaagtttaggaacgatgaaggccacagaaagacagggttgtccaatgttttatttttatttccttacttttggaataggcatagacttggcagacaagctaagaagatggcagagattgtcaagaatctaatagatgagtcggccaagttcaatgatgtttcctacacagacaacttaacatctaatgatttcactttgtctaatccgggctacatgggatttgcttctagacattctacagtggaaaaaataattgcaaaacttgaagattcctctgtaagaatgattgggctgcatgggagtggtggcatgggtaagaccactttaatcaaagcaattgctaagaaagctatggagaagaagctgtttaatgtggtggctatatcagaaatcacagccaatcccaatccacaaaaaatccaggaagacattgcttctgcgttaagattgagattggaaggggagggtgagaattctagagctcatcgtctgatgacgagattaaagcaagagaaggagaacacccttataatcttggatgacctttgggacagattagacttgaataagttagggattccacttgatggtgatgttgatgataatgatttaaacacgaagacaagcaatgctaaacagggtcccaaagaggcgactaaagaaaaatctcttggtgattatatgggctgcaaaattttgctaacttcaagggataaaaacgtattaactgataaaatggaagttaagtcaactttctatgtagaggaattagatgacgatgatgctctgaggttgtttcggaaggaggctagaatacagggtgaaatgtccgagtggaaacaagaaattgttaagaagtattgtgctgggttgcctatggcaatagttacagttggaagggcattaagagaaaagagcgactcggagtgggaaaaacttaaaaaccaagacctggtgggtgttcagaattctatggagatttctgtaaaaatgagttatgaccgtctagaaaatgaggagctcaagtccattttctttcttgtgctcaaatgggtcatcaaccccctaattatggacttggtgaagtattgctttggtttgggaatacttaaaggggtctactcgcttggggaagctcgtggcagaatatctacatcaatccaacagctgaaaaactcaggtttggtgttggatggaagttctagtattcatttcaatatgcatgatctggttcgagatgctgctttgtctatagcacagaaggagcaaaatgtatttactttgagagatgggaaacttgatgattggcctgaactcgagaggtgcacttctatttctatatgcaacagtgatatcattgatgagcttccagaagaaataaattgtcctcaacttaaattttttcaaattgacagcgatgcttcatctttaaaaatacccgacagtttttttaaaggaatgaaaaagctcaaagtattaatgttgactggtattcaactatcaagcttaccatcttcaattgaaagcctatcagacctcagattgctttgtttggagagatgcactttagatcacaacttatccatcatagggaagctgaaaaaattaagaattctcagcttttctggatctcgaattgaaaatttgccagctgagttaaaggacttggataaactacaattactagacatcagcaattgttcagtagtcaaaagaattccgcctaagtttatgtcaaggttgacttcgttggaagagttgtatgtaagaaagagcttcatcgaagtgtcggtggaaggagagagaaaccattgtcaaatttcgtttctttctcaactaaagcatttgcatcaattgcatgtggtggacttaagtattccatgtgcccaattttttcccaaggaattgttctttgacaagttaaatgattacaagattgagattgggaacttcaaaacgctttcagttggagatttcaggatgcctaataagtatgaaaagttcaaatctttggcattggagctgaaggatgacactgacaatattcactctcagaaaggaataaagttgttgtttaaaagagttgaaaatttgttgttgggagagctgaatggtgttcaagatgttattaatgagttgaatttggatggatttccacatctgaaacacttatccatcataaacaaccctagcatcaaatatatcatcaactcaaaggatttgttttatcctcaggatgtttttcccaagttggaatctctatgtctctacgaactaagaaagatagagatgatatactttagttcaggtacagagatgatatgttttagtccatttacagattgctcattcaccaaattaaaaaccatcaaggtcgagaagtgtgaccaattgaagaatcttttctccttttgcatggttaaattgcttgcgagtcttgaaacaattggtgtctccaattgtggttctttagaggagatcattaaaatacctgacaattctgataagattgagtttcttaagttgatgtctttgtcacttgaatcattatcatcattcactagtttttataccacagtagaggggtcttctacaaacagggatcagatacaaattactgttatgactcctcctctttttggtgaactggttgaaataccaaacttagagaacttgaatttaatctcaatgaacaagatccagaagatatggagcgaccagcccccgtcaaacttctgctttcaaaacttaataaaattagttgtgaaagattgtcataatttgagatatttgtgttcattgtccgtggccagcaatttgaggaaactgaaaggcctgtttgtaagcaagtgtaaaatgatggagaagatttttagcacagaaggaaatagtgcagacaaggtctacgtctttcctaagttggaggaaatccacctcaacgaaatggatgagttaacagacatatggcaagctgaagtgagtgctgattccttttctagtgtcacttctgtgaacattgatagttgcaataaactagacaaaatttttccgagtcacatggaaggatggtttgcgagtttgaacagcttgaaggtttattcttgtgagtcagtggaagtgatttttgaaatcaaagattctcagcaagtagatgcatctggtgggatagacacaaatttgcaggttgttgatgtaaggagactcccaaagttggagcaggtgtggagcagggatccgggaggaattcttaacttcaaaaaactgcagagtatagagatggatgattgtaaaagactgaggaatgtatttccagcttctgtggccaaagatgttccaaagcttgaatacatgtcggtagaaagttgtgatggaattgtggaaattgttgcctctgaagatggatccgaaacaaacactgaacaattagtgtttcctgaactaacctacatgtatttaggttacctatcaagcatccagcatttctacagggggagacatcctatagagtgtccaaaattgaagaagttggcagtagagaaatgtaacaagaagctaaaaacattcggaaccggagaaaggagcaatgaagaagatgaagcagttatgtcagctgaaaagatattccccaacttggagtatttgcatattgactttgacgaagcacagaagtggttattgagcaacactgtgaagcatccaatgcaccgtttaaaagtgctttcgttatgcaaagttaatgatggtgaacgtctctgtcaaattctgtacagaatgccaaatctagaaaagttacgcttgacggaagctgaacatttgcttcaagagtcgtcggagtcacgtttgggaaccgtattacagctgaaggaattgtatttgtggttgtcgaagataaagggtataggatttgaacgagaatcagttctacagagactagagcttttgagcttatctgagtgccatatattgaggaatttggctcctccctcggtatcattggcttacttgacaaatttgaaagtagaggattgtaaaggattaaggaatttaatggcatcctcaacggcaaaaagcttggttcaacttaagtccatgaagataagcgaatgtcatgaattagaggaaatagtaagcaatgagggaaatgaagaagcagagcaaatagtgtttggcaaattgattactatagaacttgaggggctaaaaaagctgaaaagtttttgcagttacaagaactatgaattcaaattcccgtcattggaagtattgattgtgagagaatgcccattgatgcaaagattcacggagggtggcgcaagagcagcaaagttacaaaacatagttactgctgatgaagaaggaaaagaggaagccaaatggcagtgtgaaggagacttgaatgccaccatacaagaaggtttcaacaagcgtttgcagtctgcaagtactgaatcatctcttagtctcagagatagcccactacaagtgatatggcttgactcacggtggatcccaaagtcgtgcttcagtaacttgaactctttgactgtggatggatgccaatttttaaccgatgttgtcatacccttctatttacttcctttgttaactaatttggaagaattaaaagtccgaaagtgtggttctgtgaaaagcatatttgacgtgaaaacaactacgggattgggagcagcagccttccctagacctctccctttttccctcaagaaattgactttagagaggctgccaaaactggagaatgtctggaatgaagatcctcatggaattctaaccatgcaacttctacaacatgttattgttgcagaggataatgcagatccaagagaagcaaatctggagcttacgttcccttgtccctgtgtgagctcattgaaactacaaggtttgcccaagttcaagtatttttactactgctcactgcagtgtcacatgttccagacacctaccgaggatgaaatggtactattgtgttacaactttgtccttactgcataatctcatgcctgcaaattaaatataattgcaatacttcatttttattgttcaacatgagtgatatgaacattctcttaaaattaaaatgtgagaatttcacgtacattgctatatatatatatgccgtgttctatcttctatacctattaactcccatttttcatcctacatccaacttacagtgcctgtcactcggtgaaataggactggagatgatcaagcgtggagaatttcagacaaacttcttacacaagttacaagttcttactctgtgctttcatattgggtcgaatgtatttccatatgaaattctacaactggcgcccaatatagagaagcttgtggtgtatgatggttccttcaaggagattttctgctttgatagtcttaatgtggatgaggctggactcctattacagctcaaagtcttatgcttggagtcccttccagagcttgtttccattgggttagagaactcttggattcagcccttactgggaaatctagaaaccttggaagtaataggttgttctagtttaaaagacttggtaccatctacagtgtctttttccaatctgacacatttgcaagtacaagattgcgacagcctgctatatttgttcacatcctccacagcaagaagtttgggtcaactcaaaacaatgaagataagttgctgttattcaattgaagaggtagtagtctctaaggacggggatgaatcacatgaggaggagattatatttccgcagctcaattgtttgaaacttgaatatttatcaaagctgagaagcttctataaaggaagtttattaagtttcccatcattggaggaattgtcagtaatctattgcgagtggatggaaacattatgtccaggtaccctaaaagcagacaagttggttcaagttcaacttgaaccaacttggaggcactcagatcctatcaaattggaaaatgacctgaactctaccatgcgggaggcattttggaaaaagttatggcactctgcaagttggccatgggaatcagatcttgacctcaaagatagcccagtacaagagatatggcttaggcttcactcactgcatatccccccacacttccgcttcacttacttagacaccttgattgtggacggctgccattttttatcagatgcggtcttacccttgtctttacttcctttattacctaatttggaaacattgaaagttcgaaactgtgattttgtgaaaatcatatttgatgtgacaactatggaaccactcccttttgccctgaagacattgattttagagcggctgccaaatctggagaatgtttggaattcaaatgttgagcttacgttcccccaagtcaagtcattggcactctgtgatctgccaaagttaaagtatgacatcttgaagccatttacacatctagaaccacatgctctaaatcaagtctgttttcaaaagcttacacccaacatagagcacctgacactcggtcaacatgaactcaacatgattttgagtggagaattccagggaaaccacttaaacgagttaaaagttcttgctctgttctttcattttgagtccgatgtatttctacaacgggtgcccaatatagagaagcttgaggtgtgtgatggttccttcaaagagattttctgctttgatagtcttaatgtggatgaggatggattggtttcacagctgaaagtgatatgcccggactcccttccagagcttgtttccattgggccagagaactctgggattgtgccctttctcagaaatctagaaacattgcaagtaatcagctgtttgagttcaataaatctggtaccatgcacagtgtctttctccaatctgacatatttgaaagtaaaaagttgcaagagtctgctctatttgttcacatcctcaacagcaagaagtttgggtcaactcaaaacaatggagataggttggtgtgattcaattgaagagatagtgtcttcaacagaggaaggggatgaatcagatgagaatgagataatatttcagcagctcaattgtttgaaacttgaagtattaagaaagctgagaaggttctacaaagggagtttaagtttcccgtccttggaggaattcacagtattgtattgcgagaggatggaaagtttgtgtgcaggtacaatcaaaacagacaagctgttactagtcaatcttgtggcacctctgcttaactttggatatgatatcccattggaaactgatctcaactctgccatgcaaaatcgataggcatttctggcaagggatatgactccaatattgcacttagaggagattgattcaccaagaaaaaatggttagaggagatgaacaaattaagacctttttcatgagtctacgtcaatgccgctttcaggatttgacatttcattttcaaacgtgaattcgacactagtacacacttaagtgtttatttactccagattattaaataatttacctgttaatataatttttgctctaaaaagcaaattaatattactttaattcctagctaagagataagctagttagtgtgtgttgaggaatacaattaattgaaaaagtgaaatttgatta

SEQ ID NO: 2383 - DNA, 1583 bp, Lotus japonicus
gctggttcaagctattttcaaccttctgaaccaaaatatattctttcctcaaacaagctcctaatagcttcaattcaaaggactgaatcaagggtgttgttttacttgattatggagttagatgcaggatatgacagtaggaaagccaaagttcaagcctttgatgactcaaaagtgggtgtgaaaggcctcttagattctggggtgacaaagatcccacccatgttttattctcctaagttggaccccattgaaactgagacctcactaagcgattccaacttcagcatcccaatcattgatcttcaagataggcatgttgaagtggttgaccagatccagagtgcatgcaagaagtggggatttttccaagtgatcaatcatggtattccagctgatgttttggatgagatgatcagtggaatccgcaggtttcatgaacaagatgctgaagcaaggaagctcttttactctcgtgatagcaataagaaagttagatatttctctaatggaaagctgttcagagactttgctgctagctggagggatacaattgcttttgttgcaaatcctgatcctccaaatccacaagatttaccagcagtttgcagggatattgtggctgaatattccaaacaagttaaagcactcggaatgacaatctttgggctcttgtcagaagctcttggccttaatccttcttaccttaatgaaatggactgcgctgaagcactttatattatgggtcaatactatccagaatgccctgaacctgaattaactatgggcattccaaagcacactgattgcgatttcatgacaatacttgtgcaagatcagaagggtggtcttcaagttctacatgagaatcaatgggttaatgtccctcccgtgcatggagcacttgttgtaaacattggagatattctacagcttatgacaaatgacatgttcatcagtgtttatcaccgggtgttgttgaggaatatagggcctagagtatctgtagcaagtttctttatgaattttactatatctgagtgcacgtcgaagatttatggtccaataaaggagttgttatcagaagaaaaccctccagtctatagggatgttactatgaaagaaatcttgacaaattattatgcaaaaggcattgatgggaacttacttgcaacctttaaggttgtgaaagaaaatataaggtattggataggttccccctgattctcaaatctcatggagttggctttagcctggatttatcatggttaggttgtgcctcttgctgcgtttggacactggcttttatgggagcttatctactagggctccatttggaagagtttatttgagtttatcttatagcataagccctacaaactgttatgagagagctttatggtctacctacaaactgttttcagcttattttcatgagctgttgagagcagcttacgaaaaagagctaatgatgatttataacctattttcaacttatttcaataataagcgcttacataagttgttttcccaaacgcaccctagaaaatgcactaaataagttccaataagtgctctttgat

SEQ ID NO: 2384 - DNA, 1530 bp, Glycine max
tacaccgtagtctcctgctaaagacagatctcagattctgtacgctaacacacagagagagtgagagagatatggcaacgacgtcgtcttcaagcgaggaagcaccgaacactaagaagaacaagaaggagtgtttaggttggatagaatggttaagaggttggttctatgtggtctacgaaatgctctttcagcgcatcatggcgagtcatttgcacaaccccatgcctctccctcccgtcaacgacctcacctgcattgtcaccggctccaccagcggcattggcctcgaaatcgcaaggcaattagcacagtcaggggcccatgttgttatggctgtcaggaacacaaaggcagctcaggagttgatccagaagtggcaagttgactctgaaggattgagtattcctctcaatgttgaggtgatgcaagttgatcttctctcattggattctgtcacgaggtttgctgaagcatggaatgcacgctcagcacccttacatgttctcatcaataatgctgggattttttccattggagagccacaaaagttctccaaagatggttatgaacagcacttgcaagtgaatcatcttgctcctgccttgctttcaatacttcttttgccatcccttattaggggttctcctagtcgcattgttaatgtgaattccataatgcatcatgttggctttgtagacactgaagatatgaatctcacatctggaaaaaggaaattttctagtatggtaggatactcaagcagcaagttagcagagattatgtttagtagtactattaataaacgactccctgctgaatctggcatcagtgtattgtgtgtatcacctggaattgttcagaccaatgtggcaagagatcttccaaaacttgttcaagctgcgtatcatttgatcccttacttcatctttagtgctcaagaaggtgcaagaagcgctctctttgctgccactgatcctcaagttccagagtattgtgaaatgttgaaagcagacgagtggcctgtttgtgcatttatttctcaagattgtcgtccagcaaatccatcggaagaagcgcacaatgttcaaacatcgtatgaagtgtgggagaagacattagagatgattggccttccctcagatgctgtggaaaggcttttagatggggaagaagttaaatgccgttatggacaagaacagtaatctaatatacaatatctcccttaatctgtaagggcacttccattatttatagctagtaatgagcattttcattctgaatatgtgggagaagaacccttttatatttttttaaacatgatatgtatatccattttgatcatatttatgtactcaaatgccacctgctcctcctaatgggagaatttagccagctttgaccttaaatgtcaccatagaagtaagaattaaattagtaagcactatttgttatagttgtttttgacttttgatacatgtcatatgtgacccacctaaataagtgaattccaacaatagtgttgctttc

SEQ ID NO: 2385 - DNA, 1421 bp, Vigna unguiculata
  misc_feature (56)..(56): n is a, c, g, or t
  misc_feature (97)..(97): n is a, c, g, or t
  misc_feature (192)..(192): n is a, c, g, or t
  misc_feature (276)..(276): n is a, c, g, or t
gtatagagagagagaaagagagagagggagatggcaactacgacgtcgtcttcaancaatgaagcgccggagacgaagaataagaagaaggagtgtntgggttggatagagtggttaagagggtggttctatttgatctacgaaatgctctttcagcgcatcatggccagccatttgcacaaccccatgccnctccctcccgtcaacgacctcacttgcattgtcacaggctccaccagtggcattggtctcgaaatcgcaaggcaattggcacantcaggtgctcatgttgttatggccgtcaggaacacaaaggcagctcaggaattgatccagaagtggcagattgactcttcaggattgagtattcctcttaatgttgaggtaatgcaagttgatcttctctcgttggactctgttgtgaggtttgctgaagcatggaatgcacgctcagcacccttgcatgttctcatcaataacgctggaattttttccattggagagccgcaaaaattttcaaaagatggttatgaacagcacttgcaagtgaatcatctggctcctgcgttgctttctatacttcttttgccatcccttattaggggttctcctagtcgcattgttaatgtgaattctataatgcatcatgttggctttgttgacaccgaagaacatgaatgtcacatctggaaaaaggaaattttctagtctggtagggtactcaagcagcaagttggcagagattatgtttagtagtattcttaataaaagactccctgctgaatctggcgtcagtgtattgtgtgtatcgcctggaattgtccagaccaatgttgcaagagatcttccaaaactggttcaagctgcgtatgcatttgatcccttacttcatctttagtgctcaagaaggtgcaaggagtgctctttttgcggccacggatcctcaagttcctgagtattgtgacatgttgaaagcagacgagtggcccgtttgtgcctttatttctcaagattgtcgtccggcaaatccatcagaagaagcacacagtgttcaaacatcatatgaagtgtgggagaagacattagagatgattggtcttccttcagatgccgtggagaggcttttagacggggaagaagttaaatgccgttatggacaagaacagtaatctatctaatttacaatgatgactacaaaaacagttgatcagccgaaatgtcgccacatgtcaccacgtgctcaccgctgatctgtaagggcacttacattatttatagatagcagtgagctttttcattctcagtatgtgggaaagaagaacccttctttagtttttggacatcatatatgtacattcattttgatcatatttatgcactaaagtgtcacttgttattcataatggtagagaatttaacca

SEQ ID NO: 2386 - DNA, 1535 bp, Medicago truncatula
acgaatctcaaacacacaccgtaaaacacaaccacactctcgtttcctactaaagacaaagatctcagattctctctcaattctcacacaaacacagaaacatggcaacagcaacaacgacatcttcttcaagcaacgaaccattgttgaagaagaaaaagaagcaaagtttgggttggatagaatggttaagaggatggttcaatttattctacgaatttctattccaacgaatcacggcaagtcatttgcataatcctatgccgttaccaccaatcaatgatctcacttgtattgttactggttctactagtggcattggtcttgaaattgcaaggcaattggcagaatcaggggcacatgttgttatggctgtgaggaacacaaagcgggctaatgatttgatccagaagtggcagattgagtctgatggattgggattgggtatggcactgaatgtcgaggtgatggaggtagatcttctctcattggattctgttgcaaggtttgctgaagcttggaatgcacgtgcaacacctttgcacgctctcattaataacgctggcattttttccattggagaaccacaaaagttttcaaaagatggttatgaagatcacttgcaagtgaatcatcttgctcctgctttgctttcaatacttcttttgccatcccttattaggggctctcctagtcgaattgtgaatgtgaactccattatgcatcatgttggctttgttgatactgaagacatgaatctcacatctggaaaaagaaagttttctagtttggttggatactcaagcagcaagttagcgcaggttatgttcagcagtgttctttttaagcgtctgcctgctgaagccggtatcagtgtattatgcgtatcgcctggaattgtccagaccaatgttgcaagggatcttccaaaatctgttcaaactggatatcatttgataccttacttcatctttaatgctcaagaaggttctaggagtacactttttgcagcaactgatcctcaagtttcagagtattgtgaattgttgaaatctgatgaatggcctgtttgtccgtatatttctcatgattgtcgtcctgcaaatgcgtcagaagaagcacacaatcttcaaacatcacatgaagtatgggaaaagacattagagatgattggtcttccttcggatgccgtggagaagtttctagagggagaggaagttaaatgtcgttacggacaagaacaacaatgatgaaaccaaaacacgcgattaacacaagtataaccctacatactcacccttaatgaaggacactttcaatataggggtaaagttcataattttttcaacaagattgatatgccttgtaatgcctaacatttccttagtagggggaaaatttccaaatctaaaaagtttatgtgcattaattttattttaatcttatttatacacataaacaagtgtttttgaccttaaattagtactatactgtatttgtattttgacctttgtaataaggtgaaattgactgct

SEQ ID NO: 2387 - DNA, 1607 bp, Prunus persica
tcactagtcacttgacagtaaagtcacaggcccaagctactgttttgtcctgagttccccaaattaaacccaataccgcatcagagattcagagagagaagagggaggaggctgggatggcaacgacgtcgtctcatccgaaagaggaagtgaagaagaagaagaagaaggagggattgggatggatagagtgggcaaggggttggttgtatctggtgtacgagatgctgttccagagaatcacggccagccacttgcaaaaccccatgcctttgcctcctgtcaacgatctcacttgcattgtcactggatccaccagcggtatcggccgcgaaattgccaggcagttggcggaagctggggcgcatgttgtgatggcagtgaggaacacgaaggcagctaatgagttgatccagaagtggcagaatgaatggactggaatgggccttcctcccaatattgaggtaatggaacttgatttgctctccttggattctgttgtgagatttgctgaagcgtggaatgcacgcttaggacctctccatgttcttatcaacaatgctgggatattttcaattggagagccacaaaaactttcaaaagatgggtacgaagaacacttgcaagtcaatcatcttgctccagcactgctctcagttttgctattgccatcccttatcagaggctctccaagtcgaattattaatttgaattccgttatgcattatgttggctttgttgacacagaagacatgaacgtcgtttctgggaaaagaaaatatacaagcttagtgggttactcaagcagcaagctggcacagattatgtttagtagtgttctacataagcggctccctgccgaatctggcattactgtagcatgtgtttcacctggaattgtgcagactaatgttgcaagggatcttcccaaaattgttcaagctgcttatcatctaataccctattttatctttagtgctcaagaaggttccaggagtgctctctttgcagccactgatcctcaggttcctgagtactgtgaattgttgaaagcggatgactggccggtttgtgcattcatttctcaagattgccgtccaacgaatccttctgaagaagctcataatgttgaaacttctcacgaagtgtgggagaagacatttgagatgattggccttccttcggatgcagtggagaggcttatagaaggggaagaagttgcgtgcagatatggtggtcataaggggtaggcttatttgatgatacgaaaagtgagtccgagaagcgagcttatctctaggttgttttggttgttgaatggcagagcaattgcgattgaattttgaaaaggagggaagactgactggagtaccactaacatctgataggcatttgaagagatggttctgctttgtacaccatttttattgttagatatgttttcatgggtgtggagtgtggacacataaagaaactattatgaagatttggtgttcctatttgcttcacgcgcgcccttgtcagttgtgactggtggaactatttctgtaaactaatgtttcaatttagagaattctataaagacaataatactacgagtcttaagt

SEQ ID NO: 2388 - DNA, 1242 bp, Malus domestica
ctgccattgccactatatgctgtatagctccggaggctccagctactgttttgtctttcgtcacaggagagaaagagagagagagagaggaggctgagatggcggctgcggtggcgtcgtcaaatccgaaagaggaagtgaagacgaagaataagaaggaaggattggggtggatagagtggatgagggggtggttgtatgtggtctacgagatgctgttccagagaatcaccgccagccacttgcaaaaccccatgcctttgcctcccgtcaacgatctcacttgcattgtcactggatccaccagcggcatcggccgcgaaatcgccaggcagttagcggaatcaggggcgcatgttataatggcggtgaggaatacgaaagcggctaatgagctgatccagaagtggcagaatgaatggtctggaatgggacttcctctgaatattgaggtaatggaacttgatctgctttcattggattctgtcgtgagatttgccgaagcatggaatgcacgtttaggccctcttcatgttcttatcaacaatgctgggatattttcaattggagagccgcaaaagttttcaaaagatggttacgaagaacacttgcaagtgaatcatctggctccagcactgctatccgtcttgctattgccttccctcattagaggctctcctagtcgaattgttaacgtgaattctgttatgcattatgttggctttgttgacacagaagacatgaacgttgtttccgggaaaagaaaatttacaagcttagtgggttacacaagcagcaagctggcacagattatgtttagtagtgtcctacataagcgtctgcctgctgaatctggcattagtgtagtatgcgtttcacctggaattgtccagactaatgttgcaagggatctacccaagattgttcaggctgcttatcatctagtaccttattttatgtttagtgctcaagaaggttctaggagtgctctgtttgcagccactgatccccaggttcccgagtactgtgaattgttgaaaacggatgattttcctgtttgtgcctttatttctcaagattgccgtccaacgaatccttcagaagaatcgcataatgttgaaacttctcacgaggtgtgggagaagacatttgagatgattggccttccttctgatgcggtggacaggcttatagaaggggaagaagttgcaagcagatacggggctcatggggagtagcctt

SEQ ID NO: 2389 - DNA, 1665 bp, Arachis hypogaea
tgggcggaactcagtgtctctctctctttctctgagcactgtctgtctgactaactgttacagttccattgattctccctccactccattctacagtctacaccataccaatcatttccgtacacacccctctctctctctctctctctgaaagatctctgagaaacatgggaacggaggatgaagcagcgccgccgtcgtcgtcatcgtcggtgaagaagaagaaacagggtttggggtggatagaatggatcagaggctggatggtggtggttcaggagatgctatttcagcggatcatggcttcccacttgcacaaccctatgccacttcctcccatcaacgacctcacctgcattgtcaccggatccaccagcggcattggctgtgaaatcgcaaggcaattggcacaagcaggggctcatgttgttatggctgttaggaacacaaaggcagctcaagagttgatacagaagtggcagattgactctgaagggttttgtattgctctcaatgttgaggtgatgcaagttgatcttctctcattggattctgttgcaaggtttgctgaagcttggaatgctcgctcagttcccgtgaatgctctcattaacaatgctggaatcttttccattggagagccacaaaagttttcgaaagatggttacgaagaacacttgcaagtgaatcatcttgctcctgctttgctctcagtacttcttttgccatcacttatgcggggttctcctagtaggattgtgaatgtgaattctgttatgcattacgttggctttgttgaccctgaagacatgaatgttacgtctggtaaaaggaaatattctagttttattgggtacacaagcagcaagcttgcagaggtaatgtttagtagtgttcttcataaacgaatccctgctgaagctggcattggtgtagtgtgtgtatcacctggaattgtccagaccaatgttgcaagggatcttccaaaaattgttcaagctgcttatcgtttgataccttactttatctttaatgctcaagaaggttcccggagtgcactttttgctgccacagatccttcagtttcagagtattgtgaaatgctgagatcagatgagtggcccgtttgtgcttttatttctcaagattgccgtccggcaaatccatcagaagagtcgcatgaagttcaaacgcaatacgaagtatgggagaagaccttggagatgattggccttccttcagatgccgtcgagaggcttatagagggacaggaagtcaaatgccgttatggacaacagcagtagtgacctaaagtgtattccacgcgccgcagccaaatgtcatgtgagggcagcagtttattatttatagcaagtgatgagcattacttataaacaggtgtttatatgttttagcttattacctaacatattgatggtcatgttcaggagtaagaacaaattaaattagcactatagaggcttagtgatttcataaatcattgcatttaagttcttgttgaatttagttgaatacaaaagtaattttctctacttggcaccttctacttctaggaggattttagatcgacttgaatttgttgctgatcaaattgtgtaccaaataataataataccaactgatatctaaggtaattttagtaac

SEQ ID NO: 2390 - DNA, 1413 bp, Euonymus alatus
gagacaaaacagagtgagcaattctgaacagagagaatatttgtagcgtaaactctacagatcttggattcactattgggagaaaaagagatggagaagacgacatcgtcatcttcggagaaggagaatatgaaagtgaagaagaaggaggcgttggggtggatggagtggctgagagggtggatgaacatagcacaggagatgttgttacagaggatcatggccagccacttggagaacccgcttcctctccctcctatcaacgacctcacctgcattgttactggatctaccagcggcatcggtcttgaaatcggcaggcagttggcgcaggccggagcgcatgtcgttatggcagttaggaacagaaaggcagctcaggagttgatacagaagtggcaaaatgaatggtctggaatgggcctccctctcaatattgaggtaatggagcttgatcttctctccctagaatcagttgtgagatttgctgaagcatggaatgcacgtttgggacctttgcatgttcttattaataatgcagggatattttccattggagaacctcaaaaattttcaaaagatgggtatgaagcacacatgcaagtaaatcatctggctccagcattgctctcaatattgcttttgccatccctaatcagaggatctccaagccgaattgttaatgtgaattctgtaatgcattatgttggctttgttgacccagaggacatgaatgtggtttctgaaaagagaaaatacacgagcttagtgggatacacaagcagcaagttagctcaggttatgtacagtagcgttctgcataagcgtctgcctgctgaatctggcatttgtgtgctatgcgtatcacctggaattgtgcaaacaaatgtggcgagggatcttcctaaaattgtacaagctgcttatcatcttattccctattttaccttcagcccccaagaaggttccaggagtgctctgtttgcatcaactgatcctcagattccagagtactgtgagttgttgaaatcagatgaatggcctgtttgtgcattcatttctcaagattgtcgacccacaaatccttcagaagaagctcacaatatcaagactagttatgaagtgtgggagaagacattagagatggttggcctccctctagatgctgtagagcggctattggaaggagaagaagtcaaatgccggtatggggctagtcaggagtagtttttgcttatcctcgttcatcacacaaggaaatcacaggaactccccagttgatgcggaatgcccgcatatctataacgttgattgcgaagaagttgatgtaataaccctcggttagatcgagtttgcgttggactacatgttctgtttgttacccattgatgctgacttttgttgtctgcttct

SEQ ID NO: 2391 - DNA, 1639 bp, Fragaria vesca
ctgaccggctgttgggctgctcttcaactcacaaagtcacaaacagttgcaacgtaatctctctcctcaattcccagtacccaatttgccatttggtttaaggtggcaaaaatggcaacgacattatctgatttgaaagaggaagtgaagaagaagaaggagggattgggatggatagagtggttgagaggttggttctatgtggtgtatgagatgttgttccaaagaatcactgccagccatttgcaaaacccaatgcctttgcctcctgtcaatgatctcacatgcattgtcactggatccactagcggtattggccgtgaaattgccaggcagttggcggaggccggtgcacatgttgtaatggcagtgagaaacaccaaagcagctgaggagctgatccagaagtggcagaatgaatggtcaggaatgggccttcctctcaatatcgaggtgatggaacttgatctactctccttggattctgttgtgagattttgtgaagcttggaatgcacgattgggatctctgcatgttcttatcaacaatgctgggatattttcaattggagagccacaaaaattttcaaaagatgggtatgaagagcacttacaagttaatcatctggctccagcactgctatcagtattgctactgccatcccttattagaggctctccaagtcgaattgttaatgtcaattccgttatgcattatgttgggttcgttgacacagacgacatgaacgttgtttctgggaaaagaaagtatacaagcttagtgggttattcaagcagcaagctcgcacagatcatgtttagtagtgtcttacataagcggctgcctgctgaagctggtatttctgtagcatgtgtttctcctggtgttgtccagacaaacgttgcgagggatcttcccagtattgttcaagctggttatcgtttgataccctattttatctttagtcctcaagaaggttcgaggagtgctctctttgcagccactgatcctcaggttccagagtactgtcaattgttgaaatcagatgactttcctgtttgcgctttcatttctcaagattgcaatccaaccaatccttctgaagaagctcatgatgttgagacttcacacaaagtatgggaaaagacatttgagatgattggccttccatctgatgctgtggagaggctcatagaaggggaggaagttgcatgcagatatgggggctcataatgagtaaccttttttcccatgatagcagaggtcttgtgtccaatgtatggatgattgtttttaaagtcaaacgcagaaattgccattcagttttgcaatggaaggaatgggagtaccataagcattctgattctggtaggcacatgaagagctggttattctttgtacaccatgatcttattaatttgtgtttatacgggatctgatctagttactgatttactcacccgtgtttacagcgaccggcctgttaatttagagaagcttgaaacacaaggattatttatcccaagggtagtgtcgattgagtttaagaatatgcttgccccgttatgtggagaacgttttcggcacgtattcttttagatttgtcggaataaatccgtctctctactctattctgtac

SEQ ID NO: 2392 - DNA, 362 bp, Amsonia hubrichtii
accaaacagaagatctctcaaaacctacaaccatgggtaaggttcacggatcattggctcgtgccggtaaggtgagagggcaaactcccaaggtagcaaaacaggataaaaagaagaagccacgcggccgcgcccacaagcgcatgcaatacaaccgccgtttcgtcactgccgttgttggctttggaaagaagagggggccaaactcatcggagaagtaaatgtgagcaatgttagtttgtagtaggctgggaattcttgaaactaaagttaattcttatttgaatcatgttatagattgaacatcttacttttgtccatcttttaagaagttttgtgtgttcactcctgttggaatgaaa

SEQ ID NO: 2393 - DNA, 389 bp, Amsonia hubrichtii
cagtaggtggcagcagaaatctctgtaaattcacaacaatgggtaaggttcacggatcattggctcgtgccggtaaggtgagagggcaaacgccgaaggtggcgaaacaggacaagaagaagaagccccgtggccgtgctcacaagcggatgcaatataaccgccgctttgtcaccgccgttgttggcttcggaaagaagaggggtccaaactcatcagagaagtaaagcaacatatcggagttcctttaataggtgaagactggtttccaatgacgtgaattgttattccaatcacattctactgattttaggcttggagtgcacttatattgaagattttacttccgctcatctatgttacctcgttaattataaattagaaaattt

SEQ ID NO: 2394 - DNA, 1047 bp, Cannabis sativa
gcagcggaggaaagcttagaagttcaccatgggtaaggttcacggatctttggctcgtgctggtaaggtgagagggcaaacccctaaagttgccaagcaggacaagaagaagaagcccagaggtcgtgctcacaagcgcatgcaatacaaccgccgttttgtcaccgctgtggttggatttggaaagaagaggggacccaactcctctgagaagtaaggtagctgtttctcaaggatgacacctctttaggttattatggagacatcgtttttgggtttttgaccatttgttattgagtttacatgttatttttaaagaccctttttacatgttacaggattgtgctaaagctatgctttaattaaattaaattagaagtaatgtgaattcggttttgcttgtttgtttgaattgccaaatctatcttcagtcttttttgatgtaacaaatgaaggagataaaaccaagaatattgtcttttatggagcttcttaaggtagagctcttggaagagtagattgggaaaaccaactctggtaaaaacagaaaaaaatagcattacaatttgaggtggggataacattgctggagtctttatgtgactagtcagcttaagccatggcctatatttgcacttcaagccttgaatcggtcacatagctgagcagcattcacttaaagaacccaagtcaaaagatggaacataagcatgggatgagttaattttacgcttgagactagatgtgtattagaatctggacatgtcaaattcagattttaaagctagcattaatgattttagaactcaagcatggggtgccttaacattggcttataacaaattgttaacaccatttacctccttttacaagttatcaagcttatgtttggccttacaaatttcttggactccactgtctgtagagttgagagtgggtgtccaatatgataagagagtgcactgctacaaccttttttttaagggtaaatacaattttggacttctgttttacaaaagttaccgattggattctgtgttttaataa

SEQ ID NO: 2395 - DNA, 538 bp, Catharanthus roseus
gatccaaagaattcggcacgaggctcaccagcagtcggaggcgcggcaaccagcggaagatctctctaagctacaatcaccatgggtaaggttcacggatcattggctcgtgctggtaaggtgagaggacaaactcccaaggtagcgaagcaagacaagaagaagaagcctcgcggacgtgctcacaagcgtatgcaatacaaccgccgtttcgtcactgccgttgttggctttgggaagaagagagggccaaactcatcagagaagtaaattatgacagtaatattagttttttttttatttttatatttgtagtaggattcggaaaagcacgagactgaagtgaattcttatttgcataatcattttatagattgaacatcttttgctttccttcaatttttaaaggagtttttgcttgttctcttatcatggaatgatatttttattctctgttattttgaaaagtcccttctccccagtgtttgtagttggttttgataattaccattaagatagccgagttcattggttccat

SEQ ID NO: 2396 - DNA, 673 bp, Catharanthus roseus
aagaattcggcacgaggctttccgcagaagcgatcgaagcagcagaaattccgaagatacacaacaatgggtaaggttcatggatcattggctcgtgccggaaaggtgagagggcaaacgccgaaagtggcgaagcaggacaagaagaagaagccccgtggccgtgctcacaagcggatgcagtataaccgacgcttcgtcaccgccgttgttggctttggaaagaagaggggtccaaactcatcagagaagtaaagaacatattgtagttcatcgcaaattgtatggcgatctttttgtactgatcagaggacttgtagtgcacctcagttggacattttactttcagatcatctatgttgaaacaatattacctcgttgactacaaatcacaaattttggcagcctaaattgttgttagaatgatttccattacaggtttacttatattttccggtacattgcaaattgcaatttgttagttggatattatttcccttgtgataagccaggctttcagaaagtacattactatgtttgggcttaactagatactccattcatgaggagcctgttacatgtttttgttgccgtcgtgccattttattcaccctaattgactgacgtgtttgggaagcaaaatcatgtagtgcaactctagcctgttttacct

SEQ ID NO: 2397 - DNA, 724 bp, Citrus clementina
accctaaccctagattcgtgttgtctgcctcaatttgggcgagaaagagtctcacagcagcagcagcagcagcagcggccaacaagactactcaaacgatcagctatgggtaaggttcacggatctttggctcgtgccggtaaggtgagaggccaaactcctaaagttgctaaacaggataagaagaagaagccacggggccgcgcccacaagcgcatgcaatacaaccgccgcttcgtcaccgcagtggttggttttggaaagaaaagaggacccaactcatctgagaagtaaaaaaatgcttgagaggatgaatgaagaagggttagataggtgaaaaagcacttggtgtttttgataatttctcttatgttgtgtttaaagaccttattatggtattctgttactaatgttatgttttgagattttgtctctcttaaacttgtgatcatcattttgttagtagagattatgtgattttcttttcaaatgtctttaatttgctgtttgttgtgtggttgcctttctttcttagttatgtatgatagttgttcaattggtcctttgtctctgaagaggaaggattctccggtttcatatggtatggtttaacagtctgccaaccgcctgatcttttcacgtgaaaaatggagaacaagaactgaaattctatttgaacaactttattgtttgggaaattttctaatattttcatttccaatta

SEQ ID NO: 2398 - DNA, 515 bp, Cucurbita pepo
aatttttgtcaagttgcgttgttagtttctagcggtcgaagcgagcacgcctgtcgccgaacatccggaagaggagaagacgctttcagattagccatgggtaaggttcacggatctttggctcgtgccggtaaggtgagaggccagactccgaaggttgccaaacaggacaagaagaagaagccacgaggacgtgctcacaaacggatgcaatacaatcgtcgattcgtcactgccgtcgttggcttcggcaagaagagaggacctaactcgtcagagaagtaagagtctcgataattcggcataacagccattctttcatgttatttaatatttctgttagttcttccttgatgtgttcactctggcattgatctggacaatgatagcattcgttcttttagaaggttttgtttagtcactacatgtatctttacgtctaagttttgacgtttcgcaatgagatgagtttgtttagtttttgtttaatggaccagcaagagatgatactgtcg

SEQ ID NO: 2399 - DNA, 505 bp, Cucurbita pepo
aaggacacgtgtagtccgaacgacacgaggaaccgcggggggaacgggaccgtcttacccacgcccgttctcagtcggacttcaagcaccaggacgctaccgaagaaaatcagccatgggtaaggttcacggatctttagctcgtgctgggaaggtgagaggtcaaactccgaaagtagcgaagcaggacaagaagaaaaagccccggggacgcgcacacaagcgtatgcaatacaaccgcagattcgtcactgccgttgttggctttggaaagaagagaggacccaactcttccgagaagtaaacaaacagcgatttcattgggtgctttgccgctggagatgcatggttttatgcgttattaagcattttctttctttttctaatagatgttttagttgtttaagcttttttgaccatgtaaaagatatttattttggcaatatattagaagcaatgcgatttggatctagtaaaaaaaaacagaacggcagtatattacacg

SEQ ID NO: 2400 - DNA, 407 bp, Cucurbita pepo
ttgcaatctcttctgcggcttgtcatcgggcgttaagcaccaggaaggtaccgaagcaagcaatctgccatgggtaaggttcacggatctctggctcgtgctgggaaggtgagaggtcaaactccgaaagtagcgaagcaggacaagaagaagaaaccccgtgggcgtgcacacaagcggatgcaatacaatcgcagattcgtcactgctgtggttggctttggaaagaagagaggacccaactcctctgagaagtaagcaaacggcgaaatcatgaggagattttccgctcgagaggcatggttttgtgatttattaagctttttcctcctatttctcatagatgttttagtttattgaagattttgaccgtgttaaagatacttatttcgacaatatattaaaga

SEQ ID NO: 2401 - DNA, 563 bp, Eucalyptus grandis
ataaaatccaaaaccctaatttcgtctcccttctccagcacacgaacagcggacccgacgacgccggcagaaagctctctctctctctctctctctctctctctctctctctgaaacttctccatgggtaaggtccacggatccctggctcgcgccggtaaggtgaggggccagaccccgaaggtggcgaagcaggacaagaagaagaagccccgcggtcgcgcccacaagcggatgcagtacaaccgccgcttcgtcaccgccgttgttggctttgggaagaagaggggccccaactcgtccgagaagtgaggcggcttcattggagcccgaaaggaagagaagaggagctgtgtaggtctctgcaaaaaagatgggctttttttctttttttgggtttttcgtttcttcattggattgtgttatgcttttgaatttggggacttgaaagatactggatcatgttgaggttttgcctacccacttaagctaatagataatggtagtttttgtttcccagctgcttatcaagttgttgatcatggatggctgagctttctctt

SEQ ID NO: 2402 - DNA, 527 bp, Eucalyptus grandis
cttcagcacacgaaccgcggacctgacgacgccggcagaaagcgaagcgctctctctctctctctctctctctgtgaaacttctccatgggtaaggtgcacggatccctggctcgcgccggtaaggtgaggggccagaccccgaaggtggcgaaacaggacaagaagaagaagccccgcggccgcgcccacaagcggatgcagtacaaccgccgcttcgtcaccgccgttgttggctttgggaagaagaggggccccaactcgtccgagaagtgaggcggcttcattggagcccgaaaggaagagaagaggagctgtgtaggtctctgcaaaaaagatgggctttttttctttttttgggtttttcgtttcttcattggattgtgttatgcttttgaattttggggacttgaaagatactggatcatgttgaggttttgcctacccacttaagctaatagataatggtagtttttgtttcccagctggttatcaagttgttgatcatggatggctgagctttctctt

SEQ ID NO: 2403 - DNA, 554 bp, Euonymus alatus
acttgaagcagcgagtgaagctacaacagcagctctaatcgccggcgcaagagttctccaacagaagctatgggtaaggttcatggatctctggctcgtgccggtaaggtgagaggccaaacaccgaaggtggccaagcaagacaagaagaagaagccacgcggccgcgctcacaaacgtatgcaatacaaccgccgctttgtcacagccgttgtgggatttggcaagaagaggggacccaactcttcagagaagtaaagcttgagagaatgatgacttctgctggtgaagatgcttatcttgtcttttgtcaaagtttctcatcacgcaactcttgtagtggtttaagttagtttggttgagtttgaactatgagtctatgatgaaatatgaatacattgtcatttaattagctggaaattacatgatttgatttggaattatttaagatattgaatgcggagcttattatgagttcttctttctgtaggttgatatgttacttgttggaacaattgtgagtttctatagtttttctatctaaataagaagta

SEQ ID NO: 2404 - DNA, 488 bp, Euonymus alatus
gcacactatagattcgttcccaaatccctaatctgagtttcgtacttcgtgccctaagctacagctgcagctctaatcgccggcgctagagttctccaagagtagcgatgggtaaggttcacggatctcttgctcgtgcaggaaaagtgagaggccaaactccgaaggtggccaagcaggacaagaagaagaagccacggggccgcgctcacaagcgtatgcaatacaaccgccgctttgtcaccgccgtggtgggatttggcaagaagaggggacccaactcttcggagaagtaaagcttgagagaatgaggacttctgctggtgaagatgcttatcttgtgtgttgtcaaaatttcttattactcaagtcttgtagggttttagttactttcattttgtttcaactatgatgaagacattttcttttaatcagctggaaattacttgattggatttggaattaagatattgaatgcagagtttatt

SEQ ID NO: 2405 - DNA, 528 bp, Euonymus alatus
cggccgggggagtagtcagtagacctccgcgagtcgtcttgcagcagcgagagaagctacaacaacagctcggatcgccggtgcaagagttctcaacagcatcaatgggtaaggttcatggatctttggctcgtgctggtaaggtgagaggccaaactccgaaggtggccaagcaggacaagaagaagaagccacgcggccgtgctcacaagcggatgcaatacaatcgccgcttcgtcaccgcagttgtgggatttggcaagaagaggggacccaactcttcggagaagtaaagcttgagagaatgaggatttctgcgggtcaagacgtttatcttgtgtcttgtcaaaaatttctcattactttaaaagtcttgtggcggttttagttatgtcagttgagtttgaagtttgaactatgatgaagacatggtcattttatcagctggaaattacatatgatttgatttagaattcagatgttgaatacaagagtttgttatgagtttttgtttccttatgttgatat

SEQ ID NO: 2406 - DNA, 478 bp, Euonymus alatus
cggccggggtacgtaattcgtgacctaagctactgctgcagctctaatcgccggcgctagagttctccaagagtagcgatgggtaaggttcacggatctcttgctcgtgcaggtaaagtgagaggccaaactccgaaggtggccaagcaggacaagaagaagaagccacggggccgcgctcacaagcgtatgcaatacaaccgccgctttgtcaccgccgtggtgggatttggcaagaagaggggacccaactcttcggagaagtaaagcttgagagactgaggacttctgctggtgaagatgcttatcttgtgtgttgtcaaaatttcttattactcaagtcttgtagggtttttgacttttagttacttttattttgtttcaactatgatgaagacattttcttttaatcagctggaaattaattgattggatttggaattaagatattgaatgcagagtttattatgagtttatg

SEQ ID NO: 2407 - DNA, 568 bp, Euonymus alatus
gagcgagtcgacttgaagcagcgagtgaagctacaacagcagctctaatcgccggcgcaagagttctccgacagaagctatgggtaaggttcatggatctctggctcgtgctggtaaggtgagaggccaaacaccgaaggtggccaagcaggacaagaagaagaagccacgcggccgcgctcacaagcggatgcaatacaaccgccgctttgtcacagccgttgtgggatttggcaagaagaggggacccaactcttcagagaagtaaagcttgagagaatgatgacttctgctggtgaagatgcttatcttgtcttttgtcaaaatttctcattacgcaagtcttgtagtcgtttaagttagtttggttgagtttgaactatgagtctatgatgaaatatgaatacattgtcatttaattagctggaaattacatgatttgatttggaattatttaagatattgaatgcagagcttattatgagttcttctttctgtatgttgatatgttacttgttggaacaattgtgagtttctttagtttttctatctaaataagaagtatgtg

SEQ ID NO: 2408 - DNA, 502 bp, Euphorbia peplus
gcaaagctaactgcttccctgccggcgagtactacaaagcaataaccagcaaatcgatcgatgggaaaggttcatggatccctggctcgtgccgggaaggtgagagggcaaactccgaaggtggctaagcaagataagaagaagaagcccagaggccgtgctcataagcgtatgcaatacaatcgccgattcgtcaccgccgttgttggctttgggaagaagcgaggacccaactcttcagagaagtaaaaaatcaaatcctgcagatctcatgacaatatgtaatctttttttaggttctgttatgcaacttctatttgagcttgaaagattttgttatatgagaatgtcactttgaagaaagtggaatcttgatccacttattttgactgcactattagtattattactactttgtaagcaatttgagatgttagttatggaatgatgggttgtttaagttattcaattgcgccaccgatttgagtgtgaatgttttatc

SEQ ID NO: 2409 - DNA, 391 bp, Euphorbia peplus
gcagccatgggtaaggttcacggatctttagctcgtgccggtaaggttagaggtcaaactcccaaagtggctaagcaagataagaagaagaagccccgcggccgcgctcacaagaggatgcaatacaaccgccgtttcgtcaccgccgttgtgggatttggcaagaagagaggacccaactcctctgagaagtgataaaaaaaaacccccactgtgaggtagactgtcagaaaatgacaagttgttagtaggtgtttagctgaaggattattgtgtttggtgtttggattatgttttaagaattctcatactatgtccagtttttgcaaactattcggatgatttatcagtttttttaattagaatatttttgctaattctgttttacgta

SEQ ID NO: 2410 - DNA, 441 bp, Fagopyrum esculentum
acaccagcgcttgattgccaataaccacaaacgagaaaatcaagttccggtctatattcgacgatcaatcatgggtaaggttcacggatctttggctcgtgctggtaaggttagaggccaaacaccaaaggtggccaagcaggacaagaagaagaagccccgtggtcgcgctcacaagcgtatgcaatacaatcgccgtttcgtcaccgccgttgttggattcggcaagaagagaggccctaactcatcagagaagtaagccctgtgctgatcgacgaagatgagtttcatagctttaggataaatgcttttggtttgtgtttgtatcgttacgcatctgatactaaaactctttgttattcactcgattttggtaatctcgaatttgctgttctgagtacttgatgtgaaattgcatctttattcaatgatatgttttct

SEQ ID NO: 2411 - DNA, 454 bp, Fagopyrum esculentum
tcctaaccccgacgctgatcaaccgaggaaggcagttttcgatcgtcagatcttcaacgattagccatgggtaaggttcacggatctcttgctcgtgccggcaaggtgagaggccaaacaccaaaggtggccaagcaggataagaagaagaagccgcgtggacgcgcacacaagcgtatgcaatacaatcgccgcttcgttactgccgttgttggatttgggaagaagaggggccctaactcatcagagaagtaagatctgagcttcataggtgtagagtaattgcttccgattagtttttgttcgtttagcgcttgcttactttgaaggatcttccatctcgttatatgccattgttgataagaattcgatttcgattattgctcagttagttcttcattgttggctgaaatagttatctgtcccaatattgtgcttgctcatcattttcaat

SEQ ID NO: 2412 - DNA, 447 bp, Fagopyrum esculentum
gagtacgcgggggggcccccaatctccgagcatccgaagcctctcaacaaaggaaagcagatacaggtcgtcaaatctttgagaagtagccatgggaaaggttcacggatctttagctcgtgccggtaaggtgagaggccaaacaccaaaggtggctaagcaggataagaagaagaagccacgtggacgcgctcacaagcgtatgcaatacaaccgccgtttcgtcaccgccgttgttggattcgggaagaagagaggacctaactcatctgagaagtaagacatgaacttatagtcggcgatgaatttcttagggttagagtaatttgccttttgatctttctcgttgtacgcatttggcatctgagactgttttttttaacaaagttctgtactatggagtttttgttcctttgttaatcggatatactttatttctatctaatg

SEQ ID NO: 2413 - DNA, 459 bp, Fagopyrum esculentum
cgattctgcttcgacccacaccttcaataacgcactatagccttagtcgatttggaggccaagatttccgagaatgggtaaggtgcacggatctttggctcgtgctgggaaggtgagagggcaaaccccaaaggtcgccaagcaagacaagaagaagaagccccgtggtcgcgcccacaagcgtatgcagtacaaccgccgtttcgtcaccgccgttgttggctttgggaagaagagaggccctaactcatcggagaagtaatcctgaggaactatattagattgagtattgtcggctatttggttctatgtagacagtggcagatatgatgtgtgcatttttctgtgatttatttgttctgccaaagctgaaggcttcgtttctaaatgcgtttccttgtgagatgctttaggctaagttttgagattgatttgaatatgtcagttttatctatagga

SEQ ID NO: 2414 - DNA, 478 bp, Fagopyrum esculentum
gaacatccgaagcctttgaatcaaggaaagcaaatacaggtcgtcaaaactttgacgagcagccatgggaaaggttcacggatctttggctcgtgccggtaaggtgagaggccaaacaccaaaggtggctaagcaggataagaagaagaagccacgtggacgcgctcacaagcgtatgcaatacaaccgccgtttcgtcaccgccgttgttggattcgggaagaagagaggacctaactcatctgagaagtaagacatgagcttatggtcgacgatgaatttcttagggttagagtaattgccttttgatctttctcgttgtacgcatttggcatttgagactgtttttgcttgcaaagttttgtactatggagtttttgttgctttgttaatcggatatactttatttctatataatgttcattcaaaattacgtttatcttttaagttttctattgtggcattgtttatgctttag

SEQ ID NO: 2415 - DNA, 569 bp, Fagopyrum esculentum
aaagcgcttctgcttcgacccactccttactctaaccttagtcgatttggaggccaagatttccgagaatgggtaaggtgcacggatctttggctcgtgctgggaaggtgagagggcaaaccccaaaggtcgccaagcaagacaagaagaagaagccccgtggtcgcgcccacaagcgtatgcagtacaaccgccgtttcgtcaccgccgttgttggcttcgggaagaagagaggtcctaactcgtcggagaagtaatcctgaaccatattagatcgagtatcattggctatttagttctgtgtagacagtggcagatataatgtgtgcatttttctgtggattgattttgttcagccaaagttgaaggcttcgttcctattgcttttccttgtgagatgctttaggctaagttttgagattttgaacatgtcagttttatctataggaagttgatctttcatcattttatgtcaaccatttctcccttaatagtggccattcattaatcaaaatgtgtttaacctaatgttagctgattgttttaacaatctttttgcatatttataa

SEQ ID NO: 2416 - DNA, 431 bp, Fagopyrum esculentum
ggggggcgtccaccctaaccccgacgccgatcaaccgaggaacacagttttcgatcgtcagatcttcaacgattagccatgggtaaggttcacggatctctagctcgtgctggtaaggtgagaggccaaacaccaaaggtggccaagcaggataagaagaagaagccacgtggacgtgcccacaagcgtatgcaatacaatcgccgattcgtcaccgccgttgttggatttgggaagaagaggggccccaactcatcagagaagtaagatctgagcttcataggtttagagtaattgcttcccgattagtttttgttcgtttgggatatcagaatagttaattgtttactttgatggatcttccatctgatggtgcttttcgttatatgccattgttgataaggattcgatttcgattattgttcagttag

SEQ ID NO: 2417 - DNA, 449 bp, Fagopyrum esculentum
tacaccagcgcttgattactaataaccacaaacgagaaaaccaacaattttcggcctatcttcgacgatcaatcatgggtaaggttcacggatctttggctcgtgctggtaaggttagaggccagacaccaaaggtggccaagcaggacaagaagaagaagccccgcggtcgcgctcacaagcgtatgcaatacaatcgccgtttcgtcaccgccgttgttggattcggcaagaagagaggccctaactcatcagagaagtaagccctgtgctgatcgacgaagatgagtttcatagctttaggataaatgcttttgtttttgtttgtatcgttacgcatttgataattgaactctttgttatccactcgattttggtaatctggaatttgctgcgttgagtacttgttgtgaaattgcatctttattcaatgatatattttcttttat

SEQ ID NO: 2418 - DNA, 366 bp, Fraxinus spp
actcacagaaatcaacaatgggtaaggttcatggatcactggcacgtgccggtaaagtgagaggacaaacgccaaaggtggccaagcaggacaagaagaagaagccccgtggccgtgctcacaagaggatgcaatacaaccgccgcttcgtcaccgccgttgttggctttggaaagaagaggggaccaaactcatcagagaagtaaactgaagatgctagtatctttttatcgggctaaaatgcatttgccatctgagttacttgtttttcaaaaaatgtgttaagagcattgttaattagtggactaagtttctatttctgttttatatttttgctttgattatgttgatcatctaatggcttta

SEQ ID NO: 2419 - DNA, 431 bp, Fraxinus spp
ccatgggtaaggttcacggatcgctggcacgtgccggtaaagtgagagggcaaacaccgaaggtagccaagcaggacaagaagaagaagccccgcggtcgtgctcacaagcggatgcaatacaaccgccgcttcgtcactgccgttgttggctttggaaagaagaggggaccaaactcatcagagaagtaaactggaggtgccaatatgtttttttggtcatatgaccaaactcctcaaagtgaattggagattccaatagcttttgtcggtcaagatgcgttttccatgttagttaattgtttttcatatgttatagcattgttaattagtggactaagcttctttttccattctacatttttgctgtgactatgttgaacatgtaatggcatttcatggttgaagaaagatttgttacctaacttttta

SEQ ID NO: 2420 - DNA, 497 bp, Fraxinus spp
ccatgggtaaggttcacggatcactggcacgtgccggtaaagtgagagggcaaacaccgaaggtggccaagcaggacaagaagaagaagccccgcggtcgtgctcacaagcggatgcaatacaaccgccgcttcgtcactgccgttgttggctttggaaagaagaggggaccaaactcatcagagaagtaaactggagatgccaatatgttttttggcatatgactaaactcctcaaagtgaattggagataccaacagcttttgtcggtcaagatgtgttttccatgttagctaattgttatagcattgttaattagtggactaagcttttttttctattttacatttttgctgtgactatgttgaacatgtaatggcatttcatggttgaagaaagttttgttgccgaactttttacttttatggatttggtgtcttgaacttcctagttccctttgacatgttctaatgcatagccgaggctctttttttattc

SEQ ID NO: 2421 - DNA, 542 bp, Humulus lupulus
aacctaccctctctctcacagatcggtgtatccccaccccggcacgctttctctcgccggctttctcttgctcggaaaacacagagtgtgaagaaagcttaaaagttcaacatgggtaaggttcacggatctttggctcgtgctggtaaggtgagagggcaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacacctctttaggttattatggaggcatcgttttttggggttttgaccattagttattgagttttaatgttatttttatagaccctttcacttgttatagttatgcttcaattaaattataagtaatgtgaattcgtttttccttgaagaaaatgcagcaatgttattttgaacttattcaaagatgttttcaacttatttagaatctggattatactgatggatgatat

SEQ ID NO: 2422 - DNA, 691 bp, Humulus lupulus
aaatagtccccgtgagaagaaaaccctaaatcgaaagtggaaactcgcaggcaacaaaggttgcatctttctgagtctttggcgtcgttaggagcagtttttgaaatcatccatgggtaaggttcacggttcgttggcacgtgccggaaaggtcaggggtcagacccccaaggtggccaagcaagacaagaagaagaagcccagaggccgcgctcacaagcgtatgcagtacaaccggagattcgtcaccgccgttgttggatttggaaagaagcggggacccaactcctcagagaagtaaacttgacttttagggcatcaagtacgagtagcttagcttatatagtgatggtgaagctagtttcttatattgggactggtttttatttatatttgccctttattttaaaacactaggcttggtgattgaattcggataatgaatatcatatattaacatgggctaaagattttttttttaatgagccttcattatattatatatatgtgatatgtatgtgatggttaatctaaagatacattctttttaaccaattcatgtctttatcttagcttagtttattttggaaaataagtagcaatgctttatatgattagttttaggtctcagtcctagttgtgtatgtattgtcttggccacctattttatgattgggttgaactttggtga

SEQ ID NO: 2423 - DNA, 480 bp, Humulus lupulus
gcacgctttctctcgccggctttctcttgctcggaaaacacagagtgtgaagaaagcttaaaagttcaacatgggtaaggttcacggatctttggctcgtgctggtaaggtgagagggcaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacacctctttaggttattatggaggcatcgttttttggggttttgaccattagttattgagttttaatgttatttttatagaccctttcacttgttatagttatgcttcaattaaattataagtaatgtgaattcgtttttccttgaagaaaatgcagcaatgttattttgaacttattcaaagatgttttcaacttatttagaatctg

SEQ ID NO: 2424 - DNA, 483 bp, Humulus lupulus
gcacgctttctctcgccggctttctcttgctcggaaaacacagagtgtgaagaaagcttaaaagttcaacatgggtaaggttcacggatctttggctcgtgctggtaaggtgagagggcaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacacctctttaggttattatggaggcattcgtttttttggggttttgacctattagttattgagttttaatgtttatttttatagaccctttcactttgttatagttatgcttcaattaaattataagtaatgtgaattcgttttccttgaagaaaatgcagcaatgttattttgaacttattcaaagatgtttcaacttatttagaatctg

SEQ ID NO: 2425 - DNA, 444 bp, Humulus lupulus
gcacgtgcacgctttctctcgccggctttctcttgctcggaaaacacagagtgtgaagaaagcttaaaagttcaacatgggtaaggttcacggatctttggctcgtgctggtaaggtgagagggcaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacacctctttaggttattatggaggcatcgttttttggggttttgaccattagttattgagttttaatgttatttttatagaccctttcacttgttatagttatgcttcaattaaattataagtaatgtgatcgttttccttgagaaatagcagcaatgttattttg

SEQ ID NO: 2426 - DNA, 410 bp, Humulus lupulus
ttctctcgccggctttctcttgctcggaaaacacagagtgtgaagaaagcttaaaagttcaacatgggtaaggttcacggatctttggctcgtgctggtaaggtgagagggcaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacaccttctttaggttattatggaggcatcgttttttggggttttgaccattagttattgagttttaatgttatttttatagaccctttcacttgttatagttatgcttcaattaaattataagtagtgtgaattcgtttttcctt

SEQ ID NO: 2427 - DNA, 508 bp, Humulus lupulus
ttaaatagtccccgtgagaagaaaaccctaaatcgaaagtggaaactcgcaggcaacaaaggttgcatctttctgagtctttggcgtcgttaggagcagtttttgaaatcatccatgggtaaggttcacggttcgttggcacgtgccggaaaggtcaggggtcagacccccaaggtggccaagcaagacaagaagaagaagcccagaggccgcgctcacaagcgtatgcagtacaaccggagattcgtcaccgccgttgttggatttggaaagaagcggggacccaactcctcagagaagtaaacttgacttttggggcatcaagtacgagtagcttagcttatatagtgatggtgaagctagtttcttattttgggactggtttttatatttggcctttgtgattgaattcggataatggatatcatatattaacatgggctaaagtttttttttgtatgagccttcattatattatatatatgtgatatgtatgtgttggttgttc

SEQ ID NO: 2428 - DNA, 604 bp, Humulus lupulus
ctctcactcggcactcacctcccaaaacctccctctctctcacagatcggtgtaaccccaccccggcacgcgctctctcgccggctttctctcgctcggaaaacgcagagtgtgaagaaagcttaaaagttcaacatgggtaaggttcacggatccttggctcgtgctggtaaggtgagagggcaaacccctaaagttgccaagcaggacaagaagaagaagcctagaggacgtgctcacaagcgcatgcaatacaaccgccgattcgtcacggccgtcgttggctttggcaagaagaggggacccaactcttccgagaagtaagattcaaggatgacacctctttaggttattatggaggcatcgttttttggggttttgaccattgtttattgagttttaatgttatttttaaagaccctttcacttgttaaagttatgctttaattaaattagaagtaatgtgaattcgtttttccttgaagaaaaagcagcaatgttattttgaacttattcaagatgttttgcacttatttagaatctgacttaaactgatggatgatatttacattaagaaaaaatttggtcgtttgatgatcttcgg

SEQ ID NO: 2429 - DNA, 724 bp, Citrus sinensis
accctaaccctagattcgtgttgtctgcctcaatttgggcgagaaagagtctcacagcagcagcagcagcagcagcggccaacaagactactcaaacgatcagctatgggtaaggttcacggatctttggctcgtgccggtaaggtgagaggccaaactcctaaagttgctaaacaggataagaagaagaagccacggggccgcgcccacaagcgcatgcaatacaaccgccgcttcgtcaccgcagtggttggttttggaaagaaaagaggacccaactcatctgagaagtaaaaaaatgcttgagaggatgaatgaagaagggttagataggtgaaaaagcacttggtgtttttgataatttctcttatgttgtttttaaagaccttattatggtattctgttactaatgttatgttttgagattttgtctctcttaaacttgtgatcatcattttgttagtagagattatgtgattttcttttcaaatgtctttaatttgctgtttgttgtgtggttgcctttctttcttagttatgtatgatagttgttcaattggtcctttgtctctgaagaggaaggattctccggtttcatatggtatggtttaacagtctgccaaccgcctgatcttttcacgtgaaaaatggagaacaagaactgaaattctatttgaacaactttattgtttgggaaattttctaatattttcatttccaatta

SEQ ID NO: 2430 - DNA, 589 bp, Lippia dulcis
acgtcggggaacgaagaagcaccagttgttctcccggctgccttagaacctctcgcgaagcaagttccatcgtcgccgtgcgaatatcagtcaatcatgggtaaggttcacggttcattggctcgtgccggaaaggttagaggacaaacgcccaaggtggctaagcaggacaagaagaagaagccccgcggccgtgcccacaagcgaatgcagtacaatcgccgcttcgtcaccgccgttgttggctttgggaagaagaggggacccaactcatctgagaagtaaagtggaggaaacctaatctaagatgtttttcattatatcatagtgttcttagttactggattaagtttttgttgcagttgttgaattttgaatgtggaacatatttactgctcaatgtaaaaacttggtctgaaattttacccgaaccactttttggttcagttcatttagttattaactattgagtatgattttcttttgatttgaattgtttaattcctctttttcaactattgaatatggttttgatttggttggaatagctaataactaaatgaactgaaccaaaaagtggttcgagtgt

SEQ ID NO: 2431 - DNA, 496 bp, Plantago ovata
gggggaagaagatctcattactctccggcagccgcaggaccgctcgaaaccgcctcctagttccagagtaatcaatcaaccatgggtaaggttcacggatcattggctcgtgccggcaaggtgagaggccagacgcccaaggtggccaagcaggacaagaagaagaagccacgaggccgtgcccacaagcgcatgcaatacaaccgcagattcgtcactgccgttgttggtttcggaaagaagaggggaccaaactcatctgagaagtaaatcttttcatgtagttcttcaagtgtttggacaaacttttgctactctatagtttttttttatgtttgatggatcaaattttatgcgaattcagtttcaccgcgatggttgtcttttcatttgaagtttctactgattgaatcattctatatatcgttggtgaacaaaaaaagaaaaaaaaataagatagagaggagaagaagaagactacagcggccccggcccg

SEQ ID NO: 2432 - DNA, 511 bp, Plantago ovata
gaacccatcgcctcccagtagcagctgaacaaatcaatctgcaaattctctctacgccttctgtgaaagattaaccatgggtaaggttcacggttcattggctcgtgccggaaaggtcagaggacagacccccaaggtcgcaaagcaagacaagaagaagaagccccgtggccgtgctcacaaacgtatgcaatacaaccgccgtttcgtcacagcagttgttggcttcggaaagaagagggggccaaactcatctgagaagtaaattaaatcatgattatctttgtttttactataatgtactagttcttagaatgctgctgggggctgctgtgttagcagttccctttttgttatcgactgtttaactcttgttgcttcatacatttcctaattgagttggatcagtctttgaaccccaagaatttctatttagagctacattataatcctggtgttctgggatgtgtctacgatcaaccagtctattacctacttgaatgactacgga

SEQ ID NO: 2433 - DNA, 494 bp, Platanus occidentalis
cgccggtcgccaggagagggagaagcaacaacagcagtaaacccagaaaccctaacagtccacaatgggtaaggttcatggatctctggctcgtgccgggaaggtgagaggccaaacaccaaaggtagcgaagcaggacaagaagaagaagcccagagggagggctcacaagcgcatgcagtacaaccggcggttcgtcactgctgttgttggatttggaaagaagaggggacccaactcgtctgagaagtaagcttataatgtgaggagtttcaaggagtaggatgaatttttttttctttttctttgaactgaagttttcagtcctatgttatgtttttggatgctggaattcactatagttactggtattctttcttcactcttttgtgcctgtgctgctatgttgggtttataaagtcaatggcttaagatacctggttattttttgatattttgcaacatgggagaccttaatgctaaagtaaacttta

SEQ ID NO: 2434 - DNA, 410 bp, Platanus occidentalis
agaagcaaccgcaacaatcggccatgggtaaggtgcacggatctctggctcgtgccgggaaggtgagaggccaaacgccgaaggtggcgaagcaagacaagaagaagaagcccaggggcagggctcacaagcgcatgcagtacaacaggcgcttcgtcactgccgttgttggatttgggaagaagaggggacccaactcgtcagagaagtaagcttttaatatgaggagtttttttttaggagtagttgcgatctgatgttttcagttgattttgttttttgatactggaatttactacagttgctggcattttgttgtcaaacattgtcagatttatgctttaagaactttcatatctagtgtttaaaaagagcatctcttaagtttactggttatgtttagtgttttg

SEQ ID NO: 2435 - DNA, 308 bp, Platanus occidentalis
ggcctcctctcacatctttttcgcgccagaaaagcgactgaatcctccatgggtaaggttcatggatctctggctcgtgccgggaaggtgagaggccaaacgccaaaggtggcgaagcaggacaagaagaagaagccccgaggcagggctcacaagcgcatgcagtacaaccggcgcttcgtcactgccgttgttggatttgggaagaagaggggacccaattcgtcggagaagtaagcttgtagtgtgagaagtttttatgattaggatgattgctttttatgtgaactgatgttttcagtcatatt

SEQ ID NO: 2436 - DNA, 395 bp, Pteridium aquilinum
gcctaattcctccccaaaggtctccaactctccatcctcactcaccgcctgtgaccagagaagcaacgacattcgcagatgggtaaggttcacggatcattggcacgtgccgggaaggtgagagggcagaccccaaaggtggccaaacaagacaagaagaagaagcctagaggtcgcgcccataagcggatgcagtacaatcgccgtttcgtcaccgctgttgttggctttgggaagaagcgtggacccaactcttcagaaaagtgaggttggacttgttggagtcctgcattgtaggatgtttgggagtttagtgggaacattatattgaaatttttatagcttcagtagcattatattgttctgacttaatttggagcccttttttggttaag

SEQ ID NO: 2437 - DNA, 404 bp, Sarracenia psittacina
tctgctctggtcgctccgtcgcttgaagtcacccgtcgaaaaagcaactgcaatctgatctcggaccaccatgggcaaagttcacggatctctggctcgtgccggtaaggtgagaggccaaacccccaaggtggccaagcaggacaaaaagaagaagccccgcggccgtgctcacaagcgcatgcagtataaccgccgttttgtcaccgccgttgttggctttggaaagaagaggggaccgaactcatcagagaagtaagcttgagaattaggtagttggttgatgacggccatttgggtttatgtttgaactgttagttatcaatcagtatgtgattgaattcgtaatccccagagttggatactatcgatttctgtttttctgaagtatgttgaacttgtca

SEQ ID NO: 2438 - DNA, 457 bp, Sarracenia psittacina
cgaagacacgtggtgtctaacgacaggagtatggggattatcttgctctggtcgctccgtcgcttgaagtcacccgtcgaaaaagcaactgcaatctgatctcggaccaccatgggcaaagttcacggatctctggctcgtgccggtaaggtgagaggccaaacccccaaggtggccaagcaggacaagaagaagaaaccccgcggccgtgctcacaagcgcatgcagtataaccgccgttttgtcaccgccgttgttggctttggaaagaagaggggaccgaactcatcagagaagtaagcttgagaattaggtagttggttgatgaaggccagttgggtttatgtttgaactgttagttatcaatcagtatgtgattgaattcgtaatccccagagttggatactatcgatttcttgttttctgtatattaggttgtaaacgtttgtttacctaa

SEQ ID NO: 2439 - DNA, 552 bp, Sarracenia psittacina
aaacgaagaagtaacagaaatttgagctaagagaacagagaattggccatgggtaaggttcacggatcgctggctcgtgctggtaaggtgagaggccaaacccctaaggtggcgaagcaggacaagaagaagaagcccagaggacgtgctcacaagcggatgcagtacaaccgacgtttcgtcaccgccgtggttggctttggaaagaagaggggacccaactcgtcggagaaataagctccactaatggtgggtaggtttacaggcgaaggcttatttggttttttgaacgaattactggtttccagcatgtgatagtttcctttatcacaggagttagttttctttatccagtagttatctacggttgcattttcttcttactctggagtcagaaccatgttgagtttatttgttggataaaagttgtagttttgtgtttgacagctttgtgattgaagtattcatcgggtcgtatcgattatggtttcactattttggtagaatatttctaagactgaaatttggaattagttcataccaacttctctg

SEQ ID NO: 2440 - DNA, 323 bp, Scabiosa columbaria
aacttggtatttgcagtctctctcacactttcctcttcgcaaaatcaaaccctagctgagaattcgtattaatcgttatcaaccatgggaaaggttcacggatccttagctcgtgccggtaaagttagaggccaaactcccaaggtcgccaagcaggacaagaagaagaagcctcgtggccgtgctcacaagcgcatgcagtacaatcgccgttttgtcaccgccgttgttggctttggaaagaagagggggcctaactcatcagagaagtaaaatactttgatgaaataactagggttttttagtgtatgtttgcatttttg

SEQ ID NO: 2441 - DNA, 333 bp, Scabiosa columbaria
cctgttccccgatttctcgaagaagcaactgctttcaatttctctgagaactcacacacagacgctaactcaaaatcagccatgggaaaggttcacggttcacttgctcgtgccggaaaagtgaggggccaaacaccgaaggtagctaaacaggacaagaagaagaagccacgtggccgtgctcacaagcgaatgcagtacaatcgccgttttgtcaccgccgttgttggttttggaaagaagaggggaccaaattcatcagagaagtaatttggtggctttaggatactttttcgtagtaggctaaattttgtttggatggatattttgatg

SEQ ID NO: 2442 - DNA, 583 bp, Sorghum bicolor
tataaattctcccacccatctaggtcatcgttcggagcagccgccgccgccaccgccaccgccgcaacagctcgagtcgctcgtcagatcctccgagcaccacagctccggctccgcccccgtcgccatgggtaaggttcacggatcgttggcccgcgctgggaaggtgcgtgggcagacgcccaaggtggcgaagcaggacaagaagaagaagccccgcggccgcgcgcacaagcgcatgcagtacaaccgccgcttcgtgaccgccgtcgtcggcttcggcaagaagcgcggccccaactcctcggagaagtagatctagctatggcttgtgtttttgttccccactagtttctttgtactgatcgcaagttgaagacttgtgctattatctgtatcgatgttactgcaatactatcaagtatgatgctgttactgcaatactatcaagtatgatatgcatcgtttagttgatcaagttgcctgtggtgtttatctttttggttttgaatggtggaagcatgttctgctgtgtcttgttttgaacatctaattcgcttgttttatgatatgcattgtttag

SEQ ID NO: 2443 - DNA, 600 bp, Thalictrum flavum
aatctcaacaatctccgaatgggtaaggttcatggatcgttggctcgtgctgggaaagttagaggacaaactccaaaggttgcaaaacaagacaagaagaagaagcccagaggtagagctcacaagaggatgcagtacaacaggcgtttcgtcactgctgttgttggttttggaaagaagaggggaccaaactcgtcagagaagtaagcttgcaatgtgagttgtcgagatgtagggtagcttgggtgttaagcctttcatagatctcatttgttggtgctttactcgtggttccattatcctttcatttaagcaaaagcttgttaagtatatgtgttagtatgtaatagttgccgttgaatctagttttttattttctataaaaacttcaacagagctctgaatttctatgtatgtgaatttatgaatgatgttggcatagtggtttgattacgcctaaatttggtcttgttggaaagcatggcaacaatggaggatgatgcgttgaacttgtgcccgttaaagtattacttgaatgttgttgattgttacttttggcattcggaattatggtctgttaagtatttaggcagtctttcc

SEQ ID NO: 2444 - DNA, 423 bp, Thalictrum flavum
ttccttttctatttccttgttccctttcgtttcgtttgttttggttcgtcttcagtgagaagaagaaacagagaatctcaacaatctccaatgggtaaggttcatggatcgttggctcgtgctgggaaagtgagagggcaaactccaaaggttgcaaagcaagacaagaagaagaagcccagaggtagagctcacaagagaatgcagtacaacaggcgtttcgtcactgctgttgttggtttcggaaagaagaggggaccaaactcgtcagagaagtaagctcgcaatgtagggtagttttggtgttaaacttttcatagacgttgtttctttacccatggttccataatcctttcatttaagcaaaagtttgttaagtatatgtgatagttgacgttgaatctagtcttttatttgctataa

SEQ ID NO: 2445 - DNA, 465 bp, Thalictrum flavum
aacacttcgccgccatgggtaaggttcacggatcattagctcgagctggaaaagtgagaggacaaacaccaaaggttgcaaagcaagataagaagaagaagccaagaggtagagctcataagaggatgcagtacaatcgccgattcgtcactgctgttgttggttttgggaagaagagaggaccaaactcttcagagaagtaagcaggagtatcaatgtgttttgcggatgtagagtaggttttgaattttgttgtcagctcttcattttccaaggaatattaaatttttgggagaatacattcagttctgttatgttttaattttattcagataatacttataaggatgtagtttactttttcacctggattaagctgatattcgtagtctgttttaattgtctttttgaagtcattggtagtaaagcctaactgttgttccccaagcaaatccttactaaatt

SEQ ID NO: 2446 - DNA, 411 bp, Solanum lycopersicum
taaccctagcatactaaccttcgtaccggcgtctcagaaatcaacaatgggtaaggttcacggatcacttgctcgtgctggtaaggttagagggcaaacacccaaggttgcgaagcaggataagaagaagaagcccagaggacgtgcacacaagcgtatgcaatacaatcgcagattcgtcactgctgttgttggctttggtaagaagaggggaccaaactcctctgagaagtagatgagaacttgagccagagaagttgttttcacctttgctttgctttgctttgtaaattttgattctcagacatcataatgggagaagactagtttactactggtatttttaggttggatgagtacttttgttttgccagaattaattgaattttatcctgtccttttttatacttt

SEQ ID NO: 2447 - DNA, 480 bp, Solanum lycopersicum
cttccctataaatacaactctcccaaaaaccctaaccctagaatttcaacttccgcagctcccaaacgattagcagcttctccgacgaccggcgactcagaaatcaaccatgggtaaggttcacggatcacttgctcgtgccggtaaggttagggggcaaacaccaaaggttgcaaagcaggataagaagaagaagccaagaggacgtgcacacaagcgtatgcaatacaatcgcagattcgtcactgctgttgttggctttggaaagaagagaggaccaaactcttccgagaagtagatgacgacgactttagttattttaggttgaggagttactgcttcaaaagttttcatctttgtgatgtttataaattttgattctcaaacctcataatgagaaaagactggtgtttgtaggatggatgattacattctgttttgcaagaattaattgaattttatcctttcgtctttctactg

SEQ ID NO: 2448 - DNA, 511 bp, Tripterygium wilfordii
acaactgcagctctaatctccggcgcaagagttctcgacagtagcgatgggtaaggttcatggatctctggctcgtgctggtaaggtgagaggccaaactccgaaggtggccaagcaggacaagaagaagaagccacgcggccgcgctcacaagcgtatgcaatacaaccgccgcttcgtcaccgccgttgtgggatttggcaagaagaggggacccaactcttcagagaagtaaagcttgagagaatgaggacttctgttggtgaagatgcttttcttgtcaaaatttctcattactcaagtcttgtagtggtttgagttactttggctaagtttgaactatgatgaagaccttgtcatttaattagtgggaaattacatgatttgatatggaattcagatattgaatgcagggtttattgagtttttgcttcctacaattgcacaaattttcaccattgaattagtgacaacattagcagtgtgggttttattctttagttgcagattg

SEQ ID NO: 2449 - DNA, 558 bp, Tripterygium wilfordii
aagagttctccaacagtagcaatgggtaaggttcacggatctcttgctcgtgcaggtaaggtgagaggccaaactccgaaggtggccaaacaggacaagaagaagaagccacgtggccgcgctcacaagcgtatgcaatacaaccgccgttttgtcaccgccgtggtgggatttggcaagaagaggggacccaactcttcagagaagtaaagcttgagagaatgaggacttctgctggtgaagatgctttacgccattaccttgtgtcttgtcaaaatttctcattactcaagtcttgtagtggttttagtaacttttattttgtttgaactatgatgaagacattgtcatttaattggctggaaattacatgattggatttggaattcagatattgaatgcagggtttattatgagtttatttttccttattttgatatggtacttgctggaacaatcatgtgaggaagtctttgtgtttaattgatgtagtttttgtaattttctgctgtagaacattgcatctgaataagaagtatttgcaatcctttgtgaact

SEQ ID NO: 2450 - DNA, 416 bp, Tripterygium wilfordii
tcgaccacagctgcgccaatagccggtgcaagagttctacaacagtagccatgggtaaggttcacggatcgctggctcgtgctggtaaggtgaggggccaaacaccgaaggttgccaagcaggacaagaagaagaagccacgcggccgcgctcacaagcgtatgcaatacaaccgccgcttcgtcactgccgttgtgggatttggcaagaagaggggacccaactcttcagagaagtaaagcttgagataatgaagacttctgctggtgaaggtgcttatcttgtgtcatgtcaaactttctcattaattaagtcttgtagtgtttttagttactttggttgagtttgaactatgatgaagacatggtcatttagttagctggaaattacatgatttgatttggaattcagatgtt

SEQ ID NO: 2451 - DNA, 371 bp, Utricularia gibba
gccggcggctgatttctcttccggaagagttcgtgatcaatcatgggcaaggttcacggctcattggcgcgtgccgggaaggtcagagggcagacgcccaaggtggcgaaacaggacaagaaaaagaagcctagaggccgcgcacacaagcgaatgcagtacaaccgtcggttcgtcaccgccgtcgttggttttgggaagaagagggggcctaactcgtctgagaagtaagggatgaagcccatcagtctgttgctattctattggtattatgccattttgattgccttgtgtctacgttttcggtccatgtattgacgattgttgaggcttctacatgcttctgtctttgggaaactcgtatatcgatc

SEQ ID NO: 2452 - DNA, 364 bp, Valeriana officinalis
cgttttgctgtgtaaaaaaccgtctcagttttctcatcatccagaatccgccatgggaaaggttcacggatcgttggctcgtgccggaaaagtgagaggccagactccgaaggtggccaagcaggataagaagaagaagccacgcggccgtgctcacaagcgtatgcagtacaatcgccgtttcgtcactgccgttgttggattcggaaagaagaggggacctaactcgtcagagaagtagaaatcttttcgagaaatttatagctatgtagttgaagttttgctttttttttttttaaaaggattggttgttattgaatctaaaactacattttgcttttgttaatgtaaggttactctttag

SEQ ID NO: 2453 - DNA, 433 bp, Valeriana officinalis
ctcgaaactaatagaggaggaactcaggaggaatctcagttgaatcaccatcagcaattcgccatgggaaaggtacatggatcgcttgcacgtgcggggaaggtgagaggacaaacaccaaaagtagctaagcaagacaagaagaagaagcccagaggccgcgctcataaaaggatgcagtacaatcgccgtttcgtcaccgccgttgttggcttcggaaagaagagaggacccaactcatcagagaagtagagctttggatttcatggaggagttctttaggttgagtttgttttgtattttgtttgtttttggtttgatcgaatcaacgaagtttgctaatggattaggttgagtcttttatttgatgtttgaagaattaatctcgttacactagttttcctcattgatgattaatatttgctgaattgtg

SEQ ID NO: 2454 - DNA, 432 bp, Valeriana officinalis
ccacaatgggaaaggttcacggatcactggctcgtgccggaaaagtgagaggtcaaactccgaaggtggctaagcaggacaagaagaagaagccccgtggccgtgctcacaaacgtatgcagtacaatcgccgtttcgtcactgccgttgttggttttggaaagaaaagaggacccaactcatctgagaagtaagtaaattggagctcaagattttcaaggatatgtgtgttactttttgtattttgtttgtttttcaccatgtgatgagggatattgattcaagtgtattaacttgtcaagtttagactactctataaatgcttgaaaatttttattcagtttctgtttgaatgtttcggtttaaagcaatgttatgttaagtagggttacatgttactaaatttataaatcataggaattatttttaaaa

SEQ ID NO: 2455 - DNA, 355 bp, Vinca minor
ttcctcacagcagccggcggtgcagtttcagatctctcgaaaccgacaacttcaccatgggtaaggttcacggatcattggctcgtgccggtaaggtcagaggacaaactcctaaggttgctaagcaagataagaagaagaagccacgtggacgtgctcacaagcgtatgcaatacaatcgccgtttcgtcactgccgttgttggctttggaaagaagagaggaccaaactcatcagagaagtaaatgtgattactattagcatttgataagtaggatgaggaatgttatgaaactatagtgaattcttcttatttgaatcatgttatagattgagattctcatgttgctttttg

SEQ ID NO: 2456 - DNA, 618 bp, Vinca minor
tcgtttttgcttcaatttttccagtttccacctttctttcatagcagccggagcgccgccaccttgcagaagatctctccaaactttcaaccaccatgggtaaggtccacggatcattggctcgtgctggtaaggtcagaggacaaactccaaaggttgcaaagcaagataagaagaagaagccacgtggacgcgctcacaagcgtatgcaatacaatcgccgtttcgtcactgctgttgttggttttggaaagaagagaggaccaaactcatcagagaagtaaatcagattattgttagtttttgtagtaggttgcgaatacgttggaaactaaagtgaattcttcttatttgaatcatgttttaatgttatagattcaacttttgtcttttgtttcatctttcaagtttaggttgttcacttgttcttgaatgggatttgagtaaacatcttgtgaaagtcccttttgtgatgttctgttgtggtgatttccattagaattgctgtctagtcattcattctgttatttaccgtctttcacattatgcttgataatgttttgaatagtaacctatatcgggattttattgaatgacaaaaaagctacatgatttcat

SEQ ID NO: 2457 - DNA, 387 bp, Vinca minor
caccatgggtaaggttcacggatcattagctcgtgccggtaaggtcagaggacaaactccaaaggttgcaaagcaagataagaagaagaagccccgtggacgcgctcacaagcgtatgcaatacaatcgccgtttcgtcactgccgttgttggctttggaaagaagaggggacccaactcatcagagaagtaaatcagattattgttagtatttgtagtaggacaaggaatgtttcgaaacgagtgaattcttcttatttgattcatgttatagattgaacttctgtcttttggtcacccgttcatgaagttttggttgttcaccttttattgaatgagatcttgatgtttggttatcttgtgaaagtccctttttgtggtgtttcg

SEQ ID NO: 2458 - DNA, 789 bp, Amaranthus tuberculatus
caaataacattactccaatattcatgttttatcaaaatgtatcgattacatggcacaaaaataaactacctaacaaaatccgatagccattgatatagctattagatcgatgaactaagattgaacgaaaagacaacggaaaaaagaaaattaaccatggcagtcgaagatcttctacttggatctttgtctcatctttctacgcttcctcttcaacctcctcatacgcttcttcttccacttggccctcatgatgaatggatgacgacgacggcgatctgaaaaccctaacatctataccggcgcatccaaggaggaaaaggagcgagaaaccctagaagcaagcagtagtcgagaagcaagaacagccatgggtaaggttcatggatcattggctcgtgccggcaaggtgagagggcagaccccaaaagtggctaagcaagacaagaagaagaagccccgtggtcgtgctcacaagcgtatgcaatacaatcgccgtttcgttactgctgttgtaggattcggaaagaagagagggccaaactcatcagagaagtaagatacaatgttatttccaggatattcaagtagaacctcttatttaatatctgtttagtaatgaaccttgtctagattttggtaccatgatatcaacaattgattctacatttgaagttttggttcttaccttcaatttcatttctagcttttcaaattcagtagactacagagcagtaatatttgcctgctaagatgagaaattctgcattttgaggtattttcatatac

SEQ ID NO: 2459 - DNA, 633 bp, Aristolochia fimbriata
aaaacccaaagagttagggcttcagaggatataaataccccagtgcagcatgttctaaaccctaaatcgcagtccgtcgtagaaagggaggtttccgaagcgcgggggtgctactgcggagctccactcatcaatcatgggaaaggttcacggatctttggctcgtgctggaaaggtgagagggcagacccctaaggtcgccaagcaggacaagaagaagaagcccagagggagggctcacaagaggatgcaatacaaccggcgtttcgtcaccgctgttgttggatttggaaagaagaggggacccaactcatccgagaagtaaatgacaggatttttgtagatgtagtggttcctataccatgcacttagaattttgttggataatgttctaaacatatgaatatgtagtcaagttattgaacttttctttagatcattgttgttggctttgtggttactggaacctttttttatattttgtccgaattccatgtttcattgacaactcccgagttaattggtgacactaccatttacttagttatttgctgcctgtttggctccatccaaactctagttgtgagactatactagacgtacattctgaaatccacatcttatttcttccgg

SEQ ID NO: 2460 - DNA, 578 bp, Phaseolus coccineus
agagtgcctattatggccggggggccgcagcaagagattgaagcggaaacagagtaatcagaagagaaattcatcgtcgctgtgatgggtaaggttcacggatcactggcacgtgccggcaaagtcagaggccaaacccccaaagtagcgaagcaggacaaaaagaagaagccacgtggacgcgcccacaagaggatgcagtacaatcgccgattcgtcaccgccgtggtgggatttggcaagaagaggggtcccaactcgtctgagaaatgaggttgaggcttgaagaatatgtgactactttatttgagctatctttgttttcctttttgttccatgtattgattatgttgtgtcaacggttctattgttagttttatatcaaacatcaagctagattttttgcttacaattttaatattatatcttagtttattgcttcttcatgttggaaggaaatcagtatttttggtttggggttttgtcaatcaataacatgctctacaacgaaagcctctgtgtagagacagggcaatgctatacttaaccctctgaacattacctgtgatttctctgcc

SEQ ID NO: 2461 - DNA, 497 bp, Phaseolus coccineus
atggccggggaccggtagccgctgcagctgaacgaatcagagagaagcatcaattcatcaaaatgggtaaggttcacggatctctcgcgcgtgcgggcaaagtgagaggacaaactcctaaggtggccaagcaagacaagaagaagaagccacgaggacgcgctcacaagcgaatgcaatacaaccgccgattcgtcaccgccgtggtcggattcggtaagaagcgtggaccaaactcgtcggagaagtgaggggcgcgtggtttttcttagtttgcaaaatgtattttgtttttattttaattttattgatgactgaaagtttgatagttatgattatgcttcaatgaggatgttttttgctagttaatatcaaaactttatattttcctcacgaacaattgtttgagtttttgctacacagattttgttttgcttctattaattaggggtgaagtatgcaaagatggaataccaagcttattacataaattttta

SEQ ID NO: 2462 - DNA, 321 bp, Fagus grandifolia
gccggcgagtccatcagagaagagaaagaaaaaagcactaagaagactcaaccatgggtaaggttcacggatcgttggcacgtgccggaaaggtgaggggtcagaccccaaaggtggccaagcaagataagaagaagaagccacgtggccgcgcccacaagcgcatgcagtacaatcgccgcttcgtcaccgccgttgttggatttggaaagaagcgtggacccaattcatcagagaagtagcggcttgaatttcaaggagttttgtttgtggaggcagtggttaaatatgaaacaatagtttcaaaattttatgtttcgt

SEQ ID NO: 2463 - DNA, 1075 bp, Theobroma cacao
gtcaagaaatcgggttcaattttgttcctttataaataccggattccagatcaaaaccctaagcctaattcctcccaaaggtctccaactctccatcctcactcaccgcctgtgaccagagaagcaacgacattcgcagatgggtaaggttcacggatcattggcacgtgccgggaaggtgagagggcagaccccaaaggtggccaaacaagacaagaagaagaagcctagaggtcgcgcccataagcggatgcagtacaatcgccgtttcgtcaccgctgttgttggctttgggaagaagcgtggacccaactcttcagaaaagtgaggttggacttgttggagtcctgcattgtaggatgtttgggagtttagtgggaacattatattgaaatttttatagcttcagtagcattatattgttctgacttaatttggagcccttttttggttaaggaagctgaatactagtatttgttgatttcaaatatctcctacagccttgatttctcttcctttatgttcttttatttaacgtgttaatgagttttttgctactgagcatggacagggtcaatatgaggatttgtgaatctcagtaactgatttggaatgttaaagttgaaaaattgtgatggttaaattggttctaactgttaatggatttagttgggcttctaaagcgtactagtcagtcaaattggtcttgtctccgaaagggtttagaagatcagtgtatgggtggttatgtgctttctagcaggcagcaccattaaggtcactgtagaaagtcttcaatttcagatatttcctttttgatcatcagggatgataatcctcaatcaatatttaatattagagggatgatgggatataagcatagatgatggatttgaatgcaagcatgctggcatttgagtaggaagaaaaggacttggtagaacccaaaagaaggtcattctttctccatcttctggtttatgctgggttgggtctaactcgctgtagtggacattccctcttctggttcctttggataaagtaaagcaacccagaatacaaaagcgtagcccaa

SEQ ID NO: 2464 - DNA, 434 bp, Ricinus communis
atattaacagcgaaaccctaaccctaaaactttctattcgttgcgctgcttattatcatcaccaccgcttctatcgaactcggggagcaacagcagaagcagcaacaactcaagaagccgccatgggtaaggttcacggatctttggctcgtgctggtaaggtgagaggccaaactcctaaagtggcaaagcaggacaagaagaagaagccacgtggtcgcgctcacaagaggatgcaatacaatcgccgttttgtcactgctgttgtgggattcggtaagaagagaggacccaactcatctgagaagtaaagtgtgtgacagagggataagtgtttagttatgtaggtgtgatctggattattcatttttgtgtttcaagtgttatcatactccagtcagcattggatattaaattctcaagactattgttga

SEQ ID NO: 2465 - DNA, 1219 bp, Ricinus communis
atattaacagcgaaaccctaaccctaaaactttctattcgttgcgctgcttattatcatcaccaccgcttctatcgaactcggggagcaacagcagaagcagcaacaactcaagaagccgccatgggtaaggttcacggatctttggctcgtgctggtaaggtgagaggccaaactcctaaagtggcaaagcaggacaagaagaagaagccacgtggtcgcgctcacaagaggatgcaatacaatcgccgttttgtcactgctgttgtgggattcggtaagaagagaggacccaactcatctgagaagtaaagtgtgtgacagagggataagtgtttagttatgtaggtgtgatctggattattcatttttgtgtttcaagtgttatcatactccagtcagcattggatattaaattctcaagactattgttgagcttatgctctttttttttttttataattagaattatgtgacttttgtttttgtttttttttttttttttttaatcttgcgtcatgagcttgtccttgataatctgctctgaataactgttgtggtatctaagcaaagcttccacatgcgctactgaacttgacaaagtaagaggagattttgatggtcggattactaatcttaatgttaatgccaatgcactgcagttttaaaggggaatatttaagatgtggatagactggcctgctatggatacttcacctaaatgatgctttggtgtttctgaaaatttttggaaatagaaactcctcgagatagaaactccatgtggtctttgaaacgttccagggctgggtcgctgttttggttttcccctgtatcgaaaatgttatttctattgattcttttatggggaaaaatgatcttctaatcattttatgtccttcatttacaattaaagcccccccacatctatgattgagtttggcaaaccctattggattgtcatgcttaagcaaatcaatggcagtagtggagcctcatatacagaatatcaggaacagaactttaactgcaaggcactaaagtattttagtacgcagtttaagcttcaagaaatctttcgacaatcctaaagatgggacaagtcctatattaaaatagcttaccctcataactgtgtttactctgacaaaattctgacatgcttcaacgtcttcccgttgaggattgaaacgtgtgaagtaacaaatccaaaaacttcg

SEQ ID NO: 2466 - DNA, 504 bp, Ricinus communis
attaatttgaactgttaactccagcaattcacgtacagagaattaaccagcaaatcaatcatgggtaaggtgcatggatcactagcccgtgcgggaaaagtgagagggcaaacaccgaaagtggctaagcaagacaagaagaagaagcccagaggtcgtgcccataagcgcatgcaatataatcgccgctttgtcaccgccgttgttggatttgggaagaagcgtggacccaactcttcagagaagtaagctctcattttggtgaagattttctatagtccgatcgagattcatagacaatgtttgcagatttttgttaatggatagttttcttcttctcatatttagcttaaaagggtgttgcttgatgagaatgttattagttggattgctttttggaagacaaagttcttgcttttaatgctaatttatttgagaatgcaactctgaaaccagttaaggtgatgtcaattttactggcataaagaaggaatttttttcata

SEQ ID NO: 2467 - DNA, 1478 bp, Ricinus communis
cctctgcatagctcccttttcttcttgtaactcggccgatgaacctttcaccaggtaatgcacggtcacacataacaacaaacccagtatctgccactttacagacaccctttcctttaaaagccaaagactcacaaaccaactccaaactctggcctcgttttggaaataatgcaccagacttagagctatcagcattcaattcaatgctatctttcttattcttgttcttcttcttgttattaagccttgtttctggggtgtccttaattctttcttcttgataattttgatgttgttgttgtgagtcgtcttgagtgaaagaagaaggagaaatggaggctaacgagtgaagcttatgaagtttttgaaatctgtgtagccatgggtggttagcagttaggtgtttcaaggtataaatctgcatagtcatggttgcttatggttttttggttcaagagggaaatttgagagtaagggccgaaaatttgggtttttgcggatagagggtgtccttggtaattttgaaaatctactgaggttaattcagtaaataagttctaaaacctccaataaaaaccctaatccagcaattttttttctttattaatttgaactgttaactccagcaattcacgtacagagaattaaccagcaaatcaatcatgggtaaggtgcatggatcactagcccgtgcgggaaaagtgagagggcaaacaccgaaagtggctaagcaagacaagaagaagaagcccagaggtcgtgcccataagcgcatgcaatataatcgccgctttgtcaccgccgttgttggatttgggaagaagcgtggacccaactcttcagagaagtaagctctcattttggtgaagattttctatagtccgatcgagattcatagacaatgtttgcagatttttgttaatggatagttttcttcttctcatatttagcttaaaagggtgttgcttgatgagaatgttattagttggattgctttttggaagacaaagttcttgcttttaatgctaatttatttgagaatgcaactctgaaaccagttaaggtgatgtcaattttactggcataaagaaggaatttttttcatatgacccttttgtgttacatttggtcaccattatgtggatgaataggctgaaattacagtcatacaaattccatcatgtcctgttaagatatggttgctgcccaactacgcaggattgaacaaagaactggagaacctttgggtcacccacctttggtacattcctaattatcatcgaaatgcaattcatgaaatgggatttcactttcttgtttggtagacaagaacttcaagtaggttattatgttcttggacttgaattttttgaattttaagaggaacacatttgtctgtatatgtataaacttcaaaaaatcaccaaattttgttatcttagaaatagtaatggaatgcttttcttggatcaaga

SEQ ID NO: 2468 - DNA, 515 bp, Catharanthus roseus
ctcaccagcagtcggaggcgcggcaaccagcggaagatctctctaagctacaatcaccatgggtaaggttcacggatcattggctcgtgctggtaaggtgagaggacaaactcccaaggtagcgaagcaagacaagaagaagaagcctcgcggacgtgctcacaagcgtatgcaatacaaccgccgtttcgtcactgccgttgttggctttgggaagaagagagggccaaactcatcagagaagtaaattatgacagtaatattagttttttttttatttttatatttgtagtaggattcggaaaagcacgagactgaagtgaattcttatttgcataatcattttatagattgaacatcttttgctttccttcaatttttaaaggagtttttgcttgttctcttatcatggaatgatatttttattctctgttattttgaaaagtcccttctccccagtgtttgtagttggttttgataattaccattaagatagccgagttcattggttccat

SEQ ID NO: 2469 - DNA, 638 bp, Catharanthus roseus
  misc_feature (23)..(26): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (34)..(34): n is a, c, g, or t
aagaattcggcacgaggctttcnnnngnancnancgaagcagcagaaattccgaagatacacaacaatgggtaaggttcatggatcattggctcgtgccggaaaggtgagagggcaaacgccgaaagtggcgaagcaggacaagaagaagaagccccgtggccgtgctcacaagcggatgcagtataaccgacgcttcgtcaccgccgttgttggctttggaaagaagaggggtccaaactcatcagagaagtaaagaacatattgtagttcatcgcaaattgtatggcgatctttttgtactgatcagaggacttgtagtgcacctcagttggacattttactttcagatcatctatgttgaaacaatattacctcgttgactacaaatcacaaattttggcagcctaaattgttgttagaatgatttccattacaggtttacttatattttccggtacattgcaaattgcaatttgttagttggatattatttcccttgtgataagccaggctttcagaaagtacattactatgtttgggcttaactagatactccattcatgaggagcctgttacatgtttttgttgccgtcgtgccattttattcaccctaattgactgacgtgtttgggaagc

SEQ ID NO: 2470 - DNA, 456 bp, Castanea mollissima
ctcacactgtgtgcgctcgccggcgattccatcagagaaagaagaaaagcactaagaagactcaaccatgggtaaggttcacggatcgttggcacgtgccggaaaggtgagaggtcagacaccaaaggtggctaagcaagacaagaagaagaagccacgtggccgtgcccacaagcgcatgcagtacaatcgccgctttgtcaccgccgttgttggatttgggaagaagcgcggacccaattcttcagagaagtaagtggcttggtgttcaacgagttttgtttgtggaggtagtggttaaatatgaaaaactagtttcaaagttttatatttcgactgtagccaaactacattttagtttagtatttcttattttgtgtgaacttgtctttgttgaaaacacttctgtgaggtttaaattgaccattacatagcatgggttgatttttgagttta

SEQ ID NO: 2471 - DNA, 442 bp, Castanea mollissima
tctcattttcactctctcgctcgaggcacacacacagagaagagacacacaactctcaaccaatacaccatgggtaaggtacacggatctctggctcgtgctggtaaggtgagaggccaaactcccaaagttgcaaagcaagacaagaagaagaagccccgtggtcgcgcccacaagcgcatgcaatacaatcgccgattcgtcacagccgtggtcggatttggcaagaagaggggacccaactcgtccgagaagtgaagcggttgagtgttttaggttaaagattttgttgggttttattatttttgtttttaatgttatattgaagactgtgatgatgatgatgttagttgctggaattttgtactgaattgaaatcatgttggattatgcttacttggttgattaatctgaaaatgatgtgatttttgatacaaaaaaa

SEQ ID NO: 2472 - DNA, 434 bp, Cicer arietinum
ggggttttatgccaatagccgctgcaacttaaccgaacaaagcgaaaccaatcgaagaaagagaatcacaaatttttctttgcaatgggtaaggttcatggatctcttgcacgtgctggaaaagtgagaggacaaactcccaaagttgctaagcaagacaaaaagaagaagccacgtggacgcgctcacaagcgtatgcaatacaatcgccgtttcgtcaccgccgttgtgggattcggaaagaagcgtggacctaactcatctgagaagtgaggatgatgattggtggaaggttttttaattagtttgttgaatgtaatactactttggtttaattttaatcgatgaattggaactatggaatttctgactattgttatatgaaagagttctttttgtgctagttaatttcaaactgtgttcattcctttcat

SEQ ID NO: 2473 - DNA, 520 bp, Cicer arietinum
gatttcgagcggccgcccgggcaggtggtgctttcggccgcagcaagcgatcgcaaccaacggagagaggattctgcacagaaattcatcgtcacaatcatgggtaaggttcacggttcacttgctcgtgccggaaaagtgagaggccaaacaccaaaagtggccaagcaggacaagaagaagaagccacgtggccgtgctcacaagcgtatgcagtacaatcgccgattcgtcaccgccgtggttggatttggcaagaagaggggccccaactcatcggagaagtagggttgattcttgaagaatatcagggtcttaacttcgaaaatttgcttatgaaattttattttatttttcttcttttttggatgttagtggttcgattatgatctttgaacggtttttgtgttagttaaatatcaaactatattattttgcatacactttctaagttgttgcttagttcaattttgtaactgctttaagattttaatcattttttgttaaattgtgcttgata

SEQ ID NO: 2474 - DNA, 576 bp, Citrus sinensis
tttgctggatcgcattggccgggagattcgtgttgtctgcctcaatttgggcgagaaagagtctcacagcagcagcagcagcagcagcggccaacaagactactcaaacgatcagctatgggtaaggttcacggatctttggctcgtgccggtaaggtgagaggccaaactcctaaagttgctaaacaggataagaagaagaagccacggggccgcgcccacaagcgcatgcaatacaaccgccgcttcgtcaccgcagtggttggttttggaaagaaaagaggacccaactcatctgagaagtaaaaaaatgcttgagaggatgaatgaagaagggttagataggtgaaaaagcacttggtgtttttgataatttctcttatgttgtttttaaagaccttattatggtattctgttactaatgttatgttttgagattttgtctctcttaaacttgtgatcatcattttgttagtagagattatgtgattttcttttcaaatgtctttaatttgctgtttgttgtgtgtttgcctttctttcttagttatgtatgatagttggtcaattggtccc

SEQ ID NO: 2475 - DNA, 358 bp, Cleome gynandra
ctctctagtttcacatcggctgtgaagaagaatagcaaattcagaggaactaatctaaatccgccatgggtaaggttcacggatctttggctcgtgctggtaaggtgagaggacaaacgccgaaggtggcgaagcaagacaagaagaagaagccacgtggacgcgcccacaagcgcatgcagtacaaccgcagatttgtcaccgccgttgtcggctttgggaagaagaggggacccaattcttctgagaagtagagatagtagaagctgaagaatgctcgaacttttaatgaaatatgtactttcaaattagtctttggtcttgtattgttttgtagatgatactatgaaataacaat

SEQ ID NO: 2476 - DNA, 253 bp, Cleome gynandra
taaccctaggaaggattgccggagcgacagagtcacagttcgccgtacaacttctctgatcgatcatgggtaaggtgcacggttccttggctcgtgccggtaaagtgagaggacaaactcctaaagtggcaaagcaggacaagaagaagaagcctcgtggtcgtgcccataagcgtatgcaatacaaccgccgattcgtcaccgccgttgttggatttggaaagaaaagaggtcccaactcatcggagaagta

SEQ ID NO: 2477 - DNA, 368 bp, Cleome gynandra
cccaggcttgagctctggttcgacgtagcacttcgaagcagccgccgggaagaagacagggaatccaaattcgccatgggtaaggttcacggatctttggctcgtgccggtaaggtgagaggtcaaacgccgaaggtggcgaagcaggacaagaagaagaagccacgtggacgcgctcacaagcgcatgcagtacaaccgccgattcgtcaccgccgttgttggttttgggaagaagaggggacccaactcatctgagaagtaaaaatagaagttgaagctatgtactttcagatactttttgacttctttggattgatgttatgaaccaaaaatgttttgaattgatgttatgaaattcaatttttg

SEQ ID NO: 2478 - DNA, 429 bp, Cleome spinosa
ctagcttttatgtttccaggcttgacgtagcacttcgaagcagcagccggaagaaggagagcagcgaattcagaggaactaacctaattccgccatggggaaagttcacggttctttggctcgtgccggaaaggtgagggggcaaacccccaaggtggcgaagcaggacaagaagaagaagccacgtggacgcgcccacaagcgcatgcagtacaaccgccgattcgtcaccgccgttgtcgggttcgggaagaagagggggcccaactcttctgagaagtagagagataacaggaagaagctgaagtgaagaatgctttgatgaacatctctagtttcagacagcttccgtacatctttcgttcgtggcttgttcgcttttgccctgtgttgacagctttatgaattatgaaattcagtttttgatcg

SEQ ID NO: 2479 - DNA, 272 bp, Cleome spinosa
ccctaggttttgcggattgctgttgccacagagcccgagagagaccgagtttcgactgccgcataatctctgtgatcgatcatgggtaaggtccacggttccttggctcgtgccggtaaggtgagggggcagactcccaaagtggcgaagcaggacaagaagaagaagcctcgtggtcgtgcccacaagcgcatgcaatacaaccgccggttcgtcaccgcggttgttggattcggcaagaaaagaggacccaactcatcagagaagtagag

SEQ ID NO: 2480 - DNA, 384 bp, Cleome spinosa
aggttgcgctctggtttcacatagcacttcaaagtagccgccgggaacgaaagcagcaaatctaaattcgccatgggaaaagtccacggatctttggctcgtgccggaaaggtcagagggcagacgccgaaggtggcgaagcaggacaagaagaagaagccgcgtggacgcgctcacaagcgtatgcagtacaaccgccgattcgtcaccgccgttgttggtttcgggaagaagaggggacccaactcgtctgagaagtagaggtagaagttgaagaatggttcggacaggacatttgatgaatatgtacttttcagacactttggtttaagctttgatcgttttgctctgaaccatgatctttttttacttgatgctatgaaa

SEQ ID NO: 2481 - DNA, 621 bp, Coffea canephora
aaccctagaatttgagaaagctgttcatcttcccggcacgattcgctcgtagcagacctctcggcagcagcagaagcagaagcagacctctagccatgggtaaggttcacggttcattagctcgtgccggtaaggtgagaggtcaaactcccaaggtggcaaagcaggataagaagaagaagccccgtggccgcgcccacaagcggatgcaatacaaccgccgcttcgtcactgccgttgtcggctttggaaagaagagggggccaaactcatcagagaagtaaacatgaggattgatgcagagtagttttagtaggtggaattctgttttcagcttcctgggttttgttattttgataatgttataatactgagttcagttacagactttagactacttactctcaaagacttcatttttgctcaatgtccaattctggttttatcattgtaaaagcaggtttgttaaacgccttaacatgagattgaaggaaggttaacttggttaatatgtgattggttatcattgtattgttgtagcataagcgaatggggtgctttaattcgattgagttctcgacgacccttttgttctgctgcacttggattacctgcgatggc

SEQ ID NO: 2482 - DNA, 666 bp, Vigna unguiculata
ggaacaatactaatagcataactgagtcaggttttctggttctgcggcagtaagtgatcgaagcgaaaatagagtaatcagaagcgaaattcatcgtcgctgtgatgggtaaggttcacggatcacttgcacgtgccggcaaagtcaggggccaaacccccaaagtagctaagcaggacaaaaagaagaagccacgtggacgcgcccacaagaggatgcagtacaatcgccgattcgtcaccgccgtggtgggatttggcaagaagaggggtcccaactcgtctgagaagtgaggttgaggcttgaagaatatgtgactactttcttatttgatttatctttttgttttatgttttttatcatgttgtgtgaactattctattgttagctttatatcaaacatcaagccagattttttcgtatacaattttagtattctatcttagtttattgatccttcatgctggaaggaaatcagtgttttgggttgggttttagcaatcaatcacattcttgcatcaatgtggtaacaagtttgagagtttttagcaagtttgaatttgatataatctgttacatggtagagaaggatggagttaccttataatagtaaaaaagccccgaggattgtgatcgatatttctcatatatgcacttacgcctcca

SEQ ID NO: 2483 - DNA, 665 bp, Vigna unguiculata
  misc_feature (507)..(507): n is a, c, g, or t
ggagattttaccggtcgccgctgcagctgaacgtttcagagagagaagcatctattcatcaaaatgggtaaggttcacggatctctcgctcgtgcgggcaaagtgagaggacaaactcctaaggtcgccaagcaagacaagaagaagaagccacgtggacgcgctcacaagcgaatgcaatacaatcgccgattcgtcaccgccgtggtgggattcggaaagaagcgtggaccaaactcgtcggagaagtgaggggcccgtggatgattatggttttcgtagtttgcaaaatgtatgacttgtttttgtttttatttgattgatgactgaaaccttgatagttacgattatgcttcaatgaagagtgtttttgctagttaatttcaatacttatatttgcctctcacggtttgttttagatattttgtcacacagtttttgtttatcttctattggatatagaggtgaattaagcaaacattgaacgccaagcatatcacttagaanatatttgtgctggatttagccttttcagtttttgtgtccttcgtttaaatgttacaaacaataccgtttggaggcccattagaggaaagcatatcattttggttgtaaattgaatggttacacacttatgatagaatacatacagtaacaagctaaac

SEQ ID NO: 2484 - DNA, 477 bp, Cucumis sativus
aatctcatcccaccaaaaccctaactcttgatctccatctcctcagcggcttgttatcggaagttaagcaccgggaaggttccgaagcaatcaatcagccatggggaaagtacacggatctctggctcgtgccggtaaggtgagaggtcaaactccaaaagtagcgaagcaggacaagaagaagaagccccgtggacgtgcacacaagcggatgcaatacaatcgcagattcgtcactgcagtggttggttttggaaagaagagaggacccaactcctctgagaagtaagcaaatagagcgacctcatcgggggagctttgccgctagagaggcgtggttttgtgctttactattaatctttttcttcctatttctcatagatgttttagtttattgaggtttttggctgtgtaaaagatgtttattttgacaatatatcagaagtaatgtgatttggatctgaattttgtccttag

SEQ ID NO: 2485 - DNA, 431 bp, Cucumis sativus
aatctttgccaatttgcgttcttagtttctaggaaacgaagccgacaagtcagtccaccgcttatcagattcgccatgggtaaggttcatggatctttggctcgtgccggtaaggtgagaggccaaacaccaaaggttgctaaacaagacaagaagaagaagccacgaggacgtgctcacaaacggatgcaatacaaccgcagattcgtaactgccgttgttggttttggcaagaagagaggaccaaactcgtccgagaagtaagagactcgagaattcggctgaacagccaattttttttcatgttatttggagatattttatactttctttagttcttttttgatgtggttaagctgacaatttatcttgacgatgatagtattatttctttaagaagttatctgtttcatcatttgataattggctta

SEQ ID NO: 2486 - DNA, 369 bp, Cyamopsis tetragonoloba
gacgtgacgaagagaggtagagagaaagcgtgagagaaggagtaattcatcactatgggtaaggttcacggatctcttgctcgtgccggcaaagtgagaggccaaactcccaaagtggctaaacaagataagaagaagaagccacgtggccgcgctcacaagcgcatgcaatacaatcgccgattcgtcaccgccgtggtgggattcggaaagaagcgtggaccaaactcatctgagaagtgagcaagacgataggaggatggatttaattagcgtgcgaaatgtattatttattttgttttgattgacgaactgaaactgtggaagtttttattatgtttcaataaagtgttcttttgctagttaaaa

SEQ ID NO: 2487 - DNA, 429 bp, Cynodon dactylon
gccgggggagcaccgccgccgccgccacagctcgagcacctcccgaatcacccgagcaccggagctccgccgccgccgtcgtcgccatgggtaaggttcacggatccctggcccgtgctgggaaggtgcggggacagacgcccaaggtggcgaagcaggacaagaagaagaagccccgcggccgcgcccacaagcgcatgcagtacaaccgccgcttcgtcaccgccgtcgtcggcttcggcaagaagcgcggccccaactcctccgagaagtacatctacaccgcccggcggcctggttcaaacaaatggcttcctgtccctttttcctttttatgttcttaagtagtttcgttcgagtaatcaagtttggtgctgtactgatgttaagacctaagaaaccttatgtatcaatgatattggagtctaa

SEQ ID NO: 2488 - DNA, 532 bp, Solanum melongena
aaccctagcattctaaccttagcaccggcgtctcagaaatcaaccatgggtaaggttcacggttcacttgctcgtgcgggtaaggttagagggcaaactcccaaggttgctaagcaggataagaaaaagaagcccaggggacgtgcacacaagcgcatgcaatacaatcgcagattcgtcactgctgttgttggctttggaaagaagagaggaccaaactcttctgagaagtagatgaggacatcagtaactttatccggaaaagctatctggttcaagagttttcacctttgctgtgtttgtaaattttgatccagtctagtttacttctggtatttgtaggatggatgggtaattttattttgcaagaatcaattgaatcttatcctccaccttttatattttatcaaatcatttttggaatgttctgtgctattcacagtttgggttgccacttgtgatttcattgagtgactttcttgatgttattgctatgatatttttatgaaaacagtttgaaattattttcttg

SEQ ID NO: 2489 - DNA, 620 bp, Solanum melongena
acgccttatcagctttcctataaatttatctctcccaaaaaaccctaaccctagaatttcaactttcgcagctaccaaacgattcccagcttctccgacgaccggcgactcagaaatcaaccatgggtaaggttcacggatcacttgctcgtgccggtaaggttagggggcaaacacctaaggttgcaaagcaggataagaagaagaaaccaagaggacgtgcccacaagcgtatgcaatacaatcgcagattcgtcacagctgttgttggctttggaaagaagaggggaccaaactcttctgagaagtagacaagaacatcagttattttaggtcggacgttactgcttcaaaagttttcatccttgtgatgtttataaattttgattctcagacctcataatgagagaagacatgtttactactggtatttgtaggatggatgattacgttctgttttttcaagaattaattgaattttagcccgttgttgtttatactgctatcaatcttcagtcattgctttgatttgttatagctgttcacaaattggttgctcaatcaatgattctttgagtcacccttgactctattgctatgctattagaacatataaacag

SEQ ID NO: 2490 - DNA, 482 bp, Eschscholzia californica
cgaaatttaagcaagaaactggtcttcttccttccgtctctccagaagccagaacagagtagtagcggcagagaaaccctaacaatcaaccatgggtaaggttcacggatctttggctcgtgctggtaaggtgagaggtcaaacacctaaagtagcaaagcaagacaagaagaagaagcctagaggtagggctcacaagaggatgcaatacaacagacgattcgtcacagctgttgttggattcggtaagaagaggggaccaaactcatccgagaagtagactcgagtaagatgtaagggattttgtttgtgaggttgaagatggccatcaaagtcttcttcaactagcaaccttctgtttgtttagaaattaaagatagtttcaagagttgttagttatggatgcttttttatttccttcagtttaagatatgttatcttcatatatggctgataaaaatattgtttaaatgttgaatttt

SEQ ID NO: 2491 - DNA, 528 bp, Eucalyptus grandis
gatcccctttccatcctcctccaactcgccgagctcagccgcgccccgagatcgaccgcagcaccgccgcaagttctccgacatcaatccgccatgggtaaggtccacggatctctggctcgcgccggtaaggtgagggggcagacgcccaaggttgcgaagcaggacaagaagaagaagccgcggggccgcgcccacaagcgcatgcagtacaaccgccgcttcgtcaccgccgtcgtcggcttcggcaagaagagagggcccaactcgtcggagaagtgagctcgccattgaacgccgaggaagatggttaggtgaagaaggaacgatgatggctcggtttcgatgagttttgcacccttttattttttattgggaagctttaaaatttattgtgtatgcgactcgatttcggtgctcgaccgattgaattttaatgatgattagtagagatcatgggattcagttcttgccatgcgttgctgttcctgtctgatcctttcttagttcattgaggattggtttgca

SEQ ID NO: 2492 - DNA, 435 bp, Eucalyptus grandis
  misc_feature (290)..(290): n is a, c, g, or t
  misc_feature (293)..(293): n is a, c, g, or t
  misc_feature (297)..(297): n is a, c, g, or t
  misc_feature (302)..(303): n is a, c, g, or t
  misc_feature (308)..(310): n is a, c, g, or t
  misc_feature (435)..(435): n is a, c, g, or t
cggggctgagctcggccgcagcaccgccgcaagttctccgacatcaatccgccatgggtaaggtccacggatctctggctcgcgccggtaaggtgagagggcagacgcccaaggtcgcgaagcaggacaagaagaagaagccgcggggccgcgcccacaagcgcatgcagtacaaccgtcgcttcgtcaccgccgtcgtcggcttcggcaagaagagagggcccaactcgtcggagaagtgagctcgccattgaacgccgaggaagatggtttggtgaagaaggaacganganggcncggtnncgatnnnttttgcacccttttattttttattgggaagctttaaaatttattgtgtatgcgactcgctttcggtgctcgaccgattgaattttaatgatgattagtagagatcatgggattcagttcttgccn

SEQ ID NO: 2493 - DNA, 553 bp, Setaria italica
ccgcacccgccgccgcgccagcagtaaaccctagccccgtccgccaccgccaccgcagcagccacagccatggggaaggtgcacggatcgttggcccgcgccgggaaggtgcgcgggcagacgcccaaggtggcgaagcaggacaagaagaagaagccccggggccgcgcccacaagcgcatgcagtacaaccgccgtttcgtcaccgccgtcgtcggcttcggcaagaagcgcgggcccaactcctccgagaagtaggcgccgcgcggcccccggcccgccctgccccggttcctcctttccgttcgcagtatgcttatgctcttgttggtagtagtttcattgtgcaagcaaaggaagaaccttttgtagtttcagtttcgttgttcgtagatggaaacttgagatggtatgtgcacctcgttaagattttgagatatggtgatatgagcccatgactttatcatgcttatggctgcgtgttttggtatgtggatgtgctgcaaatatgtgtcactttatggttttgcgtggaataatcagtttaaggcta

SEQ ID NO: 2494 - DNA, 547 bp, Setaria italica
ggtttggggagcatccaccgccgccgcaacagccctagttcctcgtctcctcccaaatcgcccgagcaccacagctccgccatgggtaaggttcacggatcgctggcccgcgctgggaaggtgcgtgggcagacgccgaaggtggcgaagcaggacaagaagaagaaaccccgcggccgcgcccacaagcgcatgcagtacaaccgccggttcgtcaccgccgtcgtcggattcggcaagaagcgcggccccaactcctccgagaagtagatctagctaggccagccgcctgattcatactcatgggttctcggccccttcttctgtttttgttccccagtagtttcgttcgagtaatctagttttttgtgttgtactgataacaagttgaagacctaaagctatcatctgaattgatgttactgcagtcttgttaagtatgatatgcatcgtttactacatgccaatgagtgtctctgatcaagttgcctgctgtgtttggctattcggaatgttcaaacatgtttgagtagcgaatttgcctgct

SEQ ID NO: 2495 - DNA, 559 bp, Setaria italica
cgtttggggagcatccaccgccgccgcaacagccctagttcctcgtctcctcccaaatcgcccgagcaccacagctccgccgccgccgccgccatgggtaaggttcacggatcgctggcccgcgctgggaaggtgcgtgggcagacgccgaaggtggcgaagcaggacaagaagaagaaaccccgcggccgcgcccacaagcgcatgcagtacaaccgccggttcgtcaccgccgtcgtcggattcggcaagaagcgcggccccaactcctccgagaagtagatctagctaggccagccgcctgattcatactcatgggttctcggccccttcttctgtttttgttccccagtagtttcgttcgagtaatcaagtttttggtgttgtgctgataacaagttgaagacctaaagctatcatctgaattgatgttactgcagtcttgttaagtacgatacgcatcgtttactacatgccaatgggtgtctctgatcaagttgcctgctgtgtttggctattcggaatgttgaaacatgtttgagtagcgaatttgcctgct

SEQ ID NO: 2496 - DNA, 537 bp, Zingiber officinale
gccctttgcttcgtcgctgccgctgctgcctccagttcgccgcacgccgctatgggtaaggtgcacggttctttggctcgcgcggggaaggtccgaggtcagacgccgaaggtggcgaagcaggacaagaagaagaagccccgtggaagggcccacaagcgcatgcagtacaaccgccgcttcgtgactgccgttgttggattcgggaagaagaggggtccaaactcgtccgagaagtaaagtcagcgatgacggtatcaaaatgaaatttttagctgttttccctcaattttctggcgcatgcttatgcctcattgtctttcttatgtcttccttatgcgtttgaatccttgttccatgattaagtggtagatgacttcgaactgtgaaattgtgtagtaaagtgtcttttaatcatcagttattttgcagtattattactcatgtagtggaactacaactcattgtttcatttgcagaagacctattctttaagactagagataagaattagattaggtaaatatgaggctagat

SEQ ID NO: 2497 - DNA, 459 bp, Zingiber officinale
  misc_feature (5)..(5): n is a, c, g, or t
  misc_feature (7)..(7): n is a, c, g, or t
gcacnangagagctcgcctcctctgccgatcctgtttgccgcacgacgcgatgggtaaggtgcacggatctttagctcgcgccggaaaggtccgagggcagacgcctaaggtggcgaagcaggacaagaagaagaagccccgcggcagagcccacaagcgtatgcagtacaatcgccgctttgtcactgcggttgttggattcgggaagaagaggggtccaaactcgtcagagaagtaaagatctcggtattgatggcagatccgaagtgcctctttccaccattttcgttagtagacattttctttttgtttttgcagtgtatttgttattttatttaatgttaaattatatcgattaagtttggatatggattgaatcgtggaattgtgaactgccttgtgtcacatccgagttcgtatgtgatgtgatgcttgccatatgagatcgttgggtcaaa

SEQ ID NO: 2498 - DNA, 429 bp, Panax ginseng
ggggagagttatcggcatcttcgtcctcggtgtttttcacaagcagtcgaaggagctaaaaaaaactcaaattcatccatgggaaaggtacacggatctttggcgcgtgccggtaaagtgagagggcaaaccccgaaggttgccaagcaagacaagaagaagaagccccgtggccgtgctcacaagaggatgcaatacaatcgccgttttgtcacagccgttgttggctttggaaagaagaggggacctaactcatctgagaagtagtaaaaagctggaggaatcatgtctagttttgtaggtgaagacttgtgggttgttaagttgaattgatacattttcacttttatagtgatttcagactttattggctataaattagcattttcttctctgaatgtaatggaatttgtggttttccagtgctag

SEQ ID NO: 2499 - DNA, 392 bp, Panax ginseng
ggggctagaagatcagaatctgcatcttccgctctctatcgctcaaagccagccagcagtcgaaggagctcaagaaagctcagattcaatcatgggaaaggtgcacggatccttggctcgtgccggtaaagtgagagggcaaactcccaaggttgccaagcaggacaagaagaagaagccccgtggccgtgcgcacaaaaggatgcaatacaaccgccgttttgttaccgccgttgtcggctttggaaagaagaggggaccgaactcatccgagaagtaagaagaagctcgagaattcgagatggcacatgatgtttagttttgtaggcaaagaaggcactctaggttatgttattaagatggatttatatattttcagttatgatacagtt

SEQ ID NO: 2500 - DNA, 1161 bp, Vitis vinifera
gggatcaggcccaatcccaactcaccccacgcctgccagccacgatatatattcatgtcccccaaaaaccctaaccctagaattcccattgtttggagccagaagccaaagaagcagcatcaggaacttctgaaaatccaccatgggtaaggttcacggatctctggctcgtgccggtaaggtgagaggccaaaccccaaaagtggccaagcaagacaagaagaagaagccccgaggtcgcgctcacaagcgcatgcaatacaaccgccggttcgtcaccgccgttgtgggcttcgggaagaagaggggacccaactcgtcggagaagtgagcgcaaaatatgaaaatttgaagactggttttgttgtttttaatgaatggttaggatatttcaagtctacaatactggtttttgatactggtgttaacaccattttttgaaggtttttttagctgaacgatgttgaatttatgcttactttgttagccagagattatgtgattttgccttaagaatgtcttgatttggtgttaatctatgagcttgaatttatgattgccatatcacttttaagaaatcttagccatgagttgtttgcattttctggagtggtatactgggtattgagtggtaggattgtggcctttcaagtatgtttacagtataaatgttttggtttttgtagaaatttcaccgctgaagttagttgatatccaactatttgtttggttttggggattggcataaatgcaatgatgggtttaatgcttgtagctgctaaattttgctcatggtatgggcagtgcagtgcttaaagataatgattaatacttgaaacatggatttacaagtatattgcccaagtagctatgaggcctggctcaagtggtgaagggtggggaggatttgtgggaggttctgtggtcaactccaccccaatggggaccaaaatttatctgtaataaaaagtatattgcccaagtagaaattatttccttcaacggttttcgttcagctaacaataatttacaacaatgtatcctggatttgtagtattattgcaaatgcttgtgggtatgcaataactttcaattagttcatgcctacatccatataggttccgattttgttagggttaaaaagtttaatttctaatgtgt

SEQ ID NO: 2501 - DNA, 540 bp, Vitis vinifera
ccctagaattcccattgtttggagccagaagccaaagaagcagcatcaggaacttctgaaaatccaccatgggtaaagttcacggatctctggctcgtgccggtaaggtgagaggccaaaccccaaaagtggccaagcaagacaagaagaagaagccccgaggtcgcgctcacaagcgcatgcaatacaaccgccgattcgtcaccgccgtcgtgggcttcgggaagaagaggggacccaactcgtcggagaagtgagcgcaaaatatgaaaatttgaagactggttttgttgtttttaatgaatggttaggatatttcaagtctacaatactggtttttgatactggtgttaacaccattttttgaaggttcttttagctgaacgatgttgaatttatgcttactttgttagccagagattatgtgattttgccttaagaatgtcttgatttggtgttaatctatgagcttgaatttatgattgccatatcacttttaagaaatcttagccatgagttgtttgcattttctggagtggt

SEQ ID NO: 2502 - DNA, 621 bp, Vitis vinifera
atgcatacattaaataattattgttacgcattcaccgtcggatcctcagaccacccccttaaatacccaaaacccaaccctaaccctagtctttgcatcgtcctcatcgtcgccggagaccaatcgagcaatcaccaccacccacaatcacaaatgggtaaggttcatggatcgctggctcgtgccggtaaggtgagagggcaaaccccaaaagtcgccaaacaagataagaagaagaagcccagaggccgggcgcacaagcggatgcagtacaaccgccgtttcgtcaccgccgtggtcggattcgggaagaagagagggcccaactcatccgaaaagtaattctagaatgtaagaagtttttgtgggtggaggccatttggtttggcctccctcaagctctttgtttttcgttctacttttgcttctttgattcaagaacaatgtgttaggtttagtttggcattttcataattggatgtgttgatttgaattttcagtttactgggaaatggcattctttcccaacaagaacactatcttgtttagtggtagcacttggtttgatttgtagttagtttaaacttgacatgggttagtagatttagaactcgtttgata

SEQ ID NO: 2503 - DNA, 527 bp, Vitis vinifera
tgcatcgtcctcatcgtcgccggagaccaatcgagcaatcaccaccacccacaatcacaaatgggtaaggttcatggatcgctggctcgtgccggtaaggtgagagggcaaaccccaaaagtcgccaaacaagataagaagaagaagcccagaggccgggcgcacaagcggatgcagtacaaccgccgtttcgtcaccgccgtggtcggattcgggaagaagagagggcccaactcatccgaaaagtaattctagaatgtaagaagtttttgtgggtggaggccatttggtttggcctccctcaagctctttgtttttcgttctacttttgcttctttgattcaagaacaatgtgttaggtttagtttggcattttcataattggatgtgttgatttgaattttcagtttactgggaaatggcattctttcccaacaagaacactatcttgtttagtggtagcacttggtttgatttgtagttagtttaaacttgacatgggttagtagatttagaactcgtttgat

SEQ ID NO: 2504 - DNA, 616 bp, Ipomoea batatas
acggccggggacgcggtcttggcagctacattcgtgttaagcagtcggagaatcagagagcgcaagccttttcaatcggcggccggagacttagaaatctgccatgggtaaggtacacggatctttggctcgtgccggcaaggtgagagggcagactcctaaggttgccaagcaagataagaagaagaagccccgcggccgtgcccacaagcggatgcagtacaatcgccgctttgttacagccgttgttggctttggtaagaagagagggccaaactcatctgagaagtaaatgaagaaatgaagatttttattatttaggggttgtaattcagatgaatgttcttgttatagccattttggatgctgtactaaactacaatttccagctttttattaatatgtgatgacatctcctttgtttttgatggattaagttgttttttccctaaacaaacccatagttcactctcatcttacattaactcccatctctgagattgtttgtcaggtaacgacttattgtttgaaaattgaaatgagttgtggcttttgacttaaatttactgttaaatgaacttcacctgaaatgataggcttttggttgtagtcaaag

SEQ ID NO: 2505 - DNA, 588 bp, Ipomoea batatas
gcttacggccggggcatttggaagctagaggcaagccagcagtcgaagggggcgaagttttcactgcagtctccggcgatctcagaaaccaaatatgggtaaggttcatggatctttggctcgtgccggtaaggtgagaggtcaaactccgaaggttgctaaacaggacaagaagaagaagccccgaggccgcgctcacaagcggatgcagtacaaccgccgcttcgtcactgccgttgttggctttggaaagaagagaggaccaaactcatctgagaagtagatgaagtaattgacaatggttgtgttgagggtgcaagagttttgaattaggatggttagtttttaacattatagcactatggattgttttagtaaactacatatttctggattttggtgatttgtgttgaactctacttaattttattgtgattaagtcacagatttgttctaatgaatactgtttaggtgcctgaagaaatgtgggtttttcatactttgcagtctaaagctttttgcaactgtaagaacacataatatctactttcacagttgcagaaacagtagtattagttctttgctgac

SEQ ID NO: 2506 - DNA, 485 bp, Ipomoea nil
ggaattcctttcggaagctagaggcaagccagcagtcgaagagggcgaagttttccctgcactctccgccgatctcagaaaccaaatatgggtaaggttcatggatctttggctcgtgccggtaaggtgagaggtcaaactccgaaggttgctaaacaggacaagaagaagaagccccgaggccgcgctcacaagcggatgcagtacaaccgccgcttcgtcactgccgttgttggcttcggaaagaagagaggaccaaactcatctgagaagtagatgaagtaattgaagatggtggtgttgagggtgcaagagttttgaattaggatggttagtttttaacattatagcattatggattgttttagtaaactacatatttccggattttggtgatttgtgttgaactctacttaagtttgattgtgattaagtcacagatttgttctaatgaatactgtttaggtgcccgctgaaaaaaaaaa

SEQ ID NO: 2507 - DNA, 526 bp, Jatropha curcas
tacgggggttgctctttatctttctcaccgcttgtatcaagcttcagagcaacagctcccccactcagcagaaaaagctcaagaagccgccatgggtaaggttcatggatctttggctcgtgctggtaaggttagaggccaaactccgaaagtggcaaagcaggacaagaagaagaagccacgtggccgcgcccacaagaggatgcaatacaaccgacgtttcgtcaccgcagttgtgggtttcggcaagaagagaggacccaactcatctgagaagtaaggtgtgacaggataacaagtttttaatagttatgtaggtgaagtcttatattggttgttttggattatgtctcttgtttttctgggtactggcatactgttgaatttttgatatttagactcagacaatgttgagcatattatccttttttgtttttgttaattagaattatgtgattttgttacccaaatttcgttatattgcatatctttattgtcatggttctcaaaagggggggcccggtaa

SEQ ID NO: 2508 - DNA, 490 bp, Glycyrrhiza uralensis
ccataatcattcgcgttcccaatctggttttgtgctatcagccgcaacaagcaagcaagtgatcgaaacgaaaagagtagaaagcagagaaattatcgtcgcagtgatgggtaaggttcacggatcacttgctcgtgccggaaaagtgagaggccaaactccgaaagtggcgaaacaggacaagaagaagaagccccgtggccgtgcccacaagcgcatgcagtacaatcgccgtttcgtcaccgccgtggtgggattcggcaagaagaggggacccaactcatctgagaagtgagctttcggcttgaagaatcggcttccttagcttcgaaaatatgttacaaatcttaagttgacttctcttttcttttttgtgtgtttttttgaagttagtgttttgattatgatctgtgaactgaacggtttttgtgttagttaaatatcaaactacatttttttttgcatacagttccaattcgctttctaagtt

SEQ ID NO: 2509 - DNA, 436 bp, Glycyrrhiza uralensis
gtctggattttctgctctgttggtagccgcggcaactgaacctaacgaaacgaagagagtgagagagagagagagaagcagaaattcttcataatgggtaaggttcacggatctcttgctcgtgctgggaaagtgagaggccaaactcccaaagtggcaaagcaagacaaaaagaagaagccacgtggccgcgctcacaagcgcatgcaatacaaccgccgattcgtcaccgccgtggtgggattcgggaagaaacgtggaccaaactcatctgagaagtgatgaagatgcttggaggaaggttttttgttttttattagcttgaggactgtattacttgttttgattttattgatgaactgaaactgagaaacttctgattatggtttaatggatgagttttttgctagttgatatcaaactgtgttacttcttt

SEQ ID NO: 2510 - DNA, 464 bp, Liriodendron tulipifera
ctcatcctaagctgtgaagaagaagagaacctcccgctagtcggcgctgtatctgtaaatcctaaaatacgccatgggtaaggtacacgggtcgctggcacgtgctgggaaggtgagagggcagacgccgaaggtggcgaagcaggacaagaagaagaagccccggggcagagcccacaagcgcatgcagtacaacaggcgtttcgtcacagccgttgttggatttggaaagaagagggggcccaactcgtcagagaagtaaggttggcgttgaaggctttttggggtagtgatgtaggttggttttctttggtgaaatgttattttcagtgttttgttattccttttcgatgtttcttggatattgaattttccatgatcagttgggtgtgcccatgattgcaatatacatgatggattatcaggaagaagcttatcttaagatgatttgaactttttttcct

SEQ ID NO: 2511 - DNA, 381 bp, Liriodendron tulipifera
cggagtcgaagagagcctttgcaaaaccctaacatccgccatgggaaaggtacacggatctttggcacgtgccgggaaggttcggggacagacgccgaaggttgcgaagcaggacaagaagaagaagcccaggggcagggctcacaagcgcatgcagtacaacagacgttttgtcaccgctgttgttggatttgggaagaagagggggcccaattcatcggagaagtaaacataagaatgtgaacggttttgcagatgtaggatcgtggtttgcttcacatttttattttcatttttttttttttaaaatttttttacatttcctcaatgatgttcttggattactgaattcacactgatattttctggccaaactttatc

SEQ ID NO: 2512 - DNA, 451 bp, Lotus japonicus
gggttctgccattagccgctgcaactgcaccaagcgaagagcaaaacagagagaacaagaaacagcgattcactacaatgggtaaggttcacggatctcttgctcgtgctgggaaggtgagaggccaaactcccaaggtggccaagcaggacaagaagaagaagccccgcggccgcgctcacaagcgcatgcaatacaaccgccgattcgtcaccgccgttgtgggattcggaaagaagcgtggacctaactcatctgagaagtgatgaagatgcttggaggatagtttttatttacttgtgctatgtattacttgttttgatttggttgttgaactgaaagtaagatgcttcttattatggttgaatgaaccagtttttgctagttaatattgataatatgattgtgtaagagattcgttttcactcataagtatggtattttttctttg

SEQ ID NO: 2513 - DNA, 508 bp, Lotus japonicus
ctggtctactggacttgtaatctgcttctgtttgcacctgcagccgcagcgaggaggagagcgacccaatcttcaccagagaaattcatcttcacactcagccatgggaaaggttcacggatcacttgctcgtgccggaaaagtgaggggacaaacccccaaagttgccaagcaggataagaagaagaagccccgtggccgtgcccacaagcgcatgcagtacaaccgccgattcgtcaccgccgtggttggattcggcaagaagaggggacccaactcatctgagaagtgagcctgaaccttgttattctttagctagacaacaatcatgtgactaatcttttttgttctgtttcgttttttttccgagttaagggtttgattatgtactctgaatggtgtttttgttagttggatatcaagctatacgttttgaatacagttgtaatttgcttgcttagattgttgcttggattctttgatgaaatgatcaagatagcttgccctt

SEQ ID NO: 2514 - DNA, 527 bp, Zea mays
tttcttcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccaaataaatttgaaaccagattgctgatgcgt

SEQ ID NO: 2515 - DNA, 808 bp, Zea mays
acatgtgcatgtgcctcaaaacagccggcccagtaaagcgtggcgtttataaattctcccacccgtctagggcaccgttcggacagccccgccgccgcaacatcccgagtcgctcgtcagatcctccagcaacacagcaccttcgccgccgccgccatgggtaaggttcacggatcgctggcccgcgctgggaaggtgcgcgggcagacgcccaaggttgcaaagcaggacaagaagaagaagccccgcggccgcgctcacaagcgcatgcaatacaaccgccgcttcgtcaccgccgttgttggattcggcaagaagcgcggccccaactcatcggagaagtagatctagctatggctttgtgttttattccccactagtttcctcactgatggcaacttgctgaagacttatgctattatctgtatcgatgttactgcaatactgttaagtaggatatatgcatcgtttagttgatcaagttgcctgtggtggtgatccttttagtttgtctggaatgttggaaacatgtttgtgtcgtgctgtgttcgttttgttttgaaactggtaacatgattgagtctaaatgccggtctattctgtttcaaattgtcctgctgcttgattcttaaattggtgatagtggaactgttttgtgcaattgtgaattgtcacaagtaggctgaggaaattgtctggatttttttcaagaatttaactgttagtataggttgttttgtgtgtgggcacacttgaaattggcatgagtgtaattaaatgtgctgtgccattttgctagaagccttat

SEQ ID NO: 2516 - DNA, 553 bp, Cucumis melo
ctaactcttgatctccatctcctcagcggcttgttatcggaagttaagcaccgggaaggttccgaagcaatcaatcagccatggggaaagtacacggatctctggctcgtgccggtaaggtgagaggtcaaactccaaaagtagcgaagcaggacaagaagaagaagccccgtggacgtgcacacaagcggatgcaatacaatcgcagattcgtcactgcagtggttggttttggaaagaagagaggacccaactcctctgagaagtaagcaaatagagcgaactcattgagggagcttggccgctagagaggcgtggttttgtgctttactattaatctttttcttcctatgtctcatagatgttttagtttattgaggcttttgactgtgtaaaagatgtttattttgacaatatatcagaagtaatgtgatttggatctgaatttttgtcgttagtcaaacgttttctttctgaatttcgtagtttttcttgctgtatgatggtggtattcagccacatttaagttatgtttagaaacgagtgagtagaa

SEQ ID NO: 2517 - DNA, 523 bp, Cucumis melo
cgttcatagtttctagcggacgaagcgaacaagcccgtcgaccgccatccagaaaggaagaagtcgcttatcagattcgccatgggtaaggttcatggatctttggctcgtgccggtaaggtgagaggccagacaccaaaggttgctaaacaagataagaagaagaagccacgaggacgtgctcacaaacggatgcaatacaaccgcagattcgtaactgccgttgttggtttcggcaagaagagaggaccaaactcgtccgagaagtaagacactcgagaattcggctaaacagccattttttcatgttatttggagatattttatacttccgttagttccttattgatgtggttaagctgacattttatctggatgatgatagtatttttttctttgaggagttttctgtttcatcatttgataatctgcttaagatttagaaatctgagttttgttgtttcacaatgagatgagttcatcatttttttcccggtagaaattattaatggaatattgcttt

SEQ ID NO: 2518 - DNA, 3544 bp, Pennisetum glaucum
tgagcgggcacgactcgaagtacttctccaccaccaagaagggggagatccccgagctcaaggaggagctcaactcccagtacaaggacaagagaaaggatgctgtcaagaaagtgattgccgctatgactgttggaaaagatgtctcatcattgttcactgatgttgtgaactgcatgcagactgagaacttggagctcaagaaactagtatatctgtatctcatcaactatgctaaaagtcaacctgatcttgccatacttgctgtgaacacatttgttaaggactctcaagacccaaatccactgattcgtgctttagctgttaggacaatgggttgtatccgtgtggataaaatcacagagtatctctgtgatccacttcaaagatgcctcaaggatgacgatccctatgtgcgaaagactgcagctatttgtgttgctaagctttatgatataaatgccgagttagtggaggacagagggtttctagaggcccttaaggatttaatatctgataataatcctatggttgttgcgaatgctgttgctgctctagctgagattcaagacaatagtgttcgtccaatctttgaaattaccagccatacactgtcaaagcttctgacagctctgaatgaatgcacggagtggggccaagtcttcattttggattctttgtcaagatacaaagcagcagatgccagggaagcggaaaacatagtggaaagagttacaccccgtctccaacatgcaaattgtgcggttgttctttctgctgtcaagataatcctcctacaaatggagctcattacaagcacggatgtagtccggaatctctgtaagaaaatggcgccccctcttgttactcttttgtcagcggaacctgaaattcaatatgtggccttgaggaacattaatttgatagttcaaaagaggcctacaatacttgctcatgaaattaaggtcttcttttgcaagtacaacgaccctatatatgttaaaatggaaaagctggagattatgataaagcttgcctcagatcgaaacatagatcaggtgctcttggagtttaaggagtatgccacagaggtggacgttgactttgtgcggaaagctgttcgtgctatcgggagatgtgcaattaaattggagcgagctactgaaaggtgcatcagtgttttgcttgagctgattaagataaaagttaactatgttgtccaggaagctataattgttatcaaagacatcttcagacgctaccctaacacgtacgagtctatcattgcgacactctgtgaaagtctggacactttagatgagccagaggctaaggcatcaatgatttggataattggagaatatgctgaaagaattgacaatgctgatgaacttcttgagagcttcttggaaacattccctgaagaaccggcactggttcagctacagctgctaactgctactgttaagttgtttcttaagaaaccaactgagggaccgcagcagatgatacaggctgtcctcaataatgcaacagtcgagacagacaatcctgatttgagggatcgagcttacatatactggcgacttctctctactgatcctgaggctgcaaaagatgttgttttggcggagaaacctgtgattagtgatgactccaaccagcttgactcatcacttcttgatgagctgctagccaacatttctaccctttcatcagtttatcacaagcccccggaatcatttgtcagccgtgttaaggcagcacctagggcggacgatgaggagtttgccgatacagctgaagcagggtattcggagtcaccatcacagggagttgaaggggcatcaccttcctctagtgttggcacttcttctaatgtacctgtgaaacagccaggagctggatccccacctgctgctgcaatgccagaccttttaggtgatctgatgggtatggataatgcaattgtccctgtcgatgaacctgcagcaccttctggccctccgctacctgtcttgttgccttcgactactggccaagggctgcagattagtgcacaactgacgcggcgtgatggccagatatattatgatatatcttttgagaatggaacccagggtgtcctagatggatttatgattcagtttaacaagaacacatttggtcttgccgctggcgaagcacttaaggttcccccacttcaaccaggagcatcagcaaggacacttcttcaaatggtgccgttccaaaacattgcccctggtgcaccaaactcgatgctgcaggttgctgtgaaaaataaccagcagccagtgtggtacttcaatgacaaaatcccactgcatgttttctttgttgaagatggaaaaatggagagagccagttttctcgagggctggaaatctttgcctgatgaccacgagtttacaaaagaattccctggctctgtcatcagcagcatagatgcaactgtcgagcgccttgcagcatcaaatgtgttctttatagccaagcggaaaaatgcaaacatggatgttttgtatctatccgccaagatgccccgtggaatccccttccttatagagattacagctgcggttggtgttcctggtgtaaagtgtgcagtcaaaacagcaaacaaggacatggtccctctattcttcgaagctatggaggctcttaccaaatgaggacaatgctaacatcagttgatgagcgccatgcctttggatgcgggattttttttcacggaagctggtgtgagatgtatttgttttgtattagattacagtatttaaactgctagtttcctggttccgcggttccccccccccccccagaaatactggagatgttcttgtttcagcatgatttgtatatttgcccatttgggctggaaccttttcttgttatgcatagcatatgaaatatgactagttttcaacatagctcatgtaacagaggacacgatggtgttttgcaacacataagcacaatatcgtcacgggctcatataatcatatctcaaaatcttaacgaggtacagataccatcccaggttcccatctcatcacaagaacaacgaaactgaaaactacaaaaggttctccctttgcttgcacaacgaaactactaccaacaggagcataagcatactgagaacggaaaaggaggaaccggggcaaggccgaaggcggcgcaacgcctacttctcggacgagttgggcccgcgcttcttgccgaagccgacgacggcggtgacgaagcggcggttgtactgcatcctcttgtgcgcgcggccgcggggcttcttcttcttgtcctgcttggcaaccttgggcgtctgcccgcggaccttcccggcacgggccaacgatccgtgcaccttacccatggctgcgaagcggcggtgcggctgcggcgacggcggaggcggtgggcgcagagggctgggagatgcagcggcggcggcggcggcggcggcgtggcgatgcagttcctccgaagcggcggcggcggcggcggcggaggcggtcgctac

SEQ ID NO: 2519 - DNA, 440 bp, Momordica charantia
tggtccttattacggccgggggcgaccttcgatctccatccaagtgccttgtttagtcggacgttaatcacagcaccggagagtaccgaagcaagcaatctgccatggggaaggttcacggatctctggctcgtgccgggaaggttagaggtcaaactccgaaagtagcaaagcaagacaagaagaagaagccccgtggacgcgcgcacaagcgtatgcaatacaaccgcagattcgtcactgctgtggtcggatttggaaagaagaggggacccaactcctccgagaagtaagcaaacggcaaattcaatgggagcttgtgccgtagaggcatagttttgtgcgttattaagcttttctcttatttctcatagatgtttcagtttatttaaggttttgaccgtgtaaaagataatggttttggcagtatattagaagta

SEQ ID NO: 2520 - DNA, 731 bp, Mimulus guttatus
atggcaggattcaaaaagaaagaaaagaaatcggaatcgagaaaaggaagaaaaagactcgagctccatttccactaccggcagccgaagaataaccataggaagaattttcgcagaaatcaatcaaacacaaacatgggtaaggtacacggttcgttggcgcgtgccggaaaggtgagaggacagacgccgaaggtggcaaagcaggacaagaagaagaagccccgcggacgcgcccacaagcgtatgcagtacaaccgccgtttcgtcaccgccgttgttggctttgggaagaagaggggaccaaactcatctgagaagtaaagctgagcagagtgagcaacaagtattcggatttaatatttttttttaatttataattatggtgtagtgattgctagtgttatttgactgttttgaacatatatccatttgctcaattttgaattagtttaatttgagtttctgaataatccgccattacaagaacatcatgccactacattcaagaacttatgtggacacgatttctgggtgccggtaattcgattggattatgtgatcaaatacttctatctaagctcttcgaacgaacgcactaattgaatgttttatgtcgaataatccttgataaatttttgcaacaaaagatacatattatttttgtttacttattcattaaggaaagccgttatttttgtctttgattgtatttgcttgttgaaccgaaa

SEQ ID NO: 2521 - DNA, 601 bp, Mimulus guttatus
acatctacagcttcatttcatcccggcagccgaaaaacaaacctctcggaagtagttgcagaaagagaatcaacaaaaaatcatgggtaaggttcacggatcgttggctcgtgccggaaaggtgagaggtcagacgccgaaggtggcgaagcaagataagaagaagaagcccagaggacgcgcccacaagcgcatgcaatacaaccgccgtttcgtcaccgccgttgttggctttggaaagaagagaggacccaactcatccgagaagtagattggatgatgattagtatatgtttcgaggtgcaaaaatttctgtagtttgggataattgtttttttataatgccatagttttgactttgaatggtttaaacctgttgcagctttcttttgccctttttcgactatgttgaacattttttattttggttgaatgacgattgaatggattttgtttattgagtaatggtaattcatctttctagtatcacttgttcggttaattaaattttgtacgagttactgagggaaaaggggctgtggttatctgtaatttggcataattgttcaatgtgattctccgagcttttgattttgttgct

SEQ ID NO: 2522 - DNA, 423 bp, Nicotiana benthamiana
tcgcatgggcgcgcctactctttgtaactttcgcagctccaaacacccaatttctccggcgaccagcaaccagcaaatcagccatgggtaaggtacacggatcattagctcgtgccgggaaagtgagagggcaaacacctaaggttgctaagcaagataagaaaaagaagccacgcggacgcgctcacaagcgcatgcaatacaacaggcgttttgttactgctgtggttggtttcggaaagaaacgagggcctaactcctcagagaagtagatgaggacgtccattgtggttcaggaattttgtcaccttgttttgtttgtaaattttaattttgggacctgataatcggaaaactagtttatgaattgtttttgtaggaccaatttgtgtttgatgttttgaaagaatttgaatttcagcc

SEQ ID NO: 2523 - DNA, 607 bp, Quercus alba
ggggtcttctcagccgttggatctcatcacttgcccaccgtatatataaaacacgtcccccaaaacacaaaaccctaactctaatctctcacactgtgtgcgcttgccggcgattccatcagagaaagaagaagaagaaaagcactaagaagactcaaccatgggtaaggttcacggatcgttggcacgtgccggaaaggtgagaggtcagacaccaaaggtggctaagcaagacaagaagaagaagccacgtggccgtgcccacaagcgcatgcagtacaatcgccgcttcgtcaccgccgttgttggatttgggaagaagcgtggacccaattcttcagagaagtaagtggcttggttttcaacgagttttgtttgtggaggcagtggttaaatatgaaaaactagtttcaaagttttatatttcgactgtagccaaactacattttagtttagtatttcatattttgtgtgaacttgtctttgttgaaaacacttctgtgaggtttaaattgaccattacatagcatgggttgatttttgagtttattattagcatttcttttctttttcttcttcttttttgaattttcttcggcgattcttg

SEQ ID NO: 2524 - DNA, 547 bp, Quercus alba
atcagacacgggaattcccgggatatttcagactctctcgcttgaggcacacacagagagagaagagacgcacaactctcaaccaatacaccatgggtaaggtacacggatctctggctcgtgctggtaaggtgagaggccaaactcccaaagttgcaaagcaagacaagaagaagaagccccgtggtcgcgcccacaagcgcatgcaatacaatcgccgattcgtcacagccgtggtcggatttggcaagaagaggggacccaactcgtccgagaagtgaagcggttgagtgttttaggttaaagaatttgttgggttttattattttttgtttttaatgttatattgaagactgtgatgatgatgatgttagttgctggaattttgtactgaattcaaatcatgttggattatgcttacttggttaattaatctgaaaatgatgtgattttgatcgagggtgtcgatttttgtttttgtttttttatgtttgattgttggtttgctcaagaattggacaaaaaatgaatttagttatttggtggg

SEQ ID NO: 2525 - DNA, 364 bp, Orobanche aegyptiaca
tcggcagccgaagaagccaccccaagaagttctaagagaaatcagccaaacaatcatgggtaaggtgcacggatcattggctcgtgctggtaaggtgagaggacagacgccgaaggtggcgaagcaggacaagaaaaagaagccccgtggtcgggcccacaagcggatgcagtacaatcgccgtttcgtcaccgctgttgttggctttggaaagaagagaggaccaaactcatctgagaaatgaagtggagcaagtttaaaatgttgttcttttttggttgttgtattgttttgaacgcatttgctgatttttcttcagtataagaattgaatcatcagttgataaaatttgaattagctattt

SEQ ID NO: 2526 - DNA, 267 bp, Orobanche aegyptiaca
gttccagatctgaaaaatcaaccatgggaaaggttcacggatcattggctcgtgctggtaaggtgagaggccaaacacccaaagtcgccaagcaggataagaaaaagaagccccgtggccgcgctcacaaaaggatgcagtacaataggcgtttcgttactgctgttgttggctttggcaagaaaagaggaccaaactcttctgagaagtaaattcagaaatgggtagaatttgtttagcttttctgaattgttatttttatcgtgc

SEQ ID NO: 2527 - DNA, 570 bp, Carica papaya
actcccgagtttctcactataaatatttaccaaaaccctaaccggggatctgtcacgcgaaagcaacatgggtaaggttcatggatctctggctcgtgctggtaaggtgagaggccaaactcccaaggtagcgaagcaggacaagaagaagaagccacgtggccgcgcccataaaaggatgcagtacaatcgacggtttgtcaccgcagttgttggttttggcaagaagaggggacccaactcatctgagaagtagggcgtagcttgttgagagttttgaggaattaatttatctttttcctctttctttttctttattgtactgctttttaagactggtattaagtgctgaactgcttagtctactaagataagattcaatgtgattttatcaccatggtgaactgtgctatattttgtctgcttttagcttcgatgttacgatcacacttgctacactgaattctgtcatgttatatgtgtttttgacagtcctgtaataaggatgaatttgttaaggaaactcacaaaacatagtagtgacatagccaaaatggctatggttgatta

SEQ ID NO: 2528 - DNA, 501 bp, Arachis hypogaea
gcagagtacggggggctcttttctgctcatagccgctgcaacaaacaaaagaagagcaggacagaaccactcagctccgaatcacaacgcaaacaaatcatgggtaaggttcacggatccctagctcgtgccggaaaagtcagaggtcaaaccccaaaagttgcgaagcaagacaagaagaagaagccacgtggacgagcacacaagcgcatgcaatacaatcgccgattcgtcaccgccgtggtgggattcggaaagaagcgaggaccaaactcatctgagaagtaagggagatgatgcttgaaggatggttttatttttatttttaattttattagtttgcgagatgtattgcttgtttatcagttgattggtggatttaaagatgttgaagttctgattatggttcaacgaaagagtttttttgggctaatattgaactatgttccccctttaagatttttgctagttaaagcagagcttatcttggtgttcaaaaaa

SEQ ID NO: 2529 - DNA, 433 bp, Arachis hypogaea
caacgcagagtacggggggaagattgccgcagcaagtgaccgaccgaccgagtggaagcaggagagaacttcatcgtcgcaacaatgggtaaggttcatggatcacttgcacgtgcgggaaaagtgaggggtcaaactcccaaggttgctaaacaggacaagaagaagaagccgcgtggccgtgcccacaagcggatgcagtacaatcgccgattcgtcaccgccgtggttggattcggcaagaagaggggacccaactcgtccgagaagtgagagtaacatgcttcttcaatcaacgtcttccttagatttaaatttatgtcgctagttacttttttttacccctcttaatcaagttaatgttttgattatgtactttgaacgatgtgtttttgttactagtttaatataaaaccatattttattttgcaca

SEQ ID NO: 2530 - DNA, 565 bp, Capsicum annuum
tagcagactcactacctgaaacatcacaattttcagaagcattttcactgtcctctgatgttccctgagcactcgcttccccttcatcatcagcatcattcgcacatcctccgactctaccacgaatttcttcttctccacgtccaccttggtacagcttaccagagctttacaaccggcgccggcgactcagtaatcagccatgggtaaggtacacggatcactagctcgtgctggtaaggttagaggacaaactccaaaggttgctaagcaggataagaagaagaagcctagagggcgtgctcacaagcgtatgcaatacaatcgcagattcgttactgctgttgttggcttcggaaagaagagaggaccaaactcttctgagaagtagatgagggcaacagttactttaagccgggttcaagagtgtttcgcttatgttttgtttgtaaattttgattctcagacctcgtaatgtgagaagactagtttactaccaccatttaggatgggacgaatacatctgttttgccagagttaattgaattttattaaactattttca

SEQ ID NO: 2531 - DNA, 399 bp, Cajanus cajan
cggggggattggtagccgctgcagctgagagagaaagaagagagagaagcagcaattcatcagaatgggtaaggttcatggatctctcgcacgtgcggggaaagtgagaggacaaacccccaaagtggcgaagcaagacaagaagaagaagccacgtggacgcgctcacaagagaatgcaatacaaccgccgattcgtcaccgccgtggtgggattcggaaagaagcgtggaccaaactcgtcggagaagtgagggagacgtgtggaaaatggtttttcttagtttgcaaaatgtatcacttgtttttatttgattgatgaactcaaactttgatagttatgattgaggttcaatgaaggagttttttgctagttaatatcaaactaatatgattcttc

SEQ ID NO: 2532 - DNA, 734 bp, Cajanus cajan
gtgatcgaagcgataggagagtaattagcagaaaaattcatcgtcgcagtgatgggtaaggttcacggatcactcgcacgtgccggtaaagtcaggggccaaacccccaaagtggccaagcaggacaagaagaagaagccacgtggccgcgctcacaagaggatgcagtacaatcgccgattcgtcaccgccgtggtgggattcggcaagaagagaggacccaactcatctgagaagtgaggctgaggcttgaagaatatgttactactctataattgatttatctttcttgttttatcatttgtatgttttgattgttttctgtgaacggattttttgttagctttatatcaaactagaattttggcatgcaattctaatcctatatatcaatcagttcattgctcggttcaataggggaaagtaattacattgatgttgttcaagcaaaagacttatgttactttagggtgatgttcttaccaagtaagtgcgtttatgattcggtgcccattcaagacatgcatgaccaggtgagttctgcctttgagaatgttgcatttgcacatacttagataaaattatgaatttcgagtttctagctgtttggaatgttatatcatcccctgtgtctacagcaaggttgagaagcagactaaccctatattggatgcccatagtagtttttcatatctacgcctcaaatctcaacctatgtccttatttggttctcc

SEQ ID NO: 2533 - DNA, 521 bp, Populus trichocarpa
gacaaagcccagcatgaagcaaacccattcattaacgtcatatatttaagagtttggctgtaaaagcaaaccctagctgcttcttgaggctaaaccatcttctcgccgcttagaagggacaaaaacagcagcagcaagtcatgggcaaagtgcatggttctttagctcgcgctggtaaggtgagaggccaaactcccaaggtggcaaagcaggacaagaaaaagaagccccgtggccgtgcccacaagaggatgcaatacaaccgccgttttgtcacagccgttgtgggatttggcaagaagagagggcccaattcctctgagaagtaaagcttgagagaatgaggagatgaagaaacattcatttgattttggatgaactatgttgtttttcttttctacaatactactgcttttagtttttaatctcaactgtcagactatgtggagcatctgctctctttttgttaagtagagatgatttgatttcttttttattaaatatgtgtttcttcaaattca

SEQ ID NO: 2534 - DNA, 526 bp, Populus trichocarpa
cctttaaatacaactcgcccgcatcgaaaaccctaaccccaaaatccacacgcacagagcgcagcctctctcccattcacagcagtaggcaaagaagaagaatatctaacaatcatgggcaaggtacacggatcgctggctcgtgcagggaaggtgagaggtcaaaccccaaaagtggccaagcaagataagaagaagaagcctagaggccgtgcccacaagcgcatgcagtacaatcgccgctttgtcaccgccgttgttggatttgggaagaagcgtggaccaaactcttctgagaagtaagcatgcacctgagggagtttttgctatatagactgcttaagtttcctggacaactgtatttggatgcttagatttacattatcggttgtcatttctagtagttccattttgttttagcagcaatgttattgtcttaaaggagtgaatctgttggatctttctttgtttgaagagttcttttggttgcattaatttgaaaacataatatcttcattcctctcta

SEQ ID NO: 2535 - DNA, 456 bp, Populus trichocarpa
ggctgcgaagataaaaccctagctgctccgtgaagtcgagccatcttctcgccgcatagaagggaaacagcagcagcagtcatgggtaaagtgcatggttctctagctcgtgctggtaaggtgagaggccaaactcccaaagtggcaaagcaggacaagaaaaagaagccccgtggccgtgcccacaagaggatgcaatacaaccgccgtttcgtcacagcagttgtgggatttggcaagaagagagggcccaactcctctgagaagtaaagcttgagagaatgagaagatgaagaaacatttattggcttttagatgaagaaacattgctgtttttcctttctaattatgacaatgttactgcaggttgcttttagtagttgatattaactgtcagactatgtggagcatctgccctttttgttaattatagatgatttgatcttcttttcatta

SEQ ID NO: 2536 - DNA, 563 bp, Papaver somniferum
agaagacgaagttccaccctccacaaatcttcaatcatgggtaaggttcacggatctttggctcgtgctggtaaagttagaggacaaaccccaaaggttgctaaacaagacaagaagaagaagcccagaggtagagctcacaagaggatgcaatacaacagacgtttcgtcactgctgttgttggctttggaaagaagagaggacctaactcttcagagaagtaagctggagacacaatgtgaggagttataggtgtagggtagctgctgtattttcttatgccgtgattaagtttgtttttcccgaatgacagaatttcttttgttgaatcacttcgatgcttaagggtcaactctttggtgaattcatgtgaaaatccaactttagaaggaggtttattaagaagctttattacattactgtttgtgttttgggttcgaatcaatctttaactctctgttggaggaaaaactgtgctggataatctatagccaataccagaagcaggatttagtaaccctggtaattggttcgaatcaatcggttaaaaaatataagttgg

SEQ ID NO: 2537 - DNA, 1257 bp, Solanum tuberosum
ctttgcactgctctccataatctcaatcttcaatctcctctaactcactataaagttgttgatggcttcagcttctccttctcaagctagtcttctacttcagaaacagctcaaagatctctgtaaaaaaccagttgatggattttcagctggtttggttgatgaaagtaacttattcgaatggagtgtcaccattattggacccccggaaactttatatgaggggggtttctttaatgctatcatgagctttcctcaaaattatcccaacagtccgcctacggttaaatttacctcagaggtttggcatcctaatgtttactctgatggaaaggtctgcatctcaattcttcacccccctggtgatgatccaaatggttacgagcttgctagtgagcgttggtctcccgtccatacggtggagagcataatgttgagcatcatatcaatgctttcaagtcctaatgatgagtctccagctaatgtcgaagcagctaaggaatggagagacaacagagatgaattcaagaaaaaggttagtcgttgtgtaagacggtcccaagaaatgacgtaaaactaacttctttcgtcatcagctgtcgattgatacaaatgtagaattgcttgtcaaggtcatacctctctgtatttcgttccgcgaattcggtcattgttttgcattttttgttataacataagttttgaggttcattatttcatagctctaaagatgtttactgctggtctcacattgtctgtattttcctttgtagtctactagatattaatgtacatctcagaaatgagctaaatgaatctttcttatacttcgattatcatattaatttgttgtaaaacccaaacgattcgcagcttctccgacgaccggcgactcagaaatcaaccatgggtaaggttcacggatcacttgctcgtgccggtaaggttagggggcaaacaccaaaggttgcaaagcaggataagaagaagaagccaagaggacgtgcacacaagcgtatgcaatacaatcgcagattcgtcactgctgttgttggctttggaaagaagagaggaccaaactcttccgagaagtagacgatgacttcagttattttaggttgagaagttgttttcatctttgtgatgtttataaattttgattctcaaacctcataatgagagaagactagcttattactggtgtttgtaggatgaatgattacgttctgttttgcaagaattaattgaattttatcc

SEQ ID NO: 2538 - DNA, 486 bp, Solanum tuberosum
accggcgtctcagaaatcaaccatgggtaaggttcacggatcgcttgctcgtgctggtaaggttagagggcaaacacccaaggttgcgaagcaggataagaaaaagaagcccagaggacgtgcacacaagcgtatgcaatacaatcgcagattcgtcactgctgttgttggctttggtaagaagaggggaccaaactcttctgagaagtagatgaggacatgagttacttaagccagagaagttgttttcacctttgctttgtttgtaaattttgattctcagacatcataatgggagaagactagttttactactggtatttgtaggatggatgagtacttttgttttgcaggaaattaattgaattttatctcgtctattttatactttatcaaaatcattttaattcattgttcgactttcttgatgttattgttattgcttttgctattttaaatatataaacatggtggagctgttttctg

SEQ ID NO: 2539 - DNA, 450 bp, Prunus persica
aacgcacacacacagcttccatctctctcattctctctgacggcaagagcagcttctacgatcagccatgggaaaggttcacggatcgctcgcacgtgccgggaaggttaggggccagaccccaaaggttgccaagcaagacaagaagaagaagcccagaggccgcgcccacaagcgtatgcagtacaacaggagattcgtcacggccgttgttggattcggaaagaagagggggcctaactcttccgagaagtaaggttgctctatgaggacttttgctgcttttcttatgaggcattagtttcattttgaagtacggattttgtagtcaaactatggtttagattttctactggctctgtttaattgtttggattggaaaatgcttattaatatgtgctactgttgaccacattattgtgtgctattgttcttcctaagttttgatct

SEQ ID NO: 2540 - DNA, 568 bp, Prunus persica
atgacaccgacattagaaacacaaggatcaatatcaacaaaaaccctagcgctcgcctctttaccgccgtgctgttttcttgtcttcttcaagctctctcattttcgcgatctcgtctgcaaatacaaacaccacctcaaagctctttcaagctcttagtaaggaaccatgggaaaggttcatggatctttggctcgtgctggtaaggtgagaggccaaactcccaaagtggctaagcaagataagaagaagaagccccgtggacgagcccacaagcgcatgcaatacaaccgccgattcgtcaccgctgtggttggcttcggcaagaagaggggacccaactcatctgagaagtagacagagcttttgagaagatgagaagcaattcgtagattaagaaaaaggctttatttttatttctttttatcattatgtcattatcaattcaagacccccaaatgctggtttggtagttcgtagagagatttgaaagtttttttttggaatttgtgctctatttgaattatcagtaatgtgattttgtttctgggtttcttgtttcaaatta

SEQ ID NO: 2541 - DNA, 537 bp, Oryza sativa
tctagggcttcgtctcatcacaccagccgccgctgccgcctcgtcgtcccaaatcgtccgagcgccgccgccgccgccgccgccatgggtaaggttcacggctcgctggctcgcgccgggaaggtgagggggcagacgccgaaggtggcgaagcaggacaagaagaagaagccccggggccgcgcccacaagcggatgcagtacaaccgccgtttcgtcaccgccgtcgtcggcttcggcaagaagcgcgggccaaactcctccgagaagtagatctagagatcgctcctttgcccccgtctcattaattaatactcatggatccctttttttgtttgttccctagtagttttttgttcaagtatgcaatttttggtattgaactgatgtcactgtaatacctatgatatctctatggatggtgttaagatcttatcgtcaagtgttcatcttttacttgttacacgatgtggtttgtctgatatagattgattgttgtgatgcttatcagcttatggtgttatatgcagttgttca

SEQ ID NO: 2542 - DNA, 583 bp, Oryza sativa
cctcgcctagggtttcctctcccgtctccgcgctcgccgccgccgccgctcctcctccgcgccctcgaagccgccgccgccgccgcagcctcgccgccgtcgacatgggtaaggtgcacggatcgctcgctcgcgccgggaaggtgcgcggccagacgcccaaggtggcgaagcaggacaagaagaagaagccccgcggccgcgcccacaagaggatgcagtacaaccgccgcttcgtcaccgccgtcgtcggattcggcaagaagcgcgggcccaactcctccgagaagtagacgcgccgggccgctccgccggtgatgtcccgtttgttcttggtagtagtttccttttaagtgctatatgcaagaaaacaagaagggggaaccaatcttttgtagcgtgtgagctcgatgctcgtgtgatttggatcgaactcaaaagtgcttagtcttattatgccgcatgttaagtttgagatatgatatgagctcgtgacttaattttgcttaatgtttaccctcttttatcttctatcaattgtgactaattcaaatctgtgcttgtgttcgtccttgcgttgtga

SEQ ID NO: 2543 - DNA, 438 bp, Rosa hybrid cultivar
gaaatcgtagaagcggagcctccatctcttgttgagtttcttctgtgccggcgagagcagcgtctacgatcagctatgggtaaggttcacggttctttggctcgtgccggaaaggtgagaggccagaccccaaaggtggccaagcaggacaagaagaagaagcccagaggccgcgcccacaagaggatgcagtacaacaggagattcgtcaccgccgttgttggattcgggaagaagaggggccctaactcgtctgagaagtagggttgcaatgtgagcacttctgctggtttctcatggggcaatagtgtctttttttcaatttttcttttgtagcaataaggatggtttaagtttgtacttgttttgctgaattatcttagaagcgatgttcttaatgtccgaaattgtgagattcttatgaatatgtgctacttt

SEQ ID NO: 2544 - DNA, 458 bp, Rosa hybrid cultivar
gattgcaacagcgccgttcactcttctcgtgatctcaagcaactgctccactctcccatctctctcaaactctcgtaggcaatcatgggaaaggttcatggttctttggctcgtgctggtaaggtgagaggccaaaccccaaaggtggccaagcaggacaagaagaagaagccccgtggacgcgcccacaagcgcatgcaatacaatcgccgtttcgtcaccgctgtggttggctttggcaagaagagaggacccaactcatctgagaagtagagaagctttgaaaggatgaagaactcttagtagtttaagaatgctttagttatattgaatttttatgtcatttttcaaagacccttaatgctggttgctagttaatagagattcaagtattgggcaatgttggatttttgtgttctggatccgatttacttggaagtaatgtgattttgtttctg

SEQ ID NO: 2545 - DNA, 434 bp, Salvia sclarea
ctgcaggaattcggcacgaggtctcgctctagcgatctcaaagaaatcaatcagccatgggtaaggtccacggttcgctagctcgcgccggaaaggtgagagggcagacgcccaaggtggcgaagcaggacaagaagaagaagccccgcggccgcgctcacaagcggatgcagtacaaccgccgttttgtcacagccgttgttggctttggaaagaagagggggccaaattcatctgagaagtagaggggtgcagtgattagtttataagcgaacaagtttgaaacctcggttaattggtttgattatatgttgtagtgatgcaagtgactgtgttaagcctttgtcccatccttttgggattcaactcttgaaacattactgctgaatattgagtatactctttgtttgattacttttgagatgtgagtaatg

SEQ ID NO: 2546 - DNA, 413 bp, Sesamum indicum
ccgtttcggagaaatcaatcagtcatgggtaaggtacacggttcattggctcgtgccggaaaggtgagagggcagacccccaaggtggcgaagcaggataagaagaagaagccccgcggccgtgcccacaagcggatgcagtacaaccgccgtttcgtcactgccgttgttggcttcgggaagaagaggggaccaaactcatctgagaagtagagtggaaggacctctagtttctgtaggtgaacaagaatttcagacctggattgactgtttcttctatgatgctatagtgtttctaggtcatggattgagctgtttttgcagttgtttttggattttgatatatttactgcatattgtggagcataatcgagttgttaatttcgaaattgaagttaagaaatctttaattc

SEQ ID NO: 2547 - DNA, 414 bp, Solanum phureja
taaccctagcattcgaaccttcagaccggcgtctcagaaatcaacaatgggtaaggttcacggatcgcttgctcgtgctggtaaggttagaggtcaaacacccaaggttgcgaagcaggataagaaaaagaagcccagaggacgtgcacacaagcgtatgcaatacaatcgcagattcgtcactgctgttgttggctttggtaagaagaggggaccaaattcttctgagaagtagatgaggacatgagttacttaagccagagaagttgttttcacctttgctttgtttgtaaattttgattctcagacatcataatgggagaagactagttttactactggtatttgtaggatggatgagtacttttgtttttggaagaattaattgaattttatcccgtcttttttgtactt

SEQ ID NO: 2548 - DNA, 445 bp, Solanum phureja
tagtattccaactttcgcagcttccaaacgatttgcagcttctccgacgaccggcgactcagaaatcaaccatgggtaaggttcacggatcacttgctcgtgccggtaaggttagggggcaaacaccaaaggttgcaaagcaggataagaagaagaagccaagaggacgtgcacacaagcgtatgcaatacaatcgcagattcgtcactgctgttgttggctttggaaagaagagaggaccaaactcttccgagaagtagacgatgacttaagttattttaggttgagaagttaccgcttcaaaagttttcatctttgtgatgtttataaattttgattctcaaacctcataatgagagaagactagcttattactggtgtttgtaggatgaacgattacgttctgttttgcaagaattaattgaattttatccttccgtctttt

SEQ ID NO: 2549 - DNA, 615 bp, Sorghum bicolor
cgccaccgccaccgccgcaacagctcgagtcgctcgtcagatcctccgagcaccacagctccggctccgcccccgtcgccatgggtaaggttcacggatcgttggcccgcgctgggaaggtgcgtgggcagacgcccaaggtggcgaagcaggacaagaagaagaagccccgcggccgcgcgcacaagcgcatgcagtacaaccgccgcttcgtgaccgccgtcgtcggcttcggcaagaagcgcggccccaactcctcggagaagtagatctagctatggcttgtgtttttgttccccactagtttctttgtactgatcgcaagttgaagacttgtgctattatctgtatcgatgttactgcaatactatcaagtatgatgctgttactgcaatactatcaagtatgatatgcatcgtttagttgatcaagttgcctgtggtgtttatctttttggttttgaatggtggaagcatgttctgctgtgtcttgttttgaacatctaattcgcttgttttatgatatgcattgtttagttgatcaagttccctgtggtgatctttttgtttatctgaatgttggaaacatgtgtcgttctgtgtgtcttgttttgaa

SEQ ID NO: 2550 - DNA, 695 bp, Sorghum bicolor
ttcctcttccctcttacagccgccgccgcatctcccagcctccccgcgctcgcctccgtcgccgctgccgccgccgtttcgcagccatgggtaaggtgcacggatcgttggcccgtgccgggaaggtccgcgggcagacgcccaaggtggcgaagcaggacaagaagaagaagccccgcggccgcgcccacaagaggatgcagtacaaccggcgcttcgtcaccgccgtcgtcggcttcggcaagaagcgcgggcccaactcctcggagaagtaggcgccgcgatgcgacgccgttcggctcgtaccggttcctcaccctttccgctctcagtttgcttatgctcttgctggtagtagtttcgttgtgcaagcagaggaagaaccttttgtagtttcagcttcgttgttcgtgtgatgagatgggaactcgagattatatatgtccctcgttattaagaatttgagatatgatgatatgagccaatgactttattttgcttcgttgttgtgccttttagttgtctttgtgaatgttatgcaaacaactgagctggatcattaggctatgggtctcatggctacctgacagcaataatttgttgcttaggccttgcattcctcgcttgattgacgaatcagctgtttgtcaatcagtattgcagacgtagtataaattttaatggtgtcccaattt

SEQ ID NO: 2551 - DNA, 663 bp, Sorghum bicolor
ttcctcttccctcttacagccgccgccgcatctcccagcctccccgcgctcgcctccgtcgccgctgccgccgccgtttcgcagccatgggtaaggtgcacggatcgttggcccgtgccgggaaggtccgcgggcagacgcccaaggtggcgaagcaggacaagaagaagaagccccgcggccgcgcccacaagaggatgcagtacaaccggcgcttcgtcaccgccgtcgtcggcttcggcaagaagcgcgggcccaactcctcggagaagtaggcgccgcgatgcgacgccgttcggctcgtaccggttcctcaccctttccgctctcagtttgcttatgctcttgctggtagtagtttcgttgtgcaagcagaggaagaaccttttgtagtttcagcttcgttgttcgtgtgatgagatgggaactcgagattatatatgtccctcgttattaagaatttgagatatgatgatatgagccaatgactttattttgcttcgttgttgtgccttttagttgtctttgtgaatgttatgcaaacaactgagctggatcattaggctatgggtctcatggctacctgacagcaataatttgttgcttaggccttgcattcctcgcttgattgacgaatcagctgtttgtcaatcagtattgcag

SEQ ID NO: 2552 - DNA, 507 bp, Euphorbia esula
caattgcaaagctaactgcttccctgccggcgagtactacaaagcaataaccagcaaatcgatcgatgggaaaggttcatggatccctggctcgtgccgggaaggtgagagggcaaactccgaaggtggctaagcaagataagaagaagaagcccagaggccgtgctcataagcgtatgcaatacaatcgccgattcgtcaccgccgttgttggctttgggaagaagcgaggacccaactcttcagagaagtaaaaaatcaaatcctgcagatctcatgacaatatgtaatctttttttaggttctgttatgcaacttctatttgagcttgaaagattttgttatatgagaatgtcactttgaagaaagtggaatcttgatccacttattttgactgcactattagtattattactactttgtaagcaatttgagatgttagttatggaatgatgggttgtttaagttattctattgcgccaccgatttgagtgtgaatgttttatc

SEQ ID NO: 2553 - DNA, 631 bp, Fragaria vesca
gtgctcgtgaaaccctaaatcgtagaagcttgagcagcacagcctccatcgttttttgagtttcctctaccggcgagcgactacgatcagccatgggtaaggttcacggttcattggctcgtgccggaaaagtgagaggtcagactcccaaggtggccaagcaggacaagaagaagaagccgagaggccgcgcacacaagaggatgcagtacaaccggagattcgtcaccgccgttgttggattcgggaagaagaggggacctaactcatcggagaagtaggttggatctgtgagcacttctacatgaggcaatagtgtcattttcgaatttttaaccttttcgtagccaaaggatggtttaaatttgtacttgctttgccgaattatcttagcgcaatgtttgaattgtgagattttatggatatgtgctactttgactacatgcttgtgagctattctgttttggttcaagttatatctcttgcttcactgctttcattgctagaataaatgtggtatcaatgtcaattttacagatatgtagtattagaaagagtagggctgtttgctgtgtcaagattagtacattttcgtttaagtaataattcaatgaacttatcaacctatcaa

SEQ ID NO: 2554 - DNA, 529 bp, Fragaria vesca
accttgcaaccgcgccgtttcactcttctcgcgatctcaaagcaactgcgctctactctccagcaatctcaagctctcgtaggcaatcatgggaaaggttcatggatctttggctcgtgctggtaaggtgagaggccaaaccccaaaggtggccaagcaggacaagaagaagaagccccgtggacgcgcccacaagcgcatgcaatacaatcgccgtttcgtcaccgctgtggttggctttggcaagaagagaggacccaactcatctgagaagtagagatatgctatgaaaggatgaagaactcttagtagtttaaggatgtttttagttatattgaattccatgttatttttcaagacccttgatgctggttgttagttaatagagattggaaaatgttggatattttgttctgaatctggttgacttggaagtaatgtgattttatttctggatttatcatgttccgagtttatgctatttcttgttgattttgtgatttttgcttgttttgaatgtgtgcggatc

SEQ ID NO: 2555 - DNA, 475 bp, Saccharum officinarum
cgccgccgccgcttctcccagcctccccgcgctcgcttccgtcgccgcctccaccgccgcttcgcagccatgggtaaggtgcacggatcgttggcccgtgccgggaaggtccgcgggcagactcccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgcgacgcgacgccgttcggctcgttccggttcctcatcctttccgctctcagtatgcttatgctcttgctggtagtactttcgttgtgcaagcagagagagaaccttttgtagtttcagtttcgttcatgcgatgagatgggaacttgagattatatgtctacctcgttattaagaatttgagatatggtgatatgagccaatgactttatt

SEQ ID NO: 2556 - DNA, 602 bp, Camellia sinensis
tctctctctctctctcgcgcgcgcacgaagcctccagtcaaagatacaacacaaccatgggtaaggttcatggatcactagcacgtgccggtaaggtgagaggccaaactccaaaagtggccaagcaggacaagaagaagaagccccgcggccgtgctcacaagcgtatgcagtacaatcgccgcttcgtcaccgccgttgttggcttcggaaagaagaggggacccaactcttctgagaagtaagctcactctaatgagatttaagctctagacatgtgtagttttagtctgttttggttcttgaatgaactattggtttgcaatatgtgatagtgttcttaattcccagcttttgctatcgttgcaattttctatttttactgaactaagttgaatttattattaccttgttaggtaaaaaaattttttttgaagttttgtgtttcattgtgttttgagttgaagttttcaacgggtttgatcctttattatgtttgtctcaatggaacaattttgaggattaaatttgccccggtcaatacatgttatctgtagtcactaatgatcttgagaatgcaatgatggtggagtacctttcgc

SEQ ID NO: 2557 - DNA, 446 bp, Nicotiana tabacum
catttctaactttcgcagctcgagacaaccccaatttctccggcgaccagcaaccagcaaatcagccatgggtaaggtacacggatcattagctcgtgccgggaaagtgagagggcaaacacctaaggttgctaagcaagataagaagaagaagccacgcggacgtgctcacaagcgtatgcaatacaacaggcgatttgttactgctgtggttggtttcgggaagaaacgagggcctaactcctcagagaagtagatgaggacgtccattgttgtttttcaagaatttgtcaccttgttttgtttgtaaattttaattttgggacctgataatcggaaaactagtttatgacttgtttttgtaggaccaatgaatgtttgatgttttgaaagtatttgaatttcagccatgctatcttttattgattatatcatcttattcatga

SEQ ID NO: 2558 - DNA, 474 bp, Nicotiana tabacum
cattacggccggggaacccaagcatttctaacctttgcagctccaaacactcccaatttctccggcgaccagcgactcccaaatcagccatgggtaaggtacacggatcattagctcgtgccgggaaagtgagagggcaaacacctaaggttgctaagcaagataagaagaagaagccacgcggacgcgctcacaagcgcatgcaatacaacaggcgatttgttactgccgtggttggtttcggaaagaaacgagggcctaactcctcagagaagtagatgaggacgtccattgtggttcaagaattttgtcaccttgttttgtttgtaaaattttaattttgagacagaaaactagtttaatgacttgtttttatagaaccaatgaatatgtgatgttttgaaagaatttgaatttcagccatgctatcttttattgattatatcatcttattaatgacttgaatattgtgtc

SEQ ID NO: 2559 - DNA, 411 bp, Solanum lycopersicum
taaccctagcatactaaccttcgtaccggcgtctcagaaatcaacaatgggtaaggttcacggatcacttgctcgtgctggtaaggttagagggcaaacacccaaggttgcgaagcaggataagaagaagaagcccagaggacgtgcacacaagcgtatgcaatacaatcgcagattcgtcactgctgttgttggctttggtaagaagaggggaccaaactcctctgagaagtagatgagaacttgagccagagaagttgttttcacctttgctttgctttgctttgtaaattttgattctcagacatcataatgggagaagactagtttactactggtatttgtaggttggatgagtacttttgttttgccagaattaattgaattttatcctgtccttttttatacttt

SEQ ID NO: 2560 - DNA, 447 bp, Solanum lycopersicum
aaccctagaatttcaacttccgcagctcccaaacgattagcagcttctccgacgaccggcgactcagaaatcaaccatgggtaaggttcacggatcacttgctcgtgccggtaaggttagggggcaaacaccaaaggttgcaaaacaggataagaagaagaagccaagaggacgtgcacacaagcgtatgcaatacaatcgcagattcgtcactgctgttgttggctttggaaagaagagaggaccaaactcttccgagaagtagatgacgacgactttagttattttaggttgaggagttactgcttcaaaagttttcatctttgtgatgtttataaattttgattctcaaacctcataatgagaaaagactggtgtttgtaggatggatgattacattctgttttgcaagaattaattgaattttatcctttggtctttctactg

SEQ ID NO: 2561 - DNA, 373 bp, Juglans hindsii x Juglans regia
gctctctctagcatcaaccatgggtaaggtacacggatctctggctcgggctggaaaagtgagaggccaaactcccaaagtggccaaacaggacaagaagaagaaaccccgaggacgcgcccacaagcgcatgcaatacaatcgccgattcgtcaccgccgtggttggattcggcaagaagaggggacccaactcgtcggagaagtgatgcaattctgagaggacgaggagctctttaggttaaagatttgtttttcttttttcctttcttcttttggtaaatgaatttaattctggtgctctgctggattatcattatgttggggatttctcttatttggttaattaacctggagatgatatggtttttcac

SEQ ID NO: 2562 - DNA, 300 bp, Triticum aestivum
  misc_feature (98)..(98): n is a, c, g, or t
ggcacctcgtgccgaattcggcacgagcaaatcgtccgagcgccgccgccgccgccgccgccatgggtaaggttcacggctcgctggctcgcgccggnaaggtgagggggcagacgccgaaggtggcgaagcaggacaagaagaagaagccccggggccgcgcccacaagcggatgcagtacaaccgccgtttcgtcaccgccgtcgtcggcttcggcaagaagcgcgggccaaactcctccgagaagtagatctagagatcgctcctttgcccccgtctcattaattaatactcatgga

SEQ ID NO: 2563 - DNA, 489 bp, Triticum aestivum
cgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactaagtttcgttgttcgcaagcagaggaagaaccttctgtagattcggttttgttgtccatgtgctcaagatgggaacttgagattgtatgaatttgagatatggtgatatgagctgatgattttaatatgcttaatgttgctcctctgagctgttaattttgaacgctatccaaataaatttgaaacaa

SEQ ID NO: 2564 - DNA, 468 bp, Humulus lupulus
cgccggctttctcttgctcggaaacacagagtgtgaagaaagacttaaaagttcaacatgggtaaggttcacggatctttggctcgtgctggtaaggtgagagggccaaacccctaaagttgccaagcaggacaagaagaagaagcctagaggacgtgctcacaagcgcatgcaatacaaccgccgattcgtcactgccgtggttggctttggcaagaagaggggacccaactcttccgagaagtaagattcaaggatgacacctctttaggttattatggaggcatcgttttttggggttttgaccattagttattgagttttaatgttatttttatagaccctttcacttgttatagttatgcttcaattaaattataagtaatgtgaattcgtttttccttgaagaaaatgcagcaatgttattttgaacttattcaaagatgttttcaacttatttagaatctg

SEQ ID NO: 2565 - DNA, 503 bp, Petunia hybrida
taatttcagtatatagggccgacgaatctttactataaagtttcctcgaaaaccctagtccctaaaagcctctcattattgcttattaacagctgcagcatttgctccagatctgagaaaataatcaaccatgggaaaaggtacacggatcattggctcgtgctggtaaggtgagagggcaaacaccaaaggttgcaaagcaggacaagaagaagaagccacgtggccgtgctcacaagaggatgcagtacaatcgccgcttcgtcaccgccgttgttggctttggaaagaagagaggaccaaactcctctgagaagtagatttgagaaatgggtagaatttatcttttgcgattctgaatttcagaggaattgtgattcatgtcatgctatagttttttagtttaaggggtaagcttgtcattcatatcttgtacggttaatgagatttttgaatatgtacaagatagttttgctttgaattaagacttttctttctgttcc

SEQ ID NO: 2566 - DNA, 1519 bp, Amorphophallus konjac
ggtcgcctgctggagtgtcgcgccctgttctcggaaccctagcagccaaatccgccatggggaaggtgcacggatctcttgcccgtgccgggaaggtgagagggcagacgccgaaggtggcgaagcaggacaagaagaagaagcccaggggtagggcttacaagcgcatgcaatacaaccgccggttcgtcactgctgttgttggattcgggaagaagaggggacccaactcatcagagaagtaaaggaagatgcaggtctaatttgtcgatgtaggaagggtgtgttgtttgaggaattacttacttttttctctctactttcttttttgcattgtattatggaacaccttattttgctatggcagactatggtgcatcacctatgctacttataaggtttagtgacaagtttctaggttgatatggttggattcctcttctctatggaaggatgaattgcatttgttttcttgaaattggagagagcatttgaattggtgctaagtttgtgggtatgtctggcgcagctgatgttttaaaacaattggcataagcattctctgcattgatgtcgccaccaaggccttccaaacgacgcagactttatttgtcttgattttttttttaagaaatgcttgatgcaggacaagccatccttagtttaagcatgatttgaaggttctttaatctagcttattctataaccgttaagatggatcctgcatttataaggttgaaggtatgatttctgcagtttctttcttctaaggctgcctccaagctgcggcaagaaacagggcaagccaaaagggtgtttcacaaggttagccttatcggtaatttgtattgactcatgtccaacccacataacaataagacatgggttgacttgagattgactctaaggtcagctctaattggcctagatacgatattgataggtaggggtgtctccgaaaacccgattcgaatctgattttttttcggattcggatcgggctgttgatccacaattttgaatttacgatattttaaggtgaattttctttgatccgaacacagcaacttcgtatcggatttttggggcgccataaaacaccccatttcggggcgatcattgccccgaacgatctttggccttctgcccttccttccttccccgtgtcgaaacccttcctctaggttttctccggcggcggcgatcttgcgacggtgatgcgatctcctaagccagccgcgacgacgacggcgatggcgaccttctcttcgatcggtgaggaagagaaggccagggagagcttggccggagaggaggcggccgggaggcgcggcattctcaggttcctggccctttgagttctcctttgcgagttcttcctccttttttgtctgtggtttctttcggggtgtaaaggggcgtgagcgcgtagatctgcaaatccggaaggtgggttggtgggttcgttgcgggaacccgttgtggtttcaatatcgggtggtttcgtatgtggtcttac

SEQ ID NO: 2567 - DNA, 853 bp, Amorphophallus konjac
aagctcccggcggtcgacaaacccaagcgttcgacccaccatgggcaaggtgcacggatctttggcgcgtgccgggaaggtgagggggcagacgccgaaggtggcgaagcaggacaagaagaagaagcccaggggtagggcttacaagcgcatgcagtacaaccgccggtttgtcaccgcagttgttggattcgggaagaagaggggacccaactcttcagagaagtaatggaaatgtcagtcgatggagccaggcccccacgttttgtgttcgtttgaaatcattacttactgtctctctatttcttttctattgtggattttgatgcatcgcatgcttaccatggcagcgctgtagtgtgcctttttttctcaatagctgcagtttttagcgactatcttctaatgtgatgtcttgttttttttttttgaagaatggatctcattttagttgttatttagcaccatgtggctttgctgcctgattcgtgtgtatgttcttgtgacatctgatatgctaatcgaaatagtaggaaagatgactgtatctttcattattataacactaatcatggtagtgattccctgttgtgggagtgacaaatgtgcgttactagaacatgttgtgctagttgattccccatgaatgttgacgaggatttgatgtatcatgtactgtatcatatccatatgaattgtgcgctttcagaatttgtgtgatagtatgaattatcataatggcttgtgttgtcttggtagtagatgggttgttatgtagtattattcgtacctcttagggcctatactaatggaatagaatttcaattaaaactcttcagctgggccggtatgg

SEQ ID NO: 2568 - DNA, 457 bp, Malus domestica
gtctctttaccgccgcgccgtttacctgttctcctgatcttctctgcaactacaccactcggcaaccatgggaaaggtgcacggttctttggctcgtgccggtaaggtgagaggccaaacacccaaagtggccaagcaggacaagaagaagaagccccgcggccgcgcccacaagcgcttgcaatacaaccgccgattcgtgaccgccgtggttggcttcggaaagaagaggggaccaaactcgtcggagaagtagggcaaagattcaagctttgaaaggatgacaagtgcttcgtagattatgaaaaattaaaggctttgtttttgtttaattgtcgcgcattgttcttaagaccttagtgttggtttgttacttcatacaaagatattttgcaagtgttggattatgttggtatttttttaatccaatttgaattagcagcaatgcgattttgtt

SEQ ID NO: 2569 - DNA, 495 bp, Chelidonium majus
tccagaagccaagaagaaagaagcagccggcagaaatcaagccaaatcaaacatgggtaaggttcacggatctttggctcgtgccggtaaggtgagaggtcaaactcccaaggtagctaagcaagacaagaagaagcagcccagaggtagggctcacaagaggatgcaatacaacagacggttcgtcaccgctgttgttggatttggtaagaagagaggccccaactcatcagagaagtaagccgaaggtgtgaggaattttgtcggtttattggaaggtttaccatcatgcctgcagctatgttgcaagactttgttgagttcatctatattttgatcatgtaggatttaaaagaaagtttctttaatttctgcttatgaatggtttatttttagtttgagacctattttcttgttttagttgttcgatataaatctagtggatgataattacaatagtatgagtagtcactactgattaaaatagtggttgag

SEQ ID NO: 2570 - DNA, 358 bp, Chelidonium majus
ccgccatgggtaaggttcacggatctttggctcgtgctgggaaggtgagaggacaaacaccaaaggttgcaaagcaggacaagaagaagcagcccagaggtagggctcacaagaggatgcagtacaacagacgtttcgtcaccgccgtcgtaggcttcggaaagaagagaggacctaactcatcagagaagtaagctcgaacctgatgggggaaattataggtgtaggatagtgttcctgtttgttacaatcaacttgttccttttttgaaatttctgttttgttggattaattgtttgatactttgtcattcggtacttctgttgttacggagcatagctatgatgaattcatgttc

SEQ ID NO: 2571 - DNA, 445 bp, Euphorbia peplus
  misc_feature (7)..(9): n is a, c, g, or t
ccgacgnnnctttcgccgaacatccggaagaggagaagtcgcttatcagattcgccatgggtaaggttcatggatccttggctcgtgccggtaaggtgagaggccagacaccaaaggttgctaaacaagacaagaagaagaagccacgaggacgtgcccacaaaaggatgcaatacaaccgcagactcgtcactgccgttgttggctttggaaagaagagaggaccaaactcctccgagaagtaagagactcgagaattcggcgtaacagccattttttcatgttatttggagatattttatacttccgatagtacttcttgatgcgcttaagctgatagttgtgtgaacgatgatagtattatttcttttagaggtttttaatttcgtcatttgatgcttctcttgcgttttagttttgttgtttcacaatgagatgagtatca

SEQ ID NO: 2572 - DNA, 644 bp, Setaria italica
gcaaaattcccacctcatatagctcggaaatcttgcgcttccccttctccgccactcccgcacccgccgccgcgccagcagtaaaccctagccccgtccgccaccgccaccgcagcagccacagccatggggaaggtgcacggatcacttgcgcgcgcggggaaggtgcgcgggcagacgcccaaggtggcgaagcaggacaagaagaagaagccccggggccgcgcctacaagcgcatgcagtacaaccgccgtttcgtcaccgccgtcgtcggcttcggcaagaagcgggggcccaactcctccgagaagtagatcgcctgcaggttcacataagggggtcaagattatgattttctcttatgggtttaggatgatgtatgaggaaaagaaacttgagatcgcattttggttgatgttgatggattgtgtgcctacttgaatcctccctacattatcatttccagtaatgttatcgtcctgtgcgtttctctcatatatatctgtttcagctgagatcctaggacacaataataagatgtgtggtttttctgggttttactaagtagaatttgtgcgcttgaactggtttgtgtgctgaaacagttgttagaattgcaaaaaaataataaattgtgtagtat

SEQ ID NO: 2573 - DNA, 551 bp, Humulus lupulus
aaacactcgaatataacctttgctactctcttccacacggcgattttgctcatcgttcactcgttcgctactccgaggaaagcttagaagttcaccatgggtaaggttcacggatctttggctcgtgctggtaaggtgagagggcaaacccctaaagttgccaagcaggacaagaagaagaagcccagaggacgtgctcacaagcgcatgcaatacaaccgccgattcgtcactgccgtgattggctttggcaagaagaggggacccaattcttccgagaagtaaggtagcggtttctcaaagatgacacctctttaggttattatggaggcatcgtttttttgggtttttgaccatttgttattgagttttcatgttatttttaaagacccatttactttgttactggattatgctttaattaaattagaagtaatgtgaattcgttttttatttaaaattgttaaacatgtgacactaaaggtctttattaagataaaagattttggagagttcttgctaagaaatcaaaattaagggacttagtttac

SEQ ID NO: 2574 - DNA, 366 bp, Phalaenopsis aphrodite
ttcattgtttgccatgggaaaggtgcacggatctctggctcgcgctggcaaagtgagggggcaaacgccgaaggtcgccaaacaagataagaagaagaagccgagggggagggcctacaagaggatgcaatacaatcgccgcttcgtcaccgccgttgttggattcgggaagaagaggggacctaactcgtctgagaagtaaagattgggactgcaaagtttgtaggagtaaatttctgatttttgtttgtttttaagtaatttgtggcgtttaccttatttcgttgatgctgttcaaaacttcgagtatgaattaacattgtatatgaatttctttcgtattctaggcatgagatgttataaatt

SEQ ID NO: 2575 - DNA, 353 bp, Phalaenopsis aphrodite
tacattgtttgccatgggaaaggtgcacggatctctggctcgcgctggcaaagtgagggggcaaacgccgaaggtggcgaaacaagataagaagaagaagccgagggggagggcctacaaaaggatgcaatacaatcgccgcttcgtcaccgccgttgttggattcgggaagaagaggggacctaactcgtctgagaagtaaagatcgggattgcaaactttgtaggagtaaatttctgatttttgtttgttttttaagtaatttatggcgtttaccttattttgttgatgctgttcaaaacttcgagtatgaattaacattgtatatgaacttctttcgtattctatgcatg

SEQ ID NO: 2576 - DNA, 290 bp, Phalaenopsis aphrodite
gtttgccatgggaaaggtgcacggatctctggctcgcgctggcaaagtgagggggcaaacgccgaaggtcgccaaacaagataagaagaagaagccgagggggagggcctacaagaggatgcaatacaatcgccgcttcgtcaccgccgttgttggattcgggaagaagaggggacctaactcgtctgagaagtaaagattgggactgcaaagtttgtcggagtaaagattgggactgcaaagtttgtcggagtaaatttctgatttttgttgttttaagtaatttgtgg

SEQ ID NO: 2577 - DNA, 411 bp, Pteridium aquilinum
ctcaccgccagaagccaaccgaggagatcaaagaacagccgcagccatgggtaaggttcacggatctctagctcgtgctggtaaggtgagaggccaaactcctaaagtggcaaagcaagacaagaagaagaagccccgcggccgcgcttataagaggatgcaatacaaccgccgtttcgtcaccgcagtggttggatttggcaaaaagaggggacctaactcatctgagaagtaagaactgtgaaggtgaagaaggcaagaatttgctagctttgatggattaattaagtcttggttattttgtaatgttttgtgatacttatttttagctactggtgtcaaggattgagatgaactttcattttgttagtctagagatgatgatgtgattttgttcattaattatgttaa

SEQ ID NO: 2578 - DNA, 481 bp, Sarracenia psittacina
aaacgaaggagtaacagaaatttgagctaagagaacagagaattggccatgggaaaggttcacggatcgctggctcgtgctggtaaggcgagaggccaaacccctaaggtggcgaagcaggacaagaagaagaagcccagaggacgtgctcacaagcggatgcagtacaaccgacgtttcgtcaccgccgtggttggctttggaaagaagaggggacccaactcgtcggagaaataagctccactaatgggtagctttacaggcaaaggcttattggttttttgaatgaattactggtttccagcatgtgatagttcctttatcacaggagttagttttctttatccagtagtttgctacggttgcattttctcttactctggagtcagaaccatgttgagtttatttgttggataaaaagttgtagttttgtgtttgacagctttgtgatcgaagtattcatcgggtctaatcgattatg

SEQ ID NO: 2579 - DNA, 963 bp, Silene vulgaris
gagcagtctctgagagcagccacatacatttccaggagcagtttcatcccattcatcttcctcaaccaaaacaataccatgggtaaggttcacggatcgttggcacgtgccggtaaggtcagaggtcaaactcccaaggttgctaagcaggataagaagaagaagccacgtggacgcgctcacaagcgtcttcagtacaatcgccgtttcgtcaccgccgttgttggctttgggaagaagaggggccctaactcatctgagaagtaaggcggaaaaagaagatgaagttcaattagtatattaggatttggtattgttattagtgttattcgacattttggctccaagttctaccagtgttgcttttcgagtattttatgtcgtaatttaaatggggactgccaagtgttgctggttgtagaagttttgcactaaattttacttcactatgatttgttattcaatcagtgcgactcttgtctaatttgagactccgtttattgagtttaattttgacaatcatggtttgccatttctcttggtaggattttaattcggagaatctgatagccccttccctttgtgttatggtcttatggatgctcccggcttgagatccggtgaagtggtgtaaggagttattgttagtgactattttgtccagttcttattgctggcatgttttttcaacatgcatctagcgaacaaagctcgctttattctttgtgttgaggttaaccaggagttagctacattttggaggaaagagattctgtggactttgatggcagtattgctagacgaattgcaaatcaatagtcaactgcttttttatctgcaaccactaagtttgtggctttgcgccccttacatttgcatcaagagagattgccttaacgtaaggtgtgtacaacatgtgattgcatatctttaagtaacatattctttatcagaatcggaaaa

SEQ ID NO: 2580 - DNA, 356 bp, Silene vulgaris
atccagcatcatgggaaaggtacacggatcgttggcgcgtgcaggaaaggtcagaggacaaacccctaaagttgccaaacaagacaagaagaagaagccccgtggtcgagctcacaagcgtcttcaatacaatcgccgcttcgtcaccgccgttgttggctttggaaagaagagggggcctaactcatctgagaagtagagctgtgaagtctgaagagatgattgccgtttacaatatttaggacttgtttattttgcacaatgtgggtgctttttgacactaaacacaattaaatttcctgctctcaactgttttagacttttcatatggcaacggagatcccttcttttatatc

SEQ ID NO: 2581 - DNA, 504 bp, Tabernaemontana elegans
aaactatattttcgtccaaattgatcgaagccctaaccctagcatcagttttctttcaggagcggttgaggcagcaggaatctctgtaaatccacaacaatgggtaaggttcacggatcattggctcgtgccggaaaggtgagaggtcaaacgccgaaggtggcaaagcaggacaagaagaagcagccccgtggccgtgctcacaagcggatgcaatataaccgccgtttcgtcaccgctgtcgttggctttggaaagaagagaggtccaaactcatctgagaagtaaagcaacatcttatagttcctttggttggtgaagacttttttctccttccaattaacatgaaatagtttatgccaaatctggtaatactgatcttaggctttggactgtgcttttactgaagattttggttcagcttgtctacgtagaactcttgttgatcataaattagactttttggctgtttaactgtgttggaatgagattcagtagttgtta

SEQ ID NO: 2582 - DNA, 533 bp, Eutrema halophilum
tgagattacacaatttacactcgcgtttcagcattcttgcagccgtcgaaagaaaaaagagagaagcaaatccgccatggggaaagttcatggatcattggcgcgtgccggtaaggttagaggacagacaccgaaggtggcgaagcaagacaagaagaagaaaccaagaggacgtgctcacaagcgtatgcagcacaatcgccgtttcgttaccgccgttgttggtttcggtaagaagagaggacctaactcgtctgagaagtagaagataaatgatgtttgaaagaagatagatgattgaaagatatgccttctgttgaagcttcgtgtcatggctgtttttgagaatttcgtttgttgctagttatttttcttttggcactaaactatgtgttttgattctatgctatgaaatacgactgtttcagttttgattctgattctcattctggaaacacaaaaatttcaatcttttggaattcatcaattagtttgcttgctaaaaccaatatatagacaaggtttatatgagt

SEQ ID NO: 2583 - DNA, 478 bp, Trigonella foenum-graecum
ggctcacgccctgggttttgcagcgaccgccacgccctcctactcatcggggcttggcccttgccccgacggccgggggtcgcagtcatgggaaaggttcatggttcacttgctcgtgccggaaaagtgagaggacaaacaccaaaagtggctaagcaagacaagaagaagcagccccgtggccgtgctcacaagcgcatgcagtacaatcgccgattcgtcaccgccgttgtgggattcggcaagaagaggggacctaactcatctgagaagtaagatcgaggcttgaagaattatgttgctgcttagtttcgaaaatatgttatgaatcttaattttattttgattttcctttttttttgggaatttagttgttttgactatgaattgtgaaccgtttttgtgctagttaaatatcaaacagtattatttggcatacagttcttattcactttataatgcaccttttagatgttta

SEQ ID NO: 2584 - DNA, 534 bp, Trigonella foenum-graecum
ccaaaatatgagtccacaaactataaggccgcatcaaaacctaccgatacaaatagagcatttctgtttcagttttagtttctagggtttaatccatcgaagagctgccgcagattgaatcgaagcgagaaagatagatctaacaaattcttcttaactatgggaaaggttcatggatcgctagctcgtgctggaaaagtgagaggacaaactccaaaagttgcaaagcaagacaagaagaagcagccacgtggccgtgctcacaagcgtatgcaatacaatcgccgattcgtcaccgccgttgtgggattcggaaagaagcgtggacctaactcatctgagaagtgatgaagaagatgcatgcttagtggaaggtttttttaattaggttgcggaatgtttttattttgatttatggattatggatctatgaaatttctgactatggttatatgaaagagatctttttgtgttagttaatctcatacatttgtgtaagattttatttattctgcaatctgattttctggattt

SEQ ID NO: 2585 - DNA, 605 bp, Antirrhinum majus
gccgtaaaatctccaaatcctccagttcagcgaaatcattcaatcaatcaatcatgggtaaggtacacggatcattggcacgtgccggcaaggtgagaggacaaacaccgaaggtcgcgaagcaggacaagaagaagaagccacgtggacgtgctcacaagcgtatgcagtacactcgccgatttgtgaccgccgttgtcggtttcggaaagaagagaggacctaattcgtctgagaagtaaatttaatagtgtttagcgtttttaatttgatgaattgaagtgttattgcggttttttttatgttgatgttgatgttgaagaattggtttgatgttcaatatcggatataatttttagctggattagtgttattttttttggaattgttagatggtgaagatttggatttggcttcgtgtttgatcgaaatgttgcgttttttattgatgtttgtgttggtttaaattatgtgatgaaatttgcagctttggtttattttgctagtgtgattctatttgtaattgcattgtgtcaacaaagatatgaacttgaggaacgattataatcaaaaaaatatatttctttgtccgccttcttgccctg

SEQ ID NO: 2586 - DNA, 398 bp, Antirrhinum majus
  misc_feature (397)..(397): n is a, c, g, or t
acatccggcagccggaaaatctttcgaatctcgtcgccgtttcagagaatcaatcaactatgggtaaggttcacggatcattggcacgtgccggtaaagtgagaggacagacgcctaaggtggcgaagcaggacaagaagaagaagccacgtggacgtgctcacaagcgtatgcagtacactcgccgtttcgtcactgccgttgttggatttggaaagaagaggggacctaactcatcagagaagtaaactggtggagattatagtatatcgagttgttgtcgtttttcgttctttttgtcgttttatagtgtttttagctgatggattgagctgtttttgcagttatgttttgacttgtgacattgttgaaatacattataattgagttaagtttng

SEQ ID NO: 2587 - DNA, 505 bp, Malus domestica
gaaacgtcggtcacgctacagatcgatcttaaccctaaatagtgccacttctcctcctctgccgaaaccctaactcgcaaagagaagcgcgctacacacagagcagcagtcagcatcaacgatcagccatgggcaaggttcacggttcgctcgcacgtgccgggaaggttagaggtcagactccgaaggtggccaagcaagacaagaagaagaagcccagaggccgcgcccacaagaggctgcagtacaacaggagattcgtcacggccgttgttggattcgggaagaagagggggccgaactcttccgagaagtaaggttgctgtttgaggacttttactggtttcttatgaggcattattttcttttgaagtatggactatgacattttgtagccaaactaatggtttagattatggttatgtttaacttgtacgctttaggagcgctgtctatgatgtccagattcggaaatgcttattaatctgatctacttttgaccaca

SEQ ID NO: 2588 - DNA, 503 bp, Malus domestica
gaaacgtcggtcacgctacagatcgatcttaaccctaaatagtgccacttctcctcctctgccaaaaccctaactcgcaaagagaagcgcgctacacacagagcagcagtcagcatcaacgatcagccatgggcaaggttcacggttcgctcgcacgtgccgggaaggttagaggtcagactccgaaggtggccaagcaagacaagaagaagaagcccagaggccgcgcccacaagaggctgcagtacaacaggagattcgtcacggccgttgttggattcgggaagaagagggggccgaactcttccgagaagtaaggttgctgtttgaggacttttactggtttcttatgaggcattattttcttttgaagtatggactatgacattttgtagccaaactaatggtttagattatggttatgtttaacttgtacgctttaggagcgctgtctatgatgtccagattcggaaatgcttattaatctgatctacttttgacca

SEQ ID NO: 2589 - DNA, 566 bp, Malus domestica
tcccacttctccgcctccgccaaaaccctatatcgcaaaaagaagcgcgctaacacacagagctgcagcagcagcagcggcatcaccgatcagccatgggtaaggttcacggatcgctcgcacgtgccgggaaggttaggggtcagactccgaaggtggcgaagcaagacaagaagaagaagcccagaggccgcgcccacaagaggctgcagtacaacaggagattcgtcacagccgttgttggattcgggaagaagagggggccgaactcttccgagaagtaaggttgctctgtgaggacttttactggtttttaatgagggattagtttcatttgaaatatggattgtgaaattttgtagcagttcgattagcttctggttatgtttaacttgtaccctttaggagcactctctatgatgttcagattgggaaatgcttagtaatatgttttacttttgaccacatgattgtttggtactggtctttgattttaagctctgatttgctcatgccttgttgtttcgttgttataattggttttggcatcactaatgccacctttt

SEQ ID NO: 2590 - DNA, 562 bp, Malus domestica
ccacttctccgcctccgccaaaaccctatatcaaaaagaagcgcgctaacacacagagctgcagcagcagcagcggcatcaccgatcagccatgggtaaggttcacggatcgctcgcacgtgccgggaaggttaggggtcagactccgaaggtggcgaagcaagacaagaagaagaagcccagaggccgcgcccacaagaggctgcagtacaacaggagattcgtcacagccgttgttggattcgggaagaagagggggccgaactcttccgagaagtaaggttgctctgtgaggacttttactggtttttaatgagggattagtttcatttgaaatatggattgtgaaattttgtagcagttcgattagcttctggttatgtttaacttgtaccctttaggagcactctctatgatgttcagattgggaaatgcttagtaatatgttttacttttgaccacatgattgtttggtactggtctttgattttaagctctgatttgctcatgccttgttgtttcgttgttataattggttttggcatcactaatgccacctttt

SEQ ID NO: 2591 - DNA, 539 bp, Malus domestica
atgaggcgttcacttggtggcaaatgctgtaaattggtacgaataaaaacactgcagctccaccaaaaccctaactgcgaagagaggcgcgataaacagacacaaacacgcttccgtcgtcctcagtctctctgccggcgaagatcagcatctgcagtcagccatgggtaaggttcacgggtcgctcgcacgtgccgggaaggttaggggtcagaccccgaaggtcgccaagcaagacaagaagaagaagcccagaggccgcgcccacaagcgcttgcagtacaaccggagattcgtcaccgccgttgttggattcgggaagaagagggggcctaattcttctgagaagtaaggttgctctttggggagtttttgctgttttcttatgaggctttagtttcatttgaaatgtttattttgtagccagattatggtttgacattatctattggttctgtttcgttgttctaaagcatgtttttgatgtcctgattgggaaatgcttactaatatcggctagttttcagtctttgactaca

SEQ ID NO: 2592 - DNA, 401 bp, Malus domestica
gaggcgcgataaacagacacaaacacacttccgtcgtcctctgtctctctgccggcgaagatcagcatctgcagtcagccatgggaaaggttcacgggtcgctcgcacgtgccgggaaggttaggggtcagacgccgaaggtcgccaagcaagacaagaagaagaagcccagaggccgcgcccacaagcgcttgcagtacaaccggagattcgtcaccgccgttgttggattcgggaagaagagggggcctaattcttctgagaagtaaggttactctttggggagtttttgctgttttcttatgaggctctagtttcatttgaaatgtttattttgtagccagattatggtttgacattatctattggttctgtttcgttgttctaaagcatgtttttga

SEQ ID NO: 2593 - DNA, 506 bp, Malus domestica
acgcctaattgcgaagggaggcgcgataagcagacaccacacaaacgcttccgtttctctgccggcaaatagcagcagcatctgcaatcagccatgggtaaggttcacgggtcgctcgcgcgtgccgggaaggtcaggggtcagaccccgaaggtcgccaagcaagacaagaagaagaagcccagaggtcgcgctcacaagcgcttgcagtacaaccggagattcgtcaccgccgttgttggattcgggaagaagagggggcctaattcttccgagaagtaaggttgctttttggggactttttgctgttttcttatgaggcattagtttcatttgaagtttcagattatggtttgacattatctactggttctgtttcgtcgttctaaatcgaagcacgttttgatttccggattggtaaatgcttattaatatctgctaattttgagtctttgagcatgtgattgttcaacattgttcgtaatttaagttttgatctggtccac

SEQ ID NO: 2594 - DNA, 490 bp, Malus domestica
caacaaccgaaaaccctaatactcacagcacccgtctctttaccgccgcgccgtttacctgttctcctgatcttctctgcaactacaccactcggcagccatgggaaaggtgcacggttctttggctcgtgccggtaaggtgagaggccaaacacccaaagtggccaagcaggacaagaagaagaagccccgcggccgcgcccacaagcgcttgcaatacaaccgccgattcgtgaccgccgtggttggcttcggaaagaagaggggaccaaactcgtcggagaagtagggcaaagattcaagctttgaaaggatgacaagtgcttcgtagattatgaaaaattaaaggctttgtttttgtttaattgtcgcgcattgttcttaagaccttagtgttggtttgttacttcatacaaagatattttgcaagtgttggattatgttggtatttttttaatctaatttgaattagcagcaatgcgattttgtt

SEQ ID NO: 2595 - DNA, 503 bp, Malus domestica
caacaaccgaaaaccctaatcctcacagcacccgtctctttaccgccgcgccgtttacctgttctcctgatcttctctgcaactacaccactcggcaaccatgggaaaggtgcacggttctttggctcgtgccggtaaggtgagaggccaaacacccaaagtggccaagcaggacaagaagaagaagccccgcggccgcgcccacaagcgcttgcaatacaaccgccgattcgtgaccgccgtggttggcttcggaaagaagaggggaccaaactcgtcggagaagtagggcaaagattcaagctttgaaaggatgacaagtgcttcgtagattatgaaaaattaaaggctttgtttttgtttaattgtcgcgcattgttcttaagaccttagtgttggtttgttacttcatacaaagatattttgcaagtgttggattatgttggtatttttttaatccaatttgaattagcagcaatgcgattttgttaaaaaaaaaaaaa

SEQ ID NO: 2596 - DNA, 722 bp, Malus domestica
cattcttttactctctctcctttctctctctacattttctctctgtactttccttcattactgttgacagtattaaatagtggtcgaattaatttaatcactctactaatccttccaaaaggaggggattattagtccgttcccttccctctctctctcacttggttctccacgacacctgctgtctccgtcgtccctctcgccgtcgtcgttctccccgtcgtcgttcttgccggcaccgtcaggcacgcaggcttgacaaaaacgactttgctcccctgattttaattttgtttatcattttcgtccaatcgttgtaaaagctgccggcaaatagcagcagcatctgcaatcagccatgggtaaggttcacgggtcgctcgcgcgtgccgggaaggtcaggggtcagaccccgaaggtcgccaagcaagacaagaagaagaagcccagaggtcgcgctcacaagcgcttgcagtacaaccggagattcgtcaccgccgttgttggattcgggaagaagagggggcctaattcttctgagaagtaaggttgctttttggggactttttgctgttttcttatgaggcattagtttcatttgaagtttcagattatggtttgacattatctactggttctgtttcgtcgttctaaatcgaagcacgttttgatttccggattggtaatgcatatttaaaataaaaaatcgttgtaaaatctca

SEQ ID NO: 2597 - DNA, 689 bp, Malus domestica
cacgagccattcttttactctctctcctttctctctctacattttctctctgtactttccttcattactgttgacagtattaaatagtggtcgaattaatttaatcactctactaatccttccaaaaggaggggattattagtccgttcccttccctctctctctcacttggttctccacgacacctgctgtctccgtcgtccctctcgccgtcgtcgttctccccgtcgtcgttcttgccggcaccgtcaggcacgcaggcttgacaaaaacgactttgctcccctgattttaattttgtttatcattttcgtccaatcgttgtaaaagctgccggcaaatagcagcagcatctgcaatcagccatgggtaaggttcacgggtcgctcgcgcgtgccgggaaggtcaggggtcagaccccgaaggtcgccaagcaagacaagaagaagaagcccagaggccgcgcccacaagcgcttgcagtacaaccggagattcgtcaccgccgttgttggattcgggaagaagagggggcctaattcttctgagaagtaaggccgctctttggggagttttgctgttttcgtatgaggcattagtttcatctgaagtttcagattatggtttgacattatctactgcttctgtttcgttgttctaaatcgaagcatgttttgatttccggattgg

SEQ ID NO: 2598 - DNA, 451 bp, Malus domestica
atgcacgagggtctcttttccgccgcgccgtttacccgtcctcccgatcttcttcgcagctacaccactctgcagccatgggaaaggtccacggttctttggctcgtgccggtaaggtgagaggccaaactcccaaagtggccaagcaggacaagaagaagaagccccgcggccgcgcccacaagcgcctgcaatacaaccgccgattcgtcaccgctgtggttggcttcggaaagaagaggggacccaactcgtctgagaagtagggcaaagattcaagctttgaaaagatgacaatgtcttcgtagattaagaaacaaaaggctttatttttgtttagttgtatttggaagtgttggattatgttggagtttatatttgaatcagcagtgatgtgatgttgcttctgggttgttctcaaattattgttggttttgttgttgaaaaaaaa

SEQ ID NO: 2599 - DNA, 478 bp, Persea americana
aatcacacagacgcacctcttcacttggccgtcgtcttccacacctcgtccgcaggacaaagagattgcagagttcttcaaaacctaacataagccatggggaaagtccacggatctcttgcacgtgcgggtaaggtgagggggcaaactcccaaggtagcaaagcaggacaagaagaagaagcccaggggcagagcccacaagcgcatgcaatacaacaggcgtttcgttaccgcagttgttggatttgggaagaggcgaggacccaactcgtcggagaagtaggtgaaagcccgagtggttttttagatgtaggattgctggttttgtttcgtttcgtttcgtttccttgttgttttacgcattcaagctgatgtgatgttcatggtgagctgagtttgccatggaggattttatattgttggcaaagtttgttagacacatggataccgcagatctttagaatttatcacagagc

SEQ ID NO: 2600 - DNA, 534 bp, Musa acuminata
gaaaggtttgcattgacgccgctcctctctcgccgcctcgttgaaggagctgattcacatctgccatggggaaggtgcacggatctctggctcgcgccgggaaggtgagggggcaaacccccaaagtggcgaagcaggacaagaagaagaagcccaggggcagggcctacaagcggatgcagtacaaccgccggttcgtcaccgcagttgttggattcgggaagaagagaggacccaactcttccgagaagtagggagacaaaggttttcaggagtgaagcacttggagcatttgatgttttcgtattgagcatgtagggtttaggtttcagtacaatgtactgcttgtttatgcgtggtgatgatccacgaattcaactactttggattggagttgctttcttgattttgtcgcaccaaggatatagggtttagctttcagtatgttggactaatatatgcatggtgatgatctattaaatatcttcgatgatatgcattttcttggaatttaatgctatcagtgcttttgaa

SEQ ID NO: 2601 - DNA, 298 bp, Ocimum basilicum
gcacgagggccagacgaagaacctgagcaatccccacctccttcatctatcgatctcagtgaaaccaagcagtaatgggtaaggttcatggttcattggctcgcgccggaaaggtgagagggcagactcccaaggtggcgaagcaggacaagaagaagcagccccgcggtcgcgctcataagcggatgcagtacaaccgccgtttcgtcactgccgttgttgggttcggaaagaagaggggaccaaattcatctgagaagtaaactggagcattcacgaagaaatgtttggatcctgt

SEQ ID NO: 2602 - DNA, 1245 bp, Beta vulgaris
  misc_feature (3)..(3): n is a, c, g, or t
  misc_feature (695)..(695): n is a, c, g, or t
  misc_feature (704)..(704): n is a, c, g, or t
aantgcccccccttttttgttgggagggggattttgggaaaaaataaagggcgggggggggggccccccgggggccccccaaatcccgtgataacacccctcccgagaagggattttttagcgggtgaaaagcccggggttccgggaaaccggttttaacccggggtccccccttatagggtatttttgtttttcgtggggggcttgaaaaacccaaagggccttttgggtggcctttggcgcttttcccaattttttcggttttccccgtttggggaaacgattcccccttaaggaaataacccttcccccgccaaacccgggccaggtttttggaggggaagggaaggggccccaaacgaaacccctttccccgggggtggcggattttttaaacaagggcccaacagtttttccccttggaaagggcccggggccccaagccaataaagggggtttggcccccccttagggccccccgggttttaacctttattttttccggctcgtttttttgtgggaatttggggggggatacaattttcccaccggaaaccgcttattgcccctgttttccccaaagttcgaaatttacccctccctaaagggggacaaaaagcgggagttccccccggggggggggcgcctcttaggaaattggggattcccccggggtgccaggaaattgggcacgngggaggaangggggaagaatcaaccaacatccgaacaacatcactcaccagccatgggtaaggtacacggatcattggcacgtgccggaaaggtcagaggtcaaactccgaaagttgcttctcaagataagaagaagaagccacgtggacgcgctcacaagcgcatgcaatacaatcgccgtttcgttaccgccgttgtcggattcggcaagaagagaggaccaaactcatccgagaagtagaagattataaacaacaaaatgtgaactctcctacaccaattacatttctaggattctaatgttcctcttctatttgtttttttagtatcgatggtttcttacaagtattttacgttgtgtattctcatactcatatcactactactttttgatgctcgtgaccttttctatgctgtagttggaacccatcgttttgttttcctatcatagtgacaattttgcctcaatctcatagtcaccattccacttggtagtatgctttgattttcttgatgttgaatggaagtcgacaggttttgatgtctctt

SEQ ID NO: 2603 - DNA, 497 bp, Beta vulgaris
cgcacgaggtctaggagagagaaactgcaaatcatccgccgcaacaacttcactcaacaccaaccatgggtaaggtgcacggatctttggcacgtgccggtaaggtcagaggtcaaactcccaaagttgcttcacaagataagaagaagaagccacgtggacgcgctcacaagcgtatgcaatacaatcgtcgtttcgttaccgccgttgttggattcggcaagaagaggggaccaaactcatcagagaagtaaaagacccaataacaaaatgtgaagttttgcagcatcagacttatttttaggatattgaatccctctttctttctagtattgatggtttctcaagtaatgtactttgtgtatacttaaatcactattattttttggtattcgtgggctttcttcaattctgctgttggaagttggaacactgttttcatgtactatgatagtagtaacaatttactacgtgtcaatattagtagtctttaccgt

SEQ ID NO: 2604 - DNA, 786 bp, Bruguiera gymnorhiza
gacacatcgccgctcgaaaggaaagcagggagagcaacggcttctcgcagcagccacaagaaatctacacaccgccatggggaaggtgcatggatctctggctcgtgctggtaaggtgagaggccaaactcccaaagtggccaagcaggacaagaagaagaagccacgcggacgcgcctacaagaggatgcagtacaaccgccgtttcgtcaccgcagtggtgggatttggcaagaagaggggacccaactcgtccgagaagtaaagctcgaggagatgacaagttagtcattatttaggggaaacttttatgtgatttctgtttcaagtcttttattggtttttagttgatggtattgatgtatcaaatcatgttgaacatctgtactttttctcaacaaggaatgaggtgatactgtatttcttatttaaagcaaagagaatcgaaaatgagttaataccctcgatattgaaattattagagtatggataatattgggtgagttcgtccttgcattttttacttggtcgattggatagagtcagtagtgctcttgtaggagctgggtgcactgcctttgttttttatatgggtttattattaacgaatatattattgattgctgagtgttgtggtttgaatagataaaatgtgtagctagtataatttttcctttttcgctgagactatagtctgtagagtggaagtttattacagtttgttactcgacgtatatagatgaggtgatacggggatcgctcttttttttgtcgtcattggtgcgt

SEQ ID NO: 2605 - DNA, 468 bp, Theobroma cacao
atatgagcatttcaaaaccctaaccatagtctttcttattctctgctcaccgccagaagccaaccgaggagatcaaagaacagccgcagccatgggtaaggttcacggatctctagctcgtgctggtaaggtgagaggccaaactcctaaagtggcaaagcaagacaagaagaagaagccccgcggccgcgcttacaagaggatgcaatacaaccgccgtttcgtcaccgcagtggttggatttggcaaaaagaggggacctaactcatctgagaagtaagaactgtgaaggtgaagaaggcaagaatttgctagctttgatggattaattaagtcttggttattttgtaatgttttgtgatacttatttttagctactggtgtcaaggattgagatgaactttcattttgttagctagagatgatgatgtgattttgtcattaattatgttaatttttggtttatta

SEQ ID NO: 2606 - DNA, 472 bp, Coffea canephora
ggtccacccttttcgcccttcgcagtatcagcagctccaagcagatctctcagcagctcaaactccatagctaatcatgggtaaggttcacggttcattagctcgtgccggtaaggtgagagggcaaactcccaaggttgcaaagcaggataagaagaagaagccccgcggccgtgcctacaagcgtatgcaatacaaccgccgcttcgtcactgccgttgttggctttggaaagaagagggggccaaactcatcggagaagtaaacatgagggccaaggcatggtagttttagtaggtgtaattctgttttgagcttgatgcattgtgttgttgatcatgttagtacgcttactgtcatttttgttaatttatggttatcctcttcattgtagacggaggtttgtttgaatccttgaaatgagattgaaggaaggctaatttggctgttttcgaaaaaaaaaagaaaaaaa

SEQ ID NO: 2607 - DNA, 588 bp, Gossypium hirsutum
ctaaaacggttcagatttgttctctaataaataccagataaagaaaccctaccctaaattcctccaaaagtcgccatcctctcttaccacctgtaatcagagtccagttagagaagcgacgacaatcacaaatgggtaaggttcacggatcgttggcacgtgccgggaaagtgagagggcaaactccaaaggtagcgaagcaagacaagaagaagaagcccagaggtcgtgcctataagcggatgcaatacaatcgccgtttcgtcactgccgttgttggctttgggaagaagcgcggacccaactcgtcagagaagtgaggccggacatgtaggagtcttacattatattgataattttctagcttcattagcattacattgttatgatttagtttggagtctttctttgctttaagaaaactataacatcggtatctgttgttttgaaatatttactaaggccctccatttctgatcctttacattctttttcctattttctttccttcactatcgttagatgatttatttacctctaataaggaatatggaaatgatgtggctatcagtctcctgtttgatggag

SEQ ID NO: 2608 - DNA, 551 bp, Gossypium hirsutum
aaaattcaattattctgatgaggagtaaatgaattttatagagtgcgactgcagatcatacctgctcaccgccagaggcgaattcgaagagctaaaaaacccgcagttcagcaaccggggagcactcattcgacaagtccgccatgggtaaggttcatggatctttagctcgtgccggtaaggtgagaggtcaaacacctaaagtggctaagcaagacaagaagaagaagccccgtggccgcgcttacaagaggatgcaatacaaccgtcgtttcgtcaccgcagtggtcggattcggcaaaaagaggggacctaactcatctgagaagtaagaactatgcaatttaaaaaagttattgtttgaagcttttatggatttaatctgtatttttccctgtttttttgtaatgttttatgatacttatttttatccactggtagtaaggatgaagttgaacttgaagttttgttatctaaatattatgtgattttgatattagttaagcttaattcttggttcattacgtatttcttttctgcttcatcgctgc

SEQ ID NO: 2609 - DNA, 558 bp, Gossypium hirsutum
accgcgagaggcgaaccaaggagccaaaaaatccgcagttcagcaaccaaggagcactcattcgacaagtccgccatgggtaaggttcatggatctttagctcgtgccggtaaggtaagaggccaaacacctaaagtggctaagcaagacaagaagaagaagccccgtggccgcgcttacaagaggatgcaatacaaccgtcgtttcgtcactgcagtggtgggattcggcaaaaagaggggacctaactcatccgagaagtaagagctatgcaattgaaaaaaggtcttgtttgaagcttttatgggtttagtctgtgtttccccccttttttgtaatgttttatgatacttatttttatccactggtattaaggttcaagttgaacttggaagttttgttagctaaatattatgtgatttcgatatttgttaagcttaattcttggttcattacaaatttcttttctgcttcatcgctgccgaataagtttttatctatctatttgtgaggtttgaaataactgtatttatctgattattcatttctttatccata

SEQ ID NO: 2610 - DNA, 703 bp, Gossypium hirsutum
attctctgctcaccgccataagcgagatcaaaagccagcagcgcagcagctaaaagagcagtcttttgacaattattcgccatgggtaaggttcacggatctctagctcgtgccgggaaggtgagaggccaaactcctaaagtggccaagcaagacaagaagaagaagccccgtggccgcgcttacaagcggatgcaatacaaccgacgcttcgtcacagcagtggttggatttggcaaaaagaggggacctaactcatctgagaagtaagagatctatgtaggtgaagaaggcaagaagccttgttgaaagctttgatggattttaagtctttgtttcttttgataatgtttttatgatattggtttcaaggattggattgaactgccattttgtttgctagatattatgtgatattgttatcaattatcttaatttttggtttactatgagtttcgattcctcttcatccatgctgtaattgacttgccgttcccctccctgcattcactgccgaaactaattgttctactagttagggctgaatggagaatgatttgaaatactactatctgagaatgtggagtccaaaataatgaacgaatggatagattattttcgttttatgtaattgatttcccacttgattcttctatatgttctcgtgatcatggaaatttaaatttagtctttgaattcatta

SEQ ID NO: 2611 - DNA, 473 bp, Ipomoea batatas
cataaacaaaaaccctaaccctagaagttatcagtcccgaccgctcgacctcaccagcgtacttctccgctttcttccggctacacagaaatcgaccatgggtaaggtgcacggatctttagctcgtgccggtaaggtgagaggccaaacgcccaaggttgctgagcaggacaagaaaaagaagccccgcggccgcgcccacaagcgcatgcagtacaaccgccgcttcgtcacagccgttgttggctttggaaagaagagaggaccaaactcttctgagaaataagttatttaatggatccttttttttttttgagatatggagtttggaattgggatatgatgaaagttccatatatcttgttgttatagaatttcagtggctgtactacgctacaatttcaagctcttgatgatgtatgttgaacctccgcctcgtttgtcattggattaatacagtcgttttgttcaat

SEQ ID NO: 2612 - DNA, 410 bp, Ipomoea nil
gttcaacagtcggagaatcagggagcgcaagccatttcaatcggcggccggagacttagaaatctgcaatgggtaaggtacacggatctttggctcgtgccggcaaggtgagagggcagactcctaaggttgccaagcaagataagaagaagaagccccgcggccgtgctcataagcggatgcagtacaatcgccgctttgttacagccgttgtttgctttggtaagaagagagggccaaactcatctgagaagtaaatgaagaaatgaagatttttcttattttagagtttgtaactctgatgaatgttcttgttatagccattttggatgctgtactaaactacaatttccagctttctattattatgtgatgacatctcctttgtttttgatggattaaaaaaaaaa

SEQ ID NO: 2613 - DNA, 637 bp, Actinidia deliciosa
gccaccagccaaagaaacaacagcaatccgatctcagagaacaaataattctccaccatgggtaaggttcacggatcgttggctcgtgcgggtaaggtgagagggcaaaccccgaaggtggcgaagcaggacaagaagaagaaacctcgtggccgtgctcacaagcgcatgcagcacaaccgccgcttcgtcaccgccgttgttggatttgggaagaagaggggacccaactcatcagagaagtaagtccagaattgagtagttggtaggaattgggctggttgggtttatgtctcaactgtccattacccgtatgtgatactgatttctctatttttgctgtactatgtcgtgcatcgaagatttccatgggtttgatccttgttttggttgggtattttggtaagaaaaatgctgagcataaagtttgatctttgaccatgcaaagtgtgtggatgcaatgccccaaatttcatattggtaattgtctcacatgtattttttgagggatgggaccccatattgttttggagttaatatatctgtagctgctagcatccctaagcttaatagcatatgttggaaggacatggggttttagttggcacagtttataatacacactgcgcgaatacaa

SEQ ID NO: 2614 - DNA, 467 bp, Actinidia deliciosa
  misc_feature (28)..(28): n is a, c, g, or t
  misc_feature (327)..(327): n is a, c, g, or t
  misc_feature (330)..(331): n is a, c, g, or t
  misc_feature (356)..(357): n is a, c, g, or t
  misc_feature (360)..(360): n is a, c, g, or t
  misc_feature (372)..(372): n is a, c, g, or t
  misc_feature (411)..(411): n is a, c, g, or t
aattcggcacgacgtgcctctctctcgntcatcgccaccagccaaagaaaaacagcgatctgatctcagagaactaataatactccaccatgggtaaggttcacggatcgctggctcgtgcgggtaaggtgagggggcaaaccccgaaggtggcgaagcaggacaagaagaagaagcctcgtggccgtgctcacaagcgcatgcagcacaaccgccgcttcgtcaccgccgttgttggatttgggaagaagaggggaccaaactcgtcagagaagtaagctccagaattgagtagttggtagttgatgggctggttgggtttatgtntgnnctgtccattaccagtatgtgatacnnttnttataatccccngagtttgttactactgatttttctatttttgctgtgctntgttgaacttattggttactttttaggtaaagattgaggttttgtttcaaaaaaaa

SEQ ID NO: 2615 - DNA, 566 bp, Actinidia deliciosa
ctcgctctatagctcgaagcttccaaacaacaatccgagctcagagaagctaagaatcgaccatgggtaaggttcacggatcgctggctcgtgccggtaaggtgagaggccaaacccctaaggtggccaagcaagacaagaagaagaaaccccgcggccgcgctcacaagcggatgcagcacaaccgccgtttcgtcaccgctgttgttggctttggaaagaagaggggacccaactcgtctgagaagtaagcttgagtaatgggtagttttataggtcagggccagatggcttttgaatgaactgttggttaccagtatgtgatagtgttcttaattcccagagtttgctactgttttttctgaacccatgtcgaatttatttattgggtaaaaattgaagtttagtgtttctctgcattgtgcattgaagtgtcttcaatgggttggatcttgattgtgttttttggttgaaagcttcgaagattaatatttcttgatactatcgttccatattcatctattgattgtttgaggggattgtcgctcagacttagacttgctttc

SEQ ID NO: 2616 - DNA, 3269 bp, Zea mays
tccatttaaccaataagcattcattcattagtctcagccagtcgagctcgtcggtcgccatcgccacctctaaccgccgccgtcgccgccggcccgcagtggtgccacaaaaccggtgacccctactccccctctttcctctcccctctctcccgctctgcctctcccttcgccacttctaccctgctgagggtgtcgcctatggatctcccccgtcctccgtgtgggtgcgcagcggcggtggtgcgcctggcggcagctgatgcgcacaacaaagtgttccctagttaagtgtgccgagccggaggggatggcagtcgacgcagctttgcggctgttgtggcaaccggtgcgtcggtgcccctctggaggggtttgcgcagaggctagggcagtggagacggcggaggctacctgctttgacctgggatcctggcctttcgatgtgctggatggcatcttgggcgaaaaccttggcgatggtgacatccgtggacgccacttccccctgttgagggcgtcgcattgctatgtcttccagttcgtcttgacctcgaagttaccttcagttcatgctttcgcttctcgacgtctggtttgtgggtggaggtggggttttctgcaacttgaagtcgaagctgccacattaagggatgtggctcggcaatgatgacatgaggcgagccccccttcctcgtggtctggactgttttggaggtcgggcaaataaccggaggtgggtattggatcaagattgctgatgaagaatcagagctgcctcgagtgtaggtgtgtcgaggcttcgcaacgatggcgcgtcgcggtcttcctccttttgtccaaggttttggtgtatgcgtcgtcgtgtttcttttggcgttgtgcggcccgtctggcgaagtcgtacattgtgttgagctcaacaacaatgactctggaagggctttgtatttggggttgccgctgcctgtgttgtttagacactatgtgtcggcgccaacgcgatatgccatgatttatgaagccgggcttgcagaagagagtaagctgacgtatgtcgaggagcagcttggggacgccatcgttggggagagcgagcagctccagcgccctctcggaaatcctagactgaaagaaggtacgtcacttcgcatcagtaccgcgaaattggcaaagctcaaatcaaactgtatttcgatgatacggcaggaagtggtgtacttgcgggcctccgactcgtcgtagaacacatccggcggcgcctggaactcaggccgaggcatcttcactctcctccgagttgccgctctcctcggtttctcgcctcgcaggcacaaacgttgctggtgccgctggctaacgaatcgaagccagtatgggccgagttccgttttctcagaagacttctgagctcaattgccagttagcgagccccgcgggacatttacatgggccacataacagccggcccagtaaagcgtggcgtttataaatcttctcaaccgtctagggcatcgtttgcagcagcagcagcagccgccgacgccgacgtaaaagcccgagtcgctcgtctcttcccagatcctccgagcacaacagctctccgtcgccgtcgccatgggtaaggttcacggatcgcttgcccgcgcggggaaggtgcgtgggcagacgcccaaggtggcgaagcaggacaagaagaagaagccccgcggccgcgcgtacaagcgcatgcagtacaaccgccgcttcgtcaccgccgtcgtcggattcggcaagaaacgcggccccaactcctcggagaagtagatatagccatgtctttgtgttttgttcccccactagtttccttgtactgatggcaagttgctgaagacttatatgctattattatctgtatcgatgtgttactgcaacactatgaaatatggtatgcatcgttgagctaatcacgttgcctgtggaggcgatctttttagttgtctcgaatgttgttcgtcttgttttgaaattggtgacacaggagtctcggtctattctgtttcagtttgtcctgctgatagtggagtgcaattgtgaattgtgataagtaggctgagcaaattgtactgcttgtgtagtttgttttgtttgatttgtgtgggcacacttgaaattggcgtgagtctagtaacataagttgtgccattttgctcagaagccttacatatgagttctttctggttcataatttgcttgtttagaagcagagttctagaacgtgaactgtctgtctgaagcagagctctagaacctgaactgtccgtctgattggttgctgcttactttgtgctgcactgaaattggtagtggtgtctgtctaattcatctatggcaatcctgttttattattatatgcctcgtttggttgatcaagtgaagtttaaaatagtggttgatcaagtgaagtcttttgcacggcagatagatactgttcaccgagtgaagtttaaagtggttgatgagatatgagatataatggataagccactgtagacagcttaacacgagaaactaaaaatagctttggaaaaccgggaaaaactgtaccaaacatgatctttaagaatcgaattaccaaaaatgactttgtgtccatatgttaaggttaagggtccacatcgcttaaaaatgtcactcctatggaagagtaacatcgacgtccgtctcctttcagcagccttcggaccatcgctctctccaatcgggcgagggttggggttggggtacgcgccactgaggtaaaggttgtatttgcttgtcggggattgtggcattggaggacgaggaggatgatcggagaacggaaggtggcggaggagtagctcgattctatcaccgtaaaggtcgagaggcggtggaataagagaggagccgctgtcgcaccagcggaggacgagcagtgcatggcggagtaggagaggactcgttgccgcaccgccgccactgcaggggggacgacagacactgaacgaggagaggggccacatccgcaccatcgctccagcgagacgacgggaggcggccgaggagaaggtccgccgcagccgcacaacggtgcaggcgaagacgggggatggacttcatctgctgcgcaccgctgctgttggggcacgacaggtggtggaggaggaggtccatcgcagccgcgctgacgttgcagcggaggacgaagagggcataggggaggtggaagggatcacatcggagagaactggtgatggagcctcgcg

SEQ ID NO: 2617 - DNA, 725 bp, Zea mays
cgccaaacatggtttccgtggcctctgttctccatcgttttctttcattaatccgtgaatctcaattctcactcgtgatccaccgagagcgagagcgttgtaaagataggttggaacggtaacatgaggccagtgtgacaaagcccgtcaatcttgtcccccacgggccacgacagacccttcctgaagcccaatcggcccgcacgcaaaaaaccctcacgcgtattaagccatccccctcaccacctagggtttccttttacagccgccgccgacgccgccgccgacaccgacgcatctcccaggctccccgcgcttccttccgtcgccgccgccgcttcgcagccatgggtaaggtgcacggatcgctggcccgcgccgggaaggtccgcgggcagacgcccaaggtggcgaagcaggacaagaagaagaagccccgcggccgcgcgtacaagaggatgcagtacaaccgccgcttcgtcaccgccgtcgtcggcttcggcaagaagcgcgggcccaactcgtccgagaagtaggcgcgacgccgttgggctcgcatgcctatgcctatgctcttgctcttcctggtagtagttttcgtttgtgcaagcagaagaagatctttttttgttgttgttccagtctcagtttcgtgcggtgagatgagagcttgagattatatgtcaacctccttattaatcgaggatgaatttttgagatatgat

SEQ ID NO: 2618 - DNA, 595 bp, Medicago truncatula
aagagccccgattttggttttgtgcctccagccgcagaagctagagagagagagagtgtgtgagagagagagattcatttcttcaatcatgggtaaggttcacggttcattggcccgtgccggtaaagttaggggacaaacacccaaggtagctaagcaagacaagaagaagcagccccgtggccgtgctcacaagcgtatgcagtacaatcgcagattcgtcaccgctgttgttggatttggaaagaagaggggacccaactcatctgagaagtaagatcgtggattgaagaatgatgtttttcaccttagcttttgaaatatgttgagaatcttaatcttaatttcattttgattttccttttttttttttttttttggtgggatgtaggggttatgaattgtgaaccttttttgtgctagttaaatatcaaacttaaatatttattttgcatacagttcttgcatgtcttaatttttaactagctttaagaacttatactttagttattgtagtgtgtgtgcgtgcttgttatatcagcggaataactgcggttcaaataaatttatcgtatgctttgtttgattgcttgat

SEQ ID NO: 2619 - DNA, 393 bp, Medicago truncatula
agggtttaatccgagcgctgctgctgcaaatcgaatcgaagcgagaaagagaaaatctgacaaattcgtcttcaccatgggtaaagttcacggttcccttgctcgtgctggaaaagttagaggacaaaccccaaaagttgcaaagcaagacaagaagaagcagccacgtggacgtgctcacaagcgtatgcaatacaatcgccgtttcgtcaccgccgtggttggattcggaaagaagcgtggacctaactcatctgagaagtgaggatgatgcttagtggaagtttttttaattagtttgatgaagtgttactttttttttatttgattcatgaattgtggaactatgaaatttctgactatgttaaatgaaagagttttgttgtcgtagtt

SEQ ID NO: 2620 - DNA, 437 bp, Medicago truncatula
ggggggattctggttttgcctcaagccgcagaagctaaagtgtctgtgagtgagacagagagattcatctttttcaatcatgggaaaggttcacggatcgttggcccgtgccggtaaggttagaggccaaacaccaaaggtagcaaagcaagacaagaagaagcagccccgtggccgtgctcataagcgtatgcagtacaaccgcagattcgtcactgccgttgttggattcggtaagaagagaggaccaaactcatctgagaagtaagatcgtggattgaagaatgatgtcgttccccttagcttttgaaatatgttaagattcttaatttcactttgattttcctcttttttttttttttgggatttagtgttttgactatgtattgtgaaccttttttgtgctagttaaatatcaaacttaattatttattttg

SEQ ID NO: 2621 - DNA, 461 bp, Medicago truncatula
ttacggccggggggagctccgattctcgttttgtgcctccagccgcagaagctgaagggagaggggggggagagagagagagattcatcttcttcaatcatgggaaaggttcacggttcattggctcgtgctggtaaagttaggggccaaacaccaaaggtagctaagcaagacaagaagaagcagccccgtggtcgtgctcacaagcgtatgcagtacaatcgcagattcgtcaccgccgttgttggatttggcaagaagagaggaccaaactcatctgagaagtaagatcgtggattgaagaatgatgttgttccccttagcttttgaaatatgttaagaatcttaatttcattttgattttcctcttttatttttttgggatttagtgttttgactataaattatgaactttttttgtgctagttaaatatcaaacttaattatttatttcgcataag

SEQ ID NO: 2622 - DNA, 586 bp, Pennisetum glaucum
cggcaaggggggcaacaggttttggagcatccgccgccgccgccgccgccgccgtcgcaacagccctagctccccgtctcctcccaactcgcccgagctccacagctccgccgccgccatgggtaaggttcacgggtcgctggcccgcgctgggaaggtgcgtgggcagacgccgaaggtggcgaagcaggacaagaagaagaagccccgcggccgcgcccacaagcgcttgcagtacaaccgccggttcgtcaccgccgtcgtcggattcggcaagaagcgcggccccaactcctccgagaagtagatctagctaggccagccgcctgatttcatagaactcgtgggttcttggcccccccgtcgtctgtttttttttgttccccagtagtttcgttcgagtaatcaagttcttggttgctgtactgatgacaagttgaagacctaaaaaatcttccatctgaatttatgttactgcaatcctgtttagtatgatatgcatcgtttactacatggcactgagtgtctctgatcaatttgccttgccgactattttggcaattcggaatgctgaaacatgcttgag

SEQ ID NO: 2623 - DNA, 537 bp, Pennisetum glaucum
actgccactcccgcacccgccgccgcaccagcagtaaaccctagccccgtagcccgccgccgcaaccgcaacagcagccaccagcccgccaccccctcctcgtcgccgcagccatggggaaggtccacggatcgctggcgcgcgcgggtaaggtgcgcgggcagacgcccaaggtggcgaagcaggacaagaagaagaagccccggggccgcgcccacaagcgcttgcagtacaaccgccgcttcgtcaccgccgtcgttggcttcggcaagaagcgcgggcccaactcctctgagaagtagatcgccttcaggttcacataaggggggtcaagatcgtggtgttctcttatgggtttaggatgatgtatggatgaggacaagaaacttgagatcacatttttattgatgttgatggattgtgtgcctacttgaatcattcctacattatcatttccagtactgttatggttctgtgcatttctttcatatatctgttttagctgatatcctaggacacaataataagatgtgtttt

SEQ ID NO: 2624 - DNA, 542 bp, Tropaeolum majus
cggccattacggccgggggactgatttctgtttctcttgcccacagcctgcagttcaaagaagcaccaacaactaatctccaatgggtaaggtacacggatcgttggctcgtgccggtaaggtcagaggtcagacccccaaggtggctgcgcaagacaagaagaagaaacccagaggccgcgcacacaagcgcatgcagtacaaccgtcgttttgttactgctgttgttggctttggaaagaagcgaggacccaactcttctgagaagtaggagcttggacccaagagtttgctaatgtagtgtttgggttaatgctcatgtttcaccgatggtttccttgaaaattttatttagcaaaaaagttacatgtattgaaagcctatttacctggttaagttagttaactacaacacttccatttgttattttgtattggtcactaaggacagtttatttttaatcttattgtcaatctgatgcggtagtgattgatttttaagcatttgtagtcattagagataacttacacagtaaactgtct

SEQ ID NO: 2625 - DNA, 471 bp, Tropaeolum majus
actctagaagagaaggaaggagcaaacaacgttgtctcagctcgccctccacaactacttctacagcaattagagatgggtaaggttcacggatctttggctcgtgctggtaaggtgagaggtcaaacaccgaaggtggccgcacaggacaagaagaagaagccaagaggccgcgcacacaagaggatgcaatacaatcgccgttttgtcaccgccgttgttggttttggaaagaagagaggacccaactcatctgagaagtagatgaatactatgggataggagttttgattattttccatattcctttttttgtgtatcgtcggattaattttaagaattatgtttacattgtgaatgacttgttatatatttttcaattccatttgctaaagcttgaaatagttattcaggtcacaacatagggaaaaaatcatacttcgtccctaagatctagtaagacaaatttgc

SEQ ID NO: 2626 - DNA, 605 bp, Tropaeolum majus
gtggaaaaatatttggtcacccttggttcaaccattgatttggtcaaataattcagtagtaaaataaagacaccgagtgagtgcccacgggtttttggtccgacgaaaaggatccgaagtcggcccacaacacattctcagaattaaggtcatctaaaccctaataaccttcatcacctcctctattcaatccgtgcaatcaccgcttggaggagaacgaagagcaagaacaggtctactgagcctaatcgaacaagctatccattccaatcaaccatgggtaaggttcacggatcgttggctcgtgccggtaaagtgcgaggccaaactccaaaggtggccgcacaggataagaagaagaaaccacgtggacgtgctcacaagagaatgcaatacaaccgccgttttgtcactgcagttgttgggtttgggaagaagaggggacctaattcatctgagaaatagaagagactagtatggtgaagaaagtatgtagaatagttttaatgttttgacatagtgcttgttttcgatgtactgatatttgattcatggttatggagttatggaactatgatgtctttccgccaccacaattctatgtg

SEQ ID NO: 2627 - DNA, 506 bp, Tropaeolum majus
tctcaagtccgtgcattgatagcttgaaggagaaccaaaggacccgaacagtttactgatccccatcttacaagctctctatctcaatcagcaatgggtaaggttcacggatcactcgctcgtgccggtaaagtgcgaggccaaactccaaaggtggccgcgcaagataagaagaaaaagccacgcggacgtgctcacaaaagaatgcaatacaaccgccgttttgtcaccgcagttgttggtttcggaaagaagaggggacctaattcatcagagaaatagaagagactaacatagtacttgtttccattgtgatgatttttgattcaagtttttggagttatgaactatgctctgctctgcctttgcgctattacaaatctatgtggtttcttatttaagattattttcactttgtatatttgtctattttagatgagtgttttaagtcggtatatcaattggtgtcatgtgatcaaatagtaaaaagttctatcaacaagttc

SEQ ID NO: 2628 - DNA, 709 bp, Orobanche aegyptiaca
ccccaagaagttccaagagaaatcagccaaacaatcatgggtaaggtgcacggatcattggctcgtgctggtaaggtgagaggacagacgccgaaggtggcgaagcaggacaagaagaagcagccccgtggtcgggcccacaagcggatgcagtacaatcgccgtttcgtcaccgccgttgttggctttggaaagaagagaggaccaaactcatctgagaaatgaagtggaacaagtttaaaatgttgttcttttttggttgttgtattgttttgaacgcatttactgatctttcttcagtataagaattgaatcatcagttgataaaatttgaattagctatttcagtgagaatatatgtctcagtgttaacaggaaagaaaatgttccagggaatctataattgttaagctcattgaatttgtcagatctctgtgaagatttgtgcaaactaagagaagaaagtttcattgatctcttattttgtaggatgttgaattattgaacatcagcattgactactagtggctgttgataacttggttgctgctgttgtatatagaaatataataatactgattagtattgttggtggatattcctgtcctcgacatttttctgacctgattaactttaggagctgaatatacaaacccagtaaatcttgatcggaaagtatgtagtcttcagtgcaagatatccagttacg

SEQ ID NO: 2629 - DNA, 269 bp, Orobanche aegyptiaca
ctgcagacgctcctaacttctccggcgaacggcgactcagatatcaccatggggaaagttcacggatcacttgctcgtgctggtaaagtgagggggcaaactcctaaagttaccaaacaggacaagaagaagaagcctcgcggccgtgctcacaagaggatgcaatacaaccgcagattcgtcacagcagttgttggtttcgggaagaagaggggcccgaactcatccgagaagtaaatgaagaaatgactttattttaggtgaagttg

SEQ ID NO: 2630 - DNA, 399 bp, Carica papaya
aaacttaagaaagcttcttctgttgatctccttcttgacgatacatcatgggtaaagttcacggatctctagctcgtgctggtaaggtgagaggccaaacccctaaggtggcaaagcaggacaagaagaagaagcctcgcggtcgagcctacaaaaggatgcaatacaaccgccggttcgtcacagcagttgttggttttggaaagaagagaggacccaactcatctgagaagtaaggatggaatgaaggcatggcttactgggtgttttgattactgtgctattgttattatttttcattttatatggaattttaattactacttagtggtgaagtacattgaccaggtttcttaatctagataacatgtgattttcaattcaatttgccttttgttc

SEQ ID NO: 2631 - DNA, 546 bp, Capsicum annuum
aagaaccttcgcagctccgaacaattcccagcttctccgatcaccggcacctcagaaatcagccatgggaaaggttcacggatcacttgctcgtgctggtaaggtgaggggacagaccccgaaggttgcaaagcaggataagaagaagaagccaagaggacgtgctcacaagcgtatgcaatacactcgcagattcgtcactgctgttgttggctttggaaagaagagaggacctaactcttctgagaagtagacgatggcaatcagttattttaggttgagaagttaccgcgtcaaaagttttgtcgttatgtttataaattttgattctcagacctcataatgagagaagactagtgtaatactggttatttgtaggatggattatttgattacgttctgttttgcaagaattattcgaatttaatccttgatcttctatcatttttattcatttgcaggaatggtttttgctgttcttgtctgctttcgttggaattgttctagctaataacggtcaatgtgatgaattttagtacctttgtg

SEQ ID NO: 2632 - DNA, 427 bp, Sequoia sempervirens
tttcgtcacaggtgaaggaggagagcactaggagctgaagattgagcagcagaagcagcggccaaaatgagtaaggtgcacgggtcattggcccgagcaggaaaggtgagggggcagacccccaaggttgccaagcaagacaagaagaagaagcccagaggccgcgctcacaaacgcatgcagtacaaccgccgctttgttactgccgtggttggatttgggaagaagaggggtccaaactcctccgagaagtgataaattaggtgtattatgatggaaatttggcaacggctttcattactgtaggaaatttgtatttgaggatggttgttgttactcgaaatactttatcttgaatgtattgatttggaagaacagacaaaatacatttttttgcacatttttattataacaagctctttcaatt

SEQ ID NO: 2633 - DNA, 528 bp, Panicum virgatum
ggttttcgagcagacgccgccgccgccgagttcctcgtctcctcccaaatcgccctagcatcagagctcctccgccgccgccgccatgggtaaggttcacggatcgctggcccgcgctgggaaggtgcgtgggcagacgcccaaggtggcgaagcaggacaagaagaagaagccccgcggccgcgcctacaagcgcatgcagtacaaccgccgcttcgtcaccgccgtcgtcgggttcggcaagaagcgcggccccaactcctccgagaagtagatctagctaggcccagccgcctgattcatacgcttgtgttcttggcaccttcgtcttcttttttgttccaagtagtttcgttcgagtaatcaaggttttggtgatgtactgatgaccagttgaagacctaagctatgttgctgcaatccaattaagtatgatatgcatcgtttactgcatggcaatgagtctctctgatcaagttgtctgctggggatctttttggctatatggaatgttagaaacatgccaac

SEQ ID NO: 2634 - DNA, 470 bp, Tamarix hispida
  misc_feature (39)..(39): n is a, c, g, or t
  misc_feature (167)..(167): n is a, c, g, or t
  misc_feature (378)..(378): n is a, c, g, or t
cggcacgaggcctcgtgccgaattcggcacgagcgaccnaggcgcagcagagctcatccccagaagcagtctgaagatcaatcatgggtaaggttcacggttcacttgctcgtgccggtaaggtgagaggtcagactcctaaggttgctaagcaggacaagaagaanaagccccgaggacgcgctcacaagcgtatgcaatacaaccgccgtttcgtcaccgccgttgttggattcggaaagaagaggggacccaactcatctgagaagtaaattcgacgataaaaatgatgattgaagctttagtgttaggatagacgatgttctttattttgacgaaattttgtttgcagaccatttttctttgggtattttggtnttgtcaacatcaagagctggtgtttcagttgaatgctgttggatttaagctgataatctgagtttatatatatttgctgtcataaggaaaaa

SEQ ID NO: 2635 - DNA, 533 bp, Thellungiella halophila
tgagattacacaatttacactcgcgtttcagcattcttgcagccgtcgaaagaaaaaagagagaagcaaatccgccatggggaaagttcatggatcattggcgcgtgccggtaaggttagaggacagacaccgaaggtggcgaagcaagacaagaagaagaaaccaagaggacgtgctcacaagcgtatgcagcacaatcgccgtttcgttaccgccgttgttggtttcggtaagaagagaggacctaactcgtctgagaagtagaagataaatgatgtttgaaagaagatagatgattgaaagatatgccttctgttgaagcttcgtgtcatggctgtttttgagaatttcgtttgttgctagttatttttcttttggcactaaactatgtgttttgattctatgctatgaaatacgactgtttcagttttgattctgattctcattctggaaacacaaaaatttcaatcttttggaattcatcaattagtttgcttgctaaagccaatatatagacaaggtttatatgagt

SEQ ID NO: 2636 - DNA, 883 bp, Setaria italica
atggcggcggcggcccggcggatgcacgcggcggcgcggcaccgggccagacgaagccgccgccgccgccgccgcatctcccagcatccgcgcccgcgcctccgtcgccgccgccgcgccgccgcttctcagccatgggtaaccaccttcgcctcctttcatctctcttctctggttgctacttcatcgcctactgatgcgctaatcggggttttcgtgtcgctgcgcgcaggtaaggtgcacggatcgttggcccgtgccgggaaggtccgcggccagacgcccaaggtggcgaagcaggataagaagaagaagccccgcggccgcgcgcacaagaggatgcagtacaaccgccgtttcgtcaccgccgtcgtcggcttcggcaagaagcgcgggcccaactcctccgagaagtaggcgccgcgcggcccccggcccgccctgccccggttcctcctttccgttcgcagtatgcttatgctcttgttggtagtagtttcattgtgcaagcaaaggaagaaccttttgtagtttcagtttcgttgttcgtgtgatgagatggaaacttgagatggtatgtgcacctcgttaagattttgagatatggtgatatgagcccatgactttatcatgcttatggctgcgtgttttggtatgtggatgtgctgcaaatatgtgtcactttatggttttgcgtggaataatcagtttaaggctatcaggcattagttctacatgtcattacgtctataattcctctctttgattagggaaacgaccatttgttttaggcgtattcgaagcatactgatcaagtacgaaatgttgcagtttccacagtgttcagtacttctgtactaatcccagtaatcgtgaaatcaag

SEQ ID NO: 2637 - DNA, 416 bp, Tabernaemontana elegans
ttcctcacagcaagtggaagcggcacctaacagaagacttaggaaatctacaaccagtgggtaaggttcacggatcattggctcgtgccggtaaggtgagggggcaaactcccaaggtagccaagcaggacaagaagaagaagccccgtggccgcgctcacaagcggatgcaatacaatcgccgtttcgtcactgccgttgttggctttggaaagaagagggggccaaactcatcggagaagtaaatttgagtaatgctagttttgtagtaggcttgggaaatgttaaagtgaattcttatttcaatcccgtaatagattgaacatcttacctttgttgatcatttaagaagttttggttgttcacttatgtttgaatgaaacttgattgttggttatgttgatcggtcactttcc

SEQ ID NO: 2638 - DNA, 458 bp, Euphorbia esula
  misc_feature (7)..(9): n is a, c, g, or t
ccgacgnnnctttcgccgaacatccggaagaggagaagtcgcttatcagattcgccatgggtaaggttcatggatccttggctcgtgccggtaaggtgagaggccagacaccaaaggttgctaaacaagacaagaagaagaagccacgaggacgtgcccacaaaaggatgcaatacaaccgcagactcgtcactgccgttgttggctttggaaagaagagaggaccaaactcctccgagaagtaagagactcgagaattcggcgtaacagccattttttcatgttatttggagatattttatacttccgatagtacttcttgatgcgcttaagctgatagttgtgtgaacgatgatagtattatttcttttagaggtttttaatttcgtcatttgatgcttctcttgcgttttagttttgttgtttcacaatgagatgagtatcatttttattttcgg

SEQ ID NO: 2639 - DNA, 761 bp, Nicotiana tabacum
ttgagcagctgcagacgctcctaacttctccggcgaacggcgactcagatatcaccatggggaaagttcacggatcacttgctcgtgctggtaaagtgagggggcaaactcctaaagttaccaaacaggacaagaagaagaagcctcgcggccgtgctcacaagaggatgcaatacaaccgcagattcgtcacagcagttgttggtttcgggaagaagaggggcccgaactcatccgagaagtaaatgaagaaatgactttatttttaggtgaagttgctgaagttcaatgagttgtatttgcattctattgcttctgagaatactccagacaatacaatgttagcactactatacaattggtttccgtagtttgaatgaaatgggattagcaagaattcaaatgagtatctgcttggtcttttaatgctacttatttttagccacatgttattcatatgttcatccaaggggcggcacacttctgattttcgagatgaatgccactatgttactgtgttgtgaaattcaacataggggaagtttgtgtttcagaaaagatctcttgtgctgaccgtaatcttagtgctcttatatggattgcagctccttaaatctatatttagtgataacttcttctaaaggcaatgattgtttttgttctgtctagacatttggtttacaatgtcagatttagaatttctccggactctgcttgaggtattcagcctttattatatgcactttgtgctgtttgttagc

SEQ ID NO: 2640 - DNA, 543 bp, Juglans hindsii x Juglans regia
  misc_feature (4)..(4): n is a, c, g, or t
  misc_feature (8)..(8): n is a, c, g, or t
  misc_feature (11)..(24): n is a, c, g, or t
  misc_feature (26)..(27): n is a, c, g, or t
  misc_feature (29)..(30): n is a, c, g, or t
  misc_feature (33)..(33): n is a, c, g, or t
  misc_feature (37)..(40): n is a, c, g, or t
  misc_feature (70)..(70): n is a, c, g, or t
  misc_feature (483)..(483): n is a, c, g, or t
  misc_feature (499)..(499): n is a, c, g, or t
  misc_feature (506)..(506): n is a, c, g, or t
gacngccntcnnnnnnnnnnnnnnanncnnacnaaannnnagaccaaaacactaaggtctaatctctctngctcgacaagtgttcgccggcggttccatcacagcaagaagctctaaaactaattcatgggtaaggttcacggatcgctggcacgtgtccggaaaggtgcggggtcagactccaaaggtggccaagcaggacaagaagaagaagccgcgaggccgcgcccacaagcgtatgcagtacaatcgccgcttcgtcaccgccgtagttggatttgggaagaagcgtggacccaattcttcagagaagtgagcagcttgctctttgaggagtttggttatggagaggcagtggttgatcacgaagcactagtttcgtagttttatattttatttatagcttaactacaattcagtttatttgtttatacttaaaacctgaatttgttttgttcaagacacttctcagagggttaaaanttgcaaatgcatgggntgtgccnattttgagatttctatgagcatagattatgttggctt

SEQ ID NO: 2641 - DNA, 529 bp, Fraxinus spp
cgtactcagacgccgggaacgcaaatcccatttaaccaataaataccagaagaactaaccctagaaccaatttcgctccagcaagttgcatctctttgtctaaatttactactcacagaaatcaacaatggtaaggttcatggatcattggcacgtgccggtaaagtgagaggacaaacgccaaaggtggccaagcaggacaagaagaagaagccccgtggccgtgctcacaagaggatgcaatacaaccgccgcttcgtcaccgccgttgttggctttggaaagaagaggggaccaaactcatcagagaagtaaactgaagaagctagtatctttttatcgggcaaaatgcatttgccatctgagttagttgttttcaaaaaatgcgtgttgttaattagtagactaagtttctatttctgttttatatttttgctttgattatgttgatcatctaatggctttacaaggttaaagaaagttctgtttaagttgaatcaatttcgaaatgaattcgttatccatgcct

SEQ ID NO: 2642 - DNA, 419 bp, Trigonella foenum-graecum
ccgcagttcagcaaccggggagcactcattcgacaagtccgccatgggtaaggttcatggatctttagctcgtgccggtaaggtgagaggtcaaaacacctaaagtggctaagcaagacaagaagaagaagccccgtggccgcgcttacaagaggatgcaatacaaccgtcgtttcgtcaccgcagtggtcggattcggcaaaaagaggggacctaactcatctgagaagtaagaactatgcaatttaaaaaagttattgtttgaagcttttatggatttaatctgtatttttccctgttttttgtaatgttttatgatacttattttatccactggtagtaaggatgaagttgaacttgaagttttgttatctaaatattatgtgattttgatattagttaagcttaattcttggtcc

SEQ ID NO: 2643 - DNA, 793 bp, Gossypium hirsutum
gctcaccgccataagcgaaatcaaaagccagcagcgctgcagctaaaagagcagtcgtttgacaattattcgccatgggtaaggttcacggatctctagctcgtgctggtaaggtgagaggccaaactcctaaagtggccaagcaagacaagaagaagaagccccgtggccgcgcttacaagcggatgcaatacaaccgccgcttcgtcaccgcagtggttggatttggcaaaaaagaggggacctaactcatctgagaagtaagagatctatgtaggtgaaagaaggcaagaagccttgttgaaagctttgatggattttaagtctttgtttcttttgataatgtttttatgatactggtttcaaggattggattgaactaccattttgtttgctagatattatgtgatattgttatcaattatcttaatttttggtttactatgagtttcgattcctcttcatccatgctataattgacttgccgccgccgccgcccccgccccctgcattcactgccgaaactaattgttctactagttagggctgagtggagaatgatttgaaatactactatctgagaatgtggagtccaaaataatgaacgaatggatagattattttcgttaaagtaattgatttcccacttaattcttctatatgctctcgtgatcatggaaattgaaatttagtccttgaattcattatgttgtgggtctgcaatgattatcatgttcttgaataatcagcctaacctctttcaataggaaaaaagaaaaaagtaccgactgcg

SEQ ID NO: 2644 - DNA, 473 bp, Abies balsamea
ggctaatcgaaggagattgagattgtttccgagcattgaaatcgctacatcacaatgagtaaggttcatggttcccttgcccgagcagggaaagtgagagggcagacgcccaaggtggccaagcaagacaagaagaagaagcccagaggccgtgcccacaagcgaatgcaatacaaccgccggtttgtcaccgcagtggttactttcggaaagaagagagggccaaactcctctgagaagtaaatgactagggccaatggcaggagggaagacatccggttttgaaagatcatttttttggagatttctttcttgaactttgggatttttgttcgtagttaatttctttttgataacaatcatgtaattttgtttaggttggaaacgagaagaaaattattttggatttgtaccatgtaaaatggtttctttgaatggtcatatgatataatttatgcatttggctgtttact

SEQ ID NO: 2645 - DNA, 684 bp, Ambrosia trifida
gacaatcatctgtttctctattgctacatacatccagccgaaacacagactagaatcagccacacaatcacatcttcatcatgggaaaggttcacggatcgttggctcgtgccggtaaggtgagaggccaaacaccaaaggttgccaaacaagacaagaagaaacagccacgtggacgcgctcataaacgcatccaatacaacaggcgcttcgtcaccgccgttgttggatttggcaagaagagggggccaaactcatcagagaagtaaggtgagggatagcattatttgttaacttgaaatatgtgttatgtaagctcaaaagtttttgtttggtttttgctgctacgcattttgttttgttaactaaaccatgaattagtgaacgttaatcagttttgtttggcggttttgttttcgaaactgtcatggttaagaagatatgttgttgctaatgatatgcatgattgatgaaaggtagcatagaatggtcaaatttattgtcatggtttgatccaagtttcttagccttacattttgcattctaataaaaataagtaggtcagaatcgcctctgtgaaaaatgctatgtcttctgcgtttattaatgtgtttctttgccaccattatgttggggagcgatggcatgacagcgtaaccagtaaccactctttctgcttgttac

SEQ ID NO: 2646 - DNA, 385 bp, Brassica napus
cgcactcctttaagcttattgtagccgtgggaagaaaaagcagagaagcaaatcagcagccatgggaaaagtacacggatcgttggcacgtgccggtaaggttagagggcagacaccgaaggtagcgaagcaagacaagaagaagaagcctagaggacgcgctcacaagcgtctccagcacaatcgccgtttcgttaccgccgttgttggtttcggaaagaagagaggacccaactcttctgagaagtagaagaagattgatgatatgcattgaagattctccgttgctctttttgtaacttcaatctttcttcttttgttttagtcatgtatctttggtactttatatgttttgattccatgctatgaaatacgattttagttt

SEQ ID NO: 2647 - DNA, 422 bp, Brassica napus
acctagcgtcggcgcatccagcaacaaagcagagaagccagaagtgtttccgtaattgatcatggggaaggtgcacggttcattggctcgtgccggtaaggtgaggggtcagacaccaaaagtcgccaagcaggacaaaaagaagaagccccgtggccgtgctcacaagcgattgcaacacaaccgccgtttcgtcaccgccgttgttggctttggcaagaagagaggaccaaactcatcagagaagtagacatcaactgtttccccttttgattgtggttttcttgattatttgaatcactcgttagtttatcaaccaagccaatggatgttgttgagccaatgtttctttaatcagtttcatttgggttacatctgtttctcatctgattatgtaccatacgttcttggattagtggctt

SEQ ID NO: 2648 - DNA, 459 bp, Brassica napus
gaactcagagattacgcactcctttcagctaatcacagccgtcggaagaaaaaggagagaagcaaatcagccatgggaaaagtgcacggatccttggcacgtgccggtaaggtgagaggacagacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagattgatgatatttgcatgaaagagatgcttctttcaaagctctattgctctttttgtaacttgatctttctccgtttgttttagtcatgtatctttggttcttaactctatatgttttgattccatgctatgaaatacgatcttagttttgaatctgaaaaaaaacaaaaaaataaacgtagacgtactccgacg

SEQ ID NO: 2649 - DNA, 338 bp, Brassica napus
cacatttgccggaggtagcgccgattcagtcgtcagagcaactatgggtaaggttcacggttcattggctcgtgccggtaaggtgagaggacagactcctaaagtggctaagcaggacaagaagaagaagccacgtggtcgtgctcacaagcgtcttcagcacaaccgccgtttcgtcaccgccgttgttggatttggcaagaagagaggacccaactcttctgagaaatagatgatgaacgcattggagcttaagttttgagtttttttttccaaaaaatatcgtacttgtttaatgttctaagactctgcaattttcttaatcaaatcgacttttt

SEQ ID NO: 2650 - DNA, 600 bp, Cephalotaxus harringtonia
ccgaatgttagcatcatcagcagcggaagaaggagaagatcagcagccagcagttgtttaaggaaaaccaaaatgagtaaggtgcatggatcgttggcccgagcagggaaggtgagggggcagacccccaaggtcgccaaacaagacaagaagaagaagcctagaggccgagcccacaaacgtatgcagtacaaccgccgttttgttactgccgtgcttggatttgggaagaaaagagggccaaactcttctgagaagtaactgtataggtgtgtactatggaggaaaaggagttcagttttggaagcccatccattttgggggcactttccttattgtgggaactttgtttttgaggatgctttttgttaacatgatttatttttatttttaatatattgctctgtaaaacagatttataatgttttccatatttctactatgatattggattgttaccttcatgaagagaatttgtgttattctgcactatagcttctcatgcttgatgtttttagctattggttggctttctagatttctatagctcatttgccagagtcaaattcataattgttgtagatttatggtgcttgtttt

SEQ ID NO: 2651 - DNA, 322 bp, Cirsium arvense
aactgcttctctcccgctagatccagccgaatcgaacaccagaagcagccacagaatccgaattcaccatgggtaaggttcacggatcgttggctcgtgccggaaaagttagaggtcaaacacctaaggtcgcgaagcaggacaagaagaagcagccacgtggacgtgctcacaagcgcatccaatacaaccgccgtttcgtcaccgctgttgttgggtttggaaagaagaggggaccaaactcatcagagaagtaagcataatgccctagttttgaatcgtagtttgtttgaagacttgtttattattgttcgtcttagta

SEQ ID NO: 2652 - DNA, 393 bp, Cirsium arvense
tccaaccaatcgaaagccaaatcagaaagcagcaaagaaggccgaattcgaaatgggaaaggttcacggatcgttggctcgtgctggtaaagtgagaggccaaaccccaaaagtggccaagcaagacaagaagaagcagcctcgtggaagagctcacaagcgtattcagtacaaccgccgtttcgtaacagctgttgttggttttggaaagaagaggggaccaaactcatctgagaagtaagctaaggggaatgtgtaattttgtaagcttagttttaatgaaattgtttttaggtttccatcattttatttagacaatgtttatgatgcctcaccacactttttctactataatatgagatttctttaaaaaagaaaaaagtaccgactgcg

SEQ ID NO: 2653 - DNA, 598 bp, Distylium racemosum
gccggccgcgggaatagtggtgtctgctactgatccggaagaaggaggaggaggagcagaaaaagatcttctatcaaaatgagtaaggtgcatggatcgttggcccgtgcagggaaggtgagaggtcagacccccaaggtcgccaaacaagacaagaagaagaaacccagaggccgcgctcacaagcgcatgcaatacaatcgccgatttgttactgctgtgcttggatttgggaagaagagaggtccaaactcttctgagaagtaattgactaggtgcactaaggaggaatccagtgttgaaagcctggccacattgaggatggctttcattacaatagaattttctacatttcatggcttattatcgtagtgttttttatgttcaatacgtgactgtgcaagaacacttgtagattttgatatttttacaatgacaaagtcctacgagtgaagggaagaaacagaaattttgatactggaattaagcttgtaaatgaagctaaatcttttgtgattttgcacaatatttgcttttatttagtttttagttattgctttgcctttggcattcatcaattatatttgataagagtggc

SEQ ID NO: 2654 - DNA, 318 bp, Flaveria ramosissima
ccctagaatccaaagcacctgcttatcgctccctacatccagctgaaacgaaggctagatacagctacacaatctcaaattcaacatgggaaaggttcacggatcgttggctcgtgctggtaaagtgagaggtcaaaccccgaaggttgcgaaacaagacaagaagaaacagccccgtggtcgtgctcacaagcgcattcaatacaaccgccgattcgtcaccgccgttgtcggttttggaaagaagagggggccgaactcatcagagaagtaaggtgcgggatcacaatgctcagttgtaatcgttttttgactgat

SEQ ID NO: 2655 - DNA, 442 bp, Flaveria ramosissima
atggggagaaccatctgcttctctctcacatcatccagccgaaacgaagatcagaaacatctaaaagttcacaaattcgacatgggaaaggttcatggatcgttggctcgtgctggtaaagtgagaggtcaaacaccaaaggttgcgaaacaagacaagaagaaacagcctcgtggacgtgctcataagcgcattcaatacaacagaagattcgtcactgctgttgttggttttggcaaaaagaggggaccaaactcttcagagaagtaaaaagcatgagctgaaagttcattatgtgaaagctcataatgtgaaagctcataatgatttgtttagtttaagtgagacaaatatttgttttgcgatctaaaccatatcaattagcgaccattaattactactttattgttggttggtgattttgaaactttatcatggtcaa

SEQ ID NO: 2656 - DNA, 295 bp, Flaveria ramosissima
aaaggactccaaactcaatattatgggtaaagttcacggatcattggctcgtgcgggtaaggtgagaggtcaaacccctaaggtcgcgaagcaggacaagaagaagcagcctcgcggacgtgctcacaagcgtattcagtacaatcgtcgtttcgtcaccgccgttgttggctttgggaaaaagaggggaccaaactcatcagagaagtaaagcaagcagaaggaatttgtagtttaatggaatgtgttatttaaacaatgtcaaccacaccatttttactataatttgaaattt

SEQ ID NO: 2657 - DNA, 381 bp, Flaveria ramosissima
tcacaaaccctagatctattcttctcacaatccagttgccctaaccccgccgaaccgaagaacagtaggcatccgatcgtcaaattcaacatgggtaaggttcatggatcgttggctcgtgctggaaaggtgagaggtcaaacgcctaaggtcgctaagcaagataagaagaagcagccacgtggccgtgctcacaagcgcattcaatacaaccgccgtttcgtcaccgccgttgttggctttggtaagaagagggggccaaattcatctgagaagtaaggtgactgatgcatagcagcatagtcttgtagcttactttttatggaagttttagacctttgccatgtttaaacaatgcttattattttgttatgaagttgg

SEQ ID NO: 2658 - DNA, 398 bp, Flaveria ramosissima
agaaccatctgcttctctctcacatcatccagccgaaacgaagatcagaaacatcaaaaagttcacaaattcgtcatgggaaaggttcatgggtcgttggctcgtgctggtaaagtgagaggtcaaacaccaaaggttgcgaaacaagacaagaagaaacagcctcgtggacgtgctcataagcgcattcaatacaacagaagattcgtcactgctgttgttggttttggcaagaagaggggaccaaactcttcagagaagtaaaaagcatgagctgaaagtttcattatgtaaaagctcataatgatttgtttagtttaagtgagacaaatatttgttttgtgatctaaaccatatcaattagcgaccattaattacttactttattgttggttggt

SEQ ID NO: 2659 - DNA, 408 bp, Flaveria ramosissima
aaaggactcgaaactcaacattatgggtaaagttcacggatcattggctcgtgcgggtaaggtgagaggtcaaacccctaaagtggcgaagcaagacaagaagaagcagcctcgtggacgtgctcacaagcgtattcagtacaatcgccgtttcgtcaccgccgttgttggctttgggaaaaagaggggaccaaactcatcagagaagtaaagcaagcagaaggaatttgtagttaaatggaattgtgttatttagacaatgtcaaccacaccatttttactataatttgaattttatttaatatttgctattaaattgttgctgaatatgttatttcatgtgttaatgattgctatatttggttattgacttgtggacagtgttgaattcaagtcggttgaattagt

SEQ ID NO: 2660 - DNA, 402 bp, Flaveria ramosissima
caaccgaccaaatcgaacacactaagggactctaattcaacatgggaaaggttcacggatcactggctcgtgcgggaaaagtgagaggtcaaacccctaaggtcgcaaagcaagacaagaagaagcagccgcgaggtcgtgctcacaagcggattcagtacaaccgccgcttcgtcaccgctgttgttggatttgggaagaagagaggaccaaactcatcagagaagtaagatgaaggattaaaggatgtttcgttttgtaagattaggtttatgaacctgttttcggatatgatttttaatattttgagtttagtgttagatgttagtgttcttgattatgtcatgatttacaagttttgatcggtgtgttggagatcggagatggatcatctcgaatcgg

SEQ ID NO: 2661 - DNA, 413 bp, Flaveria ramosissima
agcacctgcttcatccaaccgaaacgaagactaatcacagctacaggatctcaaattcaacatgggaaaggttcacggatcgttggctcgtgctggtaaagtgagaggtcaaaccccgaaggtcgcgaaacaagacaagaagaaacagcctcgaggacgtgctcacaagcgcattcaatacaacaggcgattcgtcaccgccgttgttggttttggaaagaagagggggcccaactcgtcggagaagtaaggtgcaggatcacaatgctcagttgcaaaccttttttgacttatgttctcattttgattgttaaaaagtttgttatgttcaattaaccttatcaagtagtaactttaaactgatgagttttgatgattatggttttgtaagcatatcatcgattacctgtttg

SEQ ID NO: 2662 - DNA, 615 bp, Pinus pinaster
aacgttgtttattcgaccctgtgcattggttatcggactacgagacctttattggtaaaccctaaataataaacccttaacctgcaaccgcaatataaagacaaaccctaatcagtatgatccttacttcgcagattgactttagagttggaagagctctcggctaattgaaggagattgagcctgtattcaactattgaaattgctctatcacaatgagtaaagttcatggttcccttgcccgagcagggaaagtgagagggcagacgcccaaggtggccaagcaagacaagaagaagaagcctagaggccgcgcccacaagcgaatgcaatacaaccgccggtttgttactgcagtggttacttttggaaagaaaagagggccaaactcctctgagaagtaaatgagtaggtgcaatggcaggagtgaagtcatccggttttgaaagtttcatctttttggggatgtcattttaactttagagtttttgttggtagtcaatttcttatacaatcatgtacttttgttgaggttggaacagggaagaaaattgttaaggatttgtactgtgtaaaatgtttctttttgaatggtaatgtgatatatttatgcat

SEQ ID NO: 2663 - DNA, 638 bp, Pinus pinaster
aaatcctgggagagagccttatttatcgttgtttagggtttttgctatttttttatagggtttgtacaaccatccttattgtacttgtcatagtttatcgttgattagggttttgtctgatctatttctcttccgcaattttctacagggttgtgttttttacagtgttacctctgcgggctttcatttttccatatcgattcttttgattcagtagctccggcaacgttactgcatcacaatgagtaaggttcatggttcccttgcccgagcggggaaagtgagagggcagacgcccaaggtggccaaacaagacaagaagaagaagcctagaggccgcgcccacaagcgaatgcaatacaaccgccggtttgttaccgcagtggttacttttggaaagaagagagggccaaactcctctgagaagtaaatgactaggtgcaatggcaggagtgaagtcatccggttttgaaagttacatctttttggggatgtcttcctttaacttctggatttttgttggtagttaatttcttatacaatcatttacttttgttgaggttggaacagggaagaaaattgttatggaattgtagtttgtaaaatgtttcttttttgaatggtaatgtgatatatta

SEQ ID NO: 2664 - DNA, 535 bp, Pinus pinaster
ttatcgcaacgttgtttatccgaccctgtgcgttggttatcggactacgagacctttattgattgactttagagttggaagagctctcggctaattgaaggagattgagcctgtattcaaccattgaaattgctgtatcacaatgagtaaagttcatggttcccttgcccgagcagggaaagtgagagggcagacgcccaaggtggccaagcaagacaagaagaagaagcctagaggccgcgcccacaagcgaatgcaatacaaccgccggtttgttactgcagtggttacttttggaaagaaaagagggccaaactcctctgagaagtaaatgagtaggtgcaatggcaggagtgaagtcatccggttttgaaaatttcatctttttggggatgtcattttaactttagagtttttgttggtagtcaatttcttatacaatcatgtactttgttgaggttggaacagggaagaaaattgttaaggatctgtactatgtaaaatgtttctttttgaatggtaatgtgatatattt

SEQ ID NO: 2665 - DNA, 680 bp, Pinus pinaster
aaaaaaatcacgggagagagcgttatttatcgttgattagggtttttgctaatttttttatagggtttgtacaaccattcttattgtacttgtaataatttatcgttgattagggttttgtctgatctatttctctggtcttccgcaattttctacagggttgtgtttttttttgtgttacctctgcgagcttttatctttccgtatcgagtccttttacataaattcagacgcaccacgatattcctttgatttagtagctcctgcaacgtcactgcatcacaatgagtaaggttcatggttcccttgcccgagcggggaaagtgagagggcagacgcccaaggtggccaaacaagacaagaagaagaagcctagaggccgcgcccacaagcgaatgcaatacaaccgccggtttgttaccgcagtggttacttttggaaagaagagagggccaaactcctctgagaagtaaatgactaggtgcaatggcaggagtgaagtcatccggttttgaaagttacatcttttttggggatgtcttccttaaacttcgggatttttgttggtagttaatttcttatacgatcatttacttttgttgaggttggaacagggaagaaaattgttatggaattgtattttgtaaaatgtttctttttgaatggtaatgtgatatatt

SEQ ID NO: 2666 - DNA, 536 bp, Pinus pinaster
cttatcgcaacgttgtttattcgaccctgtgcattggttatcggactacgagacctttattgattgactttagagttggaagagctctcggctaattgaaggtgattgagcctgtattcaaccattgaaattgctgtatcacaatgagtaaagttcatggttcccttgcccgagcagggaaagtgagagggcagacgcccaaggtggccaagcaagacaagaagaagaagcctagaggccgcgcccacaagcgaatgcaatacaaccgccggtttgttaccgcagtggttacttttggaaagaaaagagggccaaactcctctgagaagtaaatgagtaggtgcaacggcaggagtgaagtcatccggttttgaaagtttcatctttttggggatgtcattttaactttagagtttttgttggtagtcaatttcttatacaatcatgtacttttgttgaggttggaacagggaagaaaattattaaggatctgtactatgtaaaatgtttcttttgaatggtaatgtgatatattt

SEQ ID NO: 2667 - DNA, 386 bp, Avena sativa
catgggtaaggttcacggatcgctggctcgtgccggtaaggtgcgcgggcagacccccaaggtggcgaagcaggacaagaagaagcagccccgcggccgcgcccacaagaggatccagtacaaccgccgcttcgtcaccgccgtcgtcggcttcggcaagaagcgcggccccaactcctccgagaagtagacgcgcgtaatgtgtcgagaagcttcttccttgctgtagtttccctctcgtgttgttacggaagaagatggaagaagaaaaaccttaaattactatgttgttttctgtgatagatgtgatatcgaactcatgtgctaagtatgcctacttcgtttagctgagaattttgagttatggtgatatgagttgattactt

SEQ ID NO: 2668 - DNA, 387 bp, Avena sativa
acatgggcaaggttcacggatcgctggctcgtgccgggaaggtgcgcgggcagacccccaaggtggcgaagcaggacaagaagaagcagccccgcggccgcgcccacaagaggatccagtacaaccgccgcttcgtcaccgccgtcgtcggcttcggcaagaagcgcggccccaattcctccgagaagtagacgcgcgtaatgtgtcaagaagcttcttccttgctgtagtttccctctcgtgttgttgcggaagatggaagaaaaaacttaattactctgttgtttcctatgatagatgagatatcgaactcatgtgcttaagtatgcctgcttcttttagctgagaatttgtgatatgagttgattacttgaatttgcttatgct

SEQ ID NO: 2669 - DNA, 383 bp, Avena sativa
acatgggtaaggttcacggatcgctggctcgtgccggtaaggtgcgcgggcagacccccaaggtggcgaagcaggacaagaagaagcagccccgcggccgcgcccacaagaggatccagtacaaccgccgcttcgtcaccgccgtcgtaggcttcggcaagaagcgtggccccaactcctccgagaagtagatgcgcgtaatgtgtcaaagaagcttcttccttgctgtagtttccctctcgtgttgttacggaagaagatggaagaaaaaccttaatttactctgttgtttcctgtgatagatgagatgttgaactcatgtgcttaagtatgcctgcttcgtctagctgagaatttgagatatggttatatgagttgattac

SEQ ID NO: 2670 - DNA, 485 bp, Primula obconica
agagccgtcaccagaagaagcaacagagaattggtcatgggaaaggtacacggatcattggcacgtgcggggaaagtgagagggcagacaccaaaggttgcaaagcaggacaagaagaagaagccacgtggcagagcccacaagcgtctccagtacacccgccgcttcgtcaccgccgttgttggctttgggaagaagaggggacccaattcttcagagaagtaagctgatgaaatgagtgttttgttgagaaggcttatccttctcctgtcaacttttagttaccatccatttaatgttgttctgaatttctagagattggtacactttattttcccctgggtgatttgtatctcaaatattaaaaggagttcagttctgttcttaatttgatcgtggacctaacttttctttttgtgcctaatgaatttatctcgtcttgctagagaacaaagtgaatgtgttgctctattctgcactagagg

SEQ ID NO: 2671 - DNA, 500 bp, Primula obconica
ccttgttcttcttcgtcttcattttctcggcctctcaaagcaataaaacccaccttagctaagtagcaataatctcgaagaagcagcaatgggaaaggtgcacggatcgttggcacgtgcgggtaaagtgaggggccaaactccaaaggtcgccaagcaggacaagaagaagaagccacgtggcagagcccacaagcgcctccagtacactcgccgctttgttaccgcagttgttggctttggaaagaagaggggacccaactcatccgagaagtaagcttgaagagttttttaatggagttcaagacttgttactagtttgaatgaacaattggttatgcgaaatgtaattctgattttaatttctcagagaccgcatgcgtttttccgtttttgctatgttgaatttatgttgacccttcttactcagtagttgaattttggaagttgttggctttatagtttcgtgttcttgaatttgtttatttattccaattcct

SEQ ID NO: 2672 - DNA, 186 bp, Eutrema halophilum
gggaaggttcacggttcattggctcgtgccggtaaggtgagaggacagacacctaaagtggctaagcaggacaagaagaagaagccacgtggccgtgcccacaaacggatgcaacacaaccgtcgtttcgtcaccgccgttgttggatttggcaagaagagaggacccaactcatctgagaagtag

SEQ ID NO: 2673 - DNA, 460 bp, Arabidopsis lyrata
aagcagcaagctatcgagagcatcgtcgtctccaacagccaagagagcagaagcttgaagaatctctataatctgaaaaatgggaaaggtccacggttcattggctcgtgccggtaaggtgagaggtcagacacctaaagtggctaagcaggacaaaaagaagaagcctcgtggtcgtgctcacaagcgtctgcaacacaaccgccgtttcgtcactgccgttgttggttttggcaagaagagaggaccaaactcatcagagaagtagacaaaaaaaaaaggttttactctttcagattttatggaatgtttttgatattgtgccattagttggtacaaactcatcaatatccaagtggtttaactttcgttatctacaaatcagtggatgttatgtcaatgttcttgtcaatttgatttgtgtttctccccggattagacataagttcgtggattattg

SEQ ID NO: 2674 - DNA, 238 bp, Arabidopsis lyrata
ccggagagagccgccaattccgtcgtaagaagaatcctcgtaatcaatcatgggtaaggtacacggttcattggctcgtgccggtaaggtgagaggtcagacaccgaaagtggcaaagcaggataagaagaagaagccacgtggtcgtgcccacaaaaggttgcaacacaatcgccgtttcgtcaccgccgttgttggatttggcaagaagagaggacccaactcgtctgagaagtag

SEQ ID NO: 2675 - DNA, 230 bp, Arabidopsis lyrata
aagaagagaagttaataaatcatgggaaaggtacatggatctttggctcgtgctggtaaggttagaggacaaactccaaaggttgcgaagcaagataagaaaaagaagcctagaggtcgtgctcacaaacgtctgcaacacaaccgccgtttcgtcaccgccgttgttggtttcggaaagaagagaggacccaactcttctgagaagtagaagaaggtagagaaagatat

SEQ ID NO: 2676 - DNA, 522 bp, Arabidopsis thaliana
tagtaagcaagcaagctatcgagcatcgtcgtctccaacagccaagagaagcagaagcttgaagaatctctgtaatctaaaaaatgggaaaggtccacggttcattggctcgtgccggtaaggtgagaggtcagacacctaaagtggctaagcaggacaagaagaagaagcctcgtggtcgtgctcataagcgtctgcaacacaaccgccgtttcgtcaccgccgttgttggttttggcaagaagagaggaccaaactcatcagagaagtagatagaagaaggttttacccttttcagattttatgggatgtttttgatattgtgtcattagttggtccaaactcatcgatatcaaagtggtttaaccttggttatctacaaatcagtggatgttgtgtcaattttcttgtcaatttgatttttgtttctcctcagattagacttaagttcttgaattattgaacctctcttttgcagttatgtattcgtgtgtaccctttaaattccactattgtaaaacc

SEQ ID NO: 2677 - DNA, 501 bp, Arabidopsis thaliana
atctctgagaagagttaaaagcgttgccgtacactataaccggagagagcgccgattccgtcgtcagaagaatcctcgtaaacaatcatgggtaaggtacacggttccttggctcgtgccggtaaggtgagaggtcagacaccgaaagtggcaaagcaggataagaagaagaagccacgtggccgtgctcacaaaaggttgcaacacaatcgccgtttcgtaaccgccgttgttggatttggcaagaagagaggacccaactcttctgagaagtagatgatgatgatgatcacacttcatgaagcttgaagttttactttctcgttagtatgaattctgcaatatccgctttgttatcgatatttgcttatttggtttttctatagacgatgtaattctcttgttcatttctccatcgaattgacttttgaccatacttttttcgacatatgttatttgcaaccttgatagcattctacaatcactgtttactctcgagcc

SEQ ID NO: 2678 - DNA, 443 bp, Arabidopsis thaliana
tcgaaaaccctaattctgagatttcgcacgaactcatttcagcttcttgcagccggcggaacggaggaacaaaaagcagagaagctaatcaatcatgggaaaggttcacggatctttggctcgtgccggtaaggttagaggacaaactccaaaggttgcgaagcaagataagaaaaagaagcccagaggtcgtgctcacaagcgtctgcagcacaaccgtcgttttgtcaccgcagttgttggtttcggaaagaagagaggacccaactcttctgagaaatagaagaagttagagagaaagatgttgtcgtgaaacttctcaaggtcatttgtaactttttgttttctttggcaccgaactattatgttttgattctatgctatgaaatactgttttttcacttatgattttggtcaattaaacataagatatgatttttgcc

SEQ ID NO: 2679 - DNA, 426 bp, Artemisia annua
gcacacatcttcacagctgctgcatctcaaaccataacaagcaaacaacctcaaatcaaacatgggaaaggttcacggatcgttagcacgtgccggaaaggttagaggacagacaccaaaggttgctaaacaagataagaagaaacagccacgtggtcgtgctcacaaacgtattcagtacaaccgccgttttgttactgctgttgttggctttggaaagaagaggggacccaactcatcagagaagtaagcttgaggcgaggaatcatgtagttttgtaatgttagtttaatgcaatcgtttcgacattgatatctttatgtttttgacgatgcttattttgtcggtcacttctagtataacctgaagtttcgttcaagtgttttgagttttatgtttggtattatagttccagaatctgttatg

SEQ ID NO: 2680 - DNA, 545 bp, Artemisia annua
gcacacatcttcacagctgctgcatctcaaaccataacaagcaaacaacctcaaatccaacatgggaaaggtgcacggatcgttggcacgtgccggaaaggttagaggacagacaccaaaggttgctaaacaagacaagaagaaacagccacgtggacgtgctcacaaacgtattcagtacaaccgccgttttgttactgctgttgttggctttggaaagaagaggggacctaactcatcagagaagtaagcttgagccgaggaatcatgtagttttgtaatgttagtttaatgtaatcgtttcgacattgatatctttatgtttttgacgatgtttattttgccggtcacttctactataacctgaagtttcgttcaagtgttttgagttttatgttttggtattatagttctggaatctattatgttgcatgttttgtttgttcgcttgttgagttctggttctgaatgatggtaccataaaatctttacggtgactgaacgtaaccgtttaaagatgtgcatcacaaaaaaaaaaaaaaaaa

SEQ ID NO: 2681 - DNA, 439 bp, Artemisia annua
aagcagtggtattaacgcagtactccgacggggggaaccaactgctgcttgcgctctagatccatccatccagccggaaaaaaacaacaacatgggaaaggttcatggttcattggctcgtgctggtaaggtgagaggacagaccccaaaggtcgctaagcaagacaagaagaagcagcctcgtggacgtgctcacaagcgcatccagtacaaccgccgttttgtcactgctgttgttggtttcggaaagaagaggggtccaaactcatcagagaaataagcatgttatgtcttgatggtttgcttagaagacttgtctagttttttgtttacgttaaattttgttatgttcaccaaaccttatcaggtattttactctaaagtatgttgacatttgatgcctgtgatattgaatggttatcatgaatgacttgtttaa

SEQ ID NO: 2682 - DNA, 447 bp, Artemisia annua
aagcagtggtatcacgcagtactccgacggggggaaccaactgctgcttgcgctctagatccatccagccggaaaaaaagaaaacaacaacatgggaaaggttcatggttcattggctcgtgctggtaaggtgagaggacagaccccaaaggtcgctaagcaagacaagaagaagcagccccgtggacgtgctcacaagcgcatccagtacaaccgccgtttcgtcactgctgttgttggtttcggaaagaagaggggtccaaactcatcagagaaataagcatgatatgtcttgatggtttgattagaagacttgtctagttttttgttttcgtttaattttgttatgttcaccaaaccttatcaggtatttcactcttaaagtatgttgacgtttgatgcctgtgatactgaatggttatcatgaattacttgtttaattaaagc

SEQ ID NO: 2683 - DNA, 472 bp, Artemisia annua
agtggtatcaacgcagtactccgacgggggaaccaactgctgcttgcgctctagatccatccatccagccggaaaaaaagaacaccaaaacaacaacatgggaaaggttcacggttcattggctcgtgctggtaaggtgagaggacagaccccaaaggtcgctaagcaagacaagaagaagcagccccgtggacgtgctcacaagcgcatccagtacaaccgccgttttgtcactgctgttgttggttttggaaagaagaggggtccaaactcatcagagaaataagcatgatatgtcttgatggtttgcttagaagacttgtctagttttttgttttcgtttaattttgttatgttcaccaaaacttatcaggtattttactctaaagtatgttgacttttgatgcctgtgatattgaatggttatcatgaattgaatggttaattaaagcttatggctgctttgtcttga

SEQ ID NO: 2684 - DNA, 535 bp, Brassica juncea
cgcaaatcagacatgggaagtgaaagcagtgacgcaaatcagacatggggaaagttcacggatccttggcacgtgccggtaaggtgagaggacagacaccaaaggtagcgaagcaagacaagaagaagaaacctagaggacgtgctcacaagcgtctccagcacaaccgccgtttcgttaccgccgttgttggtttcggtaagaagaggggacccaactcttctgagaagtagaagaatgacttataaaagcttctcataatggctattttgtgcatttcttctattcgtatgttttagtcatgtttcttttgcacttatatatgttttgattctatgagttacgactttactcctgaatttgattctcaacttccagcagtaatagtttgattttgtctgcaagtttacaccaaccatggggttttataatttagttattgaatgatatgtttctattctacggataatgtaatcatacaagaaactgtgattatgatcttccctcgtcaatcaatttataataggcgatgctt

SEQ ID NO: 2685 - DNA, 382 bp, Brassica juncea
ctcgtttcaggttatttcagccgtcggaagaaaaagcagagaagcaaaccagccatgggcaaagttcacgggtcattggcgcgtgctggtaaggtgagagggcagacaccgaaggtagcgaagcaagataagaagaagaaacctagaggacgtgctcacaagcgtcttcagcacaatcgccgtttcgttaccgccgttgttggtttcggtaagaagagaggacccaactcttctgagaagtagaagatcgatatgcttctcttaaagacaacttcggcaatctttcttcgtttgttctaagtcatgtttttttggaactcctgtgtttaattctatgcaatgaaatacgactgttgacttttcgatctgattctcaacataa

SEQ ID NO: 2686 - DNA, 428 bp, Brassica juncea
agcagagaagcaaatcaaccatggggagatttcgcactcgtttcagctaattgcagccgtcggaagagaaagcagagaagcaaatcaaccatggggaaagttcacggatctttggcacgtgccggtaaggtgagaggacagacaccaaaggtagcgaagcaagacaagaagaagaaacccagaggacgtgcccacaagcgtctccagcacaaccgccgtttcgttaccgccgttgttggtttcggtaagaagagaggacccaactcttctgagaagtagaagccctttctgttacaagatagatatgctggaacgggacctttctgtgaaaggttctctcatatagtcatatggctattttgtaacctttcttttgttttagtcaatgtttactttggcactaaagttatgttttaatactatgaaat

SEQ ID NO: 2687 - DNA, 942 bp, Brassica juncea
cgaaggtggcgaagcaagataagaagaaaaaagcagtgacgcaaatcagccatgggcaaagttcacggatccttggctcgtgccggtaaggtgagaggacagacaccgaaggtggcgaagcaagataagaagaagaaacccagaggacgtgcacacaagcgtctccagcacaatcgccgtttcgttaccgccgttgtgggctttggtaagaagagaggacccaactcttctgagaagtagaagaagaagctaagatatgctgtgaaaagcttctcgtaatggctgttctgtgcatttctcttcgtttgttttagtcatgtttctttggcactaaacttatatatcttttgattctatgctctgaattacgactttactcctgaatctgattctcagctttcaatggtaatagtttgatttttttagacaaaatatgccatctatatagaatacaatagttttacacccttgaccaaggcataaagaacacacaaagatattgtacacacactcagtcactaaaaacatagatgcacctgaaataaaacttagtatccacgaacctgtctggtcctaactgaaataggaccctttaaaatagctttacgtataataggctcttcaaccgaatgaaccatgttgtccacatgtcctgtatccgctctatcagaaccatccataagactttcctcatctttaacctcagtagtagtattagtcttagcattatgtttggtttcttcctcactgtcgtagacgacaaaagccttctccaacaacttcacagggtcttctctaaatgacatcacatcctcaatattatcatctgtatccgatatagacttcttaggttctgatctcacatccacttcaccttctgaaagatgaacatcctccacatgtcctgcatctgctctatcagaacaatccttgagacccgcg

SEQ ID NO: 2688 - DNA, 459 bp, Brassica juncea
cgcagagtacacggggaacctagcgtcgtcgccgccagccgcagagcagagaagccagaagagtctcagtgatcgaccatggggaaggtgcacggttctctggctcgtgccggtaaggtgagaggtcagacaccgaaagtagcaaagcaggacaagaaaaagaagccacgtggccgtgctcacaagcgattgcaacacaaccgccgtttcgtcaccgccgttgttggctttggcaagaagagaggaccaaactcatcagagaagtagacatgaactgtttcaccttttgattgtggttttcttgattatttgaatggctcgttagtctatcaaccaagccgatggatgttgttgagccaatgtttctttaatcagtttcatttgggttacatctgtttctcctctgattatgtaccatacgttcttggattagtggcttataaatttgattatttacta

SEQ ID NO: 2689 - DNA, 451 bp, Brassica juncea
acgcactcgtttcaggttattgcagccgtcggaagagaaagcagagaagcaaatcagccatgggcaaagttcacggttctttggcacgtgccggtaaggtgagaggacaaacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagccctttctgttacaagatagatatgctggaacgggacctttctgtgaaaggttctctcatatagtcatatggctattttgtaacctttcttttgttttagtcaatgtttactttggcactaaagttatgttttaatactatgaaatgaaatacaacttttttacatcttgatctagacatgaaagttgtattcaactcta

SEQ ID NO: 2690 - DNA, 1066 bp, Brassica juncea
tggctaagcaggacaagaagaagaagccacgtggacgtgccgattcagtcgtcagagcaactatgggtaaggttcacggttcattggctcgtgccggtaaggtgagaggacagacacctaaagtggctaagcaggacaagaagaagaagccacgtggacgtgcccacaaacgtcttcaacacaaccgccgtttcgtcaccgccgttgttggatttggcaagaagagaggaccaaactcgtctgagaaatagatgatgatcgctttggagttggaggttttgcgggttttgttttaatatctttctttgtttaatttgtaagactatgcttcttctcaatgaaattttttgagaaagagaagaatggtttctgatttataaagtttgtttgtgaattacaagtgtgttgacacaagactacaacgctcaaaacatttctcgtgacacacacacacaccctgcacacacatacattctcgtgactacacaagactacaacgacaaaaacatacttgaacaacgtacttgtctacaacacacaccagaagacatgggtgcttcacctctctctcgtgttcttctcaaatcacagacctctctcatgttcttgtttgcctccgacatactctctcatctttaaacaagtgggaaaggatgctgattccgacgacactgtcacctctcggaagtccacggtctaacaataaaacgacgccgacattacggcccgacatcatgctggagcagccctccgtcaagaacaaatcaaccggctccaaatcgatgaaactattccaccgcgtccactccgtgttccgatcgctcccgatcatgtctccgatgtgcaaattccccggggggaggaggaacatgcgtccacgagaaccacgtccaccgagggatgcgcgtcacggggatgctgtttggctaccgcaaagcgcgggtgaacttggcgattcaggagaacccgcgcactctcccgatcctcgtcctggagctggccatcccgacggcgaagctcttgcaggatctcggggtcggtctgatgaggatcgcgctcgagtgcg

SEQ ID NO: 2691 - DNA, 319 bp, Brassica juncea
aagcgacagttgccctaaaaagtttttacctagcgtcctcgtcgtctcctcgaacagcagagccagagaagccgaagattttctgtgatcgaccatggggaaggtgcacggttcattggcacgtgccgggaaggtgagaggtcagacaccgaaagtggctaagcaggacaagaagaagaagcctcgtggtcgtgctcacaagagattgcaacacaaccgccgtttcgtcaccgctgtggttggctttggcaagaagagaggaccgaactcatctgagaagtagacagaagcaatttttacctttttggtgtttttgata

SEQ ID NO: 2692 - DNA, 464 bp, Brassica juncea
ctcacagtcaggtataaataaatattatcagcacccaaaaccctaactctgagattacgcctcctttcagcttaacgcagccgtcggaagaaaaagcagagaagcaaatcagcagccatgggaaaagtacacggatcgttggcacgtgccgggaaggttagagggcagacaccgaaggtagcgaagcaagataagaagaagaagcctagaggacgcgctcacaagcgtctccagcacaatcgccgtttcgttaccgctgttgttggtttcggtaagaagagaggacccaactcttctgagaagtagagaagaagattgatgatatgcattgaagattctccgttgctctttttgtaacttaaatctttcttcttttgttttagtaatgtatctttggtactttatatgttttaattccatgctatgaaatacgattttagttttgaatctgatgatcaacctcc

SEQ ID NO: 2693 - DNA, 468 bp, Brassica juncea
ctcgtttcagctaattgcagccgtcggaagagaaagcagagaagcaaatcaaccatggggaaagttcacggatctttggcacgtgccggtaaggtgagaggacagacaccaaaggtagcgaagcaagacaagaagaagaaacccagaggacgtgcccacaagcgtctccagcacaaccgccgtttcgttaccgccgttgttggtttcggtaagaagaggggacccaactcttctgagaagtagaagaatgacttataaaagcttctcataatggctattttgtgcatttcttctattcgtatgttttagtcatgttccttttgcacttatatatgttttgattctatgaattacgaatttactcttgaatttgattctcaacttccaacagtaatagtttgattttgtctgaaagtttacaccaaccatggggttttatcttttatgttattgaatgatatgtttcta

SEQ ID NO: 2694 - DNA, 439 bp, Brassica juncea
actacgcactagttttcagcttattgccagccgtcagaagaaacagcagagaaaagctaatcagccatggggaaagtacacggatctttggcacgtgccggtaaagtaagaggacagacaccgaaggtagcgaagcaagacaagaagaagaaacccagaggacgtgctcacaagcgtctccagcacaatcgccgtttcgttaccgccgttgttggtttcggtaagaagagaggacccaactcttctgagaagtagacgattcatatatatgctgggaagagacctttctgtgaaagatatgggctagtttgtaacctttttgaaattgcttttcgtttgtattagttatgtttctttggtacttaaacttgatatgttttgattccatgcgatgactttagttttgaatctgatcagcttccaacaaaaaaaaaaaaaa

SEQ ID NO: 2695 - DNA, 403 bp, Brassica oleracea
gagcgtcgccccgaagagcagagagccagagaagtcaagaagattatctttaatcgaccatgggaaaggtgcacggttcattggctcgtgccgggaaggtgagaggtcagaccccgaaagtggctaagcaggacaagaagaagaagccacgtggccgtgctcacaagcgtttgcaacacaaccgccgtttcgtcaccgccgttgttggctttggcaaaaagagaggaccaaactcatcagagaagtagacaaaccaagacttttgttgtgatttctgttcggattttttgatgtttagataacgcgtttcagttccggtataatgagtcgatggatattgagccaatgcttgttgtcaatttgatccgtgttcctccttggattattattattatttgttgag

SEQ ID NO: 2696 - DNA, 420 bp, Brassica oleracea
  misc_feature (364)..(364): n is a, c, g, or t
gaacatagcgtcgtcgtctcgtcttcttcagagaagccagaagatttatctgtgatcggccatgggaaaggttcacggttcattggctcgtgccgggaaggtgagaggtcagacaccgaaagtggctaagcaggacaagaagaagaagcctcgtggccgtgcccacaagagactgcaacacaaccgccgtttcgtcaccgccgttgttggctttggcaagaagagaggaccaaactcatctgagaagtagacagaagcaatgttaatggctctttagttacaaagctaaagtttgttgttgatttcatttttttctgttcggattatcaaacactttcttgtgttagtggaaagctggcattgntgtattagatcttctgttttcatatattggatttgaggtgaaaccttggtttgaat

SEQ ID NO: 2697 - DNA, 425 bp, Brassica oleracea
gacgcactcgtttgagcttattgcagccgtcggaagagaaagcagagaagcaaatcagccatgggcaaagttcacggttctttagcgcgtgctggtaaggtgagaggacagacaccgaaagtagcaaagcaagataagaagaagaaacccagaggacgtgctcacaagcgtcttcaacacaatcgccgtttcgttaccgccgttgttggtttcggtaagaagagaggacccaactcttctgagaagtagaagccctttctgtgaccacctttctgttacaagatagatatgctggagcgagacctttgtgtgaaaggttctctcatttggctatttttgtaacctttcttcttttgttttagtcaacgtttactttggcaccaaacttatgttttaattctatgaaatgaaatacaactttttta

SEQ ID NO: 2698 - DNA, 426 bp, Brassica rapa
ggaactctgagattacgcactcctttcagcttaacgcagccgtcggaagaaaaagcagagaagcaaatcagcagccatgggaaaagtacacggatcgttggcacgtgccgggaaggttagagggcagacaccgaaggtagcgaagcaagataagaagaagaagcctagaggacgcgctcacaagcgtctccagcacaatcgccgtttcgttaccgccgttgttggtttcggtaagaagagaggacccaactcttctgagaagtagagaagaagattgatgatatgcattgaagattctccgttactctttttgtaacttaaatctttcttcttttgttttagtaatgtatctttggtactttatatgttttaattccatgctatgaaatacgattttagttttgaatctgatgatcaacctccaaa

SEQ ID NO: 2699 - DNA, 588 bp, Brassica rapa
  misc_feature (31)..(31): n is a, c, g, or t
  misc_feature (271)..(271): n is a, c, g, or t
  misc_feature (282)..(282): n is a, c, g, or t
  misc_feature (356)..(356): n is a, c, g, or t
  misc_feature (358)..(358): n is a, c, g, or t
  misc_feature (387)..(387): n is a, c, g, or t
cccacgcgtccgtgtcacctaacgtcggcgnatacagcaacaaagcagagaagccagaagtgtctccgtaattgatcatggggaaggtgcacggttcattggctcgtgccggtaaggtgagaggtcagacaccgaaagtggccaagcaggacaagaagaagaagccccgtggccgtgctcacaagcgattgcaacacaaccgccgtttcgtcaccgccgttgttggctttggcaagaagagaggaccaaactcatcagagaagtagacatnaactgtttcancttttgattgtggtttcttgattatttgaatggctcgttagtctatcaaccaagccgatggatgttgttgagcnantgtttctttaatcagtttcatttgggttncatctgtttctcctcggattatgtaccatacgttcttggattagttgcttataaatttgattatttactagatttgcatattcattactgttttcagaatgtattataatagaatttagaagtaaatttaatcttattcatctctatttatagaggatgaacaacatttctccatattttattttataatttgggtgctac

SEQ ID NO: 2700 - DNA, 491 bp, Brassica rapa
  misc_feature (469)..(469): n is a, c, g, or t
aggagcgtcgtcgtcgtctcctccaagagcagagccagtgaagccaagaagatttactgtgatcaaccatggggaaggttcacggttcactggctcgtgccgggaaggtgagaggtcagacaccgaaagtggctaagcaggacaagaagaagaagcctcgtggccgtgctcacaagagattgcaacacaaccgccgtttcgtcaccgccgttgttggctttggcaagaagagaggaccgaactcatctgagaagtagactgaagcaatgtttaccttttggtgtttttgataatgcgtctttagttacgaagccaatgtttcttgttgatttcatttctgctacattttttctgtttggattataacttgtgttagtggaaagctggcatattgttgtattagatctttggttttcttatattggatttgaggcgaaaccttggaataaatacagaatgtgattcaatntattcatctgaaatttaaggag

SEQ ID NO: 2701 - DNA, 450 bp, Brassica rapa
agaaaaaaagtagcgtcgccgtcgcctcgaagagcagagacagagaagcaaagaagactatctttaatcgaccatgggaaaggtgcacggttcattggcacgtgccgggaaggtgagaggtcagaccccgaaagtggctaagcaggacaaaaagaagaaaccccgtggccgtgctcacaagcgtttgcaacacaaccgccgtttcgttaccgccgttgttggctttggcaagaagagaggaccaaactcatcagagaagtagacaaacttttgttgcgatttctgttcggattatttgatgtttagataacgcgtttctgttccggtatggtaatgagtccatggatattgagccattgtttgttgtcaatttgatccgtgtttgttcttggattatttttattgtttgttggacaaaccacttcattatattaaagaaactcaaaaaaa

SEQ ID NO: 2702 - DNA, 400 bp, Hordeum vulgare
cggcacgagggagcgccctccgttcacctcgccgaccgaagcgccgccgctccaccgccgcagcagctatgggtaaggtgcacggatcgctggctcgtgccgggaaggtgcgcggccagacgcccaaggtggcgaagcaggacaagaagaagcagccgcgcggccgcgcccacaagcgcatccagtacaaccgccgcttcgtcaccgccgtcgtcggcttcggcaagaagcgcggccccaactcgtcggagaagtagtagatccagccggtctcgcgccacccctccttttttgtttgtttgtttgttcaccagtagctttcgatccgttcgcgtatgcatgctaagaagaagacctaatcaagtgtctgtaattgactgttgtgttggtaatggaaatc

SEQ ID NO: 2703 - DNA, 1327 bp, Hordeum vulgare
ctgcactgccgttccatttgatccattttttatctccctcagttacaatataggtctagcaagcctagcagcaatgaaaacggtgcaacccatctccttagcattctctggaattgtcatcattctcctttgcacgaccatcaccgctcaagctgccaacaccaagcccgtagcatcaggcataatattggaagcatgcaagaatgtctcaagcgacttcttcaaggtgcgcttcacgcatgacttctgtgtatcgacgctgcagtcggacaaccgaagcaccaacgcgaaggactaccgcatcctagctctcgtggccgtcgacgccatgaagtcccaagccattgccgcgacggccaaggttgagaaattgatccagggtgctaccaaggacaagactgcgactcgcgcccttgggttctgtcgagtggactacagtggcatggtgagcaccctcgaaatctgccatgatatcatccagagctttgagatccgcaaaggcaatgaaggtgtgacgcccttcctcctgcctggttgcattgagaaaacaaccaaagcaatcaacgattgcgctgacaaaacagagttcgctgctatttcagtagggctaatgaaggaatatgaggacttatctatgcttgccaacctcagcagctctttgctacttctcttcatcacctcacctcctcctcgtggactaggtttagatattcctagtaaccataatcatacccgccgccgccgccaaccctcgcgcacccgccctccagacctcctccgccgccgtcgttccgcagccccaccgccgccgtcgacatgggtaaggtgcacggatcgctggcccgtgccgggaaggtgcgcgggcagacgcccaaggtggcgaagcaggacaagaagaagcagccccgcggccgcgcacacaagcggatccagtacaaccgccgcttcgtcaccgccgtcgtcggcttcggcaagaagcgcggccccaactcctccgagaagtaggcgcgccgagaaataaaaaaggctcttcccctgcgctggtttcctctctcgtttgatgttggaagagacgttacttacgttcatactcaattgttaaagtatgcatcttgtgcttagctgaaggatctgggatatttgtgttatgagtatgatgcatgttttgcttagttgaagaatatcagatattgtggcatgagtgagttcttggcttaattttgcttgttgtttgctgtttcccctgttgcgcatcatatgctaaattgtagctgtttgtggtatgtgtttttgtattctgctgctgtctatacgacctgacattact

SEQ ID NO: 2704 - DNA, 486 bp, Hordeum vulgare
cagcaaccgccgccgcccccaaccctcgcgcacccgccctcaagacctcctacaccgccgccgttccgcagccccaccgccgccgtcgacatgggtaaggtgcacggatcgctggcccgtgccgggaaggtgcgcgggcagacgcccaaggtggcgaagcaggacaagaagaagcagccccgcggccgcgcacacaagaggatccagtacaaccgccgcttcgtcaccgccgtcgtcggcttcggcaagaagcgcggccccaactcctccgagaagtaggcgcgccgagaaataaaaaaggctcttcccctgcgctggtttcctctctcgtttgatgttggaagagacgttacttacgttcatactcaattgttaaagtatgcatcttttgcttagctgaaggatctgggatatttgtgttatgagtatgatgcatgtttggcttagttgaagaatatcagatattgtgggcatgagtgagttctt

SEQ ID NO: 2705 - DNA, 651 bp, Brachypodium distachyon
ctcttcaccccacaagcgccgccgcaaaccctcagctccctcgccctcaaagcctcctcgcgccaccgccgccgtcaacatgggtaaggtgcacggatcgctagctcgtgctgggaaggtgcgcgggcagacgcccaaggtggcgaagcaggacaagaagaagcagccccgcggccgcgcgcataagaggatccagtacaaccgccgcttcgtcaccgccgtcgtcggcttcggcaagaagcgcggccccaactcctccgagaagtaggcgcgcgcatgtgttgaaccccttcttcctggcggttgtcttcccccaggagatgcaagaaccttaattacgttttgtagtagtatgagttttactctgttcgctctcgtgtgatagatgggatcgaaccaagtggtgatgttttatgcatgtttcgttcagttgagaatttgagatatggtgatatgagttcatgacttaaatttgcttatcgcagatgtgcaacatatgctaaatggcgcctgtttgtgttgtctctggcttattagttctatggctacttcctaccttacattttgtagttctatatgaacctacttatcctagacatagcatttttgtttcagtttacttgatcaataaagtctcattttggagtagta

SEQ ID NO: 2706 - DNA, 545 bp, Brachypodium distachyon
gtcaaccacatcagacgcatcccacgccgcagctcaagcgcttcgtcgtcctgtcgccccagcacccgccgccgtcgccatgggtaaggttcacggatcgttggctcgcgctggtaaggtgcgcgggcagacgcccaaggtcgcgaagcaggacaagaagaagcagccccgcggccgcgcccacaagcgcatccagtacaaccgccgcttcgtcaccgccgtcgtcggcttcggcaagaagcgcggccccaactcctcggagaagtagatctagaccccgcccggcctcttgatcccctttttgtgcactactagttttgttcctttccagtatggaagctttccagtactgatgatgatgcatcttaagacatgattaatgatctgtatctctctgtgggtggtaatggaatccctcatgaagtaagcaccgtttagattactattacttgatgttctgcttatggttgcagttttgttgcctgaaaattgtttctacgtgttcgattgtttacttattgacggtcacagtggttaatatcgga

SEQ ID NO: 2707 - DNA, 507 bp, Brassica napus
atcaacgcagagtacgcggggagattacgcactcgtttcaggttattgcagccgtcggaagagaaagcagagaagcaaatcagccatgggcaaagttcacggttctttggcacgtgccggtaaggtgagaggacaaacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagccctttctgttacaagatagatatgctggaacgggacctttctgtgaaaggttctctcatatagtcatatggctattttgtaacctttcttttgttttagtcaatgtttactttggcactaaagttatgttttaatactatgaaatgaaatacaacttttttacatcttgatctagacatgaaagttgtattcaactctacttatttgctccaacaattattttttagaa

SEQ ID NO: 2708 - DNA, 531 bp, Brassica napus
gcagccgtcggaagagaaagcagagaagcaaatcagccatgggcaaagttcacggttctttggcacgtgccggtaaggtgagaggacaaacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagccctttctgttacaagatagatatgctggaacgggacctttctgtgaaaggttctctcatatagtcatatggctattttgtaacctttcttttgttttagtcaatgtttactttggcactaaagttatgttttaatactatgaaatgaaatacaacttttttacatcttgatctagacatgaaagttgtattcaactctacttatttgctccaacaattattttttagaattcatcgtttatttgctatttaaaattaatattatatactaagtaaactttgttgtttacgaaaaaaaaaa

SEQ ID NO: 2709 - DNA, 498 bp, Brassica napus
gcactcgttccagctaattgcagccgtcggaagtgaaagcagtgacgcaaatcagacatggggaaagttcacggatccttggcacgtgccggtaaggtgagaggacagacaccaaaggtagcgaagcaagacaagaagaagaaacctagaggacgtgctcacaagcgtctccagcacaaccgccgtttcgttaccgccgttgttggtttcggtaagaagaggggacccaactcttctgagaagtagaagaatgacttataaaagcttctcataatggctattttgtgcatttcttctattcgtatgttttagtcatgttccttttgcacttatatatgttttgattctatgaattacgaatttactcttgaatttgattctcaacttccaacagtaatagtttgattttgtctgaaagtttacaccaaccatggggttttatcttttatgttattgaatgatatgtttctattctacggataatggaatcatacaaga

SEQ ID NO: 2710 - DNA, 457 bp, Brassica napus
gcacccgtatcagcttattgcagccgtcggaagagaaagcagagaagcaaatcaaccatggggaaagttcacggatctttggcacgtgccggtaaggtgagaggacagacaccaaaggtagcgaagcaagacaagaagaagaaacccagaggacgtgcccacaagcgtctccagcacaaccgccgtttcgtcaccgccgttgttggtttcggtaagaagagaggacccaactcttctgagaagtagacgaagctattttgtgcatttcccttcgtatgttttagtcatgtttcttttgcacttatatatgttttgattctataatgctatgaatttgattctcaacttccagcagtaatagtttgattttgtctgcaagtttacaccaaccatggggttttataaattagttattgaatgatatgtttctattctacggtaatggaatcatacaaga

SEQ ID NO: 2711 - DNA, 407 bp, Brassica napus
cgtcgccgtcgcctcgaagagcagagccagagaagccaagaagattatctttaatcgaccatgggaaaggtgcacggttcattggcacgtgccgggaaggtgagaggtcagaccccgaaagtggctaagcaggacaagaagaagaagcctcgtggccgtgctcacaagcgtttgcaacacaaccgccgtttcgtcaccgccgttgttggctttggcaagaagagaggaccaaactcatcagagaagtagacaaccaagaattttgttgtgatttccgtttcagattttttgatgttttttttttaaacacaactttcattaaaacttaacttcaaggactacaaaggaaagagggaattagacatcctcttgaaaacaaatcataaactaaaatggaaaatgatatc

SEQ ID NO: 2712 - DNA, 1356 bp, Brassica napus
gtcgccgtcgcctcgaagagcagagccagagaagccaagaagattatctttaatcgaccatgggaaaggtgcacggttcattggcacgtgccgggaaggtgagaggtcagaccccgaaagtggctaagcaggacaagaagaagaagcctcgtggccgtgctcacaagcgtttgcaacacaaccgccgtttcgtcaccgccgttgttggctttggcaagaagagaggaccaaactcatcagagaagtagacaaaccaagaattttgttgtgatttccgtttcagattttttgatgttttttttttaaacacaactttcattaaaacttaacttcaaggactacaaaggaaagagggaattagacatcctcttgaagacaaatcataaactaaaatggaaaatgatatcaaaccggataagtctccatatgaagttgacagcgaattcaaaacaaagtctgaatgcgtcgaagaagctacaacaaagtcggatagctgagaaatagtcacaagtgacgttgaaggacaaccctcaccaacgagaaaaaccgaagtagtctcgattgcactttctggccccgtacagaccgctacgcaaagtaacaaaccggtgagtaagttgaaacaaggactcagcagagaatccgagagagcatctccgttcatagaagggaggcatagttgtgaaaaactctcttcgtttgaggaggatgatgaaacccataccagagttggtgaacccacataaaaattcttccaaaagagatgatattgtaataatctcagcttattgatctcgaagaatccatcgaacatctttaacatgaccaaaaaggccatacccacaactatatatcgcatgttttgatttgaaaatatgggctttaggttcttggtaatcaccttaatagcttcaagaaaagaattgggccaggcccacttaggtacatatctctttggttctgaagcagtcgccggcaaagttcgagacgtcgttgatcgaaattgaaggtcggagatggtgcagtagacgtcgactgagagatagatggtactcaccggcggagagacgagctcaccggagcaagctgagtgaccatcgaacccagatgtagagagagacgttcggtgatgatatgcagatcctccgttgaggaaggggcacgcaaggggaaatggcagctcactaggaggagaggaaggtgaagatcttcctatgagattcagatctgagcttgagttgccttgcactctggagccatatgagtagaaaggagcgacatgcggtagttttgctgtctcacttcccggaaatggaaagcaagagcttgagcgttgagagcttagctccatgataa

SEQ ID NO: 2713 - DNA, 449 bp, Brassica napus
atcaacgcagagtacgcggggatagcgtcgtcgtctcgtcttcttcagagaagccagaagatttatctgtgatcggccatgggaaaggttcacggttcattggctcgtgccgggaaggtgagaggtcagacaccgaaagtggctaagcaggacaagaagaagaagcctcgtggccgtgcccacaagagactgcaacacaaccgccgtttcgtcaccgccgttgttggctttggcaagaagagaggaccaaactcatctgagaagtagacaatggctctttagttacaaagctaaagtttgttgttgatttcattttttttctgttcggattatcaaacactttcttgtgttagtggaaagctggcattgttgtattagatcttctgttttcatatattggatttgaggtgaaaccttggtttgaataaaggtgatacaaaatatttgtc

SEQ ID NO: 2714 - DNA, 439 bp, Brassica napus
tagcgtcgtcgtctcgtcttcttcagagaagccagaagatttatctgtgatcggccatgggaaaggttcacggttcattggctcgtgccgggaaggtgagaggtcagacaccgaaagtggctaagcaggacaagaagaagaagcctcgtggccgtgcccacaagagactgcaacacaaccgccgtttcgtcaccgccgttgttggctttggcaagaagagaggaccaaactcatctgagaagtagacagaagcaatgttaatggctctttagttacaaagctaaagtttgttgttgatttcattttttttctgttcggattatcaaacactttcttgtgttagtggaaagctggcattgttgtattagatcttctgttttcatatattggatttgaggtgaaaccttggtttgaataaaggtgatacaaaatatttgtc

SEQ ID NO: 2715 - DNA, 443 bp, Brassica napus
cgtcgtcgtctccttcaagagcagagccagtgaagccagaagatttatctgcgatcaaccatggggaaggtgcacggttcattggcacgtgccgggaaggtgagaggtcagacaccgaaagtggctaagcaggacaagaagaagaagcctcgtggccgtgctcacaagagattgcaacacaaccgccgtttcgtcaccgccgttgttggctttggcaagaagagaggaccgaactcatctgagaagtagactaccttttggtgtttttgataatgcgtctttagttacgaagccaatgtttcttgttgatttcatttctgctacattttttctgtttggattataacttgtgttagtggaaagctggcatattgttgtattagatctttggttttcttatattggatttgaggcgaaaccttggaataaatacagaatgtgat

SEQ ID NO: 2716 - DNA, 426 bp, Brassica napus
gaagccagaagatttatctgcgatcaaccatggggaaggtgcacggttcattggcacgtgccgggaaggtgagaggtcagacaccgaaagtggctaagcaggacaagaagaagaagcctcgtggccgtgctcacaagagattgcaacacaaccgccgtttcgtcaccgccgttgttggctttggcaagaagagaggaccgaactcatctgagaagtagactgaagcaatgtttaccttttggtgtttttgataatgcgtctttagttacgaagccaatgtttcttgttgatttcatttctgctacattttttctgtttggattataacttgtgttagtggaaagctggcatattgttgtattagatctttggttttcttatattggatttgaggcgaaaccttggaataaatacagaatgtgattc

SEQ ID NO: 2717 - DNA, 338 bp, Brassica napus
ccacgcctagtccatttgccggaggtagcgccgatccattcgtcaaaacaactatgggtaaggttcacggttccttggctcgtgccggtaaggtgagaggacagactcctaaagtggctaagcaggacaagaagaagaagccacgtggtcgtgcccacaagcgtcttcagcacaaccgccgtttcgtcaccgccgttgttggatttggcaagaagagaggacccaactcttctgagaaatagatgatgaacgcattggagctgaagttttgagtttttattttccaaaagatatcgtacttgtttaatgttgtaagactgcaattttctcaatcaaat

SEQ ID NO: 2718 - DNA, 480 bp, Brassica napus
gatataaacgaccgtattattcctaaccctaaaaaaaaagtttcacctagcgtcggcgcatccagcaacaaagcagagaagccagaagtgtttccgtaattgatcatggggaaggtgcacggttcattggctcgtgccggtaaggtgaggggtcagacaccaaaagtcgccaagcaggacaaaaagaagaagccccgtggccgtgctcacaagcgattgcaacacaaccgccgtttcgtcaccgccgttgttggctttggcaagaagagaggaccaaactcatcagagaagtagactcaactgtttccccttttgattgtggttttcttgattatttgaatcactcgttagtttatcaaccaagccaatggatgttgttgagccaatgtttctttaatcagtttcatttgggttacatctgtttctcatctgattatgtaccatacgttcttggattagtggcttataaattttattatt

SEQ ID NO: 2719 - DNA, 354 bp, Brassica napus
agtccatcgaaagctgtcgtcgtcacacatttgccggaggtagcgccgattcagtcgtcaaagcaactatgggcaaggttcacggttccttggctcgtgccggtaaggtgagaggacagacacctaaagtcgctaagcaggacaagaagaagaagccacgtggtcgtgcccacaagcgtcttcagcacaaccgccgtttcgtcaccgccgttgttggatttggcaagaagagaggacccaactcttctgagaaatagatgatgaacgcattggagctgaagttttgagtttttttttttccaaaaaatatcgtacttgtttaatgttgtaagactgcaattttctcaatcaaat

SEQ ID NO: 2720 - DNA, 340 bp, Brassica napus
tgtcgtcgtcacacatttgccggaggtagcgccgattcagtcgtcagagcaactatgggtaaggttcacggttcattggctcgtgccggtaaggtgagaggacagactcctaaagtggctaagcaggacaagaagaagaagccacgtggtcgtgctcacaagcgtcttcagcacaaccgccgtttcgtcaccgccgttgttggatttggcaagaagagaggacccaactcttctgagaaatagatgatgaacgcattggagcttaagttttgagtttttttttccaaaaaatatcgtacttgtttaatgttctaagactctgcaattttcttaatcaaat

SEQ ID NO: 2721 - DNA, 679 bp, Brassica napus
atcaacgcagagtacgcggggaactctgagattagtagattacgcactcctttaagcttattgtagccgtgggaagaaaaagcagagaagcaaatcagcagccatgggaaaagtacacggatcgttggcacgtgccggtaaggttagagggcagacaccgaaggtagcgaagcaagacaagaagaagaagcctagaggacgcgctcacaagcgtctccagcacaatcgccgtttcgttaccgccgttgttggtttcggaaagaagagaggacccaactcttctgagaagtagaagaagattgatgatatgcattgaagattctccgttgctctttttgtaacttcaatctttcttcttttgttttagtcatgtatctttggtactttatatgttttgattccatgctatgaaatacgattttagttttgaatctgatgatcaacctctaacacaaaccaatcatgtgtttaattatttagaatattgataattcgataagggtctttaatggttttattgaaatatccaatgaaaattaggaaaagagttgtaataaaaaccagacggtggttttagagttcgtctttgggtgagtcgaaccctttagaggccttgtcttcgaggtatcgtacagccatcgatgcatgcatagcagcaccgtacgggagcgcatcttcg

SEQ ID NO: 2722 - DNA, 411 bp, Brassica napus
agattacgcactcctttcagcttaacgcagccgtcggaagaaaaagcagagaagcaaatcagcagccatgggaaaagtacacggatcgttggcacgtgccgggaaggttagagggcagacaccgaaggtagcgaagcaagataagaagaagaagcctagaggacgcgctcacaagcgtctccagcacaatcgccgtttcgttaccgctgttgttggtttcggtaagaagagaggacccaactcttctgagaagtagaagaagattgatgatatgcattgaagattctccgttgctctttttgtaacttaaatctttcttcttttgttttagtaatgtatctttggtactttatatgttttaattccatgctatgaaatacgattttagttttgaatctgatgatcaacctc

SEQ ID NO: 2723 - DNA, 401 bp, Brassica napus
aactctgagattacgcactcctttcagcttaacgcagccgtcggaagaaaaagcagagaagcaaatcagcagccatgggaaaagtacacggatcgttggcacgtgccgggaaggttagagggcagacaccgaaggtagcgaagcaagataagaagaagaagcctagaggacgcgctcacaagcgtctccagcacaatcgccgtttcgttaccgctgttgttggtttcggtaagaagagaggacccaactcttctgagaagtagagaagaagattgatgatatgcattgaagattctccgttgctctttttgtaacttaaatctttcttcttttgttttagtaatgtatctttggtactttatatgttttaattccatgctatgaaatacgattttagtttt

SEQ ID NO: 2724 - DNA, 355 bp, Brassica napus
agtccatcaaaagctgtcgtcgtctcacatttgccggaggtagcgccgatccattcgtcaaaacaactatgggtaaggttcacggttcattggctcgtgccggtaaggtgagaggacagactcctaaagtggctaagcaggacaagaagaagaagccacgtggtcgtgcccacaagcgtcttcagcacaaccgccgtttcgtcaccgccgttgttggatttggcaagaagagaggacccaactcttctgagaaatagatgatgaacgcatttgagctgaagttttgagttttatctttccaaaaaatatcgtacttgtttaatgttgtaagactctgcaattttcttaatcaaat

SEQ ID NO: 2725 - DNA, 452 bp, Brassica napus
ggagattacgcactcgtttgagcttattgcagccgtcggaagagaaagcagagaagcaaatcagccatgggcaaagttcacggttctttagcgcgtgctggtaaggtgagaggacagacaccgaaagtagcaaagcaagataagaagaagaaacccagaggacgtgctcacaagcgtcttcaacacaatcgccgtttcgttaccgccgttgttggtttcggtaagaagagaggacccaactcttctgagaagtagaagccctttctgtgaccacctttctgttacaagatagatatgctggagcgagacctttgtgtgaaaggttctctcatttggctatttttgtaacctttcttcttttgttttagtcaacgtttactttggcaccaaacttatgttttaattctatgaaatgaaatacaacttttttacatcttgatctagacgcaaaa

SEQ ID NO: 2726 - DNA, 491 bp, Manihot esculenta
ttttccattcgttgctgcatatagttgttaccgcttcgatcgagcttgaagctacagtccccgcgcagcagcagcaactgaagaagacgccatgggtaaggttcacggatctttggctcgtgctggtaaggtgagaggccaaacacctaaagttgcaaagcaagacaagaagaagaggccacgaggtcgtgcctataagagaatgcaatacaaccgccgctttgtcaccgcagttgtgggatttggcaagaagagaggacccaactcatctgagaagtaaagtggccggatgacaagttattaaagttattactgatgtaggtgaaggctgatgttgggtttttggatgatttttcttgtgtttttaagtatttgtgatattcagtcccaaaactatgccgatcatatgctctttttttgttataattaggataatgtgattttgtttccaagttatatttcattttgtcacagccttgtttcttgtggat

SEQ ID NO: 2727 - DNA, 713 bp, Ceratodon purpureus
gaaagctcggcagcaaccttcgggagctctctttcgcttgccatcatcgaactcgtctgcacggctcgcatcgtcgtagtccccgctcgctcgcgcttcaccccgcttccgtcgccatgagtaaggttcacggatctttggcccgtgccggaaaggtgcgtggccagacccccaaggtcgccaagcaggataagaagaagaagccgaagggtcgtgcgcacaagaggatgcagtacaaccgccggtttgtgactgcagttgttggatttggtaagaagaggggccccaactcgtctgagaagtagagcgtgatgatcccagaattcgttactactgtacaattcgtgagccagaagatcatgatagcttaggtcgttgacatgcagcggctgttttgtctcggaagtatcagtatgaagtgattcagtttgttttcaccggggcgcaattgcctgaacttaatcctgcacagtcacttttgcagcatggtctggttttaatcatgtattatgtttattttggaatggcctgttctggtcaataatctttctttggtttggaatttgctgatgaaatatactagtctgctcaggtggctattgtaatgcttactagacatctgatcgcttgtgtcgactaaggcgatgttgtgagtctgtaatttgaatcttgattagttgaatattcattccgacttctagccagaaaaaaaa

SEQ ID NO: 2728 - DNA, 720 bp, Ceratodon purpureus
cgcagccatcgacagaagctctcttttcgctcgcacctcgagtcttctgcgcttccgaacgcgacgcagctcccgcgcgcttgtccgctcgccgcccatcttccaccatgagtaaggttcacggttccttggcccgtgccggaaaggtgcgtggtcagacgcccaaggttgccaagcaggacaagaagaagaagccaaagggtcgcgctcacaagaggatgcagtacaaccgtaggtttgtgactgcagtggttggattcggtaagaagaggggacccaactcatctgagaagtagagtgttgaagactgcgattcttcatcgctgtgtaatcggcgagtctgaagttcatgttagccttcgtcatcatgtctcggaagtagcatgatgggattaatcagtcaatatgtatgcattgaggcataatggcctttgactaaattcagtaccatcacttttgtagcatggcattgttctgattgcattgttgctctcatgctggtattgtttcttctgcattcgatatggcatactggcttctctacctgttcggatttatgtcttctctcctttttctctgctgcgaactggcgacgttatattaccataacccagtcgatattctctgcatgttatgagcgatcttgacgctggtattctagatggctgatacgatttgtgaattgtcactgatgttttacgtgtacagcgcagcatagac

SEQ ID NO: 2729 - DNA, 434 bp, Cichorium intybus
acctaatttcattgtctcttgatcctttgtgccagtgccagccgaagcggaggacagaaggtagcagcactccaaattcgacatgggaaaggttcacggatcgttggctcgtgccggtaaagtgagaggccaaaccccgaaggtggccaagcaagacaagaagaagcagccccgtggtcgtgctcacaagcgcattcaatacaaccgccgtttcgtcaccgccgttgttggttttggaaagaagaggggaccaaattcatctgagaagtaagcctgttgatgaataccaatagtcttgtagtttaggtttattttgtttgactaaacaatgcttattatgtagccactacaagtttgagttttgactaaaattcgatggtttcaagatttatgaaattgatatatgtttttggttggttttctttcttgcaaaa

SEQ ID NO: 2730 - DNA, 458 bp, Cichorium intybus
agatccagccgaaaagaaccctagacggtagacagagtgaaagaatcctaaattcaacatgggaaaggttcacggatcgttggctcgtgccggtaaagtgagaggccaaacccccaaggttgcgaagcaagacaagaagaagcagccccgtggacgtgctcacaagcgcattcaatacaaccgccgtttcgtaaccgccgttgttggttttggaaagaagaggggaccaaactcatcagagaagtaagctgagggaagcatgctcagtcttccctgaagttgttttgatatttgtttagaagacatgtttagttttttggtattttaaagttttgtcatgcccccaagcctgctgagttcaaccatgacagaagtcgttgttcggttattgtgatattaaatttttgtcttgttttttttgttttgctaaaaaggttatgattccgttgaaaaaaaaa

SEQ ID NO: 2731 - DNA, 547 bp, Cryptomeria japonica
  misc_feature (344)..(344): n is a, c, g, or t
  misc_feature (468)..(468): n is a, c, g, or t
gattcatcaatatagcaaaaccctagcatcaatttgtcatcttgggccaagggaagagctgaaaatcaggagcagcagcagcagaagcagcggcaggagcagcagcagcaatccaaaatgagtaaagtgcacggatcattggcccgagcagggaaggtgagagggcagacccccaaggttgccaagcaagacaagaagaagaagcccagaggccgtgcccacaaacgcatgcagtataaccgccgttttgttactgcagtagctggatttgggaagaaaagaggtccaaactcttctgagaagtaattgattaggtgtactatgatggaggaaaatgaatcagncctgcaagtagatctattttggtggaggctttcgttaatgtaggaaatttgtatttgaggatggtttttgttactcaaaatactttatcttgattgtattgttctggaagcacatacataattnttttgcacattttaattataacaatcactttcaattaaatgaaaaatgaaaaaaaaaagatcttaaattacagttaaaa

SEQ ID NO: 2732 - DNA, 466 bp, Taraxacum officinale
acctaattttcattgtctcttgatctatacacgaagcggaaggaagaaaggcatcaagaactccaatttcgacatgggaaaggttcacggatcgttggctcgtgccggtaaagtgagaggccaaaccccgaaggtggccaagcaagacaagaagaagcagccccgtggacgtgctcacaagcgcattcaatacaaccgccgttttgtcaccgccgttgttggttttggaaagaagagggggccaaactcatctgagaagtaagcttgaggtgcatggaatagtcatgtagtttattagttctatggaagttttagacgattttgtgttgagaaaatgatgatttattttgtcactatacttttgagttttgaatgaaatttgaagccggtgtttggtgattttattttattacattacttttagttaaattatgtaataaaaccaaaaatcaaacacgaattgatc

SEQ ID NO: 2733 - DNA, 414 bp, Taraxacum officinale
gcgggggtgtatcgtgacttcatagaaagaacgaaatcgaaatcaggaggcagcaaaagacactagattcaatatgggaaaggttcacggttcattggctcgtgccggtaaagttagagggcaaacccctaaggttgccaaacaagacaagaagaagcagcctcgcggacgtgctcacaagcgtattcagtacaaccgtcgtttcgtcaccgccgttgttggttttggaaagaagagaggaccaaactcatctgagaagtaagcagaggatgtgtgtagttttgtaagcttagtttaatggaattgttttttatattgctataatgttgttattcagacggtctttattaagctgattacagttttttctactaaaacctaaaattctatgaagtgtttttcagtttgacgttt

SEQ ID NO: 2734 - DNA, 436 bp, Taraxacum officinale
ggcgggggctgattttattttctcgcaccggatccaggcgaaaagaagaccagacagagctaaacaatctaaattcatcatgggaaaggttcacggatcgttggctcgtgccggtaaagtgagaggtcaaactcctaaggttgcgaagcaagataagaagaagcagccacgtggacgcgctcacaagcgcattcaatacaaccgccgcttcgtcaccgccgttgttggttttggaaagaagagggggcctaactcatcagagaagtaaaaaaggaaaatcatatgctgtcttttacttgaaattattttgatgttttcttagaagacttgttcagttttttttgtcttacaaagttttgtcatgttaattaatccttgttgagtatcaaccattgatcataatgtacttgattaaattaaggttatgattgcattc

SEQ ID NO: 2735 - DNA, 462 bp, Eucalyptus grandis
  misc_feature (162)..(162): n is a, c, g, or t
  misc_feature (164)..(164): n is a, c, g, or t
  misc_feature (198)..(198): n is a, c, g, or t
  misc_feature (215)..(215): n is a, c, g, or t
  misc_feature (218)..(218): n is a, c, g, or t
  misc_feature (242)..(242): n is a, c, g, or t
  misc_feature (280)..(280): n is a, c, g, or t
cggccggaatttcggctctctacctctctctctacctctctctgtgaaacttctccatgggtaaggtgcacggatccctggctcgcgccggtaaggtgaggggccagaccccgaaggtggcgaagcaggacaagaagaagaagccccgcggccgcgcccacnancggatgcagtacaaccgccgcttcgtcaccgccnttgttggctttgggaanaanaggggccccaactcgtccgagaantgaggcggcttcattggagcccgaaaggaagagaagangagctgtgtaggtctctgcaaaaaagatgggctttttttctttttttgggtttttcgtttcttcattggattgtgttatgcttttgaatttggggacttgaaagatactggatcatgttgaggttttgcctacccacttaagctaatagataatgttagtttttgtttccgaaaaaaaaaaa

SEQ ID NO: 2736 - DNA, 327 bp, Gerbera hybrid cultivar
gaagacagaagccatcagaaccctaatttcgctatgggaaaggttcacggatcgttggctcgtgccggtaaagtgagaggccaaacccccaaggtggccaagcaagacaagaagaagcagccgcgaggacgtgctcacaagcgcattcaatacaatcgccgtttcgtcaccgccgttgttgggtttggaaagaagagggggccaaactcatctgagaagtaagcttatggatggatatcatagtcttgtagcttaacttttatcttattgttattattattatgtccaaactacaatttcagttataatttcaagttggttatcatg

SEQ ID NO: 2737 - DNA, 713 bp, Mesembryanthemum crystallinum
  misc_feature (555)..(555): n is a, c, g, or t
  misc_feature (557)..(557): n is a, c, g, or t
gtttctctctcctcttcttcttcagctttcttctccatcaagcggcaccggcgaagaagaagagcaacagctcactcaaccaaccaattctaaatcatgggtaaggtgcacggatctttggctcgtgccggtaaggtgagagggcagacccctaaggtcgctaagcaagacaagaagaagcagcccagaggacgcgctcacaagcgtatccaatacaaccgccgttttgtcacagccgttgttggattcggaaagaagaggggccccaactcatcagagaagtaagatgtgaattgcaagagatgaagcctgcttaggttactaggaattcattaatattaccaccatagggtttctgtgacgtgtgttatgtacacttgaaaaattgtcctctaaaagagtgttttggtttcttacttgataagcattctcaagacctcgctttgtgatctagacaaaggtttgatctcagtaaaaagttttgtcccctcaaaaaaaaaaaaaaaaaaaaaaaaaattaaaaataaataaaaaaacaaaaatatcaaactcttntnggaaatcttaaaacacaatatcactctaattttaattctttcgggggggggcgcccggaccccaatattcccctttaaaggagggtgtttttacccccccccccctgggcccggttttaaaaacttcggaatgggaaaaacccttgcttttcccac

SEQ ID NO: 2738 - DNA, 436 bp, Lactuca sativa
ccctcgtgactgctctccttgcattccaacgaacgaaatcgatatcggaaggcagcaaacgacaccagattcaatatgggaaaggttcacggatcattggctcgtgccggaaaagtgagagggcaaacccctaaggtagcaaagcaagacaaaaagaagcagcctcgcggccgtgctcacaagcgtattcagtacaaccgccgttttgtcaccgccgttgttggttttggaaagaagaggggaccaaattcatctgagaagtaagctactgatggaatgtgtagttttgtaagcttagtttaatggaattgttttttacattgctatcatgttattttagacagtctttattatgatgctcacagtgtttctaccaaaacttaaaattctatgagatgttctgagtttgatttttggtatcgtttttcatgaaatt

SEQ ID NO: 2739 - DNA, 492 bp, Lactuca sativa
cctgatttgcttctctccaccagatccagccgaaaagaagactacacagagctaaacaatcctcaattcaacatgggaaaggttcacggatcgttggctcgtgccggaaaagtgagaggtcaaaccccaaaggttgcgaagcaggacaagaagaaacagccacgtggacgtgctcacaagcgcattcaatacaaccgccgcttcgtcaccgctgttgttggttttggaaagaagagagggccaaactcatcagagaagtaaaagctgagggaagcatgatcagtctttacctgaaattgtttttgatgtttgcttagaaagacttggttagattttttgatcttacaaaattatgtcatgttcatcaatcttttgctgagtatcaaccattttgtcatatctattacgctttttcgtttgaactttttattttatactataaccttgttattataacaaattaattcatcaatatctacatacatgattcat

SEQ ID NO: 2740 - DNA, 508 bp, Lactuca sativa
ctacagtctctcttgatcattgcgtcagtgctagccgaagcggagggcagaagacagcggaactcaacatccgaaaatgggaaaggttcacggatcgttggctcgtgccggaaaagttagaggccaaacgccgaaggtggccaagcaagacaagaagaagcagccccgtggacgtgctcataagcgcatccaatacaaccgccgttttgtcaccgccgttgttggttttggaaagaagaggggcccaaactcatctgagaagtaagcatgttgatgaatagcatagtcttgtagcttattagttgtttttgtgtttagaaaacaagtatggtgtcattatacttttgagttatgacatttttttattttcaatttaagaagtgtttatggcgattttattacaatctacatgtttgatgcaaccgaaatgttgtgttgagatgttgtttggtgcttgattttgctatatcacatttgatgatttggttttattgaatcctatttccgt

SEQ ID NO: 2741 - DNA, 556 bp, Lactuca sativa
cttcgcggggacctaaattacatcgtgtctgccattcttgctttccacgaacgaaatcgatatcggaaggcagcaaacgacaccagattcaatatgggaaaggttcacggatctttggctcgtgccggaaaagtgagagggcaaacccctaaggtagcaaagcaagacaagaagaagcagcctcgcggccgtgctcacaagcgtattcagtacaaccgccgttttgtcaccgccgttgttggttttggaaagaagaggggtccaaattcatctgagaagtaagctgatggattgtgtagttttgtaagcttagtttgttggaattgtttttacattggtatcatgttattttagacagtctttattttgatgatcacagtgtttctattaaaacctaaaattctatgaaatgttttgagtttgatttttgatatcgttattcttgaaatttatctttgtatacattgtcaaaaaatagatgctctggttatcagctgattatgaatgttgcttgaaattagcttggactgaaaccaccacctctcgtctcctccac

SEQ ID NO: 2742 - DNA, 412 bp, Lactuca sativa
caatcgtgactgctcttcttgcatttcgacgaacgaaatcgatatcggaaggctgcaaaagacaccagattcaatatgggaaaggttcacggatcattggctcgtgccggaaaagtgagagggcaaacccctaaggtagcaaagcaagacaaaaagaagcagcctcgcggccgtgctcacaagcgtattcagtacaaccgccgttttgtcaccgccgttgttggttttggaaagaagaggggaccaaattcatctgagaagtaagctgctgctgatggattgtgtagttttgtaagcttagtttgatgaaattgtttttacattgctatcatgttattttagagtctttattatgacgttcacaatgtttctactaaaacctaaaattctatgaaatgttttgagtttgatt

SEQ ID NO: 2743 - DNA, 390 bp, Lolium multiflorum
ccgccgccgccgcacgagagctagccgtcccctcatcgccggagaacgcacgagcgccgccgctccacaccatgggtaaggttcacggatcgttggcccgcgccgggaaggttcggggccagacgccgaaggtggccaagcaggacaagaagaagcagccgcgcggccgcgcccacaagcgcatccagtacaaccgccgcttcgtcaccgccgtcgtcggcttcggcaagaagcgcggccccaactcctcggagaagtagatctgaggccctttttttggttccctagtagctctgttccgttccagtatgcatgttttccagcactgatgattattaagacctaagtaagatctgtatgactgttatgttggaaatggaatatgcttat

SEQ ID NO: 2744 - DNA, 482 bp, Avena sativa
gcccctacaaccgccgccgcgaaccctcagcgccctcgccctccaagcctccgccgccgcagcgtcaccacctcaccgccgccgtcgacatgggcaaggttcacggatcgctggctcgtgccggtaaggttcgcgggcagacccccaaggtggcgaagcaggacaagaagaagcagccccgcggccgcgcccacaagaggatccagtacaaccgccgcttcgtcaccgccgtcgtcggcttcggcaagaagcgcggccccaactcctccgagaagtagacgcgcgtaatgtgtcaaagaagcttcttccttgctgtagtttccctctcgtgttgttacgcaagaagatggaagaaaaaccttaaattactctgctgtttcctgtgatagatgagatatcgaactcatgtgcttaagtatgcctgcttcgtttagctgagaatttgtgatatgagttgattacttgaatttacttatgctctc

SEQ ID NO: 2745 - DNA, 522 bp, Avena sativa
tccacgcagcagacgccatgggtaaggtccacgggtcgttggctcgcgccgggaaggtccggggccagacgcccaaggtggcgaagcaggacaagaagaagcagccgcgggggcgcgcccacaagcgcatccagtacaaccgccgcttcgtcaccgccgtcgtcggcttcggcaagaagcgcggccccaactcgtcggagaagtagatctagacccgccccatggcaggcctccttcttgatcgattaccccaacctttttttgttccttagtcagtatgcatgttttccagtgctgacgatgacccatgttaagacctaattagagatctgtatttgctgtgatgctggtaatggaatatgatccaagcatgcaatgcttagtttaccactacatgattattgttatgcctctgtattgtattaggttgggtctttgctagagtacttggtttcaggattgtttctgcatttctagctttagtaaatcaaatcgagttggtcgcttggtgcttgcttatgt

SEQ ID NO: 2746 - DNA, 587 bp, Avena sativa
gccatcagcagaagcacccgccgccgcctgcacacgcgcgctctccgtccgctcctcgccgccgatccacgcagcagacgccatgggtaaggtccacgggtcgttggctcgcgccgggaaggtccggggccagacgcccaaggtggcgaagcaggacaagaagaagcagccgcgggggcgcgcccacaagcgcatccagtacaaccgccgcttcgtcaccgccgtcgtcggcttcggcaagaagcgcggccccaactcgtcggagaagtagatctagacccgccccatggcaggcctccttcttgatcgattaccccaacctttttttgttccttagtcagtatgcatgttttccagtgctgacgatgacccatgttaagacctaattagagatctgtatttgctgtgatgttggtaatggaatatgatccaagtatgcaatgcttagtttaccactacatgattattgttatgcctctgtattgtattaggttgggtctttgctagagtacttggtttcaggattgtttctgcatttctagctttagtaaatcaaatcgagttggtcgcttggtgcttgcttatgt

SEQ ID NO: 2747 - DNA, 375 bp, Avena sativa
gccacagccgccgcatcgtacgagcgccacagctccacgccgccgccgccatgggtaaggttcacggatcgttggctcgcgccgggaaggtgagggggcagacgcccaaggtggcgaagcaggacaagaagaagcagccgcgcggccgagcccacaagcgcatccagtacaatcgccgcttcgtcaccgccgtcgtcggcttcggcaagaagcgcggccccaactcctcggagaagtagatctaaggccccgcccgcctcttgatcggtcctttacagtacttatgacgcatcttaagacctagtaattagagatctgtatgattgtgatcttgataattgaatcccatcaagtatgcattgttcaacttattgt

SEQ ID NO: 2748 - DNA, 374 bp, Avena sativa
ccacagccgccgcatcgtacgagcgccacagctccacgccgccgccgccatgggtaaggttcacggatcgttggctcgcgccgggaaggtgagggggcagacgcccaaggtggcgaagcaggacaagaagaagcagccgcgcggccgagcccacaagcgcatccagtacaatcgccgcttcgtcaccgccgtcgtcggcttcggcaagaagcgcggccccaactcctcggagaagtagatctaaggccccgcccgcctcttgatcggtcctttacagtacttatgacgcatcttaagacctagtaattagagatctgtatgattgtgatcttgataattgaatcccatcaagtatgcattgttcaacttattgt

SEQ ID NO: 2749 - DNA, 469 bp, Avena sativa
gccgccgcgaaccctcagcgccctcgccctccaagcctccgccgccgcagcgccaccgcctcgccgccgccgtcgacatgggtaaggttcacggatcgctggctcgtgccggtaaggtgcgcgggcagacccccaaggtggcgaagcaggacaagaagaagcagccccgcggccgcgcccacaagaggatccagtacaaccgccgcttcgtcaccgccgtcgtaggcttcggcaagaagcgtggccccaactcctccgagaagtagatgcgcgtaatgtgtcaaagaagcttcttccttgctgtagtttccctctcgtgttgttacggaagaagatggaagaaaaaccttaatttactctgttgtttcctgtgatagatgagatgttgaactcatgtgcttaagtatgcctgcttcgtctagctgagaatttgagatatggttatatgagttgattacttgaatttact

SEQ ID NO: 2750 - DNA, 361 bp, Orobanche aegyptiaca
agaagaaaaatcaatcgaatgggtaaggtacacggatcattggctcgtgccggtaaggtgagaggacaaacgccgaaggtggtgaagcaggacaagaaaaagaagccccgcggccgcgcccacaagcgcatgcagtacaatcgccgtttcatcaccgctgttgttggctttgggaaaaagaggggaccaaactcatctgagaagtaaagtggagcaatttcaagttgatttttatattattttgtttgtgtttctagttactgaattaatgtcttttttgaattttactgttttgaacacatttcctcttcgttaaaggatatttgagttgaattaatctgagttatcagttcgaaagaaa

SEQ ID NO: 2751 - DNA, 536 bp, Physcomitrella patens
agggccctctttcgctcgagtctgcattgctcgcgctcacgcaccctctgtgccgttgcttgcacgccctctcgtctttcaccatgagtaaggttcacggatccttggcccgtgccgggaaggtgcgtggtcagactcccaaggtcgcgaagcaggacaagaagaagaaaccgaagggtcgtgctcacaagaggatgcagtacaaccgtcggtttgtgactgcagttgttggattcggcaagaagaggggtcccaattcatctgagaagtagagtgtgatgttgcctattcaacgtggcatgccatgggctaggttcgcaatcatggtctacgtagtttaattccagcggctgttatgtttccgaccttagaaggaaatcatataacatgatcatatcaaggaaatttgtccttgatttcatgtagcttggttgaagtctggcattttgattatcatgatttcatttgactggttttcaacctctatccttgtgttaatgccgaaattatttaaagttttcggaaattcgcactga

SEQ ID NO: 2752 - DNA, 655 bp, Physcomitrella patens
agggtttcgggtgcgtcggtccacctgaaaacaccgcagccgtaaaactacttgctctttccctcgtgatcgagacatcgcgcatcttgagtcgtctctgcttccgcttgttcgctttctacccgccaccatgagtaaggttcatggatccttggcccgtgccggtaaggtgcgtggtcagacgcccaaggttgccaagcaggacaagaagaagaagccaaagggtcgtgcccacaagaggatgcagtacaaccgccggtttgtgactgcagtggttggtttcggtaagaagaggggccccaactcatcggagaagtagagtaagctgacggttgcaagtcgccttacccatagagtcggggagcctggtgataaccctagcaacatgttacttcttggcgttagcagcattaagtgattgaacatgtaattacctggctataactgccactgaaataattttgtaccatcactttgagacaaggttcgggagtgaaacattatgatgcagtgtgatcttcgtatatatcatcattcacaagagaataaaattgatttgcaggtctgtgttgaatgagtctatatcgttgtgttacatgaatacattcaataaagcattacagctctctcgcgcttggtgccttaattaatagtg

SEQ ID NO: 2753 - DNA, 696 bp, Physcomitrella patens
ctctttcttcggagtctcccgcgctcgcttcgtttccgccccctttgcttccgcttgctcgctcactctcctacaccatgagtaaggttcatggatccttggcccgtgccggaaaggtgcgtggtcagaccccgaaggtggcgaagcaggataagaagaagaagcctaagggtcgcgctcacaagaggatgcaatacaaccgccgatttgtgacagcagtggtcgggtttggcaaaaagaggggtcccaactcatctgagaagtagagtgcggatgtaatctactcttcagtagcatgcaatggaagatgctgaggatcatgctagatggcgtttgtagcgcgttgcggatgctgtgcatccgcagtagtaggaggaagtggattttagtgtttaaatctatggaaaatacccttttacttgagtcagtattcatagttatgaagcttgacagtggtgtttttagttggtgattttgattgagacactcatgcctaatatttctccttttgctcaattcgtgtagactctgtgctcccttctgattccgtggctcgaaattttcatttcatcggctggatcgcttaagtgcgttgctgcatgactgatttgaaagatgcaaaaccagtgcttggcctatctctgtggtgctgttccttaaacaggtgaacttgtggccgaaataaatttgtgaagg

SEQ ID NO: 2754 - DNA, 661 bp, Physcomitrella patens
gtgaggcttcattgctaacattctctcgcacactgcgttttcgcttgcgatctgacgtctgctcaccatgagtaaggttcacggatctttggctcgtgccggaaaggtgcgtggtcagacacccaaggttgcgaagcaagataagaagaagaaacctaagggtcgcgcgcacaagaggatgcagtacaaccgtcggtttgtgactgcagtggtcggattcggcaagaagaggggtcctaattcatctgagaagtagggtgtggtgaagtgcactatcagtcacctacatataatgggcgagttcgagtatcacattacatgatgtagttaaggtgcagcagctgtttgtgcttcgttcgcacggggacgtactgatgcagtatgtttgcgccgaagctaatttttttactatttatatcagtatcatgacacttgcagcctcgtcacggttgtattgtaacatgattatgaatccggcttcgactgctctcagtttagcttctttacctcggtataggatggctccgcgttggtccattttcgtgaatttgaactcatgtttccttgcgttctaggttgaaatgtattccagtctggcaatttggcaataccgaatgtcggtccttgtttaatcccatgctactcttactcttttattttt

SEQ ID NO: 2755 - DNA, 586 bp, Podocarpus macrophillus
gccaaaatatctttgattccccaacatcatctttggccgaagcagctgccgcagagagaacagcgtcgtgagtgtttttacgaagaggaagaagaagaatatcgaagaacaaaaatgagtaaggtgcacggatcgttggcccgagcagggaaggtcagaggccaaaccccaaaagtcgcaaagcaagacaagaagaagaagcccagaggtcgcgcccacaagcgcatgcaatataaccgtcggtttgtcactgcagtgcttggattcgggaagaagagaggtccaaactcttctgagaagtaactgattagatgcgctatgttggagaaattcgtttttgaatttacatccgtttagctgatgtctttcattttgagagttttgttattttggaaaagacttatgttattatagatttttaacacagctgtacagaaaccttgagcaatattttaatattttacataacaatttatctgaacaaaaatgagtgattaaccacactaaaattatatgcggaattagtggaattttcattcagtgttttgaattatttattgtttgaaaaatatgaatgtgaaacctt

SEQ ID NO: 2756 - DNA, 444 bp, Raphanus sativus
ggaacctagcatcgtcgtcgtctcctccaacagcagagccagagaagccagaagattatctgtgatcgaccatgggaaaggtgcacggttcattggctcgggccgggaaggtgagaggtcagacaccgaaagtggctaagcaggacaagaagaagaagcctcgtggtcgtgctcacaagagattgcaacacaaccgccgtttcgtcaccgccgttgttggctttggcaagaagagaggaccgaactcatctgagaagtagactgaagcaatttttaccttttggtgtgtttttttttgataatgtttctttagttacgaagccaatgttacttgttgatttcatttgtgttacattttttctgttcggattataacttactttcttgttgtatcagatcttttgttttcttataatggattagaggtgaatttcaccttgggta

SEQ ID NO: 2757 - DNA, 419 bp, Raphanus sativus
ggaaacactgagattacgcactagtttcagcttatttgcagccgtcagaagaaacagcagagaaagctaatcagccatgggaaaagtacacggatctttggctcgtgccggtaaagtaagaggacagacaccgaaggtagcgaagcaagataagaagaagaaacccagaggccgtgctcacaagcgtctccagcacaaccgccgtttcgttaccgccgttgttggtttcggtaagaagagaggacccaactcttctgagaagtagagaagattgatagatatgcctgtgaaagccgtctcatatggctagtttttgtaaccttttgaatttccttttcgtttgtattagtcaattcctttggtactactttatatgttttgattccaatctatgaaatacgcgattttagttttgatcc

SEQ ID NO: 2758 - DNA, 428 bp, Raphanus sativus
  misc_feature (393)..(393): n is a, c, g, or t
  misc_feature (412)..(412): n is a, c, g, or t
  misc_feature (416)..(416): n is a, c, g, or t
gggagattaggcacacgtatcagcttactgcggccgtcaggagagaaaaaaaacagtgacgcaaaacagccatgggcaaagttcacggatctttggcacgtgccggtaaggtgagaggacagacaccgaaggtagcgaagcaagataagaagaagaaacctagaggacgtgctcacaagcgtctccagcacaatcgccgtttcgttaccgccgttgttggtttcggtaagaagagaggacccaactcttctgaaaagtagacgaagaagaagataacatatgcttgtggaagcttttcataatggctgttttgtgcatttctcttcttatgttttagtcatgtttctttggcactaaacttatatatctttttgattctatgctatgaattangactttactcctgaatctnattntcaactttcaat

SEQ ID NO: 2759 - DNA, 393 bp, Raphanus sativus
gattaagcagcttattgcagccgtcggaagaaaacgcagaaaagcgaaccagccatgggcaaagttcacgggtcattggcacgtgccggtaaggtgagagggcagacaccgaaggtagcgaaacaagataagaagaagaaacctagaggacgtgctcacaagcgtcttcagcacaatcgccgtttcgttaccgccgttgttggtttcggtaagaagagaggacccaactcttccgagaagtagaaggatagatttgctttgaaagaaactctttcttctttgctattttgtaaccttcgggatgttttctctgtttgttttaagttatgtttctttggaacttgtgttgtgtaactctatgcaatgaaataggaccatttacttttccatctg

SEQ ID NO: 2760 - DNA, 434 bp, Raphanus sativus
  misc_feature (133)..(133): n is a, c, g, or t
  misc_feature (344)..(344): n is a, c, g, or t
ggaaagctaagcttttgtttcagctaattgttgcagccgtcaggagcagagaagcgaatcagctatgggcaaagttcacgggtcactggcgcgtgccggtaaggtgagagggcagactccgaaggtagcgaancaagataagaagaagaaacccagaggacgtgctcacaagcgtcttcagcacaatcgccgtttcgttaccgccgttgttggtttcggtaagaagagaggacccaactcttccgagaagtagaaggataaatttgcttgaaagaaactctttcttctttgctattttgtatccttcgggatgttttctttgtttgttttaagtcatgtttctntggaacttgtgttgtgtaactctatgcaatgaaataggaccgtttacttttccatctgattctcaatttgaatcccaaaagatactttta

SEQ ID NO: 2761 - DNA, 477 bp, Raphanus sativus
ggaaccctaaagaaagttttaacctagcgtcgtcctcgtcgtcgcctccagcagcagagccagagaagcaaagaagattctctgtaatcgaccatgggaaaggtgcacggttcattggctcgtgccgggaaggtgagaggtcagacaccgaaagtggctaagcaggacaagaagaagaagcctcgtggccgcgctcacaagcgattgcaacacaaccgccgtttcgtcactgcagttgttggctttggcaaaaagagaggaccaaactcatcagagaagtagagacaaaaccaagacttctggtgtggttttccctcggattattttgatgttttgataatgcgttttagttccggtatggtaatgagtcgatgtttgcatgtttgttgtcaattttattcgtgtttctccttggattatttttattatattaaagaaactcaaactccattataggaggagaaagtacacgatcat

SEQ ID NO: 2762 - DNA, 438 bp, Raphanus sativus
gggagattaagcactcgtatcagcttactgcagccgtcagtagaaaaaaaacagtgacgcaaaaacagccatgggcaaagttcacggatctttggcacgtgccggtaaagtgagagggcagacaccgaaggtagcgaagcaagataagaagaagaaacctagaggacgtgctcacaagcgtctccagcacaatcgccgtttcgttaccgccgttgtgggctttggtaagaagagaggacccaactcttctgagaagtagatgaagaagataatatgtgctgtgaaaagcttctcataatggctgttctgtgcatttctcttcttttgtttctttggcactaaacttatatatgttttgattctattatgaattacgactttactcctgaatcggattctcaactttcaatggcaatagttttattttgtttgcaagga

SEQ ID NO: 2763 - DNA, 454 bp, Salvia sclarea
ctactagaccttggctgtcactcagaaccccatcgccgtgcagccatttacttacgccaaagccggagaaatctctctcgatcggagaatattccaagctaaatcatgggtaaggtgcacggatcgttggctcgcgccggaaaggtgagaggtcagactcccaaggtcgccaagcaggacaagaagaagcagccccgcggccgcgctcacaagcggattcagtacaaccgccgtttcgtcacagccgttgttggattcggaaagaagaggggccccaactcatctgagaagtaaattgtagcaatttcagttgttttcgttatgttttagttttgctagttctggatcattttcccccctttgatttcttgagcagaattacacaattatgtgaaattttgaattgatctaatttcgtttaaagtggcattcgcagtgagtgacaggctagtag

SEQ ID NO: 2764 - DNA, 464 bp, Salvia sclarea
ctactagaccttggctgtcactcaactcccatctctctaccggcgaaatctctctctctctcctcccccgatctcgaagaaatcaatcagccatgggtaaggtccacggttcccttgctcgcgccggaaaggtgagagggcagacgcccaaggtggccaagcaagacaagaagaagcagccccgcggccgcgctcacaaacggattcagtacaaccgccgcttcgtcacagccgttgttggctttggaaagaagagggggccgaactcatctgagaagtagagtgttgctaccgatagtttatatatgtgttttgatatattcgagcaactttgaaacctcggttagttggtttgattatgttgtagtgttgcaagtgactgtattgagccttcatcccatgcttttctcgggttcgactcttgggaatgttactgcttaacattaaagtataatctttttttg

SEQ ID NO: 2765 - DNA, 463 bp, Sciadopitys verticillata
gcagagaagagaagagagtaatcatctggatcggagcagagggtgtttactctcacagttggaaaaatgagtaaggtacatggatccttggcgcgggctggcaaggtgagggggcagacgccaaaagtagcaaagcaggacaagaagaaacagccgaggggccgcgcccacaagcgcatgcaatacaaccgccgctttgtcactgctgtcgtcggattcggcaagaagagaggacccaattcttctgaaaagtaatcacgcatgacaaaatgctgtggcatgtgttttcggcaaaatgcggattttgctttaggtttttatttttatcttttattaagtttgttatttccatgacagtttacattgaattcaattgaatgacagaacatctctgatgactatataactttttaacagcgtgtttcactcaattttgtctatactatattagtctcatagcttt

SEQ ID NO: 2766 - DNA, 415 bp, Senecio madagascariensis
aagcagtggtatcaacgcagagtacgcggggagaaacgatcctgcactctattcagccgcaaagaagaccaggagcagaaacacctcaaattcaccatgggtaaggttcacggatcgttggctcgtgccggtaaggtcagaggtcagacccctaaggtcgccaaacaagacaagaagaagcagccacgtggacgcgctcacaagcgtatccaatacaaccgccgtttcgtcaccgccgttgttggctttggaaagaagaggggtcctaactcatcagagaaatagagtgttttattttcagttgaatctttttgatgtttgtttagaagacttgtttagtattttgctgctacacaattttgttatcacctcaaccattttaagtattcgtcttaatatgatttgatatttggtg

SEQ ID NO: 2767 - DNA, 1029 bp, Picea glauca
acggtccaaaccctaaagctcaaacccttaccttccgaccacattataaacacaaaccctaatcgatcaagcccttactttgcattttggctttggcgttggaagagctctcggctaatcgaaggagattgagattgtattcaggcattgagattgctgtatcacaatgagtaaggttcatggctcccttgcccgagcagggaaagtgagagggcagacgccgaaggtggccaagcaagacaagaagaagaagcctagaggtcgtgcccacaagcgaatgcaatataaccgccggtttgtcaccgcagtggttacatttggaaagaagagagggccaaactcttctgagaagtaaatgactaggtgcaatggtagaagggaaggcatccggttttgaaagttcatctttttgggggattgtttttcattaattcgggaatttttgtttttagttaacttcttattcataacgatcatttacttttgtcgaggttggaaccgagaagaaaatcattatggatttgtactgtgcaaaataggttttttcgaagggtcatatgatatgatatgatataatatatgtatttggctatttatattttctcattgcattaaaatttatggattgatctgtgatgtaaaagatagtcagaaatgttgcatagttttgtgctttctgtagtgaaatttggaacattcatgagtgggaatggacctatttgtttacgataagaatgcattgacatcaccattaccttcaaaacaattaggaagctatgtatatgaaagcatgtgaggaatttgcagttatggaatgacccttaaatgtatgagattgaaatctatgccccctgcacaatctagtctgttattcttgttgctcgacaagattgagcgttcttttgaacaattctgtgctagtagtatcaagggaattttcagttaccaagaatttaatggtacgtattgtatgacagtattggtactgtattttctcattttctttgtacacgttttatcttctttata

SEQ ID NO: 2768 - DNA, 633 bp, Picea glauca
ttaattaaattaatcccccccccccccgactttgcaacttggctttggcgttggaagagctcccggctaatctaaacagattgagactgtattcaagcattgagattgctgtatcacaatgagtaaggttcatggttcccttgcccgagcagggaaagtgagagggcagacgccgaaggtggccaagcaagacaagaagaagaagcctagaggtcgtgcccacaagcggatgcaatataaccgccggtttgtcaccgcagtggttacatttggaaagaagagagggccaaactcctctgagaagtaaatgactaggtgcaatggcaggaggggagtcatctggttttgaaagttcatctttttgggggattgtctttctttaatttgggaatttttgcttttagttaatttcttattcataatgatcttgtactttttgttgaggttggaaccaagaagaaagtcattatggatttgtactgtgcaaaataggttttttcgaatggtcatatgatatgatataatatatatatttggctatttatattttctcattgcattaaaatttatggattgatctgtgatgtaaaagatagtcagaaatgttgcatattttcgtgctttctgtagtga

SEQ ID NO: 2769 - DNA, 404 bp, Saccharum officinarum
ttcggagcaggggagccgccgccgccgcaacagcccgagtcgctcgtcagatcctccgagcaccacagctccggctccgccgccgccatgggtaaggttcacggatcgctggcccgcgctgggaaggtgcgtgggcagacgcccacggtggcgaagcaggacaagaagaagaagccccgcggccgcgcatacaagcgcatgcagtacaaccgccgcttcgtcaccgccgtcgtcggattcggcaagaagcgcggccccaactcctcggagaagtagatctagctatggcttgttttgttccctactagtttccttgtactgatggcaagttgaagacttatgctattatctatatcgatgttactgcaatactatcaagtatgatgctgttattgcaatactat

SEQ ID NO: 2770 - DNA, 416 bp, Helianthus annuus
cgggagccccaaaattccatcgtattgcaacacaacgaaccgactcgaagacgttaagcaccaaaatccgccatgggaaaggttcacggatcattagctcgtgctggaaaagtgagaggtcaaaccccaaaggtggcaaagcaggacaagaagaagcagcctcgaggacgcgctcacaagcgtattcagtacaatcgccgttttgttactgccgttgttggttttggaaagaaaaggggacctaactcatcagagaagtaagctgaaggaatatccagttttgtatgcttagtttcatgaagctgttttctactataatctgaattttgttttgaattattttttttatcttattctgtcataattctgatttagtgattggtatatttggttattgagttcttgatattgttggt

SEQ ID NO: 2771 - DNA, 450 bp, Helianthus annuus
gtcttccttgcatctaccacaaccaaccagaatcgaagacagttagcagcaaccgccatgggtaaagtacacggatcgttggcgcgtgcgggtaaggtgagaggccaaacccctaaggtcgccaagcaggacaagaagaagcagcctcgtggacgcgctcacaagcgtatccagtacaaccgccgtttcgtcaccgccgttgttggttttgggaaaaagagaggaccaaactcatcagagaaataaacaagttgaatgaaattgcttttacattgttatgttatttagataatgtttattgtgccagccacactccttttatgtgacctcaaatgacttgtaatttttcagattaatatgtgctattcagttgttctaatccatgatttgaatgatttatgcattcccttacattaaatttaattccatttctaccaaaatacaacctcc

SEQ ID NO: 2772 - DNA, 449 bp, Helianthus annuus
gggggcccaaaccctagtacattctccgttatctttcgatccagttgccctagagccagccgatcgtcaaacttcaagatgggaaaggttcacggatcgttggcacgtgccggtaaggtgagagggcaaacaccgaaggtggcgaagcaagataagaagaagcagccacgtggccgtgctcacaagcgcattcaatacaaccgccgttttgtcaccgccgttgttggtttcggtaagaagagggggccgaattcatctgagaagtaaggtggttgatgcacatcaagcagcatagtcttgtagtttattttgatggaaattttagacctttatgatgtttgactatacaatgctttttatctggttatgaagttggatgaatattttctatctttttgtggtgaaatttgtattctgcattttggcatggtattgtaatttacatgttt

SEQ ID NO: 2773 - DNA, 308 bp, Helianthus annuus
cgtgacttcatagaaagaacgaaatcgaaatcaggaggcagcaaaagacactagattcaatatgggaaaggttcacggttcattggctcgtgccggtaaagttagagggcaaacccctaaggttgccaaacaagacaagaagaagcagcctcgcggacgtgctcacaagcgtattcagtacaaccgtcgtttcgtcaccgccgttgttggttttggaaagaagagaggaccaaactcatctgagaagtaagcagaggatgtgtgtagttttgtaagcttagtttaatggaattgttttttatattgcc

SEQ ID NO: 2774 - DNA, 510 bp, Taxus baccata
taattcgcaacacccctttgtattagtaaaagcttagtccagaggctttttgattcgtctgagcgaagagaaactagtaggagaagaagattaatctacagcagaatgagtaaggtgcatggatcgttggctcgagcggggaaggtgagggggcagactcccaaggtcgccaaacaagacaagaagaagaagcccagaggacgcgctcacaagcgtatgcagtacaaccgtcgctttgttaccgccgtgcttggatttgggaagaaaagagggccaaactcttctgagaagtaattgattaggtgtgtactattgacaatggaggaaaaggaaatcaaaaatacatccttgttggcggctttcattaccgatgtgtttttttatagttgaggatgatttttgttaacatgatttttgtttcataatctattactctaaaaacagatttataatattttccgtatgcctactgtgacaagcccttgaacaaaggaaaagtaaaaggctgat

SEQ ID NO: 2775 - DNA, 499 bp, Tragopogon dubius
cgggggaacctagacaccttcgcggctgctcagtgcttccttgcaatcgaacgaacgaaatcgaaatcacaaggccgcaaaggacaccagattcaatatgggaaaggttcacggatcattggctcgtgccggtaaagtcagaggccaaacccctaaggtagccaaacaagacaagaagaaacagccccgcggacgtgctcacaagcgtattcaatacaaccgccgttttgtgaccgccgttgttggttttggaaagaagagaggaccaaactcatctgagaagtaaatctgagggaatgtgtagttttgtaagtttagtttaatggaattgattttacattgctattatgttatttagacagtctttctcatgttatttacagtctttctactaaacctgaaattatatgaagtgttttcagtttgatatttgatatatttgtccttcattttattttgattcatataaagttctactaaaaaaaaaaaaaaaaaaagt

SEQ ID NO: 2776 - DNA, 395 bp, Triticum aestivum
cccgagcactccgtctcctcgccgaagcgccgccgctccaccgccgcagccgccatgggtaaggtgcacggatcgctggcccgagccgggaaggtgcggggccagacgcccaaggtggcgaagcaggacaagaagaagcagccgcgcggccgcgcccacaagcgcatccagtacaaccgccgcttcgtcaccgccgtcgtcggcttcggcaagaagcgcggccccaactcgtccgagaagtagatctaggtggtctcgcgccagccctcctttttttttgtttcccgtcagtagctgtgatccgttccggtatgcatgctaagaagtaagaagacctaatcaagtatctgtaattttctgtgatgttggtaatggaaatctcactgcattgtcca

SEQ ID NO: 2777 - DNA, 390 bp, Triticum aestivum
gcactccgtctcctcgccgaagcgcccgccgctccaccgccgcagccgccatgggtaaggtgcacggatcgctggctcgcgccggaaaggtgcggggccagacgcccaaggtggcgaagcaggacaagaagaagcagccgcgcggccgcgcccacaagcgcatccagtacaaccgccgcttcgtcaccgccgtcgtcggcttcggcaagaagcgcggccccaactcctccgagaagtagatctaggtcgtctcgcgccagccctcctttttttttcgtgtttcccagtagctgtgatccgtttattcagtatgcatgctaagaagaagacctgatctagtatctgtaattgactgtgatgttggtaatggaaatctcactgcattgtcca

SEQ ID NO: 2778 - DNA, 545 bp, Triticum aestivum
ctttctccctccacaaccgccgccgccgtcgcaaaccctcgcgcactcgcctccaaccctccttctccgccgccccaccgccgccgtcgacatgggcaaggttcacggatcgctggcccgtgccgggaaggtccgcgggcagacgcccaaggtcgccaagcaggacaagaagaagcagccccgcggccgcgcccacaagaggatccagtacaaccgccgcttcgtcaccgccgtcgtcggcttcggcaagaagcgcggccccaactcctccgagaagtaggcgcgcgccaagaaaaggctcttcctttgcgctagttttcctctcctttgttgttacgcaagattatgatgatggaagagacactactgaagtgttaaagtatgcattgttttgcttagttgaagaatctgagatactgtggtatgagtatgcatgttttgattagttgaagaatctgtgatattgtggtaatgagttcatggcttaaatttgcttgttctttgtcgttgcccatgatgtgcaacatatgcggctaaaaaaaaaa

SEQ ID NO: 2779 - DNA, 526 bp, Triticum aestivum
cgacccacgcttccgcgactggagcacgaggacactgacatgactgaaggagtagaaaagaagccgccgccgccgccgcccgagcgctccccgttctcgtcgccgaagcgctccccgttctcgtcgccgaagcgctcccccgccgctcgagtgctccccgttctcgtcgccgaagcgctccccgccgctccaccgccgcagccgccatgggtaaggtgcacggatcgctggcgcgggccgggaaggtgcgggggcagacgcccaaggtggcgaagcaggacaagaagaagcagccgcgcggccgcgcccacaagcgcatccagtacaacaggcgcttcgtcaccgccgtcgtcggcttcggcaagaagcgcggccccaactcctccgagaagtagtagatcttggtggtctcgcgccagccctccttttttttttgttttcgttccagtatgcatgctaagaagacctaatcaagtatctgtaatttactgtgatgttggtaatggaaatctcactgcattgtcca

SEQ ID NO: 2780 - DNA, 647 bp, Zamia vazquezii
ggtagccgaattcggctaccgggaggaatcgagagatattttgtcattgtttggatcagcgggcgtaatttagggctgcagcgatgagtaaggtgcatggatcgttggcccgagcgggcaaggtgaggggtcaaacccccaaggtggccaaacaggacaaaaagaagaagcccagagggcgtgcctacaagaggatgcaatacaatcgccgctttgttacagccgttgtaggtttcgggaagaagagaggacccaactcttcggagaagtaaataaattttttgtagatggatttgaggtgcaggggattcatcactgtctgtaaacgtttggtaagagtttgctgtttctggagaatcatctgccctggtgtactctgaactttgtagtgagaaattaatatgatgcaatattctaaacatgtagcctttttttccctcgtttggggaggtacgcgtttatgaatgctggctctggtcaatgggttttccgttttctagtagctcttgctggttcctcttttgcagtttgcattgctgtaaatttcttttcttaagtcatctgtgctagatcttgactttttttctatgaaacaagcattgctgcccaatctttaatcagatttgagctaagtatgctccggtagc

SEQ ID NO: 2781 - DNA, 613 bp, Zostera marina
gccatgacccgtggcccgtgggtaataaagaatattcgcagtttttttaatgatccaggcaattttaaacggataaatacccatttgcagcgaaggaaaccctaattgatatcatcttggttttttttaccgcaactcgagatactttacttcattcgttcgtcatgggtaaggttcacggatcgttagcgcgtgcggggaaggtaagggggcagacgccgaaggtggccaagcaggataagaagaagcagcctcgtgggcgtgctcacaagcgaatccaatacaatcgccgcttcgtcacggcagttgttggatttggaaagaagagaggaccaaactcatcagagaagtaaaaaagtttaggtttgacatttgagcaacaaccagcaagcttgatgttttatttagttttttttgcatttaatgggatctttatgaaaaaaattgccatcctttttcatttttacaagaagaaattaactgttattaactcttaatacttaattctgtttactttcataactgttattaatgttaattgtgatattctaatgttaattttatagccatttttttagcacctgaatcttgcatggaaaataatgaatatatc

SEQ ID NO: 2782 - DNA, 701 bp, Brassica napus
tcagtactcgttccagctaattgcagccgtcggaagtgaaagcagtgacgcaaatcagacatggggaaagttcacggatccttggcacgtgccggtaaggtgagaggacagacaccaaaggtagcgaagcaagacaagaagaagaaacctagaggacgtgctcacaagcgtctccagcacaaccgccgtttcgttaccgccgttgttggtttcggtaagaagaggggacccaactcttctgagaagtagaagaatgacttataaaagcttctcataatggctattttgtgcatttcttctattcgtatgttttagtcatgttccttttgcacttatatatgttttgattctatgaattacgaatttactcttgaatttgattctcaacttccaacagtaatagtttgattttgtctgcaagtttacaccaaccatggggttttataaattagtttattgaatgatatgtttctattctacggtaatggaatcatacaagaaactgtgatttatgatgttctctcgccaacaaatgtataataggcgatgcttccacaaatctttcttcatccagcaatctctgaccatgctcttgaattgcttgtataatttcatgtcgttcacatttggttaggagcggttctttgcattggaccagttaactgttgcttgcttggtaataacctagatatatgaactaa

SEQ ID NO: 2783 - DNA, 481 bp, Brassica napus
ctggaccctgcggaccggtccggaattctgggtcgacgaagcgtccgcgaagctgtcgtcgtcacacatttgccggaggtagcgccgattcattcgtcaaaacaactatgggtaaggttcacggttccttggctcgtgccggtaaggtgagaggacagactcctaaagtggctaagcaggacaagaagaagaagccacgtggtcgtgcccacaagcgtcttcagcacaaccgccgtttcgtcaccgccgttgttggatttggcaagaagagaggacccaactcttctgagaaatagatgatgaacgcattggagctgaagttttgagtttttattttccaaaagatatcgtacttgtttaatgttgtaagactgcaattttctcaatcaaatcgacttttttgataaaaaaaaaaaaaaaaaagagctcgaggggggggccggtacacgattcgccctatagtactggagttccggccccg

SEQ ID NO: 2784 - DNA, 354 bp, Brassica napus
aagctgtcgtcgtctcacatttgccggaggtagcgccgatccattcgtcaaaacaactatgggtaaggttcacggttcattggctcgtgccggtaaggtgagaggacagactcctaaagtggctaagcaggacaagaagaagaagccacgtggtcgtgcccacaagcgtcttcagcacaaccgccgtttcgtcaccgccgttgttggatttggcaagaagagaggacccaactcttctgagaaatagatgatgaacgcatttgagctgaagttttgagttttatctttccaaaaaatatcgtacttgtttaatgttgtaagactctgcaattttcttaatcaaatcgacttttt

SEQ ID NO: 2785 - DNA, 525 bp, Avena sativa
gccgccgcgaaccctcagcgccctcgccctccaagcctccgccgccgcagcgtcaccacctcaccgccgccgtcgacatgggcaaggttcacggatcgctggctcgtgccggtaaggttcgcgggcagacccccaaggtggcgaagcaggacaagaagaagcagccccgcggccgcgcccacaagaggatccagtacaaccgccgcttcgtcaccgccgtcgtcggcttcggcaagaagcgcggccccaactcctccgagaagtagacgcgcgtaatgtgtcaaagaagcttcttccttgctgtagtttccctctcgtgttgttacgcaagaagatggaagaaaaaccttaaattactctgctgtttcctgtgatagatgagatatcgaactcatgtgcttaagtatgcctgcttcgtttagctgagaatttgtgatatgagttgattacttgaatttacttatgctctcttgtccctgatgatgtccagtatgcaagattgtgcctgtttgtgtccaaaaaaaa

SEQ ID NO: 2786 - DNA, 821 bp, Cirsium arvense
gctcttacaaggtgacattcggtgttcttttccacgatgatcgatgtgcaaacatatttgaagcattggttgggacactgcgggcggccaagaggcgcaaattcctgacatatgatggtgaactgctacttcaaggtgttcacgataacgttgaaatcatactgaaacccaccccaccagcagcagctgcataattcaaacctcatcaagtttgtataagcttatacccttgtattatcttgtatgattcatcataatttgtattaccttaagaccctctgcttcaaaactcatcgtggttgtatcagcctaaaacctcttatctatctatcttgtatagtggaaagattgtgattaccactaaattggaacaccaatctctttcttataaaaaagaaaacataatattgaattcacccaactcagtattttagttgaaacttaaacattcaccgataacatcataaatcatatgttcaaccaaaaagtagcgagtttagacaaagtcaacatgatttaggatctaaaatttccagcgaactaatcgaaaagcgtattattcagcttacttctccgatgagtttggccccctcttcttcccgaaaccaacaacggcggtgacgaaacggcggttgtattggatgcgcttgtgagcacgtccacgtggctgcttcttcttgtcttgcttggccacctttggggtttgccctcgaacttttccggcacgagccaacgatccgtgaacctttcccatggcgaatttgaagtttctgcttccttgtgtggattctgtgcagctgaatcactcgagaacggaaaag

SEQ ID NO: 2787 - DNA, 445 bp, Utricularia gibba
aaggttcacggttcgttggcgcgtgctggaaaagttagaggtcagacgccgaaggtggcaaagcaagacaaaaagaagaagcctcgaggccgtgcgcacaagcgaatgcagtacaatcgccgcttcgtcaccgccgttgttggctttgggaaaaagagaggaccgaattcgtctgagaagtaagggcaacgaggcattgtcatgtatgtgcttgcctacttgttacaatgatttggaacatagtctttctgaaatctgaactatgcacttgatcctttttgtttccttcgctgaagatctctttgaaccactacaagtagttctgtgcttttagcttccgcttttgctgttgatcaatctgtgcaacagcttagacaaaataatgttttagaaagggtgtcaagcaagctctatttatcccttagtaaaaaaaaaaaaaaaacac

SEQ ID NO: 2788 - DNA, 485 bp, Amaranthus tuberculatus
gtaaggttcacggatctttggctcgtgccggaaaagttagaggtcaaacccctaaagttgctaagcaagacaaaaagaagaagcctcgtggtcgcgctcataagcgtatgcaatacaaccgccgtttcgtcaccgctgttgttggattcggcaagaagagaggaccaaactcttcagagaagtaagatagctagtggttgcagcaacaatgtgatttcccagatatcttagttgcacttcttatttttgaaaatggactttgtgtattcctaaaatgctgtctcttcatttttttttgtttagcgagtgaagttttggtgcactgatataaacatagttttgtcacaacgctatatctacatatcaagcttttttaattctcacctttatattttggtaaaattgtcacgaataatttcagttaatgtccatctgttgtgaataatttaaactagtgattattttaaataattcaacttgtatgt

SEQ ID NO: 2789 - DNA, 443 bp, Brassica oleracea
gaactcagagattacgcactcctttcagctaatcacagccgtcggaagaaaaaggagagaagcaaatcagccatgggaaaagtgcacggatccttggcacgtgccggtaaggtgagaggacagacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagattgatgatatttgcatgaaagagatgcttctttcaaagctctattgctctttttgtaacttgatctttcttcgtttgttttagtcatgtatctttggttcttaactctatatgttttgattccatgctgctatgaaataccgattttagttttgaatctgatgatcagcctccaacac

SEQ ID NO: 2790 - DNA, 482 bp, Brassica rapa
cgcactcgtttcagctaattgcagccgtcggaagagaaagcagagaagcaaatcaaccatggggaaagttcacggatctttggcacgtgccggtaaggtgagaggacagacaccaaaggtagcgaagcaagacaagaagaagaaacccagaggacgtgcccacaagcgtctccagcacaaccgccgtttcgttaccgccgttgttggtttcggtaagaagaggggacccaactcttctgagaagtagaagaatgacttataaaagcttctcataatggctattttgtgcatttcttctattcgtatgttttagtcatgtttcttttgcacttatatatgttttgattctatgaattacgaatttactcctgaattttattctcaacttccagcagtaatagtttgattttgtctgcaagtttacaccaaccatggggttttatcttttatgttattgaatgatatgtttctattctacggat

SEQ ID NO: 2791 - DNA, 393 bp, Brassica rapa
ggagtccatcaaaagctgtcgtcgtcacacatttgccggaggtagcgccgatccattcgtcaaaacaactatgggtaaggttcacggttcattggctcgtgccggtaaggtgagaggacagacacctaaagtcgctaagcaggacaagaagaagaagccacgtggtcgtgctcacaagcgtcttcagcacaaccgccgtttcgtcaccgccgttgttggatttggcaagaagagaggacccaactcttctgagaaatagatgatgaacgcattggagttgaagttttgagtttttattttccaaaaaatatcgtacttctttaatgttgtaagactgcaattttctcaatcaaatcgacttttttgataatttgttctaattcattcaaaaaa

SEQ ID NO: 2792 - DNA, 458 bp, Brassica rapa
aagcagtggtatcaacccagagtggctattacggccggggacgcactcgtttcaggttattgcagccgtcggaagagaaagcagagaagcaaatcagccatgggcaaagttcacggttctttggcacgtgccggtaaggtgagaggacaaacaccgaaggtagcgaagcaagataagaagaagaaacccagaggacgtgctcacaagcgtcttcagcacaatcgccgtttcgttaccgccgttgttggtttcggtaagaagagaggacccaactcttctgagaagtagaagccctttctgtgaccacctttctgttgcaagatagatatgctggaacgagacctttctgtgaaaggttctctcatttggctatttttgtaacctttcttcttatgttttaattctatgaaatgaaatacaacttttttacatcttgatctagacacaaaagtttgatt

SEQ ID NO: 2793 - DNA, 604 bp, Elaeis guineensis
actcaccgctcgctttcagcgtctcctcgttcccttccctcacccggtcgcttgctgcaaaccctacaaaccaatccgccgccatggggaaggtgcacggatctctggctcgtgctgggaaggtgagagggcagacgcccaaggtcgcgaagcaggacaagaagaagaagccccgcggcagggcttacaagcgcatgcagtacaaccgccgcttcgtcaccgccgttgttggattcgggaggaagcgagggcccaactcatccgagaagtaaaagaagattgtagtagactccttttcaatatctagtttcaaacaaatgtagggttttgtttctggattctgaattacgtgtctggattctgcgttttgagaatggtttatggaaattctgaatcgattgggggtgtaatgctatgtttggcccctctttagagatgcttcgctagctatctatctttatcctgaaggaagtctccttttttaggtcacatttgttgtttttgtctttcaaaatttagcttcttttgtatggttgttgctgtgtgaatgttatttggacatccagtttgaattgtttatgatgaatggggtggggtcttaatc

SEQ ID NO: 2794 - DNA, 371 bp, Raphanus sativus
  misc_feature (74)..(74): n is a, c, g, or t
ggaaaaaccctagtctaacaaaaagctgtcgtcacacatttgccggaggtagcgccgattcagtcgtcagaacnactatgggtaaggttcacggttcattggctcgtgccggtaaggtgagaggacagacgcctaaagtggctaagcaggacaagaagaagaagccacgtggccgtgcccacaaacgtcttcaacataaccgccgtttcgtcaccgccgttgttggatttggcaagaagagaggacccaactcatctgagaaatagatgatgaacgctttggatttgaagttttgcggattttgttttaacatctttcttgtttaatgtgtaagactctgctattttctcaataaaattgactttttgata

SEQ ID NO: 2795 - DNA, 401 bp, Raphanus sativus
agattacgcagccgtcggaagaaaaagcagagaagcaaatcagccatgggcaaagttcacgggtcattggcacgtgccggtaaggtgagagggcagacaccgaaggtagcgaaacaagataagaagaagaaacccagaggacgtgctcacaagcgtcttcagcacaatcgccgtttcgttaccgccgttgttggtttcggtaagaagagaggaccaaactcttccgagaagtagaggatagatttgctttgaaagaaactctttcttctttgctattttgtatccttggggatgttttctttgtttgttttaagtcgtgtttctctggaacttgtgttgtgtaactctatgcaatgaaataggaccatttacttttccatctgattctcaatttgaatccc

SEQ ID NO: 2796 - DNA, 434 bp, Carthamus tinctorius
  misc_feature (58)..(58): n is a, c, g, or t
cgcggggaacctaacttttccgatctcgagcgattcagctgcacagaatccacacaangaagcagaaaactccaaattcgccatgggaaaggttcacggatcgttggctcgtgccggaaaagttcgaggccaaacccctaaggtggccaagcaagacaagaagaagcagcctcgtggacgtgctcacaagcgcatccaatacaaccgccgtttcgtcaccgccgttgttggtttcggaaagaagagggggccaaactcatcggagaagtaagccgaacgagacgcttttcgattagtttgatggaagttttagatcgtgaatcatgtcgactttgactaaactcgctactttttggttgaacgtatgatttatgatgttatcggtgcacgtttaagtttcaactaaaatactgaagttggttgagttcaatatc

SEQ ID NO: 2797 - DNA, 598 bp, Sequoia sempervirens
tatatcttcgatgaatgttaaaacttcttaaagattttattacgctcgctgtgtctgaagtgcagagttcagaggtatttttgcgcgtctgtcaatagtcacagattgagtcgggttttgggagtcttgcgcctgtcaatacactccggccgctgcgtaccaagtgcagtgaatcggtaatcttgtcaaaatgagtaaagttcacggttccctggccagagcagggaaggtcagggggcaaaccccgaaagttgcaaagcaagacaaaagaaaaagcccagaggccgcgctcacaagcgcatgcaatataatcggcgctttgttactgccgtggttggtttcggcaagaaaagagggcccaactcatcagagaagtgatgaggaaaactacaagatcaagcttgctttctgttgttgaagacacatttctccgtgtaatatcatcttaatgaagtagcaagtgaattcttaaactgtagtatgcatatttatgtgttttgtctgtaaatcatcaacagttattatgatttggatcatctaatatccattttggatgtcgccaaagtgaaacatcgtattttatgaagtgacaaatttg

SEQ ID NO: 2798 - DNA, 2054 bp, Zostera marina
actgttttcccccaaccatcatcggccttgctgtatcgttctgcatctttttcctcgccgctggatcccgtctcgatccgatcctccggttaccgtctgagaaggattctcttgggacgaggtgggctgtgctgatcgccggatcatctggatatggaaattatcgtcatcaggccgacgtctgtcatgcgtaccagatcatgaggaaaggaggattgaaagatgaaaacatcgttgttttcatgtatgatgatattgctaataacagatataaccctagacctggaatcatcatcaaccatccaaagggtgaagatgtgtatgcaggagtccccaaggattatgttgggatggatgttaatgtgaacaatttctttgcggttctgcttggaaacaaagccagattaagtggtaatggtagtggaaaagttgttgacagtggtcctgacgatcatatctttatattctactcagatcacggcggtcctggagttcttggaatgccctcgtatccgtacctctatgccaacgatttaatcgatgtcttgaaggaaaaacatgcactgaaatcctataaaagcatggttttctatcttgaagcatgtgaatctggaagtatatttgaaggactccttcctgaagatatagacatctacgccactacagcatccaatgccgtggaaaatagctggggtacttattgtccagaacaactcatcagccctcctgatgaatattcaacttgtttgggagacttgtatagtatttcctggatggaagacagtgacatacacaatttgcataccgagactcttaagcagcagtaccatgtggttaaagatcgtacttctgtgcaaaagacttatgattctggttcccatgttatggaatatggagatttggacctgagtttaagtgacttattcacgtacattggcacaaatcctgcaaatgataattcaagttttgtcgatatcaactcattgccgcagttgccatcatcaaaccgtgtcaaccagcgcgatgcagatctagtcttttattggaataagatcagaaaagcctccgaaggtcctgaaaaacgtgaggctgaaacagaattgatcaatgtgatgacacacagagtgcatatcgacagaagcatagaactcataggcaagattctgtttggtctggatgcaagtaaggataaactaaacgaagttcgaccatcaaacaaacctttggtagatgactggaaatgcctaaaatcaatggtaagaacatttgagacgtattgtggatctctttctcaatatggaatgaaacacatgaggtcattagcgaacatctgcaatgctgacgtaacgcttgataagatggaagaatctgctgcccaagcttgtgaaaagattccatcaaactcatggagctcaattgaccaaggtttcagtgcttaattatgtaaaataattgaatatgtaatttatgtatataatcaaataccgcgttattgtataaaaatagatgttgatagataaatatttaaagtcagaaaattaagcagaataaagtttaaagttatttcatctggtgcaaattgcaaatgtgaaaaaagaaacgttaaaaaaaaacatgttctgttgctcgaacctaaggtaaaaccatctttacttctctgatgagtttggtcccctcttctttccaaatccaacaactgcagtgacaaagcgacggttgtattggatccgcttgtgagcccggccacgaggctgtttcttcttgtcttgcttcgccaccttcggcgtctgcccccttaccttccctgcacgcgctaacgatccgtgaaccttacccatgataaacgaatcaaatgcagtatttcaagctgcggtagaaagcaaaaacaacaacgacaataaacagaaaattagggttttcttcgctgcaaggagaggcaaaggaagctgcgaattcaggcttatatactgaaatgagatggtaaaccctaaaagtagttaggaacacaggaatatatcgatccggatctgtatggaaccagacccaaatcaaat

SEQ ID NO: 2799 - DNA, 545 bp, Utricularia gibba
gcgagagagaaaggaagatactttgacacagaagtggggaaggtacatggatcactggcgcgcgcaggaaaggtgagggggcgagactccgaaagtggcgaagcaggacaagaagaagaagcctcgaggccgcgcacataagcgaatgcagtataatcgtcgcttcgtcactgctgttgttgggtttgggaagaagagaggacccaattcctctgagaagtaaagggctagtaggcatcagggaggttcagtggtttctattggtcccttcaacagttacaatttggttactatggttcagtttcctgtgtgtttttcacactaaatcaggggatttctacctggcattatcaggttgatcccccttggtattcttttgaatgtttttctttgactactcaataggcgaaattcagcgtgaatcctaatcttgctggtatgtacaactcagactgaatacatgagtttcgattctgtaattgatttttgtgtcttattttcacccactccaaagaacactaccgccaaattagggggtggatcat

SEQ ID NO: 2800 - DNA, 508 bp, Cedrus atlantica
cgttggaagagttgtcggctcatcgaaggagattgtcatcgttgcatcacaatgagtaaggttcatggctcccttgcccgagcagggaaagtgagagggcagacgcccaaggtggccaagcaagacaagaagaagaagcctagaggccgtgcccacaaacgaatgcaatacaatcgccggtttgttaccgcagtgcttactttcggaaagaaaagagggccaaactcctcggagaagtaaatgactagagccaatggcaggagcgaaggcatctggttttgaaaggtcatcctttttgaggatgtctttctttaacttttgttggtatttaatttcttttgataacaatcatgtaattttgttgaggttggaaccatgaaaaatgtagttttgatttgtactgtgtaaaatgggtttttgaatggtcatatgatataatttatgtatttggccatttatatttgttcaatttgttaaagctaatggactaatctgtgatgctaaaggt

SEQ ID NO: 2801 - DNA, 457 bp, Cedrus atlantica
agcatctctcggctaatcgaaggagattgagattgtatccaggcatcgacctcgctgcatcacaatgagtaaggttcatggttcccttgcccgagcaggaaaggtgagagggcagacgcccaaggtggctaagcaagacaagaagaagaagcctagaggccgtgcccacaagcgaatgcaatacaaccgtcggtttgttaccgcagtggctactttcggaaagaagagagggccaaactcctctgagaagtaaatgactagaggcaacggaaggaggcaaagcatctggttttgaaaagtcacctctttttgggatgtctttctttaaaactttttgttggtagttaatttcttttgataaaagtcatgtaattttgctgaggtttgaaccgagaaaatagttttgatttgtactgtgtaaaatgttgtttcttaatgatcatacgatataatttaa

SEQ ID NO: 2802 - DNA, 636 bp, Citrus clementina
aaaaagaaaaaaacccgcaacctgtcgctgacgttaactcagacgaagaagatctgattaaagcaatcaatcatgggtaaagtacacggatcgctggcacgtgccggaaaggtgagagggcagacgccgaaggtcgccaagcaagacaagaagaagaggccccgtggacgcgcctacaagcgcatgcagtacaatcgccgcttcgtcactgccgttgttggttttggaaagaagcgtggacccaactcttcacagaagtaaactcgaactcaagacaagtttttgaataaactgtggagtctcatgtgaaaaatggatattattctatttaaatcaacttcgctggccttagtatttcttagtagtttttttttttaaattgttaattcaagttctttttagttgaagcaaattttgatcagtttaggattgaatttaagttctagcttatgctggttttctcagtcattgtcatggaagaggacatgaagtatgtattgatcgttgactgatttttagctgggaaaatcaattagactctggctattcaattactgctgtgtctcaatgtttgttgacatttatttctttttcttttttttaaggtacaattattacctgtgttttctatttctt

SEQ ID NO: 2803 - DNA, 645 bp, Linum usitatissimum
ctcgtccgcatcctcaggcgcaaccaggagcagcagagcagcagcagcatctgaagatacaagagaaaccatgggtaaggtgcacggttctttggctcgtgctggtaaggtgaggggacagactcccaaggtcgcgaagcaggagaagaagaagaggccacgcggccgtgctcacaagagggaacaatacaaccgcagattcgtcactgctgttgttggattcggcaagaagaggggaccaaactcttcagagaagtaaaaacctaaaaggatgatgaaatttctggttatgtagggaaagatgatcaactttatgtttgttattcgaagaatgatgagtttaaatgctgtcagactatgaacggaactgttttcatatcagtgtgaacttatttcaggattttttcctctacttgtagtagttacttttgttgagttgcttctggtgatgctgcattcggtcacgattactcgtgtctgcctcgatcccgagtcagccaaatctgaaatttgtgtaactatatttcttagtgaatgcattggctatcattatggtttaacattctagcaacgcttgcagctcctgtttttcagctgcatcatctgtgatctaaatagtattgtgtggatggttgagcacctttc

SEQ ID NO: 2804 - DNA, 616 bp, Linum usitatissimum
gatccaatatatattgcagaaaccctaaccctgaatttcttgaccaacttctgatcgtattctcaggccgcaaccagcagcagtagtgcatttcggtagcagagaagcgaagaaccagagaagcagccatgggtaaggtgcacggttctcttgctcgtgccggtaaggtgaggggacagactcccaaggttgcaaagcaggaaaagaagaagaggccacgcggccgtgctcacaagagagagcaatacaaccgcagattcgtcactgctgttgttggattcgggaagaagagaggaccaaactcgtctgagaagtaaaaaagcttaaagaggaggatgacgtgatggaccattcatcacttgtctgtttgttttggaacaagtagaagttttgtctctaggaggaagttatttggttgtcctggctatgaacaagctttaatttcatcaatctgatccagtgtgacttgattatctttctggtgttttgcattttccgtaaacataagcgtggccagtagtcactaataccagttgttttcggtttttaattaattagttgagtttcagaaaaattcaattaggtttagatttttgtaattagttatttttttaat

SEQ ID NO: 2805 - DNA, 437 bp, Fraxinus spp
gccggggaatctgaagctccgtatattcgctgcggccgaacaaccctagggatctctctgcttcaggcgactagaaaatcaatcatgggtaaggttcatggatcattggctcgtgccggaaaggtcagagggcagactccgaaggtggcgaagcaggataagaagaagaagccccgtggccgtgcccacaagcggatgcaatacaaccgccgcttcgtcactgccgttgttggctttgggaagaagaagtcaccaaattcctcctcgaagtaaattggaggcatcaatagttctcttagaaacttggattagttgtttttctattgtgacatgttagtatcacgccaaattgccatggcattttctcgtttgggaatttgattgttggacaacattaccatcacttggttttatcgagttttgaaatttggatgatc

SEQ ID NO: 2806 - DNA, 644 bp, Citrus sinensis
aaaaagaaaaaaaatccgcaacctgtcgctgactttaactcagacgaagaagatctgattaaagcaatcaatcatgggtaaagtacacggatcgctggcacgtgccggaaaggtgagagggcagacaccgaaggtcgccaagcaagacaagaagaagaggccccgtggacgcgcctacaagcgcatgcagtacaatcgccgcttcgtcactgccgttgttggttttggaaagaagcgtggacccaactcttcacagaagtaaactcgaactcaagacaagtttttgaataaactgtggagtctcatgtgaaaaatggatattattctatttaaatcaacttcgctggccttagtatttcttagtagtttttttttttaaattgttaattcaagttctttttagttgaagcaaattttgatcagtttaggattgaatttaagttctagcttatgctggttttctcaatcattgtcatggatgaggacatgaagtatgtattgatcgttgactgattttttgctgcgaaaatcaattagactctggctattcaattactgctgtgtctcaatgtttgtttttacgtgacatttatttctttttcttttttttaaggtacaattattacctgtgttttctatttctt

SEQ ID NO: 2807 - DNA, 517 bp, Brassica napus
cctgcggaccggtccggaatttcgggtcgacccacgcgtccgcgccgtcgccgtcgccgtcgcctcgaagagcagagccagagaagtcaagaagattatctttaatcgaccatgggaaaggtgcacggttcattggctcgtgccgggaaggtgagaggtcagaccccgaaagtggctaagcaggacaagaagaagaagccacgtggccgtgctcacaagcgactgcaacacaaccgccgtttcgtcaccgtcgttgttggctttggcaaaaagagaggaccaaactcatcagagaagtagacaaccaagacttttgttgtgatttctgttcggattttttgatgtttagataacgcgtttcagttccggtataatgagtcgatggatattgagccaatgtttgctgtcaatttgatccgtgttcctccttggattattattattatttgttggacaaactacttcactccatagataaagaggcaaaccataccaaaggattcaccagataaaaaaa

SEQ ID NO: 2808 - DNA, 501 bp, Brassica napus
aatttcgggtcgacccacgcgtccgcgccgtcgccgtcgccgtcgcctcgaagagcagagccagagaagtcaagaagattatctttaatcgaccatgggaaaggtgcacggttcattggctcgtgccgggaaggtgagaggtcagaccccgaaagtggctaagcaggacaagaagaagaagccacgtggccgtgctcacaagcgactgcaacacaaccgccgtttcgtcaccgtcgttgttggctttggcaaaaagagaggaccaaactcatcagagaagtagacaaaccaagacttttgttgtgatttctgttcggattttttgatgtttagataacgcgtttcagttccggtataatgagtcgatggatattgagccaatgtttgctgtcaatttgatccgtgttcctccttggattattattattatttgttggacaaactacttcactccatagataaagaggcaaaccataccaaaggattcaccagataaaaaaa

SEQ ID NO: 2809 - DNA, 376 bp, Manihot esculenta
ggtaaggttcacggatctctggctcgtgctggtaaggtgagaggccaaactcctaaagtcgcaaagcaggacaaaaagaagaggccacgcggccgcgcctacaagaggatgcaatacaaccgccgctttgtcaccgcagttgtgggattcggcaagaagagagggcccaactcatctgagaagtaaagtgtgacaagattattgaagttagtagttatgtaggtggaggttgatgttgggaggttggataatctttttattgtgttactgtgttgagttttttatattatgtctcaaactatgttgaggatacgctctttttgttaattgggatggtacaacttgtttcgtaattctattatactgcattttgtta

SEQ ID NO: 2810 - DNA, 580 bp, Citrus sinensis
gtcccgatttccgggtcgaccacgcgtccgaaagaaaaaaaaatccgcaacctgtcgctgactttaactcagacgaagaagatctgattaaagcaatcaatcatgggtaaagtacacggatcgctggcacgtgccggaaaggtgagagggcagacaccgaaggtcgccaagcaagacaagaagaagaggccccgtggacgcgcctacaagcgcatgcagtacaatcgccgcttcgtcactgccgttgttggttttggaaagaagcgtggacccaactcttcacagaagtaaactcgaactcaagacaagtttttgaataaactgtggagtctcatgtgaaaaatggatattattctatttaaatcaacttcgcaggccttagtatttcttagtagtttttttttttaaattgttaattcaagttctttttggttgaagcaaattttgatcagtttaggattgaatttaagttctagcttatgctggttttctcagtcattgtcatggatgaggacatgaagtatgtattgatcgttgactgattttttgctgcgaaaatcaattagactctggctattca

SEQ ID NO: 2811 - DNA, 423 bp, Linum usitatissimum
gattcctctcagtttctctcagtccgcatcctcaggagcagcaaagcagcagcagcagcagcagcgtcatctgaagatacaagagaaaccatgggtaaggtgcacggttctttggctcgtgccggtaaggtgaggggacagactcccaaggtcgcgaagcaggagaagaagaagaggccacgcggccgtgctcacaagagggaacaatacaaccgcagattcgtcactgctgttgttggattcggcaagaagaggggaccaaactcttcagagaagtagaaacctaaaaggatgatgaaatttctggttatgtagggaaagataatcactttatgtttgttttcgaagaatgatgagtttaaatgctgtcagactatgaacgaaactgctttcatatgagtgtgaagttatttcaggattttt

SEQ ID NO: 2812 - DNA, 621 bp, Linum usitatissimum
ggattcctctcagtttctctcagtccgcatcctcaggagcagcaaagcagcagcagcagcagcagcgtcatctgaagatacaagagaaaccatgggtaaggtgcacggttctttggctcgtgccggtaaggtgaggggacagactcccaaggtcgcgaagcaggagaagaagaagaggccacgcggccgtgctcacaagagggaacaatacaaccgcagattcgtcactgctgttgttggattcggcaagaagaggggaccaaactcttcagagaagtagaaacctaaaaggatgatgaaatattctggttatgtagggaaagatagtcgctttttgtttgttttcgaacaatgatgagtttaaatgctgtccgactatgaacgaaactgctttcatatgagtgtgaagttatttcaggttttttccctctagttgtagtagttttatcgagttgcttctggtgatactgcactcggtcacgattcctcttttgtccggctcaatcccgagttggccaaatctataatttgagtaacatactcatgcagctgtagttcttagtgaatgcactgggtattattatagctaacattctaagaacagtaagaatcaattgttac

SEQ ID NO: 2813 - DNA, 377 bp, Gerbera hybrid cultivar
gaagcttgaaggcagcaaaacgatcagaatttcagtatgggaaaggttcacggatcgttagctcgtgcgggtaaagtgagaggtcaaacccctaaggttgctaagcaagacaagaagaagcagcctcgcggacgtgctcacaagcgcatcccgtacaaccgccgtttcgtcaccgcggttgttggttttggaaaaaaaagagggccaaattcatcagagaagtaaggtgatggatgcttagttttaatggaattgtattcagactgctgtaatattgtttgtttaggaactggttctttggtttcacaatttttgttacgtgcaccacggtgtttctgaaacattatcacgatttacttgttttaacggagaggtac

SEQ ID NO: 2814 - DNA, 670 bp, Marchantia polymorpha
  misc_feature (626)..(626): n is a, c, g, or t
ctctcgtcgattagcgttgcgcaagctcggtccgtctgcaattccaaaatcgtttgattctgtgtcgagagggttttcaccatgagtaaggttcacggttccttggctcgtgccggtaaggtaagaggccaaactccaaaggttcaaaagcaggacaagaagaagaagccgaagggaagagcgcacaagcgcatgcaatacaacagacgttttgtgaccgcagttgtcggcttcggaaagaagcgtggtcccaactcatctgagaagtagatgcatatcctgagggattagtcggctttcatcaacatcattatcgaggagatctagcgaggcagcgaaaggcgtaagaatacgtcaatggacgtctccgtagatctcagtagtctttctgtactcagtggctctcggggaggcctgcttacactgggccattttgaacatgtgcagcccccaaatattttttgaatgaaattgataccttattgctctttctacatttgtctccgaggaaaacgttctcaccatcataatcttttagtcaacctgagcttttactcatgaccatcaatggactgatattgaataggtagatcaccagttcctccatcagtcatacactgtgtcanttgaaattgaattcgagcaaggtccaatatcatcaaaaaaaaaa

SEQ ID NO: 2815 - DNA, 733 bp, Pinus taeda
acgccgggattacggccggggacttcgcatattgactttagagttggaagagctctcggctaattgaaggagattgagcctgtattcaaccattgaaattgctgtatcgcaatgagtaaagttcatggttcccttgcccgagcagggaaagtgagagggcagacccccaaggtggccaagcaagacaagaagaagaagcctagaggccgcgcccacaagcgaatgcaatacaaccgccggtttgttaccgcagtggttacttttggaaagaaaaaagggccaaactcctcggagaagtaaatgagtaggtgcaatggcaggagtgaagtcatccggttttgaaagtttcatcttttttggagatgtcattttaactttagattttttgttggaagttttgttggaagtcgatttcttatagaatcatgtactttttctgaggttggaacagggaagaaaattgtaatgtgatatgttttatgcatttgactatttatattttctcatggcatatggatcgatttttgatgcaaagcataaaaggaaatagggtatggtttcatgttatctgaaataaattttgaaaccttcgtgagtgggaatggtcatatttgtttatgataagaaatcattaccatcaccatcaccttcaaaacaattaggaagctatgtatatggaagcatggtgtgagaaatttgcagttatggaatgacccttgaatgtaggagatgg

SEQ ID NO: 2816 - DNA, 887 bp, Pseudotsuga menziesii
ctaaagactcaaatccttaacctaaaaccagtctaaagataaaacctaagaggccgaagtcttgctttgcaacttggtagtggcgtcggaatagctttcggctgatcgaaggatattcagattgtattcaagaattgaaatcgctgcatcacgatgagtaaggttcatggttcccttgcccgagcagggaaagtgagagggcagacgcccaaggtggccaagcaagacaagaagaagaagcctagaggccgtgcccacaagcgaatgcaatacaaccgccggtttgtcaccgcagtgcttacttttggaaagaagagagggccgaactcctctgagaaataaatgactaggtgcaatggcagaagggaaggcattgggttttaaaggtcatcatttttggggatgtctctatttaactttggaatttttgttagtagttaatttgttattgataaacaatcatataattttgttgaggttggaaccgagaagaaaattgctatggatttgtacggtgtaaaatgtttgatttgaatgatcgtatgatatagtctgtgccatgggctacagactaaaacttatgaattaatctgtgatgcaaaagatcgccagaaatatcacatagtttcattctatctgtagtaaaatttgttacattcatgaatgggaatgatcatttatttatattaagaatgcattaatatccccatcaatttcaaaacaattaggaaactatgtatatgcgagcattatgtgagaaatttgcagtcatggaatgacccttgaatttatcaggttgaaatctatggcctttgctttacaacaatgcaacctagtctgttattcttgctgtctgattttaaaaataaaacaagggctagttctgc

SEQ ID NO: 2817 - DNA, 469 bp, Pseudotsuga menziesii
gttgaaagagccctcggctaatcgaagaagattcagattgtatccaagcattgaaatcgctatatcacaatgagtaaggttcatggttcccttgcccgagcagggaaagtgagagggcagacgcccaaggtggctaagcaagacaagaagaagaagcctagaggccgcgcccacaagcgaatgcagtacaaccgccggtttgttaccgctgttcttacttttggaaagaagagaggaccaaactcctctgagaaataaatgactaggcgcaatggcaggagggaaagcatccggttttgaaatgccatctctttttgggatgtctctttttaattttgtaatttttgttggtagttaatttcttattgaaaacaataatgtaattttgtcaaggttggaacatagaagaaaatcgttatggatttgtactgtgtaaaatgtttaatttgaatgatcatatgatacactc

SEQ ID NO: 2818 - DNA, 734 bp, Sciadopitys verticillata
gcggaggggaggaggaagtttgcattgaaccagctctaagaaaaaccctaattttgaaatatcaactttgttcgaacgaacgccataagaaaaccccaacccgcacaaatttcatcattttctgaagaaagccgggagtgtgtggagaagaagaacgagaagaagaatatcgattgcaggcgttttgagatcaaaatgagtaaggtgcacggatcgttggcccgagcagggaaagtgaggggtcagacccccaaggtcgccaaacaggacaacaagaagaaacccagaggccgcgcccacaaacgtatgcagtacaaccgccgctttgttactgcagtgctgggatttgggaagaagagaggtccaaactcctctgagaagtaattgattaggattagtattgtaagacttagtatttctgcagtgacaaagtcctttgagcaaagcaaaaatgaaaattttggttacggattctagctatgtaaagtgctttttgtgtgattctggcctaatttgaatgccttaattcgcgagtgtcttttgcttgttggtcgtatggttgaatttgctgggcttaatgtggaacttgatctaactggcctatgatattattccatcttgattaatgcttttcctccctagtttacagtatattgaaggtgaaactaagtgtttagctgaaaaagtgattttataaaaggattgaatataattttaacaaaaattgatctatt

SEQ ID NO: 2819 - DNA, 410 bp, Thellungiella halophila
gaaagagcgtcgtcgccttcaacagcagagcagaaaccagaagaatctctctgatcaacaatgggaaaggttcacggttcattggctcgtgccggtaaggtgagaggtcagacacctaaagttgctaagcaggacaagaagaagcagcctcgtggccgtgcccacaagaggatccaacacaaccgccgattcgtcaccgccgttgttggttttggcaagaagagaggaccaaactcatcagagaagtaaacaaaacaaaacaaaaaaagaagatttttgataatgctttgttagttagattactctctctctctttccatcggagagtttctcgaaactattatgtgtattccaaattccattgttactcgattcatttgatcagatataaaactttacaatctcctttg

SEQ ID NO: 2820 - DNA, 504 bp, Ambrosia trifida
aaagcagctactcgtccctcactacatccagccgaacagaagaaccagttccgcctcaaactcaacatgggaaaggttcacggatcgttggctcgtgccggtaaagttagaggtcaaacacctaaggttgctaagcaagacaagaagaaacagccacgtggccgtgcccacaagcgtattcagtacaaccgtcggtttgttaccgctgttgtcggttttggaaagaagaggggccaaactcatctgagaagtaaggcatgggatagtcctcagtcttaattggtttttgattattgttatgtttttgttttgatgttacagaagtttgttatgtttgttaaactttatgaagtagtagtaactccaaagtgagcgttttgtcaaaaaagaaaaaagtacccatcaggcgttaattattcaagtctattacacagttttgaacctgatttacaaaaacatcgatacgagcccatgaccgtctatcggctaactagcttcaagtat

SEQ ID NO: 2821 - DNA, 514 bp, Cirsium arvense
ccatcgtctctgctctatttgcaatccaaccaatcgaagcgaaatcagaaagcatcaaaggacgccaaattcgaaatgggaaaggttcacggatcattggctcgtgccggtaaagttagaggtcaaactccaaaggtagccaagcaagacaagaagaagcagcctcgcggccgtgctcacaagcgaattcagtacaaccgccgtttcgtcaccgccgttgttggtttggaaagaagagggggccaaactcatctgagaagtaagctgtgggaatatgtaattttgtaagcttagttttaatggtattgattttagtttttcatcatcatatttagacaatgttgattattgccatcactcacatcttttctactataatcccatattccttttaagggttttttgagttttgatatatgataccattgttcttgaatttataatgatcaactactgattgatgtggcttaagctaaattagtgtttaaaaaagaaaaaagtaccgactgcgact

SEQ ID NO: 2822 - DNA, 365 bp, Flaveria ramosissima
caaccgaccaaatcaaatacaacaagggactccaatttcaacatgggaaaggttcacggatcactggctcgtgcggggaaagtgagaggtcaaacccctaaggtcgcaaagcaagacaagaagaagcagccgcgaggtcgtgctcacaagcggattcagtacaaccgtcggttcgtcaccgccgttgttggatttgggaagaaagaggaccaaactcatcagagaagtaagatgaaggattaaaggatgtttcgttttgtaagattaggtttatgaaactgttttatgatatgatttttaatattttgagtttagtgttacatctgttaatgttcttgattatgtcatgatttacaagttttgat

SEQ ID NO: 2823 - DNA, 351 bp, Flaveria ramosissima
ctgtatcatatcataatgttcgttatacaaaccgatcgatttaactctatgattgctcaattgaatcacaggaaaggttcacggatcattggctcgagccggaaaagtgagaggtcaaaccccaaaggtcgcaaagcaagacaagaagaagcagccgcgaggacgtgctcacaagcggattcagtacaaccgccgattcgtcacagccgttgttggttttgggaagaagaggggaccaaactcatcagagaagtaagatgaaggattaaagatgtctctcgttttgaaagattagtatcttgaaattgttttctgatatgatttgaaatttgtttgagtattagatgttaa

SEQ ID NO: 2824 - DNA, 476 bp, Phalaenopsis aphrodite
gaaatccgaagaagaggaaccgcgaggaagaaagtactcctctttctaaccgacaaatccgccatgggaaaggtgcacggatctctggctcgcgcaggtaaggtgagagggcaaacgccaaaggtttcgaagcaggacaaaaagaagaaaccaaggggagggcttacaagcggatgcagtacaatcgccgctttgtgactgccgtcgttggctttggaaagaagagggggcctaactcgtcggagaagtagatgttggaatttgaaaattttgatatttgatgttactgtaaggtttgctcctcttttgttctgagatttattggacattgaatttcatttgaagataggatacaacaatgtgaaaacctgattgttattgtggcttcgcccttatatatcttgaatcgttttgttatttacagttttaaggctgtttctgccttgttggtttaagattttagttttcttaatatt

SEQ ID NO: 2825 - DNA, 442 bp, Raphanus sativus
  misc_feature (54)..(54): n is a, c, g, or t
  misc_feature (66)..(66): n is a, c, g, or t
  misc_feature (95)..(95): n is a, c, g, or t
  misc_feature (101)..(101): n is a, c, g, or t
  misc_feature (170)..(170): n is a, c, g, or t
  misc_feature (274)..(274): n is a, c, g, or t
  misc_feature (278)..(279): n is a, c, g, or t
  misc_feature (330)..(330): n is a, c, g, or t
  misc_feature (352)..(352): n is a, c, g, or t
  misc_feature (367)..(367): n is a, c, g, or t
  misc_feature (378)..(378): n is a, c, g, or t
  misc_feature (415)..(415): n is a, c, g, or t
ggaaagtgaacctaccgtcgtcgcctccagcagagaaaccagaagagtatccgnaatcgacgatgnggaaggtgcacggttcattggctcgtgcnggtaangtgagaggtcagacaccgaaagtggctaagcaggacaagaagaagaagccccgtggccgtgctcacaancgtttgcaacacaaccgccgtttcgtcaccgccgttgttggctttggcaagaagagaggaccaaactcatcagagaagtagacatggaactgtttcaccttttnattnnggttttctgattatttttaatggctcgtttgtctatcaacaaagccaatgnatgttgttgagccaatgtttcnaatcagtttcatttntgttacatctntttctactctgattatgtaccatatgctcttcgattngtggcttataaatttgattattgcctg

SEQ ID NO: 2826 - DNA, 343 bp, Carthamus tinctorius
cggggaacctaaacaccatcgtctctgctctgcttggcaatccaaccaatcgatcgaagcgaaaccagaaagcagcaaacaactccaagttccaaatgggaaaggttcacggatcattggctcgtgctggtaaagtgagaggccaaacccctaaggtggccaagcaagacaagaagaagcagccccgcggacgagctcacaagcgtattcagtacaaccgccgtttcatcaccgccgttgttggttttggaaagaagaggggaccaaactcatctgagaagtaagctaaggggaatgtgtaattttgtaagcttagttttaatgaaattgtttttaggttcca

SEQ ID NO: 2827 - DNA, 472 bp, Humulus lupulus
ttctctcgccggctttctcttgctacggaaaacacagagtgtgaagaaggcttaaaagttcaacatgggtaaggttcacggatctttggctcgtgctggtaaggtgagaggcaaaccctaaagttgccaagcaggacaagaagaagaagcctagaggacgtgctcacaagcgcatgcaatacaaccgccgattcgtcactgccgtggttggctttggcaagaagagggacccaactcttccgagaagtaagattcaaggatgacaccttctttaggttattatggaggcattcgttttttggggttttgaccattagttattgagttttaatgttatttttatagaccctttcacttgttatagttatgcttcaattaaattataagtaatgtgaattcgtttttccttgaagaaaatgcagcaatgttattttgaacttattcaaagatgttttcaacttatttagaatct

SEQ ID NO: 2828 - DNA, 254 bp, Scabiosa columbaria
atttcgtctgtgccgtctctaacttttctctgtgaaaatcctccctgagaactcactcgtattaatcgtaatcaaccatgggaaaggttcacggatcgttggctcgtgccggtaaggttagaggccaaaccccgaaggtggccaagcaggacaagaagaagaagccccgtggccgtgctcacaagcgcatgcagtacaaccgccgtttcgtcaccgccgttgttggatttggaaagaagaggggtcctaactca

SEQ ID NO: 2829 - DNA, 571 bp, Hordeum vulgare
gccgccgccaaccctcgcgcacccgccctccagacctcctccgccgccgtcgttccgcagccccaccgccgccgtcgacatgggtaacccctctcacctccatcccccgcccctctgcccccttccaccgccgtatcttattcggatcctgacgcgagcccgccgctgtttgcgcaggtaaggtgcacggatcgctggcccgtgccgggaaggtgcgcgggcagacgcccaaggtggcgaagcaggacaagaagaagcagccccgcggccgcgcccacaagaggatccagtacaaccgccgattcgtcaccgccgtcgtcggcttcggcaagaagcgcggccccaactcctccgagaagtaggcgtgccgcaccgaaaaggctccccccctgcgctagtttcctctcgtttgtttgttaccgcaagaacatgatgatgatggaagagacgttacttacggtcgtactcaagtgttgaagtatgcatgttttgcttagctgaaggatctgggatatttgtggtatgagtatgatgcatgttttgcttagttgaagaatatcagatattgtgg

SEQ ID NO: 2830 - DNA, 345 bp, Taxus baccata
aggaggaagaagaatatcgagagcagccaaagcaaaatgagtaaggttcatggatcgttggccagagcaaggcaaggtgagggggcagacccctaaggtcgccaaacaagacaagaagaaacagcccagaggacgcgcccacaaacgtatgcagtacaaccgccgttttgttaccgccgtgcttggatttgggaagaaaagagggccaaactcttccgagaagtaattgattaggtgtgtactatgatgatggaggaaaggaatttcaaaagtccatccttttagggcgctctcattaatgtgggaacttttttgtagttaaaaggatgagttttgttgacatga

SEQ ID NO: 2831 - DNA, 600 bp, Gnetum gnemon
ttcagcaaaaccctagcggaacactacaaggggaacgctggtgtcggagcgctttgttcgcaacagaccgcaggaaatcgcagcagatcgcagaccggagtttgttaaatcgagttaaaatgagtaaggttcatggatctttagcccgagcagggaaagtgagagggcagactcccaaggtcgccaagcaggataagaagaagaagccccgcggtcgtgcccacaagcgtatgcagtacaaccgccgttttgttactgctgtggtcactttcgggaagaagaggggacccaattcttctgaaaacaaataagctggcgttcgctgttttagtgattgtatcggttgaaatagttttgctgatcatgtaggatatttagctgttttgttggacacagtcagctagtgacttaattcatggggactctacaaagatgtttcttgctgaatgtttttcaatgagatttgacgatttgattttgagcaagctgaaagtttttggattggcaactgttatggaaggtcctttttgatctttcaaaatatacccgtataattgatatgcatcagttttgatatgttcttataaatgttattgctat

SEQ ID NO: 2832 - DNA, 363 bp, Brassica oleracea
  misc_feature (37)..(37): n is a, c, g, or t
  misc_feature (170)..(170): n is a, c, g, or t
  misc_feature (323)..(323): n is a, c, g, or t
gatcaaaagctgtcgtcgtcacacatttgccggaggnagcgccgattcagtcgtctaagcaactatgggcaaggttcacggttccttggctcgtgccggtaaggtgagaggacagacacctaaagtggctaagcaggacaagaagaagaagccacgtggtcgtgccacangcgtcttcagcacaatcgccgtttcgtcaccgccgttgttggatttggcaagaagagaggacccaactcttctgagaaatagatgatgaacgcattggagctgaagttttgagttttttttttccaaaaaatatcgtacttgtttgatgttgnaagactgcaattttctcaatcaaatcgacttttttttgac

SEQ ID NO: 2833 - DNA, 1224 bp, Mesembryanthemum crystallinum
  misc_feature (195)..(195): n is a, c, g, or t
  misc_feature (279)..(279): n is a, c, g, or t
  misc_feature (306)..(306): n is a, c, g, or t
  misc_feature (454)..(454): n is a, c, g, or t
  misc_feature (463)..(464): n is a, c, g, or t
  misc_feature (476)..(476): n is a, c, g, or t
  misc_feature (489)..(489): n is a, c, g, or t
  misc_feature (518)..(518): n is a, c, g, or t
  misc_feature (522)..(522): n is a, c, g, or t
  misc_feature (533)..(534): n is a, c, g, or t
  misc_feature (542)..(542): n is a, c, g, or t
  misc_feature (545)..(545): n is a, c, g, or t
  misc_feature (570)..(570): n is a, c, g, or t
  misc_feature (573)..(573): n is a, c, g, or t
  misc_feature (581)..(581): n is a, c, g, or t
  misc_feature (584)..(584): n is a, c, g, or t
  misc_feature (589)..(589): n is a, c, g, or t
  misc_feature (591)..(591): n is a, c, g, or t
  misc_feature (595)..(595): n is a, c, g, or t
  misc_feature (601)..(601): n is a, c, g, or t
  misc_feature (1118)..(1118): n is a, c, g, or t
ttattctctccatacaccagtcgaccaccggcttaggacttctcggccgcgtcgaccgatttcgcatcacaccttcagaagccgaggagagagagaggagacagcaagaagaacagctatgggtaaggtacacggatcgttggcgcgtgccggtaaggtgagagggcaaaccccaaaggtggccagccaagacangaagaagaagcccagaggacgcgctcacaagcgcttgcaatacaatcgccgtttcgtcactgccgttgttggatttggcaagangaggggaccaaactcatctgagaagtnaggcttgagttgaaaaaggtgaagccaactatggataaccttgcaatagattctagcttatcctagtatatgtaattctctcttctttttaactcttgatgttttcagaagcgacattcagtatgcgtagcttcatgcttcaattctnttaggagtnngagagagctttngccatgtagtcgnaacatttttctttgtttatgatggaaatntttnttacttgcatnncccacagnggntgaaacttctgcttaatgagtattntgncaattgangangattncntagngaagtnaactttaatatactatccttctcttactatattctttttattatcttctttcttaactaacttcttgtagttgtctcggtctcctaatttgtctcctctcttcttccttatatatacttcttctctgctatctcttcttctcacttttttctagtatatactctattcatctctctctacatatgcgtctccgtatcattctccatctcttatactctacttatatcctattctataatcttctcctcttcatttcactacttctgtcttgtcatttctattctacttcctcttctctatcttctctacactactctctctgcttactatcttattctaatctgttttctctatctttccctactcttcttacattctatcttcatttcattcagtattctattctatctactatctatatactctctactcttcttattctctctatcttcttctctctctcattctcctctccttctatatctctcatcttatcttactttctctcttcttatcnctttctctattctatttactcatttctctatactctcttcttatctctgcttcttcattccttattctcattattcttctctctctctctctactcttctcatttc

SEQ ID NO: 2834 - DNA, 523 bp, Triticum aestivum
aataagtaacccatgttagggcaatttttctgccatgttggtaatacagagagcgttgtagattgagaccgctagggagaggagagtagaccgtccgaatcggcacgacgccgacgccgacgtaaaacccgagtcgctcgtctcttcccagatcctccgagcacaacagctctccgtcgccgtcgccatgggtaaggttcacggatcgcttgcccgcgcggggaaggtgcctgggcagacgcccaaggtggcgaagcaggacaagaagaagaagccccgcggccgcgcgtacaagcgcatgcagtacaaccgccgcttcgtcaccgccgtcgtcggattcggcaagaaacgcggcccaactcctcggagaattagatataccatgtctttgtgttttggtcccccactattttccttgtactgatggcaattgctgaagacttatatgctattattatctgtatcgatgtgttactgcaacactatgaaatatggtatgcaccgttgagctaaaaaaaaaaaa

SEQ ID NO: 2835 - DNA, 427 bp, Sarracenia psittacina
tcacggatcgctggctcgtgctggtaaggtgagaggccaaacccctaaggtggcgaagcaggacaagaagaagaagcccagaggacgtgctcacaagcggatgcagtacaaccgacgtttcgtcaccgccgtggttggctttggaaagaagaggggacccaactcgtcggagaaataagctccactaatgggtaactttacaggcgaaggcttattggtttttgaatgaattactggtttcaagcatgtgatagtttcctttatcacaggagttagttttctttatccagtagtttgctacggttgcattttctttgaactctggagtcagaaccatgttgagtttatttgttggataaaaagttgtagttttgtgtttgacagctttgtgatcgaagtattcctcgggtcgtatcgattatggttt

SEQ ID NO: 2836 - DNA, 228 bp, Eutrema parvulum
gtctcgtaatcaatcgcaggaaaggtgcacggttcattggctcgtgccggtaaggtgagaggtcagacaccgaaagtggctaagcaggacaagaagaagcagcctcgtggccgtgctcacaagagattgcaacacaaccgccgtttcgtcaccgctgttgttggctttggcaagaagagaggaccaaactcatcagagaagtagacagaagaacaaagaaaacagaag

SEQ ID NO: 2837 - DNA, 381 bp, Cichorium intybus
gccgaggattagaacgaacgaaattaaatcagaagacagcaaaggaccccagattgatatgggaaaggttccggatcgttggctcgtgccggtaaagtgagagggcaaacccctaaggtagccaagcaagataagaagaagcagcctcgcggacgtgctcacaaggtatccagtacaaccgccgttttgtcactgccgttgttggttttggaaagaagaggggaccaaactcatctgagaagtaagctgattgaatgtgtagttttgtaagcttagtttaatggaattgtttttacgttgctatcatgtatttagacagtgtttattgtgctgatcagtcttcctactatatgaagtgcctttgagtttgatattgaaaaa

SEQ ID NO: 2838 - DNA, 1188 bp, Pinus taeda
gatgtttatgtgggcaataagggcaacttaaacatagctcagcccaaccattttattttgctggtaaaaaccctagggtttgtctaatccaattttttccttttttcgttcttccgctaacagggtttttgtttctccatatcgattcgttgcaccgcgatattcctttgattcagtagctcctgcatcgtaactttgtgttgaatctgcaatagcgttaccaatcaaagcacagtgatatatataatcagaaacagggtatacccagtccaaacagggtatacactctgccttgctgccttcaggctctacgattgagcttgtattcaactattgaaattgctacgtcacaatgagtaaggttcatggttcccttgcccgagcagggaaagttagagggcagacgcccaaggtgcctaaacaagacaagaagaaaaagcctagaggccgcgctcacaagcgaatgcaatacaaccgccggtttgttaccgcagtgcttacttttggaaagaagagagggccaaactcctctgagaagtaaatggctaggtgcaatggcagaagtgaagtcatccagctttgaaagtaacatctttttcgggatgtctttctttaactttggaattttgttggtggttaatttcttatacaatcatgcactgttgtcgaggttggaacagggaagaaaattgctatggatttgtactgtgtaaaatgtttcttttttgaatggtaatgtgatatattttttgcatctggctactatatattttctcatggcattaaagcttatggattgacctgtgatgcaaaacatagaaggaaatatggtatggtttcattttatctgttttaaaatttgaaacattcatgagtgggaatggtcatatttggttatgataagaattcattaccatcatcatcacctttaaaacaattaagaagctatgtatacggaggcatggttgagaaatttgcagttacggaatgacccttgaatgtaggagatggaagtctatgtctactcaatctagtctcttattgttgttgctaaacaagaattgagcatttgttagtagtatcatagaaaatttcaacttaccaagaatttgttggtgctatactgtatttaaaaatgtcgaatgttttgtactgcatttccctactttctttgtacatgttttagcg

SEQ ID NO: 2839 - DNA, 635 bp, Pinus taeda
ttttttatagggtttgtacaaccattcttattgtacttgtaataatttatcgttgattagggttttgtctgatctatttctctggtcttccgcaattttctacagggttgtgttttttacagtgttacctctgcgagctttcatttttccatatcgattccttttacataaattcagacgcaccacgatattcctttgattcagtagctcctgcaacgttactgcatcacaatgagtaaggttcatggttcccttgcccgagcggggaaagtgagagggcagacgcccaaggtggccaaacaagacaagaagaagaagcctagaggccgcgcccacaagcgaatgcaatacaaccgccggtttgttaccgcagtgcttacttttggaaagaagaaagggccaaactcctctgagaagtaaatgactaggtgcaatggcaggagtgaagtcatccggttttgaaagttacatcttttttggggatgtcttcctttaactttgggatttttgttggtagttaatttcttatacgatcatttacttttgttgaggttggaacagggaagaaaattgttatggaattgtattttgtaaaatgtttattttttgaatggtaatgtgatatattttatgca

SEQ ID NO: 2840 - DNA, 351 bp, Tragopogon dubius
caccagatccagccgaaaagaagacaacacagagctataccgtcccaaattcaatatgggaaaggttcacggatcgttggctcgtgccggtaaagttagaggccagaccccaaaggctgcgaagcgggacaagaagaagcagccccgtggacgtgctcacaagcgcattcaatacaaccgacgcttcgtcaccgccgttgttggttttggaaagaagagggggccaaactcgtcggaaaagtaagctcagggaagaaggatgagtgattacttgaaattgttttgattacaaaattttgttatgtggacttatatcatgattttcttgtttaatccaaggtaatggttaca

SEQ ID NO: 2841 - DNA, 367 bp, Sarracenia psittacina
gatctgaaccacctgcttttcgctcgctcgctacatccagccgcaaggaagaccagatcgaagctaaacagcctcgcattcattcaacatgggaaaggttcacggatcgttggctcgtgccggtaaagtgaggggtcaaacccccaaggttgccaagcaagacaagaagaaacagccccgtggacgtgcccacaagcgcatccaatacaaccgccgatttgtcaccgccgttgtcggttttggaagaagaggggccaaactcatcagagaagtaaggcatgggatcatgctcaatcttatttgtttttttgaccattgttatgtttttgttttgatgttacagaagtttgttaaacattatgaagta

SEQ ID NO: 2842 - DNA, 464 bp, Secale cereale
  misc_feature (163)..(163): n is a, c, g, or t
gccgccgccgccgccgccgcccgagcgccctccgttctcctcgccgaagcgccgccgctccaccgccgcagaagccatgggtaaggtgcacggatcgctgctcgcgccgggaaggtgcggggccagacgcccaaggtggcgaagcaggacaagaagaagcagnccggcgggcgcgcgcacaagcgcatccagtacaaccgccgcttcgtcaccgccgtcgtcggcttcggcaagaagcgcggccccaactcgtccgagaagtagatctaggtcgtctcgcccctggccatctcctcttgatcgcccccccttttttcgtgtttccgtttatccagtatgcatgctaagaagaagacctgatctagtatctgtaattgactgtgatgttggtaatggaaatctcactgcattgtccagttaacatctgccatatgtgcctgtgtttatcttgtattatcctgctt

SEQ ID NO: 2843 - DNA, 401 bp, Brassica juncea
ggtgcacggttcattggcacgtgccgggaaggtgagaggtcagacaccgaaagtggctaagcaggacaagaagaagaagcctcgtggccgtgctcacaagcgattgcaacacaaccgccgtttcgtcaccgccgttgttggctttggcaagaagagaggaccgaactcatcagagaagtagacagactcaaattttaccttttggtgtatttgataatgtgtcttttagttacgaagccaatgtttcttgttgatttcatttgtgttacattttacccgttcggattataacttactttcttgtgttagtggaaagctggcatgttgtattagatcttttgttttcttatagtggattagagtcgaaaccttggaataaaaacaaaaggtgattcaatata

SEQ ID NO: 2844 - DNA, 667 bp, Marchantia polymorpha
cgcattcccgggattcgtgtacgctctcgtaactacctctgctcttctcgcacccccgtctcgaaaccatgagtaaggtccacggatccctcgcccgtgcggggaaggtcagagggcaaaccccgaaagtgcaaaagcaggataagaagaagcagcctaagggccgtgctcacaaacgtatccagtacaaccgcagattcgtcactgctgttgttggcttcggcaagaagcgtggtcccaactcttccgagaagtagatgaccttttttcgtgtggaggtctgcgaatcccgctgcatctggcctgggatggcgatgtgccttcaaagctcctgggcctcaactcgccttatcgagaaactgctgcaaagcagtcgatgaacttgttgacgaggggagctggagccatgtcgctgttgttttccgggctgcttgatatggctttgtactctccattaattaatttcaggctttgagaaatcctttcggcgtagtcaccggcccctatcccacagtgatgagaattctgagtctattgcccaaagttctttccaactgttcatggtacaaatccacgtcttaatgtgaccgcaccactcttgaacttttcattttcgaataaacatctattgagcgccagatttggatgttttcattcaaaaaaaaaa

SEQ ID NO: 2845 - DNA, 841 bp, Pinus taeda
gttttgtctgatctatttctttggttcttccgcaaatttttacagggttgtgtgttttacagtgttacctgcgagcattcatttttccagatcgattccttttacataaatacagacgcgccacgatattcctttgattcagtagctcctgcaacgtaactctgtgttaaatctgcaatagcgttactgcatcacaatgagtaaggttcatggttcccttgcccgagcagggaaagtgagagggcagacgcccaaggtgcccaaacaagacaagaagaagaagcctagaggccgcgcctacaagcgaatgcaatacaaccgccggtttgttaccgcagtggttacttttggaaagaagaaagggccaaactcctctgagaagtaaatgactaggtgcaatggcaggagtgaagtcatccggttttgaaagttacatcttttttggggatgtcttcctttaactttacgatcatttactttgttgaggttggaacagggaagaaaattgttatggaattgtattttgtaaaatgtttatttttgaatggtaatgtgatatattttatgcatctggctatttatattttctcatggcactaaaacttatggattgatctgtgggaatggtcatatttgtttatgttagaattcattaccatcaccatcaccttcaaaacaattcataagctatgtatatggaagcatagtgtgataaatttgtagttatggaatgacccttgaatgtagatggaagcctatggcaacacaatctagtcttttattcttgttgctaaacaagattgagcattcgtttgaacaattaattgttgctgcatattgt

SEQ ID NO: 2846 - DNA, 432 bp, Triphysaria pusilla
ggttcacggatcattggcacgtgctgggaaggtgagagggcagacgccgaaggtggcgaagcaggacaagaagaagaacccccgaggccgtgctcacaagcgcgttcagtacaatcgccgtttcgtgaccgccgttgttggttttggaaagaagagaggcccaaactcatctgaaaagtagagttgtatagttgaacgagcgtttggaacgtgaattaatcggttttgttatgccatagtattactagttactgtttcaaacacgtggcattattctgggctttgactttgtgttgatcattttaatttgctcaaggatgattataattgagttgaactgatttttattttgagatgcggtaatttggccttttgatataattttttaattatatgtgtttcaagttgctaaaatgtgaaaaaaaaaaaaaa

SEQ ID NO: 2847 - DNA, 315 bp, Triphysaria pusilla
ggttcacggatcattggcacgtgccggaaaggtgagagggcagacgccgaaggtggcgaagcaggacaagaagaagaacccccgaggccgtgctcacaagcgcgtgcaatacaaccgccgtttcgtcacagccgttgttggctttggaaagaagagaggcccaaactcatctgagaagtagaattgctgcataaatagattatatcatgactatttaaatttgtgttttttttcctttgtattttttactatgtgttgaatattttttttcgatgatgactataatcaagttaaattgatcttttgtttcgagct

SEQ ID NO: 2848 - DNA, 289 bp, Triphysaria pusilla
ggttcacggatcattggcacgtgccggaaaggttagagggcagacgccgaaggtggcgaagcaggacaagaagaagaatccccgtggccgtgctcacaagcgcgtccaatacaaccgccgttttgtgactgctgttgttggctttggaaagaagagagggccaaactcatctgagaagtagagatgctgcatcaatagattttatcattacttttcatatttgtggcattttttttggggcaatattgacaatgttgaatatttttatttctcattgacactaattaag

SEQ ID NO: 2849 - DNA, 445 bp, Fagopyrum esculentum
tacaccagcgcttgattactaataaccacaaacgagaaaaccaacaattttcggcctatcttcgacgatcaatcatgggtaaggtttcacggatcttttggctcgtgctggtaaggttagaggccagacaccaaaggtggccaagcagggcaagaagaagaagccccgcggtcgcgctcacaagcgtatgcaatacaatcgccgtttcgtcaccgccgttgttggattcggcaagaagagaggccctaaactaacaatacaagagaagtaagccctgtgctgatcgacgaagatgagtttcatagctttaggataaatgcttttgtttttgtttgtatcgttacgcatttgataattgaactctttgttatccactcgattttggtaatctggaatttgctgcgttgagtacttgttgtgaaattgcatctttattcaatgatat

SEQ ID NO: 2850 - DNA, 374 bp, Thalictrum flavum
tactacaaacaaatactaccaaatagggtaaaggttacaatggaatcgttggctcgtgctgggaaagtgagagggcaaactccaaaggttgcaaagcaagacaagaagaagaagcccagaggtagagctcacaagaggatgcagtacaacaggcgtttcgtcactgctgttgttggtttcggaaagaagaggggacctaactcgtcagagaagtaagctcgcaatgtgagttgtcgagatgtagggtagttttggtgttaaacttttcatagatgttgtttctttacccatgattccataatcctttcatttaagcaaaagtttgttaagtatatgtgttatgtgatagttgacgttgaatctagtcttttatt

SEQ ID NO: 2851 - DNA, 773 bp, Pinus taeda
tagcgtggtcgcggccgaggtacgcgggggatgtttatgcgggcaataagggcaacttaagcatagctcagcccaaccattttattttgctgatgcaccgcgatattcctttgattcagtagctcctgcatcgtaactttgtgttgaatctgcaatagcgttaccaatcaaagcacagtgatatatataatcagaaacagggtatacgggtaaggttcatggttcccttgcccgagcagggaaagttagagggcagacgcccaaggtggctaaacaagacaagcctagaggccgcgcccacaagcgaatgcaatacaaccgccggtttgttaccgcagtgcttacttttggaaagaagagagggccaaactcctctgagaagtaaatggctagaagtgaagtcatccagttttgaaagtaacatctttttcgggatgtcttctttaatttttggttaatttcttatacaatcatgcactgtcgtcgaggttggaacagggaaagaaattgctatggatttgtactgtgtaaaatgtttcttttttgaatggtaatgtgatatattttttgcatctggctactatatatttttttatggcattaaagcttatggattgacctgtgatgcaaaacatagaaggaatatggtatggtttcattttatctgttttaaaatttgaaacattcatgagtgggaatggtcatatttggttatgataagaattcattaccatcaccatcacctttaaaacaattaagaagctatgtatacg

SEQ ID NO: 2852 - DNA, 340 bp, Euphorbia peplus
acggcttctttggctcgtgctggtaaggtgagaggtcaaactcccaaagtagccaagcaggataagaaaaagaagccacgtggccgcgcccacaagaggatgcaatacaaccgccgttttgtcacagcagttgttggatttggaaagaagagaggacccaactcatctgagaagtaaactgtgacagaatgacaagttgttagttaggtgaagaattatgtttggtgtttggactggtcttcttatgttttaagaattctcatactatgttgagcttcttatattaagtatcaaactatcgtgatgattctcatttttgttaattagaattattcaacct

SEQ ID NO: 2853 - DNA, 675 bp, Pteridium aquilinum
tggctggtcatttagcaaaccctagaagtatttgagaagcaggcgatcgcgttgtagcttctctgccgctcttcttcctgcaggtcttgagagagagctcgagtctgtaaccatgagtaaagtacatgggtcgctcgcacgagctggtaaagtcaggggtcagaccccgaaagtcgccaagcaggagaagaagaagagaccaaagggccgtgcctacaagcgcatccagtacaaccgtcgctttgtcacagctgtcgttggttttggaaagaagaaggggaccaaactcttctgagaagtagaaagaaatggctacctcattggaatcaaggtgtgccttcccagtgcagtgccaattttggtgtggaagtgtaggaagtcattttggattagaagattctattttgaatgtaacggatgtgctagagccactgagattttttcatctcaatggctataagctgtaggagttgacctcaacgcaattaattttatttgcttgtggttgaatatttgtgagctcagctgcatgtctcaacatatatagagttgttgatcatatctgtctaatgaggaaaggaccatctcaaatcttggggggcagcctggttagttatttgttcaccgttaatcattgttcaaagtgagtaagcttgatttgatttcaaaaaagaa

SEQ ID NO: 2854 - DNA, 406 bp, Musa acuminata
gaatcggagttgctgcgtctcgagatctctgcctcgttcccctgtgcgccggaagcccctagacggagaggccaattcatccagcatgggtaaggtgcacggatctcaggctcgcgccggcaaggtgagagggcagacgcccaaacaggcgaagacggataagccgaagaaaccgaggggcagagcctacaagcggatgcagcacaaccgccggttcgtcactgcagtggttggattcggcaagaagaggggacccaactcgtcggagaagtaaagacccgaaggaacccgaaacgaaggcgttcggggtgcaattttgattttacagtatctcctttatttgcattcggtgagttgacgatgacttatggtttacagtatctcctaattttatttgttatggtgt

SEQ ID NO: 2855 - DNA, 571 bp, Adiantum capillus-veneris
cttttagcaaaccctagaaattgatcgtgcgaccttctgcgttatctgcagctcgcctttgggagggcttcattctgtcaggatgagtaaggtgcatgggtcgctggctcgtgccggcaaggtcaggggccaaacccctaaggttgccaagcaggagaagaaaaagagaccaaagggtcgtgcatacaagcgcatccagtacaaccgccgttttgtaactgcagttgtcggttttggtaagaagaggggacccaattcatcagagaagtaaagctagctggttgtaattgcgagccttggatcgctatactgattcgtgaagatggataatgataggggaattcttgattgagttaggctaaattttgagaggttatggaagtggcgaaagacctcttgctgtaaactgcgaagactgcctgtaaaaggctgtgattttcaaagcacactgctgactgcttttaatctacttttgataatgtctgtatcgtggtgcatcatggccttgtaatcttttgctatacgatctatcttgcttgcttgtttatgtaaggaatttaaatgtttcttt

SEQ ID NO: 2856 - DNA, 441 bp, Zingiber officinale
gcacgagggctacacgtcgacatgggtaaggtgcacggttctttggctcgcgccgggaaggttcgagggcagacgccgaaggtggcgaagcaggacaagaagaagaagccccgcggaagggcccacaaacgcatgcagtacaatcgtcgtttcgtcaccgccgttgttggattcgggaagaagaggggtccaaactcgtcggagaagtaaagattctggtggtcacggtggtaccaaattgcctcctttatcattttgcgtaccatttcctgtctacgtactttatccttttgatctttctttgttttttttttcctttttgtctttgattacagtaactaagtgggatatgaattgaatcgtggaattcttctttacattgatgttattgctatgctgttctgatgcctgattttatgataaatgcaatcactctgtgtg

SEQ ID NO: 2857 - DNA, 475 bp, Brassica rapa
atagcgtcgtcgtctcctccagtgaagccaagaagatttactgtgatcaaccatggggaaggttcactggctcgtgccgggaaggtgagaggtcagacaccgaaagtggctaagcaggacaagaagaagaagcctcgtggccgtgctcacaagagattgcaacacaaccgccgtttcgtcaccgccgttgttggctttggcaagaagagaggaccgaactcatctgagaagtagacagaagcaatatttaccttttgatgtctttgataatgtgtctttagtcacgaagccaatgtttcttgttgatttcatttgtgttacatttttcttgttcggattataacttactttcttgtgttagtgtaaggctggcatattgttgtattagatcttttgttttcttatgttggattagaggcgaaaccttggtgatgcaatatattcatctgaaactaagaagaacccctaatcaccg

SEQ ID NO: 2858 - DNA, 1266 bp, Beta vulgaris
cgcacgagggcgctttcgaggacacagaaagtgcgaacaatcaaccaacatccgaacaacatcactcaccagccatggggaaggtatttccaagaagggcacgcgccggaaaggtcagaggacaaactccaaaaggtgctgctcaagataagaagaagaagccacgtggacgcgctcacaagcgcatgcaatacaatcgccgtttcgttaccgccgttgacggattcggcaagaagagaggaccaaactcatccgagaagtagaagactataaacaacaaaatgtgaactctctacaccaattacatttctaggattcgaatgttcctcttctagttgttaataaggatcgaaggtttcttacaagtattttacgttgggaagactcatatcactactactttttgaggctcgcgacctattctatgctgtagctggaaccccccggttgggtttcctaacacaaagacaattttgcctcaatcctcatagccaccactccaccgggtagtaaaaacaccgaaccgggaaaaaacaaccaaataccaccatcacccgagggggggcccggcacccaaacccccccaataggagagccgaaaaaatccccgggccgccgtatcacaacaccgtgctggggaaaaaccgggcagcccccacaaaaccgcccagcagcaaacccccctcaccccaaatggacaaaaatgcaaaaagcccccaccgaacccccccacaacgaaggcccccctagaagccaaaaggacaaataaaaaagcacaactccgccaaaacccccgtaaaatttaggaaaaagaacaggtctaccccaaaaccgaaacagcaaaatcccgaaagctaaagaaaaacccaaacacgcccacacggcaccacggcacacagaaccccagaaaacctgccaccaaaccaacgcccaaaaacccccagggaacagccaccgcgacaaccccccgaaaaaaaccagcaaccgcagaaaacacaatgaacgaaaaacgccacacaagcttgccaaaacccgcaactccacaaagacaacaaacacccgccgagcccgaaagaacgaccccaaaacccaccccacccggctcgcccctagcctagcgcacgccccctcataccacgccccaacacacaaaaacaaaccacgaacgacacggacacaaccagccatcaccctacccaccgcgattccaataccccagatgatgaaccacacgactaccgagcccacacacatccaaacctacag

SEQ ID NO: 2859 - DNA, 278 bp, Cleome spinosa
aaaccttgcactctagcacgtagcacttcgaagccagccatcaggaaggagaagagcgaattcctgaggagctagttcaaatctgccatggggaaagttcacggatcgttggctcgtgccggaaaggtgagaggacaaacgccgaaggtggcgaagcaggacaagaagaagaagccacgaggacgcgcccacaagcgcatgcagtacaaccgccgattcgtcaccgccgttgttgggtttgggaagaagagggaccaaactcttctgagaagtagaga

SEQ ID NO: 2860 - DNA, 365 bp, Eutrema halophilum
ttgtctttgaatcacacaggaaaggttcacggttcattggctcgtgccggtaaggtgagaggtcagacacctaaagttgctaagcaggacaagaagaagcagcctcgtggccgtgcccacaagaggatccaacacaaccgccgattcgtcaccgccgttgttggttttggcaagaagagaggaccaaactcatcagagaagtaaacaaaacaaaacaaaaaaagaagatttttgataatgctttgttagttagattactctctctctctttccatcggagagtttctcgaaactattatgtgtattccaaattccattgttactcgattcatttgatcagatataaaactttacaatctcctttg

SEQ ID NO: 2861 - DNA, 219 bp, Eutrema parvulum
gaatgtgtgtcgattccaggcaaagtccacggatctttagctcgtgccggtaaggttagaggacagacaccaaaggtggcgaagcaagataagaagaagcaacccagaggacgtgctcacaagcgtctgcagcacaatcgccgtttcgttaccgccgttgttggtttcggtaagaagagaggaccaaactcttctgagaagtagaagatagatatgctg

SEQ ID NO: 2862 - DNA, 219 bp, Eutrema parvulum
tttgttggcaatgttttaggtaaggttcatggctccttggctcgtgccggaaaagtgagaggacagacgcctaaagtggctaagcaggacaagaagaagcagccacgtggtcgtgcccacaaacgtctgcagcacaaccgccgtttcgtcaccgccgttgttggattcggcaagaagagaggacctaactcatctgagaagtagatgatgaacacacta

SEQ ID NO: 2863 - DNA, 321 bp, Brassica napus
aaaccccaaagagaagaacaactttcttcttccctaatctacaatcatgggtaaggttcacggatttttggctcgtgctggaaaagttagaggacaaactccaaaggtagctaaccccgcccagaagaagaaccctagaggcagggctcccaaggggatgcaatacaacagacgtttcgttactgctgttgttggatttgccaagaagagaggccctaactcttcagagaagtaagctggaaacccaatgagggaaggggtttaaggtgtaggggatagctgtttttagtttatatgctgattttgttttagttggtccca

SEQ ID NO: 2864 - DNA, 278 bp, Selaginella moellendorffii
gagttttgcgtgcgcgaagaggatgagtaaggtgcacggatctttggcccgggcgggcaaggtgcgcggacaaacgcccaaggtccagaagcaggacaagaagaagaagcccaagggccgggcgcacaagcgggagcagtacaacaggcgcttcgtcacggcggttgttggatttggcaagaagcgcggccccaattcgtccgagaagtaaagaggatgagattgatgttctagaatttttgttctttgtatgaaacgcgatgtgagaggtcactcaa

SEQ ID NO: 2865 - DNA, 512 bp, Triphysaria pusilla
aaaaatagacgaagctctaggggattcagggttcacggatcattggcacgtgctggaaaggtgagagggcagacccccaaggtggccaagcaggacaagaagaagaaccctcgaggccgagctcacaagcgggtgcagtacaaccgccgtttcgtcaccgccgttgttggatttggaaagaagagagggccaaactcatctgagaagtagggatgtaggttatcaacgaacatttggaaggttttgttatggcatagtattactagttattttatcaatcttgtgtcatttttctggagttttgatgatgtgttcaacatttttaatgctcaagttttaattgagtttaactgttttttggtatttaaaactatggtaatttgtctttattgatatagttgtttaattaatgatgtttgtagttactaaaaagtgaaaatgtgttgtagggctgctatctgctgattgatttaagcctaattattgcgtaacttctaatgaagtgtcttgga

SEQ ID NO: 2866 - DNA, 473 bp, Orobanche aegyptiaca
ccccaagaagttccaagagaaatcagccaaacaatcatgggtaaggtgcacggatcattggctcgtgctggtaaggtgagaggacagacgccgaaggtggcgaagcaggacaagaagaagcagccccgtggtcgggcccacaagcggatgcagtacaatcgccgtttcgtcaccgccgttgttggctttggaagagagaggaccaaactcatctgagaaatgaagtggaacagtttaaaatgttgtcttttttggttgttgtattgttttgaacgcatttactgatctttcttcagtataagaattgaatcatcagttgataaaatttgaattagctatttcagtgagaatatatgtctcagtgttaacaggaaagaaaatgttccagggaatctataattgttaagctcattgaatttgtcagatctctgtgaagatttgtgcaaactaagagaagaaagtttcattgatct

SEQ ID NO: 2867 - DNA, 644 bp, Volvox carteri
ctgaagatataccggaaacatgggcaaggttcacggttccctcgcccgcgccggtaaggtgcgcggccagacacccaaggtcccgaagcaggagaagaagaagcggccgcggggccgcgctatgaagcgcatgaagtacaaccgccgctttgtcaacgttgtggttggcttcggcaagaagcgtggaccgaactcgaacccagcctaaacggaatcagtagcggaggctagtcgattttggagccgtcgtgcagccactggttctccggaacgatggaagttgctagcatgcatcttcagtggcgtcgccatgctgtgaacggccgcgcacgagctactccagcagcttagggagtgcagttggtcgtcctactttgtacgtcactttggcaggggctttcgagtgacggattgggaacggcgtgagcggtccttgcggcagcgcaggaggcggtgggattgcagccggatactcggtcctatttgcggctgttggcccgcccttgcgctgccatcaagtttgatagccgcagcggcgaggatcgttgactgtaacggcacggcaaatccaggatataccgtcgcctctgagaaccaagtacctagggctgcacacacgacgtcaaaacagtctaatcttgccg

SEQ ID NO: 2868 - DNA, 561 bp, Chlamydomonas reinhardtii
ctctcttcttcaacacgcatcaaaatgggcaaggtccacggttccctcgcccgtgccggtaaggtgcgcggccagacccccaaggtccccaagcaggagaagaagaagcgcccgcggggccgtgccatgaagcgcatgaagtacaaccgccgcttcgtcaacgtcgtggtgggcttcggcaagaagcgcggtcccaactccaaccccgcctaagcggacgcggccagttgtagaggcgacactctggcgtatcggcgtggcagctatgggctctacaggacttattagcgccttgtcgtggagttcagagtagccctgcagccgctgcatcggcggcggttctggcctcgcggggcgcacagcagagcaggagcggcgtagcatttggagattgcggggagcgacaagcaggagctttagtcgtggtgaagagggcctgacagttctggaggctcggatgtcggagcccaacctcgctggtgggtgccgcgaggccccgcagcgcagacagtggaccaggttcctatggtatccgttggctgtaacggcagttgcggagct

SEQ ID NO: 2869 - DNA, 489 bp, Nicotiana tabacum
  misc_feature (23)..(23): n is a, c, g, or t
  misc_feature (291)..(291): n is a, c, g, or t
  misc_feature (294)..(294): n is a, c, g, or t
  misc_feature (381)..(381): n is a, c, g, or t
tacgcgggacgcttgctcgtccngatctgaaaaatcaagcatgggaaaggttcacggatcattggctcgtgctggtaaggtgagaggccaaacacccaaagtagccaagcaggataagaaaaagaagccccgtggccgggctcacaaaaggatgcagtataataggcgtttcgttactgctgttgttggctttggcaagaagagaggaccaaactcctctgagaagtaaattcagaaatgggtagaatttgtttgcttttctgaattgttatttttatcgtgctatagctntgntaattaatggggtaagcttgccattgacaatcttgtacggttaattagatttttgaatctgtacaagatagttttgcattgaattanagactttatttttcaagtttcccggctcaaataatgttggcggtcgccaatcggcggaacccctcaaattgggcagcaaggtacctatctttgcccacataaaaggac

SEQ ID NO: 2870 - DNA, 745 bp, Mesostigma viride
gcggttgctcgtcgttacttttaacaaccatgggaaaggtccacggttccctggctcgtgccggaaaggtgcgtggccagactccaaaggtggccaagcaggaaaaaaaggccaagccatgcggccgcgctcgcaagcgtgcccagtacaaccggcggtttgttaacgtcgttgtcggctttggaaagaagaggggcccgaacgctgccccagagtaaatatcatagcatgtccgaattttccagcttcttgtagagggcggaaggactacgcgtgtgcgtttccttgtcggcgtgcggaaatatgatggcacggagcgtggaaatgagaaatgagccccgcgtagctttccactcaaggatacttgcgggagctatctgttcgatgccgaattggctgctggtcatggagcatagcgtgccatgcatggaatggggtcggcttgtagtcggcacttttttcacgctgcgattgcctgtgcggcgagtgcgcttgctgggcggcccacgaggcaaaatacgccagtatggcaccaaaggaaaggaggcatgaattgctatttttggagtttcgtgatttattatttttaacagaataaacttctgaagcaaaaaaaaaaaaagcgcgtcccccgcagccctgtgccccgtggcccataccacacggatatgtcggagtccctcattggctacaggcttgcaaaaacgcaagattggaactgtcttgcaaaaaccacagaactttc

SEQ ID NO: 2871 - DNA, 385 bp, Triticum aestivum
  misc_feature (13)..(13): n is a, c, g, or t
  misc_feature (25)..(25): n is a, c, g, or t
  misc_feature (44)..(44): n is a, c, g, or t
  misc_feature (56)..(56): n is a, c, g, or t
  misc_feature (68)..(68): n is a, c, g, or t
  misc_feature (76)..(76): n is a, c, g, or t
  misc_feature (78)..(78): n is a, c, g, or t
  misc_feature (89)..(89): n is a, c, g, or t
  misc_feature (114)..(114): n is a, c, g, or t
  misc_feature (159)..(159): n is a, c, g, or t
  misc_feature (181)..(181): n is a, c, g, or t
  misc_feature (185)..(185): n is a, c, g, or t
  misc_feature (203)..(203): n is a, c, g, or t
  misc_feature (208)..(208): n is a, c, g, or t
  misc_feature (213)..(213): n is a, c, g, or t
  misc_feature (223)..(223): n is a, c, g, or t
  misc_feature (241)..(241): n is a, c, g, or t
  misc_feature (244)..(244): n is a, c, g, or t
  misc_feature (257)..(257): n is a, c, g, or t
  misc_feature (268)..(268): n is a, c, g, or t
  misc_feature (273)..(273): n is a, c, g, or t
  misc_feature (280)..(280): n is a, c, g, or t
  misc_feature (300)..(300): n is a, c, g, or t
ccccgtttttgtngccgaagcgctnccccgccgcttgagtgctncccgtttttgtngccgaagcgctncccgccgntncaccgccgcanccgccatgggtaaggtgcacggatngctggcgcgggccgggaaggtgcgggggcagacgcccaaggtggngaagcaggacaagaagaagcanccgngcggccgcgcccacaagngcatncagtncaacaggcgntttgtcaccgccgttgtnggntttggcaagaagngcggccccaantcctncgagaantagtagattttggtggtttngcgccagccctccttttttttttgttttcgttccagtatgcatgctaagaagacctaatcaagtatctgtaatttactgtgatgt

SEQ ID NO: 2872 - DNA, 396 bp, Malus domestica
atgaaaaaagaagaaggaggagaagacgaagaaggagaaccagggattcagatgaaagaagaaggaggagaacaactctcaacacatggacaacaactgggtaaagtggagcgtgtgaagtcaaaactggccacgggaaaggtccacggttctttggctcgcgccggtaaggtgagaggccagacagccaaagtggtcgagcaggataagaagaagcagccccggggccgcgcccacaagcgttgcaatacaacagtcgatccgtcatccccgtggttggcatcggaaagaagaggggacccaactcgtctgagaagtagggcaaatattcaagctttgaaaggatgagaaggtcttcgaagattaagaaaaaaaaggctgtatttttgtttaatt

SEQ ID NO: 2873 - DNA, 416 bp, Sarracenia psittacina
cgtcagcgctacccgcgtcgacgcaagcttcgctagattgtttgccacctcctatacattcaccactgagtaaggttcacggtccttggcccgtgccggaaggtgcgtggtcagacgcctaaggtcgccaagcaggacaagaagaagaagccgaagagccgtgccacaagaggatgcagtcaaccgcgtttgtgactgcagttgtttggatttggtaagaaaaggggacccaactcatctgagaagtagatgagctcaaggccatgattcgtcgtcactgtatgatcggcgagcttgaggatcatgttagcccacgtcgtagacatgtagtggctgctaagtcttggaatagcagcatggagttattcaatgtgtattcacgaggcaaattagcctttgactaaattcagctctcc

SEQ ID NO: 2874 - DNA, 485 bp, Nicotiana benthamiana
  misc_feature (478)..(478): n is a, c, g, or t
cggcacgaggctttgctcctccaatctgaaaaattaacaatgggaaaggtccacggatcattggctcgtgctggtaaggtgagaggccaaacgcccaaagtcgccaagcaggataagaaaaagaagccccgtggccgtgctcacaaaaggatgcagtataataggcgtttcgtttctgctgttgttggctttggcaagaaaagaggaccaaactcctctgagaagtaaattcagaaatgggtagaatttgtttgcttttctgctttgttatttttaccgtgctatcgctttgttaattattggggaaagcttgccattgacaatcttgtacggttaattagattttttaaatctgtacatgatacattgaattaaacactttatttttcaagttttcgggctccaataataatggtgttctggaaatatgttttgagctgtaaagatacgtgaaaatattgcaagtggaaatggctcnaatatat

SEQ ID NO: 2875 - DNA, 356 bp, Allium cepa
caaagcacgatcagaaagagagatcacttcgaattcacaatggggaaaagttcacggatcgttggcacgtgcgggaaaggtcagagggcaaacaccgaaagtggcgaagcaggacaagaagaagaagccgagaggtagggcccacaagcgtatgcaatataaccgacgtttcgtcactgccgtcgtcggtttcgggaagaaaagaggacccaactcttccgagaagtaggaaatttcagcttcatgagtttgtttcctttttaattcgtattctgttttattttctgcggtactgatattagactgctatgtgaacactgaaagtggtattattggtagaaaacgtttctcttttg

SEQ ID NO: 2876 - DNA, 1281 bp, Aquilegia formosa
gcagtagcagaaagaagaagaagagttctgcacactccgccgccatgggtaaggttcacggatcattagctcgagctggaaaggttagaggacaaacaccaaaggtagctaagcaagataagaagaagaaaccaagaggtagagctcacaaaaggatgcagtacaatcgccgtttcgtcactgctggtaaacttttcagatctaatttactttcgcatattctattcattcaaatcgaattaactttgttaattatccgttttgttcttataaacttactgattgagatctgcttaggtttgactcagttatcaaaacatacatttgattaagaataaatagtgttatggcatgatttcttaaacacttctgtaatagtatctaatttcgaaaatgattaaaaagaatgcttctgctgattgaaagtatttttgttaatggttttattagttcttctcatgtaatgttatggttgaatgttaatggacattgtagtctaatcgacagaccttaaatgtttaaggaaagcatgtgacgacttgtttaataaataagacagatttagtagttttgattgtcattaggtgctactacatcatgattttcaacatttggtgtagtaattatactgaatgttttaatggtgttttgtgtttggattgtgtactttggttaatgaattgaagattttttactagtccacacaaaatgaaaagaacaaatgatttgttagctgtttgcgtttttcatactcattttgtcttcttttttatagttcttgtgcattttattgctataccactaaataattgctgtgtatcgattagtactcatgaatatcgactagatttggtgttgaaagtataggccagtaatttaaagaacagatataaaagtactataagaagtttcattcatcatgtttatattcttttaattcaaagaatagtatttgggtattcaaactttttggtaagtatgataatgagaattactataagctctgctttgtaactacatgaaatcaaaggtcaaccggttgtttcttacactatttatttgatctgtgttttcagttgttggtttcgggaagaagagaggaccaaactcttcagagaagtaagcaggagtagcaatgcagtttgcatatgtagagtaggttttgaaggctattgtcagctctcgattattcaaggaatgttgaaattttgagaaatacattcagtttttgctgttatgttttaatttgattcagatgctttaaaatggatgtattgcact

SEQ ID NO: 2877 - DNA, 286 bp, Olea europaea
atttaacgtaaagcccgttaaccatataaatgcagggaaaaaaaaccctaaacatctagaaccatatttcgctcgaatcgatccagcagttgcttctctctaaatttctactcaccgaaatcatccatgggtaaggttcacggatcactggcacgtgccggtaaagtgagagggcaaacaccgaaggtggccaagcaggacaagaagaagaagccccgtggccgtgctcacaagcggatgcaatacaaccgccgcttcgtcaccgcgttgtggctttaggaaagag

SEQ ID NO: 2878 - DNA, 601 bp, Mesostigma viride
ttaccttttaacaaccatgggaaaggtccacggtttcctggctcgtgccggaaaggtgcgtggccagaccccaaaggtggccaagcaggaaaaaaaaggcaagccattcggccgcgctcgcaagcgtgcccagtacaaccggcggtttgttaacgtcgttgtcggctttggcaagaagaggggcccgaacgctgccccggagtaaatatcatagcatgtccgaattttccagcttcttgtagagggcggaaggactacgcgtgtgcgtttccttgtcggcgtgcggaaatatgatggcacggagcatgaaaatgggaaatgagccccgcgtagctttccactcgaggatacttgcgggagcatatttggtcaatgccgaatttggtgctggtaatggagcataaagtgccatgcacggaatcgtggggtcggcatgtgatcggcactttattcgtgctgcgattgtctgtgcggcgagtgcgcttgctgtgcggcccacgatgcaaaatatgccagtacggcttcaaaggaaaggaggcatgaaattggcaatctttgagtttctgatttattattatttcaacagaataaagttctgaag

SEQ ID NO: 2879 - DNA, 751 bp, Picea glauca
gcacgaggcaggtactctccaggactgcaccgaccagattgagcaaacatgggcaaggtccacggatcgttggcccgtgctggaaaggtcagaggtcagaccccaaaggtccccaagcaagacaagaagaaggtccccaagggacgtgcactcaagcgcatcaaatacaacaggcgattcgtcaatattgttgtcggcttcggcaagaagaagggacccaactcgcagtaggtttcttgaaaggaagatgcagcggtagcatgagacatgcagccaaataagcatgcgctatatgcgtaagctgatgcagaggagctctgagcaccagcatcagccatgatacctgcagctcatatcatccagctacagttggccgcttgaacatggttcagcctgtacagtaccagtccctggggctagatgagcagcaaggcagcttggcacctgcatggcctagggctcagctgcaaatggacagcgtggagttgttgacagcggcctctcatggagggctcattcttcacgtgtctcgcaacatgcagcctgcagtgcatacctgtgggctctcagcagggtgctgagggacactgatgtttcgagatcaaaggctgcaatggaggatccagcagaaggctcaaacgaccaatcgtcttgcttgcatgatcagcctgcaatgttgctggctcgcggcatgactttttcacattgtcataaggctggatgacaccgctggtgaatggctcatcatttc

SEQ ID NO: 2880 - DNA, 464 bp, Citrullus lanatus
aatctgtttgtgaattgtgtgtattcgtgctttgatcgattttcagggaaagtacacggatctctggctcgtgccgggaaggtgagaggtcaaactccgaaagtagcgaagcaggacaagaagaagaagccccgtggacgtgcacacaagcggatgcaatacaatcgcagattcgttactgcagtggttggttttggaaagaagagaggacccaactcctctgagaagtaagcaaacagcaacccatggggggggagctttgccgctggagaggcatggttttgtgctttattaagctttttttcctatttctcatagatgttttagtttattgaggctcttgaccgtgtaaaagatatttattttgacaatatattagaagtaatgtgatttgggtctgaatttttgttagttaaacagttttttccccctgaattttcatattttgtccttctattttgaag

SEQ ID NO: 2881 - DNA, 602 bp, Citrullus lanatus
gtacgaaaccgacgagccggtcgccgaacatcctgaagaggagaagtcgcttatcagattcgccatgggtgagactcaaactctctatcttcatttcacatatttctttcttctgtttaatgttccatattagtctgtttcttcatccatgtaatcaactttcaggtaaggttcatggatccttggctcgtgccggtaaggtgagaggccagacaccaaaggttgctaaacaagacaagaagaagaagccacgaggacgtgcccacaaaaggatgcaatacaaccgcagattcgtcactgccgttgttggctttggaaagaagagaggaccaaactcctccgagaagtaagagactcgagaattcggcgtaacagccattttttcatgttatttggagatattttatacttccgatagtacttcttgatgcgcttaagctgatagttgtgtgaacgatgatagtattatttcttttagaggtttttaatttcgtcatttgatgcttctcttgcgttttagttttgttgtttcacaatgagatgagtatcatttttattttcggaaaacattgttaatggcgataattctactgaaatcgcgt

SEQ ID NO: 2882 - DNA, 1290 bp, Glycine max
gctggatatattttgctctttccagatttagccttcctgtccccttccgctacgaaattggagcagaggagtggcggaggacgaagtcgacggcgacaatggttaacgaaacggtgcggtggtgtgctttgttgtagtcgtctccgatcatcatcgagaatgcgcaatctggctgcacctcattccttgggggttttcatctttcgccccaataagcctccttttctcactctcccctcactctctcgaagatctctcccttccatccagtgcggtgcagttcaattccgcccctgcatcgatatccacaaagggaaagtgaagcaaattgtagggtccacccttcaagacttgaaaggctccgatcccgtcaccaattttgagtctgataagtcagccgctgaatacgccacgctttacaagcaagatggactcactggtggtcacgtcatcatgcttggtgcggatcctttgagcaaagctgctgcccttcaagcattgcacgcttatcccggcggtctgcaagtcggagggggaataaattctgacaattgtttgagttacattgaggaaggagcaagccatgtcattgtcacttcttatgtattcaataatggacaaatggatattggaaggctaaaagatcttgttcaaattgttggaaaagagagacttgtgttggatctcagttgcagaaaaaaggatggtaaatatgcaattgtcactgatagatggcagaagttcagtgatgtgtttgttgatcctgatgtaatggaatttcttgccaactttgctgatgagtttctggttcatggtgttgatgttgaagggaagaagttgggaattgatgaagaacttgtggctttgcttggcaaatattcaacgattcctgttacttatgctggtggtgtgactgaaatggctgatctagagaggataagaacggctggaatggagcgtgtgaatgttactgtgggcagtgccttggatatttttgggggaaacctggcttacgaagatgttgtagcttggcatgcccagcaaaatgcctctgtagtttaattagtatgttttctttagttggggggactggtaagcaaagatttgtttttagtgtttctctaggtatgtaaccatgtatcaagtgatttttctatcatttttttcttataattctagcatttaccctcatcgttaacttttgtgattctgacaagattattatctaccactagtaacccaaaagcaacccttttaatggtcttattttaaaagcaatcttcttgttta

SEQ ID NO: 2883 - DNA, 1103 bp, Cajanus cajan
gggggggtgtgttaaattgcagtcgccattacagcgtagctccgatcatcgagaatgcgtaacctcgctgcacctcgttccttccgtctttgcatcaactcacccatctctcgcggcaataagcttccttctgttactctcaaccctctttggacaccttccagaacatctccaccgtccattcaatgcgccgttcaattccgcccctgcatcgatatccacaaggggaaagtgaagcaaattgtggggtccacccttcaggatttgaaagggtcggatcctgtcaccaattttgagtctgacaagtcggcggcggagtatgctgcgctttacaaacgagacggactcaccggcggccacgtcatcatgctcggtgctgaccctttcagcaaagctgctgcgcttcaagcattgcatgcttatcccggcggtcttcaagttggaggaggaataaattctgacaattgtttgagttacattgaggaaggagcaagccatgtcattgttacatcttatgtattcaataatggacaaatggatcttggaaggctaaaagatcttgttcaaattgttggaaaagagaggcttgtttttggatctcagttgcagaaaaaggatggtaaatatgcaattgtcactgatagatggcagaagttcagtgatgtttttgtggagcctgatgtaatgcaatttcttgccaactttgctgatgagtttctggttcatggtgttgatgttgaagggaagaagctgggaattgatgaagagcttgtggctttgcttggcaaacattcaccgattcctgttacttatgctggtggtgtgactggaatggctgatctagagaggataaaaactgccggaatggggcgtgtggatgttactgtgggcagtgccttggatatttttgggggaaacttagcttatgaagaggttgtagcttggcatacccagcaaaaggcctctgtagtttaattagtatgatttagacttgttgggggcaggaactggtgagcaaggatctgtttttggtgtttctctaggtgtttaactgtgtatcaggagagtttttgtaacaactttttatttatttttttattttt

SEQ ID NO: 2884 - DNA, 1604 bp, Vigna unguiculata
  misc_feature (267)..(267): n is a, c, g, or t
aaggtgcaaacgtagaaccaccaagaaagacaccaacactgaactgttggtgcaattggagaaggcaacatcaacactcaaaactcaaacaaaccttgcaagggagaatcagtgaaccacaaaattattactcactcctgcgtaaatcctcatctacaagcaattaattccattgtcattttttttttcctggtgtccaaccgagtgtacgacttcacgccatcttcgtaaccttgcttgaaatcctaggatcgcatttcactcgcngctgcagcagggaagcactcttctttctttgctcgtgtccgatctgccatggctgaaggtaatccctgtctcatgattcactattgaccattctatttcattgttaggtccctgaaaagaaaatttccccccctttagtccttcaatattcatcgcgctagaatgcgagtccctcgacttttttgagtgaagaagggtggtcacagtttccttgaggaatgatgagaaatctctctgcatctcattcctttggtcttttcgtcacctcacccatcttttgtcccaataaccttcctgctatcactctctcctcacgttccagcagaagatcttctccttccattcaatgtgcggttcaattccgtccctgcatcgacatccacaaggggaaagtgaagcagattgtggggtcaaccttgcaagacttgaaagggggtgatgggtcggatcctgtgaccaattttgagtctgataagtcagctgctgagtatgctactctttacagaggagatggactcacgggtggccacgtcatcatgcttggtgcagaccctttgagcaaagcttctgccttggaagcgttgcatgcttatcccggcggtctacaagttggaggggggataaatgctgacaattgtttgagttacatagaagagggagcgagccatgtcattgtgacatcttatgtattcaatgacggacaaatggatattggaaggctaaaagatcttgttcaaattgttggcaaagagaggcttgtattggatctcagttgcagaaaaaaggatggtaaatatgcaattgtcactgatagatggcagaagttcagtgatgtttttgttgatcctggtgttatggaatttcttgccaattttgctgatgagtttttggtccatggtgttgatgttgaagggaaaaagttgggaattgatgaagagcttgttgctttgcttggcaaacattcaccaattcctgttacctatgctggtggtgtgactggaatggctgatctagagaggataaaaagcgccggagtggggcgtgtggatgtgactgtgggtagtgccttggatatttttggaggaaacttgtcttatgaagaggtcgtagcttggcatgtacagcaaaaggcctatgtagtttgattaatatgttttcttctaattggagatagggactggtgtgcaaggatctgtttttggtatttctctagatgtgtaaccatttatcaggttattttttaatgactgaaggcaaattgaacaattgataacagaatatctagtatgaactgattactattttaataatactaagtcttcaaaaaaaagaaaaaa

SEQ ID NO: 2885 - DNA, 1433 bp, Medicago truncatula
aaacttcacttcactgaactgtcttcgaactcaatcaatcatcactcaatgcgcagtcctgcttccactccttccatccgtggtggtgccttcgcatcttctccaattctccgccacaatcatctcccttttcttcgcctcaatcctccctcctcttcaccaacacgatcatctccaccttcaattcaatgctccgttcaattccgcccctgcatcgatattcataaggggaaagtgaaacaaattgttgggtcaacccttaaagatttgaaagatgatgatgggtcagatccaatcactaattttgagtctgataaatcggcagctgagtatgctactctttacaaacaagatggacttaaaggtggtcatgttatcatgcttggtgctgatcctttcagtaaagctgcttctcttgaagcattacatgcttatcctggtggcttgcaagttggaggaggaatcaattctgataattgtttgagttacatcgaggaaggagcaagccatgtcattgtgacatcttatgtattcaacaatggacaaatggatcttgaaaggctaaaagatctggttcggattgttggaaaagaaaggcttgtgttggatctcagttgcagaaaaaaggaaggtaaatatgcaattgtcactgatagatggcagaagttcagtgatgtgtcactcgatgccaaagtaatggagtttcttgccaactttgctgatgagtttctggttcatggcgttgatgttgaaggaaagaagttgggaattgatgaagagcttgtagctctgcttggaaagcactcaccgattcctgtgacatatgctggtggtgtgacagtaatggacgatttagagaggataagaacagctggaatggataatgtggatgttactgttggcagtgccttggacatttttggggggaacttggcttataaagatgttgtagcttggcataaccagcaaaaggtctcagtggcttaagtaagcattttttagagtcgttgaagttaggggtgggtgagctctgagcacggatttgcttaactatatctcttagtgtaaccttgagtctggtgatttgtcgcaatttctgtggttccagcatttgcctgaccattaacttgtcatgacattcttacatgattatcttctgccactacatttacatctctgtgatgtaggtgtaaggcagtgcatgtaggtttttctccctgtacaagaatccccgtcatatcgtgaaaatcctatgaatatagcattgtgtgtttctgcatattatatgcccaatgaaggataggagttcattcatcaagtttgatgatttagttgtaaaatgttattgttttggtttttaattaacacttctgagctgcactttgaataatgtgatctcatttatttgtataaataaatatggcataattgtt

SEQ ID NO: 2886 - DNA, 1296 bp, Trigonella foenum-graecum
acttcgctaaatcctcaatgttcaattccacttccactccttccatccctgggttcccatcttctccaatcctccgccccaatcatcttccttttctcagcctcaatcttccttcctcttcaccaaggaaaaaatcttcactttcaattcaatgctccgttcaattccgcccctgcatcgatattcacaaggggaaagtgaaacaaattgttgggtcaacacttaaagatttgaaaggtgatgatgggtcagatccaattaccaattttgagtctgataaatctgcagctgaatatgctactctttacaaacaagatggacttaaaggtggtcatgttatcatgcttggtgctgatcctttgagtaaagctgcttctcttgaggcattgcatgcttatcctggtggcttgcaagttggaggggggataaattctgataattgtttgagttacattgaggaaggagcaagccatgtcattgtgacatcttatgtattcaacaatggacaaatggatcttgaaaggctaaaagatcttgttcggattgttggaaaagagaggcttgtgttggatctcagttgcagaaaaaaggaaggtaaatatgcaattgtcaccgatagatggcagaagttcagcgatgtgtcacttgatgcagaagtaatgcagtttcttgccaactttgctgatgagtttctggttcatggtgttgatgttgaaggaagaagttgggaattgatgaagagctcgtggctttgcttggcaagcattcaccgattcctgtgacgtatgctggtggtgtgactgtaatggatgatttagagacgataaaaacagctggaatggataatgtggatgttacggtgggcagtgccttggacatttttggggggaacatggcttataaagacgttgtagcttggcataaccagcaaaaggtctccgacgcttaaataagcattgttgggatttgttgggggcaacagtggtaggtgagctctgagcaaggatttgtttcattatttctcttagcgtaaccttgaatccactatcaagtgatttttctctcaatctctgtgatttcaccatttgcctcaaccatcaacttgtcgtgatattcttaaaatcatatcaacagagcattgtgtgtttctgcatattaaattaaatgaccaatgaaggattggagttcattcatggagtttgatcagatttttattttaaaattaacacttctcatcagatgtattttgagtagcgtgatcacatatttatttatataagtatggcataatttata

SEQ ID NO: 2887 - DNA, 1205 bp, Glycine max
gaaaatcaatttggatttcaatgcctctggctcaccgttgaattgaattttgatggctcaacaaccgtcaccatcgtcatcgcctccacggcggaaaactcctccgccaccgcagtacgtggaggtgaattgcagaagctccggcaagacacggcggtttgcggctggcaccgacgcggggtttgcggtggcgctgatcaatcggaagctgaagggaacgctggtggctgcgtcgcacatagaagcagtgaaggatgaagaagaaccaatcgcttttggccccacttcgcttctttctaacttcggcgaaggttggaaactccaaactgttacactcacggatctttcttcagaagtgggggatggacaatttcaacagatggcaatgcatacaccaggactagtttcaggtgtcccaagtcctgcaagcaggatatccaatccaatcagctttgtatatcttgttaaaataatgtttgcttttattttgatttttgtacttggtgcaatttttactttgtttctcgataaccttcctgcattcatattgtttcttaagtcaataacctagtaccttttttattgcttgaaatgtattatgtatatatgcattaaataaattgttcaatctatagcctttttgttaaggactagaattcaaactatggaaggagacgatgtcagaaactgaactgtgagagcattgtgtctctcttgaacatttcaatatttcaacattaattttctaggggcatgttttagagtggttgtatagaagatgtcaatttatgggaacagtaatggattccagctcttaaggcttttctatcagagtgcaaattgggcatcattccaaaggtagaactatttcctgatgggctctatgcaatggtctagaagataaactcttattatgttgctagaaaacaatcctccagatttacatgcttcaaaattatgtcctatcattggaggattttggacaacaactgttaaatcagcagatttgtgtgatcataggacaagatattgtcctccatcaggtggtggagaaagctttcgatggtcaatgtgcatgaaagtcacgatttttgttgaaaatgtgaaaatattaagagaacgtacaaaagtttcatgaacttcaaacttgatattgaaagtgcttcagtcattatatcaagaagttgtctaccaatttcttgact

SEQ ID NO: 2888 - DNA, 1880 bp, Phaseolus coccineus
  misc_feature (539)..(539): n is a, c, g, or t
caattttttaatccccctgagaaaaaaaatccgcctttccccctcaatcaacgcaacacgcttaaattactacccttcttccttctctctttttctctctcacacgcgcgcactcctcctcctcctcctaaagtctttaccttttgcggaatcggaatcggaatcggtgatctagatgggcataatcagaagcatgagatcgaggtcgcatcgcgtggtgcaggagcaagaagagtgtgttggtgacagcatgagacagagttgttgggccaacatgccccaagagcttctccgagaggttctcctgcgaatcgaggcctccgaggacatgtggccgccgcggaagagtgttgtcgcctgcgccggcgtgtgccgcagctggagacaaatcaccaaagacattgtcaaaacacccgaactttcctcaaaaatcaccttccccatttctgttaaacagcctggcccaagggagaatctcctccggtgctttataaagcgcaaccggtccacccaaacgtactatttgtttctcagtttanccaatacactagctgaagatgggaagttccttctggctgcacgcaagtgcagacgtccaacatgcacagattatataatctctcttgatgcagatgatatgtcaaagggaagcaactcctatgttgggaaactaagatcaaattttcttggaacaaagttcacaatctatgacagccagccacctcattcaggtgcaaggattatgaaaagtcgctccacaaggctggtgaatctaaaacaagtttcacctaaggtccctacaggcaactatccagtggcccacatctcatatgaattgaatgtgctaggctcccgggggcctaggagaatgcactgtgtcatggattctattcctgccactgcaattgaagctggaggagtagctcctacacaaactgagttttctcttaacaacatagatatgtttccttcattccctttcttccgatcaaaatcaaatcgtgtagaaaactccatgtctggacccctggttgatcaaagggatgggatgctcgtgttgaaaaacaaggctcctaggtggcatgagcaactccagtgttggtgcttaaactttcatggccgggtgacaattgcctcggttaaaaactttcagctggtggcttctgcagaaaatggacctgctggaccagagcatgataagattatcctccaatttggaaaagttgggaaggatttgtttacaatggattaccgataccctatttcagcatttcaggcctttgccatgtgcctcagcagctttgataccaagattgcttgtgaatgacatgtttaaacagcttcaatccagaatacatagctatctctcttacttctgagagaagtatggtttgaacgcacttgttgggaagcagaaagatgaaaagtgtttggtaatataagattggttggaaggggtgttgaactgaattttaaagatccattcagtttctgggatcacaattcaccagctcttgagaagataccatgaacttggaatgttatttgaaactcctccaccctaaccccacaagacaagacaaaaagtgcaaaagtggaaaatacttttcttctgtctcccgtgtacataaatgatatttctcatttatttttgtctttcaacaactgtttggttgtttatggtattatagtagtcttttttaaaacgtgttccccacaagacatgttttgtttatgggacaaaacaccatagctagctttcaacttatcctttgattagaacatgttgtgttagttggactacttgcaagaacacgagcaaacaacttgttatgtgcaactcctttccttccgtaatccactctgaaaattctctttcc

SEQ ID NO: 2889 - DNA, 1790 bp, Vigna unguiculata
  misc_feature (647)..(649): n is a, c, g, or t
  misc_feature (963)..(963): n is a, c, g, or t
acgcgcgcactcctcctcctaaaggctttacctttcgcggaatcggaatcggaatcggtgatctagatgggcataatcagaagcatgagatcgaggtcgcatcgcgtcgtgcaggagcaagaagagtgtgttggtgacagcatgagacagagttgttgggccaacatgccccaagagcttctccgagaggttctcctacgaatcgaggcctccgaggacacgtggccgccgcggaagagtgtcgtcgcctgcgccggcgtgtgccgcagctggagacaaatcaccaaagacattgtcaaaacgcccgaactttcctcaaaaatcaccttccccatttctgttaaacagcctggcccaagggagaatctcctccggtgctttataaagcgcaaccgctcaactcaaacgtactatttgtttctcagtttaactaacacgctagctgaagatgggaagtttcttctggctgcacgcaagtgcagacgtccgacatgcacagattatatcatctctcttgatgcagatgatatgtcaaagggaagcaactcctatgtcgggaaactaagatcaaattttcttggaacaaagttcacaatctatgacagccagccacctcactcgggggcaaggattatgaaaagtcgctnnncaaggctggtgaatctaaaacaagtttcgccgaaagtccctacagggaactatccagtggctcacatctcatatgaattgaatgtgctaggctcccgggggcctcggagaatgcattgtgtcatggattccattcctgccactgcaattgaagctggaggagtagctcctacacagaccgagttttctcttaacaacatagatatgtttccttctttcccttttttccgatcaaaatcaaatcgtgtagaaaacaccatgtccgggacccctggttgatcaaaaggatgggatgctcgtgttgaaaaacaagtntcctaggtggcatgagcagctccagtgttggtgcttaaactttcatggccgggtgacaattgcctcagttaaaaactttcagctggtagcttctgcggaaaatggacctgctggaccagagcatgataagattatcctccaatttggaaaagttgggaaggatttgtttacgatggattaccgataccctatttcggcatttcaggcctttgcgatgtgcctcagcagctttgataccaagattgcttgtgaatgacaacatgtttaaacagcttgaatccagattatatagctatctctcttacttctgggagaaggatggtttaaaagcacttgttgggaagcagaaagatgaaaagataaaattggttggaagggtgttgaactgaattttaaaggtccattcagttttctaggatcacaattcaccagctcttgggagaagacaccatgaacttggaatattatttgaaactcctccaccctcacctccacaagacaacacaaaaagagaaaaagggaaaaaaaaatacttttcttctgcctccgtgtacataaatgatatttttcatttatttttgtctttcaacaactgtctggttgtttgtggtatttaaaacatgtcccccacaagacatgtttttgattatgggactactatctagctttcaacttatcctttcatgagaacatgttgtgttagttagactacttgcaagaaaacaagtgcaagcaacttgttatgttcaactcctttccttccgcaatccactctgaacgtgctctttccaaaacagtagtaatgcaatgttttaatagtatttaca

SEQ ID NO: 2890 - DNA, 1976 bp, Glycine max
agaatcccatctctctcttttttctgcatctctcctacactttctttctcttatcttcccaaacccaccaaaaaagaatcaattttttaattccccagaaggaaaaaacaggaacttttttctccctcaatccacccaccctcttctctctctctatttctcaacacacacaagcactcctcttcataaagccgtgaccttaggtggaattggaattggagatctagatgtgcctaatcagaagcatgagatcgcagtcgcagcgtgtggtgcaggaacaagaagaagcagagtgtgtcggcgacagcatgcgacagagttgttgggccaacatgccccaagagcttctccgagaggtcctcttcagaatcgaggcctccgaggacgcgtggccgccgcggaagagcgttgtcgcctgcgccggcgtttgccgcagctggagacaaatcaccatagacattgtcaaaacacccgaactctcctccaagatcaccttccccatttctgttaaacagcctggcccaagggagaatctcctacgatgctttataaagcgcaaccgttccagccaaacatactatttgtatctcagtttaaccaatacactagctgaagatgggaagttccttcttgctgcacgcaaatgcagacgtccaacctgcacagattatatcatctctcttgatgcagatgatatgtcaaagggaagcaactcctatgttgggaaactaagatcaaattttcttggaacaaagttcacaatctatgatggccagccacctcatgcaggagcaaagattatgaaaagtcgctccacaaggctggtgaatctaaagcaagtttcacccaaggtccctacaggaaactatccagtggcccatatttcatatgaattgaatgtgcttggctcaagggggcctaggagaatgcattgtgtcatggattccattcctgccgctgcaattgaacctggaggtgtagctcctgtacagactgagttttctcttaacaacatagacatgtttccttcattccccttttttcgatcaaaatcaaatcgtgtggaaaattccgtgtctggaccattggttgatcaaaaggatgggatgctagtgttgaaaaacaaggcccctaggtggcatgagcagctgcaatgttggtgcctgaactttcatggacgggtgacaattgcctcagttaaaaactttcagctggtggcttctgcagaaaacagacctgctggaccagaacatgataagatcatcctccaatttggaaaagttgggaaggatttgtttacaatggattaccggttccctatctcagcatttcaggcatttgcaatctgcctcagcagttttgataccaagattgcttgtgaatgacatgtttaaacagtttcaatccagattatataggtatgtctcttgctgccgggagaagtatggtttgaaggtcacttgttgggaagcagacagatgaaaaatgtttgtcaaggtaaagattggttggatgggtgttgaactaaaatcaaaaggagcattcagtttctgggatcacaattcaccagctcttgggaatgttacttggaacttctccaccatcaccccacaaagcaaagcacaaaaacgggaaaaatacatttattcagacccccttgtacataaattctccattttttttctttcaacaatttggttgtttattgtaatatagaagtggttgtttaaaacatgtccccgctagacatgttttgttaatgagactactagctttcaacttatcctttcatgagaacatgtgttggggggactacttgcaagagcacaagcaacttgctatgtgcaactcctttcgttacgtaatccactcttgacgtggtttttttccaaaacagtaacacactgttctaatagtgcatgtcacgagggataattgccactgtctgtattctcttgactgaggaataaaccttc

SEQ ID NO: 2891 - DNA, 2009 bp, Medicago truncatula
atctcatgtgtgactctctctcttacactcacaacaaagtaaccgacctcttcttcacacacaatcataccacaacgcatttcaccttctcacccttttcctctctcaaacaaatcatcaaacacacactactcatacctcaattccccttttttttcatcacaatcttcccttttcttcttcaaaaaatcaatttttctcattcccccacaaggaaaaaataatccaaaattctatcaaaatcaattttccctcaatcaacgcaacacttttacatcttcactctctctttctctctctctctctctctctctctctcttctcttttaaaggtgaaatttttcatcttttggtggaactgaaatcgaaattggcgatctgggtatggctataatccgcaacataatagaagacatgagatcaagatctcaaagggtggtggtggcggcggagaaggaagagaaagtggcggttggtgacagtttacggcagagttgttgggctaacatgccacaagagcttctccgggaggttcttctccgaattgaggcgtcggaggacacgtggccgccgaggaagaacgttgttgcttgtgctggagtgtgtaggagttggagagttatcactaaagagattgttaaaaaacctgaaatttctgctatgatcactttccccatttctgttaaacagcctggtccaagggagaatctccttcaatgctttataaagcgcaaccggtccactcaaacatattatttgtttctcagtttaactagttcgctaggtgatgatgggaagttccttctggctgcacgcaaatgtagacgtcctacatgcacagattatatcatctctctagacgcagatgatatgtccaggggaagcaacaactatgttgggaaattgagatcaaatttcctcggaacaaagttcacaatctatgacggccagccacctcatgcaggagcaaaatttactaaaagtcgttctactaggctggtgaatctaaagcaggtttcacccaaggtcccaacaggcaactatccagtggctcacatctcatatgaattaaatgtgctaggctctagggggccaaggagaatgcattgtgtcatggattccattccatcctcttcaatcgaaccaggtggcgtagctcctacacaaactgagttttctctaaacaacatagaaatgtttcccttgtttccttttttccgatcaaaatcaaatcgtgtggtagagaactctctatccggacctcttgttggtgataaaaaagatggtatgcttgtgttgaaaaacaaggctccaaggtggcatgagcagctgcagtgttggtgcttaaactttcatggacgggtgacaattgcctcggttaaaaactttcagctggtggcttccgcagaaaatggaacagctggaccggaacacgataagattattctgcaatttgggaaagttgggaaggatttgtttacaatggatttccgataccctatttcggcgtttcaggcatttgcaatctgcctcagcagctttgataccaagattgcttgtgaataagagcatgtttaaacaggttcaatccagattagatcacaatctgagaaatatgtttgaatgtcacttcgtgggaagaaatctaatgagaagtatttatgaagatgattggatggtgttctactgaatcaataaaaaggtgctgcacatgagttttcagttagtttccggaatcagcattcatagcatgaaattgtaatgttacttgtcttcattcgtgtaaattattccccttgtgctgtacataaattctttctccctcagtttttcttctcttttaacaatttgattttcatttggttgtttatattattatgcaatatagtgtcatgtacttgcaataacataataccggtgttacaacgttgtctttcaaaatcagtaacaaattggttccattttgtgtagagtatgtcacaaggaatatgaattagacctagattatt

SEQ ID NO: 2892 - DNA, 1951 bp, Lotus japonicus
atgatgaacctgacttccactatttgagtctctctctctcttcaccttctctctctctctgaatcatcacactgcatttcatttcacctttttatcagaacctctctctttctctctaccttttccccttcatacccaccaagaaagaaacaatttttcttcatccccagaagaaaaagattaaaaatttcccctcaatcaacgcaatcacaacgcttaaagccttaaaccactcacctactctttctctctctagaactagtactaatactcttatcctctgaaccttgaagcattttcattgtgaattccgcatctgaatggcgattatacggagcttaattcaggatatgagatcgaggtcgcagagggtggtggtggaggaggacgcggcggcggcggtggtggtcggcgatgggttgaggcagagctgctgggctaacatgccgcaggagcttctccgtgaggtgcttctccgaatcgaggcgtcggaggagaagtggccggcgaggaagagtgtggtggcgtgtgccggagtttgccggagctggagggagatcaccaaggacatcgttaagaaacctgaattttcatccaagttaaccttccccatctctgttaagcagcctggtccaagggagaatctcctccagtgctttataagccgcaaccggaccacccaaacatattatttgtatctcaatttaactagtgcactatgtgatgatggaaagttccttctcgctgcacgcaaatgcagacgtcccacctgcacagattatatcatctctttacatgcagatgatatgtcaaggggaagcaacgcctatgttgggaaactcagatcaaattttctgggaaccaagttcacaatctatgatggccagccacctcatgctggggcaaagattacaaaaagtcgctcgactagactggtgaatctaaaacaagtttcacccaaggtcccaacaggaaactatccaatagctcacatctcatacgaattgaatgtgctaggttccagggggcctaggcgaatgcattgtgtcatggattccattccgacctctgcaattgaaccaggaggggtagcccctacacagaccgagttttctcttaacaacgtagatatgttcccctcattcccatttttccggtcgaagtcaagtcgtgctgaaaactctttatctggacctttggctgataaaaaagacgggacactcgtgttgaaaaacaagtctcccaggtggcatgagcagctgcagtgttggtgcttaaactttcatggacgggtgacagttgcctcggtgaaaaactttcagctggtagcttctgcggaaaatggacctgctggaccagaacatgataagattatcctacaatttgggaaaattgggaaggatttgtttacaatggattaccggtaccctatctcagcatttcaggcttttgcaatctgcctcagcagctttgataccaagattgcttgtgaatgacgtgtatagacagcttcaatccacaatgatattgctgtttctctaaggctggtagaaaaccatggtttgaaggtcggatgtcatgtcgggaagcaatcttggaaaatgcttgggaaggtggattgatggtgtgaactgaatctgacaaagacagtgttgcacattgagtgttttagttagtttctgcaatcatgattcatccattctgggaagatccttgaaatacttgaaacatcttttatcccctcttcttcccaatttgtttattctggtcaccttgtacataaatactctcacattgtttatcttctctgcttttaacatttgtatgttttcaatgttcaactttggacagcctcaacattcagtagtgacatgctttatccattcatgagaacataataatgttaatacatgcgatgaaatgaacacaagctcagaatcttgttcaacat

SEQ ID NO: 2893 - DNA, 1511 bp, Manihot esculenta
gaaaaaaacaatgtctgcaattaggagtatgataatccggtcgaggtcccaccgggtggtgcgggacgggccggcgtcggagccggaggattggcatggaggggatacgtcttgctgggcaaacatgccacaggaactcttaagagaggttcttttgagaatagaagcatcagaaagcagttggccttccagaaaaagcgtggtggcttgtgctggtgtttgcaggacctggagacatatcactaaggatttagtcaaagtccctgaattttccggcaggctcaccttccccatctccgtcaagcagcctggtccaagggattttctcctgcaatgctttataaggcggtgtcggtccactcagatgtactatctttacctcagtttaactaatgcactaactgatgatggaaaattccttcttgctgcacgcaaatgtagacgccccaccttcacagattatatcatctctctagatgctgacaatatgtcaaaggggagtagcacttatgttgggaagctaagatcaaattttctgggaaccaagttcacagtctttgacggacagctccctcatgctggggcaaagatggcaaaaagtcgctccactaggctagtaaatacgaaacaagtttctcctagggtccctgctgggaactatcctgtagcacacatctcatatgaattgaatgtgttgggttccaggggtccaaggaaaatgcagtgtactatggatgctatccctgccacttctattgaacctggtggagtggcccccacacagactgaattttctcatcacagtgtagatttctttccatcactccctttcttcctttcaaaatcaaatcgtgcagagaaatttctatcaggacctttgtccagtcagaaagatggagcattggtattgaaaaacaaggctccaaggtggcatgagcagctccaatgttggtgtttgaacttccatgggcgagtgacagttgcttcagtgaaaaactttcagctggttgcttcccctgaaaatggtcctgcgggtccagaacatgagaagatcatccttcaatttgggaaagtggggaaggatttgtttaccatggattaccggtacccaatctctgctttccaagcatttgcaatttgcctcagcagctttgacaccaagattgcttgtgaatgataattgaacaggtgcgaagtttcaaggttcaaggtcccagttgtgatgcgattgaaagagactgtagcttgttctgtaagattagattgcaaatgaaagatttttgctaatgaaatgggaagactgcagcttgttcgagattttgaatgtgtggattttgaaatcagtcggtcagtcggttgaattgcagatcctggactctttttttcttctttttttgaatatgtagatagtggtgaagcttagaatgttggcaattcatccgcagttgccgtacatttttctttgtatagaataataaaattgtacaagtatctgcattttttattctctc

SEQ ID NO: 2894 - DNA, 3170 bp, Glycine max
ttccaaactaactaatctctctatcttcttctcttcgcgtagcgcgtcgtcccccgcaacgacgtcgtttcatggttacgttattgttgttgtgctgattctctctccgaaaatcttctgagggcttctcggcgatgagtggagtaatacattctctggtgtttgattccgcgtttccatttttcaatttctctgtctcgcatgtaagaaatgtttgattggaacgacgaagagctcgctaacatagtatggggtgaggcgggtgagagtgatgatcatattgtgccttatccggaggcaagtgaagatcttaatgacaagaaagaatggaatcaggaagcttctgctactaaactgattgagcagaggagaatagaggctaaaactgattttcatcaaggaaagctaggaagcagttccaaacttgatattattgagggatcttctgcctcagaatctggcacaaagtcatggcctgacttatctttatccaatgcagctaaaactgatcagggttccctgggtgcagaagtatctaaaaatttagaagagactacccagcttgaaaaggatgtagaaaagcaaggtgattttgtcaactatgcctgggataacataggaagctttgatgatcttgatcgaattttcagcaatgatgaccctatatttggccatgtaagtcttgagaattctgatgagctgtggtcttccaaagacgtgagtaacagtgcagtacccatactcttggaagctccaaacccaacaagtgctttaagcaacagatctgagcctttggaaattaaagcagaatatgttcaacagaatgatcaatcattttcccctagatttaagaagattggcaattcttcatctcatgatattgcgaatgctcctgcaaacacattcaatgtaggatatgatagagatagaattgccccagctgataaggagcaacaggattttgggcaaaataatcagttgaaagctcggaaaaaatcacaaggtaaacaagaggtaaaagcattgcaggagttttatggtagctggtctccttcatcaactacatgtggacaatttcagaatcagcagtcttcagtcatacagtcttctccctcttcaattcttgggaaacggaaccagcttcaaggacctgagacactataccaggacatcagaaatacatatgtgacatcctctgcatatgagaaccttacaaatacatattcttctatgtcaacgctaccacaagcacagtcaggagttcttatgcgacagcctctgctttctgggtatgaagcatctcttggtgttatgaatcctgtgagcaagtctgtggacttagttaagcctcttacaatgactccccaggaaaaaattgaaaaattgaggaggcggcagcaaatgcaagcaatgcttgctattcagaagcaacagcaagaattcagccatcaagttcctagctctaataaatcaatgaatgaaaaatgtgccatagaaatgcatagtcaactttgtgatggggctgatcctgaaattgaagatttaagaacaactctagatccaccaactgagcaagatgattctaatacaatctctctggcaattgatgatctttttgttgaagacaccatactgtacatgcttcaggatgttatatcaaagttagatgtcaacataagactctgcattagagatagcttgttccggttggctcaaagtgctatgcaaaggaattatgctagtgatacaagcagtacaaacaacagtagcagagaagaacttaaagttgctgcaagagaagaaagaagtagccaaaacagatatgctaggattgctgatgttgaaaccaagacaaatcccatcgatcgaactgtagctcatttgctctttcataggcctttggatttaactgggaattatcctgataagcttgagtcacctatttctgctaagatacaatatgaaagcaaagaagctaacctcgagaagtttcctatgggatgcttgccagatgaggacatgaaaagtaatcaacaaatttctccccaagtgcttgaggcccagcctcaggaccaatttaaaaacagtcattgcagagactcctcagagaatgcttctaacaatgatctagctgatgctggagatcaggtgcttgaagcctctcaatgaagaaaaaggttccccagaaattggagatatgcaaatgttctctgttattgtcagctgtctggatcataatcaaggcaaccgttaaagtctatcatcatataatcctgaacagctgtttcgcatgtgcatgttatcattaatatttatgtttcgtctgtcaaaatcttgacaatatatgtatctcagcatatgaacttactcaacttggtcagtgctgacttatgttaataattacttcagacttgtgtagtagtaaatgctcctaatgtcaaagactacgtcagatttgtgtagtagtaatgccactcatgtcaaatagtcaagtcttcacccaactggtttggatgaagcttaaagttggtgttagatttctgtattatgtaactcgttttagttgccccacatcaatagctaaacctgttgactgtcattgagattgagtcttgatatcaaattatggtttttattaggtttatgtatgtttctggtttgaccggttggtcatggattcaaatccagaaacatctttgcatatgcaagggtatgactgtataatggcgtccggatccgctccatttccaatttactgaatcctgtgtgttaaagcttttaaacggttgtgattttgtttacttagttcaatttttttatagataaaggctgaaatgcgtgagaacaacatgcaaaatgattctcgaagcaatgacactgccacactggtgcccttgtcacactaaccccgaccaaggttgcagtgcaaaaccatctttgcctccaccaagtcgccgtccctcgccactgctggaggccaaacatccaacccaatttcccatctctctccgctcaacaattcacaactttatgatgttcgagacttgtaaggatgaagcaagtggtgctccttgttctgtgctttgttctcatctttggttttattttttccattgaacgaatgaatgtaaataatttcagattataaaatttgaaattcgtttatgtta

SEQ ID NO: 2895 - DNA, 2666 bp, Glycine max
gttacacgaattcgatcctctaacctccttcttcgccctccccctatttcaattaaacctctatattcccccaattttctcattctccatcgccacagacttcgctgcgtcgcagaatcctccaataatcaccaccacaatcatcatcacgaccatgaccacggtcacaaccaccaccatcaccatcaccatcaccactcacacggcatccacggcgctgatctcaccggccctcaaaaagctgtcatcgcgttcgcgaaagccaccagatggatggacctggcagacatcctgagggagcacctgcatctatgctgcttctccaccgctctattcgtagccgccgcaatttgccctcacaccttgcctaagccacttatcaagcctcttcaaaactctctcatcttcgtcgcctttcctctggttggggtttctgcatcacttgacgctctccttgaaatcagcagtggaaaggtgaacatccatgtgctaatggcaatggcagcctttgcgtcgatattcatgggaaactctttggaaggaggcttgcttcttgccatgtttaacctcgcgcatatcgccgaagagtatttcaccagccggtcgatggttgatgttagggaattgaaggaaaataatccagatttcgcccttgttctggataccaatgatgataaactccccaatacgtttgacttggcgtacaagagggttcccgtgcatgatgtaactgtaggatcatatattctggttggcgctggtgagtctgtgccagtagattgtgaagtattccaaggaagtgccacaattaccaccgagcacttgacaggggaagtcaaacctttggaagccaaagttggagatagaattcctggtggtgcaaggaacttagatgggaggataatcgtggaggtaaccaaaacttggaaggaatcaactctcagcagaattgttcagttgactgaagaagcacagtcaaataaacctaaacttcaaaggtggcttgatgaatttggtgaacgctatagcaaagttgttgtggtgttatcaattgctattgctgttattgggccatttttatttaagtggccattcattagtacatctgcttgcagaggttcaatttacagagccttagggcttatggtggcagcatccccttgtgccttggctgtggccccattggcatatgctatagcaatcagctcctgtgccagaaaggggatattactcaaaggtgggcatgttctggatgctctagctacttgtcatactgttgcctttgacaaaacagggacattgacaactggtggactcgtattcaaggcaattgagcccatttatggtcatcatgttagaaacaataaatcaaatgttccttcctgttgcattcccacctgtgaaaaagaagctcttgctgttgctgcagctatggaaaagggtactactcaccctattggaagggctgtggttgaccatagtgaaggcaaagacctcccatctatttctgttgaaagtttcgaatactttcctggtagaggccttactgctactgttaacagcattgagtcaggaactggaggtgctaaactattgaaagcatcacttggatctatagatttcatcacctctttttgtcaatctgaagtcgagtcagaaaagatcaaggaagctgttaatacatcttcttatggaagtgaatatgttcatgctgccctttcagttaatcagaagctggtaacattgattcatctagaggataggcctcgtcctggggtttctaatgttattcaagaattgcaagatgaagcaaagtttcgtgtgatgatgttaactggtgatcatgagtctagtgcaaggagagttgcaagtgctgtgggcatcaatgagtttcattgcaacctgaagcctgaagacaagctgagtcatgtaaaggatatctcaagagatatggggggaggcttaattatggttggtgaaggcatcaatgatgccccagcactagctgctgcaactgttgggatagttcttgctcaccgtgctagtgcaactgccatagctgttgcagatgtattgttgcttagagaaaacatttctgcagtgccattttgtattgccaagtctcgtcaaacaacttcactgattaaacaaaatgtggctttagcattgacgtccattgtcatggcttcccttccatcagttttgggatttctgccattgtggttaacggttcttttacatgaaggtggaaccttgcttgtctgtcttaattctgtacgtgctctgaatgaaccatcttggtcctggaagcatgatatatcacatttgattagcgagattaaatctagactcctctctctcaagacaaatatcacgggctcaaacagtatcatgacggcgaatttgtaacgtagtgttgtagtgtattgcatatttatagtgtattgagaaaaatgtcaatatcccttttcttgtatatctgtaggcttctttttcactccagagaattgaacattccattctattggaggttagtttccctttaatcctcgttttcccattcaaatggaataagaaaaatgacattaagggaagaatatgcatatgcatttcggatttggcatttacaatataatgatataatgtttatatgacttaaatttaaa

SEQ ID NO: 2896 - DNA, 665 bp, Glycyrrhiza uralensis
atactctttcacagttcgtacacaccaccacacccctgtttcccctcttccatcaacaatggtgcaaaggctcacatatcgtaagcggcacagttatgccaccaaatccaaccagcaccgggttgttaagacccctggtgggaagttggtgtaccagaccactaagaagagagcaagcggacctaagtgccctgtcactgggaagaggatccaagggattccacacttaagacctgctgaatacaagaggtctagattgcctcggaaccgccggacagtaaaccgggcatatggaggtgtattatctggaggagctgttagagaaaggattatccgggctttccttgttgaagagcaaaaaattgtaaagaaggtactgaagatccagaaggcaaaagaaaagcaagcatcaaagagttaagcccagtggatcatggatggaaaaaaaaaggaaaaaaatccatttcgttaaaatttgtgctcgagaagttttgactttaaatggtgttaattctgaatgtggaacttaattcgaaattgattttatggatttttgtgcttttctttgtagtttagattttgttacaagtaatcggattctgttgttccagtgcgtatgttaaaagcaaaaacctcctctaaagtgaatttgcttctgaactttt

SEQ ID NO: 2897 - DNA, 573 bp, Cyamopsis tetragonoloba
cctttttcgtattcctgtttgtaggtatcaatcccattaaccctaacatggtgcagaggctcacttatcgcaagcgtcacagctacgccactaaatccaaccagcacagggttgtcaaaacccctggtgggaagttggtctaccaaagcactaagaagagggcaagcggacccaagtgtcctgttactggcaagaggatccaagggattccacacttgagacctgcagaatacaagaggtctagattgcctaggaaccgccgaacagtaaaccgggcctatggaggtgtattatctggaggagctgtcagagaaaggatcatccgtgccttccttgttgaagagcaaaaaattgttaagaaggtattgaagatccagaaggcaaaagaaaagcaagcatctaagagttaagctgagtgattcatggatggaatagaaatcgttttgctatatttgtgctgaaagttttgactttgaatgttgttaactatgaatgtcgaacttgattttatgaattattgtgcttttttggtagtttcggtcttattaaatgttaatggattatgtcctcgtg

SEQ ID NO: 2898 - DNA, 699 bp, Glycyrrhiza uralensis
gcctatcctctgaaaagcctagcaaacggagacgcaggtgcaaagcttaatcgatcgaagaagatggtgcagcgtctcacctaccgcaagcgtcacagctatgctaccaaatccaaccagcacagggttgtgaagacccctggtggaaagctcgtttatcagaccactaagaagagggctagcggacccaagtgccccgttactggcaagagaattcaggggattccacacttgaggcctgcagagtacaagagatcaaggttgcctagaaaccgtaggactgtgaaccgtgcatatggtggagttttgtctggaggtgctgtcagggaaaggattatccgggctttcttggttgaagagcaaaaaattgtgaagaaggtcttgaaaattcagaaggcaaaagaaaagcaggcctcgaaggcatgaatttgggcagcagaatgagagaaagatctttttggaggacttttaggtttgggtgattatagtaaatcacaaattttattagagttgtgcctgtgttaattgtgcttaattgtcttgtttgaactcattctagagcaaccgttaactttgtcgacaattccattgtgatacagttttgtttgtctcaattttctcttgacggtttattggtttcatcttggtttctttacgttatagcagtacttttattttcaatgcaattggtatatctct

SEQ ID NO: 2899 - DNA, 995 bp, Quercus alba
gggcttcttagacccaaaaccctatttatacactttcttcaatcatttataacccttttgtttttcactctcacacaaaaacacacacccatctgagacagcctcaaacggagagtacctgaaaatggtgcagcggctcacctatcgtaagcgccacagctacgccaccaagtccaaccagcaccgggtcgtcaagacccctggtgggaagttggtgtatcagaccactaagaagagggcaagtggacccaagtgccctgtcactggcaagagaatccaagggattcctcacttgagacctgctgaatacaaaaggtctagattgcctagaaaccgaaggactgtgaatcgggcatatggtggtgtgctgtctggaggtgctgttagggagaggataatccgagccttcttggttgaagagcaaaagattgtgaaaaaggttttgaagattcaaaaggcgaaggaaaagatagcctcaaagagttaaaaatgagtggataaagcaatagttacttgagttatgaaatatgcttttgagagtctagagaaattttgaattaggttggcgttgatgaaatgttaaacgatatttgaatggtttttaatttttgtttgtttgctacctgactacttatttgtttactctgatgacaaattatttacctggttcttcttttatgataatatttgcatcgatggcattgccttggaatttgatttttctagtaatattgctggatttgatattcatctctgtttgattttgtttttgaagtcaatcggctgttgtcatctgctgccagaattacatttggtctcccaaatggccaaatcttttgctgttctaaatgccattagcttgccattagttggttggtgattctttttaattttaccctagcttacatgcaccgtgtaccgacttctaggatgccatgtgctttgtgcttatcatttctggttgattggggtgcgtgttctttttcacagtgaaa

SEQ ID NO: 2900 - DNA, 563 bp, Cajanus cajan
catttcgtgattctagggtttcactcccatcagcaacaacgatggttcagaggctcacttaccggaagcgccatagctatgctaccaaatcgaaccaacaccgggttgttaagacccctggtgggaagttggtgtaccagaccactaagaagagggcaagcggacccaaatgccctgtcactggaaagaggatccaagggatcccacacttgagacctgctgagtacaagaggtccagattgcctaggaaccgcaggacagtaaaccgggcctatggaggtgtattatctggtggagctgttagagaaaggattatccgtgctttccttgttgaagagcaaaaaattgtgaagaaggtattgaagatccagaaggcaaaggacaagcaagcatcgaagagttaagctgattgattcatggatgataaaaaaaatcttatctttaaaatttgtgctcaagaattttgactttcaatggtgttaagtatgaatgtggaacttaatttgaaatttattttatgattctgtgcttttttggtcttttatatttagaatatgaaatga

SEQ ID NO: 2901 - DNA, 663 bp, Cucurbita pepo
acccagagggaggaagagaggaaaatcgtccaagatggttcagcgtcttacataccgcaagcgccatagctatgctaccaagtctaaccagcaccgtgtcgtcaaaaccccaggtgggaagcttgtgtaccagactaccaagaaaagagctagtggaccgaaatgcccggtcaccggcaaaaggattcagggaattcctcacttgaggccagctgagtataagaggtctagattagctaggaacaggaggactgtgaatcgtgcatatggtggcgttttatccggcggtgccgtcagagagaggatcattcgtgcctttttggtggaagagcaaaagattgtgaagaaggtattgaagatccagaaggccaaggaaaagctagcatcaaagagctaaattagttgtgttggtggtttagaaaattgaagaaattttgactttctttgacttgatgctgaagtttatcgattattatttaaagttggttttgggaggaaccagattttagctccggagttcagttcttctatgatatgtttgcattttatactagttcttatgatagcatttcttcaaccaagttcttataatccagggtgtttggtgtattgtgtcccttccaattcaaaggtttcctcgaatcaatttctgtgctttacttc

SEQ ID NO: 2902 - DNA, 642 bp, Cucurbita pepo
aggacaggacacccagagggaggaagagaggaaaatcgtccaagatggttcagcgtcttacgtaccgcaagcgccatagctatgctaccaagtctaaccagcaccgtgtcgtcaaaaccccaggcgggaagcttgtgtaccagaccaccaagaaaagagctagtggaccgaaatgcccggtcaccggcaaaaggattcagggaattcctcacttgaggccagctgagtataagaggtctagactagctaggaacaggaggactgtgaatcgtgcatatggtggcgttttatccggcggtgccgtcagagagaggatcattcgtgcctttttggtggaagagcaaaagattgtgaagaaagtattgaagatccagaaggccaaggaaaagcttgcatcaaagagctaaattagttgtgttggtggtttagaaaattgaagaaattttgactttctttgactttctttgacttgatgctgaagtttatcgattagtatttaaagttggttttgggaggaaccagattttagctccggagttcagttcttctatgatatgtttgcattttatactagttcttataatagcatttcttcaaccaagttcttataatccagggtgtttggtgtattgtgtcccttcc

SEQ ID NO: 2903 - DNA, 831 bp, Eucalyptus grandis
gcgaaaggctctcccatatatctgcaaaccctagcggccagtgcgaccccctctctgctgctgcaactggaagccgagctctctgcaaaaccctagaggtaataaggaggaggaggaaagcagaagaaaaatggtgcagcgtctcacgtatcggaagcggcacagctacgccaccaagtcgaaccagcaccgggtcgtcaaaaccccgggtgggaagctagtgtatcagaccaccaagaagagagccagtggccccaaatgtcccgtcaccggcaagaggatccaagggattcctcatttgagaccagctgaatacaagaggtcgagattatccagaaatcgccgtaccgtgaaccgtgcctatggtggtgtattgtcaggaggagctgttcgtgagaggattatccgggcctttttggtggaagagcaaaagattgtgaagaaggtgttgaagattcagaaggctaaggaaaagctagcctccaagagctaagatttgtaaaaccacagtgagtctggcgctttgagagtaattttggttttgaattcttggtagtaatatgagttgctgggttaaaatttgcttcttgggcttcttggaacatcatatgtagcgcacctttcatcactttgtcgacaagtcaactacttaaattttgtcttttccatttgaatgcttgctgatggtactgaaaacatcatttatgatattcatgatgtaatattagatccacgatttgacaatattggttctgtttgagcttggatgtccttgagggtgggtatcttccaggtcatttgtgcaatcagttcataatatattatcaacca

SEQ ID NO: 2904 - DNA, 824 bp, Theobroma cacao
agtttttaacttgccatcttcgctgcaaacaaaagcccttccagtctccgcctccatccacagagagagagagagagagagagagagagggagagaatcataaaagtgggaaaaaatggttcaacggctgacataccgcacgcggcacagctacgctaccaagtccaaccagcaccgtgtcgtcaaaactcctggtgggaaacttgtgtaccagaccaccaagaagagagctagcggacccaaatgtcctgttactggcaaaagaatccaagggattcctcacttgagacctgccgaatacaagaggtctaggttacccaggaataggaggactgtgaaccgtgcctatggtggcgtgctatctggtggtgcagtcagggagaggatcatacgggcctttttggttgaagagcagaagattgtgaagaaggttttgaagattcagaagaccaaggaaaagcaggcatcaaagagctaaaagatgagacagaagctttttcaattttactttgtttcaattaaattttgacttgaagagatgatgattgtgcgcattattattgcgagttgtttgtttaaacgtgaatgagcatttaattttttgttggaatctttaccctctactctctggatcgctccaactctggtgccatacactcatgcccatcaagataagttatttgcatgccatattaattagtaactagtctgattgctgcaattgactgaaattactggaggggtggctttctttttcctctttttctagagtttggtttttcttttgttttatattttggttggaatgaagtaaagataaccaa

SEQ ID NO: 2905 - DNA, 639 bp, Castanea mollissima
caaaaacacatacccatctgagacagcctcaagcagagagtgcctgaaaatggtgcagcggctcacctatcgtaagcgccacagctacgccaccaagtccaaccagcaccgggtcgtcaagacccctggtgggaagttggtgtatcagaccactaagaagagggcaagtggacccaagtgccctgtcactggcaagagaatccaagggattcctcacttgagacctgctgaatacaaaaggtctagattgcctagaaaccgaaggactgtgaatcgggcatatggtggtgtgctctctggtagtgcagttagggagaggataatccgagccttcttggttgaagagcaaaagattgtgaaaaaggttttgaagattcaaaaggcaaaggaaaagatagcctcaaagagttaaaatgagtggatgataaagcaatagttacttgagttatgaaatatgcttttgagagtctagagaaattttgaattaggttggtgttgatgaaatgttaaacgatatttgaatgctttttaatttttgcttgtttgctacctgactacttatttgtttactctgatgacaaattatttatctggttcttctttaatgataatatttgcattgatggcattgccttggaa

SEQ ID NO: 2906 - DNA, 646 bp, Castanea mollissima
caaagtctcaacaattccaaagcctcccctctctaattcccccaaaaccctaagagagagagagagcctcagagcttcgcaaaaatggtgcagcgtctcacatatcgcaagcggcacagctacgccaccaaatccaatcaacaccgcgtcgtcaaaacccctggagggaagctagtgtaccagaccacaaagaagagggcaagtggacccaagtgtcctgtaactggcaagaggatccaagggattcctcatttgagacctgctgaatataagaggtctaggttacctaggaaccggaggactgtcaacagggcttatggtggtgtactctctggaagtgctgtcagggaaaggatcattcgtgcctttttggtggaagagcaaaaaattgtgaaaaaggtcttgaagattcagaagaccaaggaaaagcaagcctcaaagagttaagttcaagatcttagtgagcttctagcagctttagtgtaattttggctattgcagcgcgtggagaaacatggaaagtaatttgaggttttctgatttggatccgtcttttgttttggtttgaaccatgtatttgttgacaaatccattatgctaagattttgcttgtttctataatttgtctcttggtaaatatattgtt

SEQ ID NO: 2907 - DNA, 642 bp, Cucumis sativus
cctccctcccaactctatttggcagtcccctccggtctcccgtcttcatttctcctcaccgttgcctcgttcgttgccatccctagtcatcttgttgtttttatttcctccttcgttgttgtctctgcagcagcattcaagatggttcagcgtcttacataccgcaagcgccatagctatgctaccaagtctaaccagcaccgtgttgtcaaaacccctggtgggaagcttgtgtatcagactaccaagaaaagagctagcggacccaaatgtccggttaccggcaaaaggattcaggggattcctcacttgaggccagctgaatataagaggtctagactggctaggaaccgtaggaccgtgaatcgtgcatacggtggtgttttatctggtggtgctgtgagggagaggatcatccgggcctttttggtggaagagcagaagattgtcaagaaggtattgaagattcagaaggctaaggaaaagctggcatcaaagagctaaattaattatgtttaaattttgacttttttgtggcgtgatgctgaattttagcaattactacttaaagtttgtttgtggaagaacgaaattttaggccaggagttcacttctatgatatgatggcatttcttcaaccaa

SEQ ID NO: 2908 - DNA, 776 bp, Eucalyptus grandis
  misc_feature (702)..(702): n is a, c, g, or t
  misc_feature (704)..(705): n is a, c, g, or t
  misc_feature (708)..(708): n is a, c, g, or t
tggcaatagacagtttcggccggggctctgctgctgcaactggaagccgagctctctgcaaaaccctagaggtaataaggaggaggaggaggaaagcagaagaaaaatggtgcagcgtctcacgtatcggaagcggcacagctacgccaccaagtcgaaccagcaccgggtcgtcaaaaccccgggtgggaagctagtgtatcagaccaccaagaagagagccagtggccccaaatgtcccgtcaccggcaagaggatccaagggattcctcatttgagaccagctgaatacaagaggtcgagattatccagaaatcgccgtaccgtgaaccgtgcctatggtggtgtattgtcaggaggagctgttcgtgagaggattatccgggcctttttggtggaagagcaaaagattgtgaagaaggtgttgaagattcagaaggctaaggaaaagctagcctccaagagctaagatttgtaaaaccacagtgagtctggcgctttgagagtaattttggttttgaattcttggtagtaatatgagttgctgggttaaaatttgcttcttgggcttcttggaacatcatatgtagcgcacctttcatcactttgtcgacaagtcaactacttaaattttgtcttttccatttgaatgcttgctgatggtactgaaaacatcatttatgatattcatgatgtaatatnanntcnaagcacacagctcaaacatacatggccgcccataataaactccaattagctccaaaatagaatctaat

SEQ ID NO: 2909 - DNA, 827 bp, Vitis vinifera
attcatcacggccatcggatctagggttttggatcccaaaaccctatatattcatttctctcccattgcgcaaaaccccttttgtttcggtcgtcttcagcagagggaggtgagagtgcttgaaaatggtccagcgtctcacataccgcaaacggcatagctatgccaccaaatctaaccagcacagggtcgtcaaaacccctggaggaaagttggtgtatcagagcaccaagaagagggccaatggtcccaaatgcccagttactgggaagagaatccaagggattcctcacctgagacctgctgaatacaagaggtctagattgccaaggaaccgtaggactgtgaaccgggcctatggaggtgttttgtcgggtggtgctgtcagggagaggataattcgagctttcttggtggaggagcaaaagattgtgaaaaaggtgttgaagatccagaaggcaaaggaaaagcaagcctcaaagagttgaaaaatgagagagtgattaagcgaaaaggttttgagttttattatgcttgagtgaaattttggcttaggtggtggtggtgacgaaaggtggaaaataccataatgaggtctgtctctgaatttgaaagacatcttagtttgttttgagaatgattattaggtttccctatttgttcacttcaatgacaatttgatttggaatgtatcgttttatgatatattatgctttgactgccctttaatctttattcttctattgaattttggtatacattcaccctgaatgtctcaagctggaggcaaattccctggtacaatggccaagaaaattaggctgctt

SEQ ID NO: 2910 - DNA, 695 bp, Vitis vinifera
accccttttgtttcggtcgtcttcagcagagggaggtgagagtgcttgaaaatggtccagcgtctcacataccgcaaacggcatagctatgccaccaaatctaaccagcacagggtcgtcaaaacccctggaggaaagttggtgtatcagagcaccaagaagagggccaatggtcccaaatgcccagttactgggaagagaatccaagggattcctcacctgagacctgctgaatacaagaggtctagattgccaaggaaccgtaggactgtgaaccgggcctatggaggtgttttgtcgggtggtgctgtcagggagaggataattcgagctttcttggtggaggagcaaaagattgtgaaaaaggtgttgaagatccagaaggcaaaggaaaagcaagcctcaaagagttgaaaaatgagagagtgattaagcgaaaaggttttgagttttattatgcttgagtgaaattttggcttaggtggtggtggtgacgaaaggtggaaaataccataatgaggtctgtctctgaatttgaaagacatcttagtttgttttgagaatgattattaggtttccctatttgttcacttcaatgacaatttgatttggaatgtatcgttttatgatatattatgctttgactgccctttaatctttattcttctattgaattttggtatacattcaccctg

SEQ ID NO: 2911 - DNA, 900 bp, Vitis vinifera
tgacaatcgtcggatctagggcacccactcttttatattgtctctaaaccataagcttcacttcagccctatctcaaaaccctaaccctgggagagaggaagagagagctcgaagatggtgcaacgtcttacctatcgcaagcggcacagctatgccactaagtccaaccagcacagggtcgtcaaaaccccaggtggaaagctggtgtatcagagcaccaagaagagggcaaacggtcctaagtgtcctgtaactggaaagaggattcaagggattcctcacctaagacctgcagaatacaagaggtctagattacctaggaaccgtaggactgtgaaccgtgcttatgggggtgtgttgtctggaggtgctgtgagggaaaggatcatcagagccttcttagtggaggagcagaaaattgtgaagaaggttttgaagattcagaaggctaaggaaaagcaagcctcaaagagctgaggtgaaaagtaagagtgacatggtttgagagtgtttttgctatgcccacagtattgaatcatggaaatgtaatgtcaggtggtcaaatttgaatttgtatttttctttggttgattaatctctgatgactaatacttcttttactttgccgacaaatccaccaggctaggtttggttttgttttgttttgattttttgcctcctaatatttgtttgttagggttgtcataaaactttattttaaattccttgtaacgttagagtagcggtttttcttttacttgtttctgtgagtagttgggttttggatatcttgagcctcttaaatgccaaatgctgctctggaagatcaaagcataagttttaggagtgtttagatagaaccatctaccatggaccctacactttcaaacacgatttat

SEQ ID NO: 2912 - DNA, 761 bp, Vitis vinifera
cactcttttatattgtctctaaaccataagcttcacttcagccctatctcaaaaccctaaccctgggagagaggaagagagagctcgaagatggtgcaacgtcttacctatcgcaagcggcacagctatgccactaagtccaaccagcacagggtcgtcaaaaccccaggtggaaagctggtgtatcagagcaccaagaagagggcaaacggtcctaagtgtcctgtaactggaaagaggattcaagggattcctcacctaagacctgcagaatacaagaggtctagattacctaggaaccgtaggactgtgaaccgtgcttatgggggtgtgttgtctggaggtgctgtgagggaaaggatcatcagagccttcttagtggaggagcagaaaattgtgaagaaggttttgaagattcagaaggctaaggaaaagcaagcctcaaagagctgaggtgaaaagtaagagtgacatggtttgagagtgtttttgctatgcccacagtattgaatcatggaaatgtaatgtcaggtggtcaaatttgaatttgtatttttctttggttgattaatctctgatgactaatacttcttttactttgccgacaaatccaccaggctaggtttggttttgttttgttttgattttttgcctcctaatatttgtttgttagggttgtcataaaactttattttgaattccttgtaacgttagaatagcggtttttcttttacttgtttctgtgagtagttgggttttgg

SEQ ID NO: 2913 - DNA, 690 bp, Hevea brasiliensis
aaattccaggtgagagagagaagtaaaaaatggttcagagactgacatatcggaaacggcacagttatgccaccaaatcgaaccagcaccgggtcgtcaaaacccctggaggaaaattggtgtaccagactacaaagaagagagctagtggtccgaagtgccctgttactggcaagaggattcaagggattcctcacttgagacctgctgaatataagaggtcaagattggcacgaaacaggagaactgtgaaccgggcttatggtggagtactgtccggtggtgctgttagagaaaggattattcgagcctttttggttgaagaacaaaagattgtgaaaaaggtcttgaagattcaaaaggcaaaggaaaaacaagcctctagaagttaagattgaaatgttcaatgacttggatgatttgtcgaaacagccagtgttgtgatttgtcgagggcattgttcccttgtcatccattttctaagctttatctacaaattatgctgcaattttgtgctgttttattatttatcatttgatgctttcttgaaactctttcttggttgacatgtgtaatgacagattagttggtaattgcagttactgggttatttacatgcaagtttaagtcagaatgtctggttatctttgatgagcttgcatgggtgacattcttgattcaacaacttga

SEQ ID NO: 2914 - DNA, 649 bp, Lotus japonicus
gggcaaaaccctagactttgtcggagggaaaagatggtgcaacgcctcacctatcgcaagcggcacagctatgccaccaaatccaaccagcacagggtcgtcaaaacccccggtgggaagctcgtttaccagaccaccaagaagagggccagtggacccaagtgccctgtcactggaaagaggattcaggggatcccgcatctgaggcctacagaatacaagagatcaaggttacccagaaataggaggactgtgaaccgtgcatatggtggtgttttatctggaggagctgttagagaaagaatcattcgagctttcttggttgaagagcaaaagattgtgaaaaaggtgttgaaaatccaaaaagccaaggaaaagcaagcttcaaaagcctgagtttcatgaaaaaagattacaatctttatggagaaattttaggttgagtcagcatgaaatttattagctgctccatgttaattttatgcttatttggcttctttgacctcattctagtgcaattgttaactttgctgacaactccattatgataccgttttgttcagagttctcttaatggattactgattttctctattttttctgttagtatatatttgaacttcgttggtaatgttattgaagttgtgat

SEQ ID NO: 2915 - DNA, 620 bp, Momordica charantia
cgcagagtcgccattacgccgggggttccgactctttcgactcttctgcaacagctctggagggtaccgattccgacgagcgagaagatggtgcagcggctcacttaccgtaagcggcacagctatgccaccaagtcgaaccagcaccgcgtcgtcaaaaccccgggggggaagcttgtgtaccagaccacgaagaagagggccagtggtcctaaatgccctgtcactggaaagagaattcaagggattcctcacttgaggcctgctgaatacaagaggtctaggcttgctaggaaccgtagaaccgtaaaccgtgcctatggtggtgtactatctggaggtgctgtaagggagaggattataagagcttttttggttgaagagcaaaagattgtgaagaaggtcttgaagatccagaaagcaaaggaaaaacttgcctccaagagctagaacaaccggtttaaaagcatgaaaccctttccattttatatatgctgagtgaaaattttgacttggatcaatgacttgttaatttaaatgattttggaattagcattgttttctttcagttgtattagtcgtttcaagtttcttctacatgaatattaagtttgccgttc

SEQ ID NO: 2916 - DNA, 820 bp, Quercus alba
ctctaatcccccaaaaccctaagagagagagagagagatagagagctcagagcttcgcaaaaatggtgcagcgtctcacataccgcaagcggcacagctacgccaccaaatccaatcaacaccgcgtcgtcaaaacccctggagggaagctagtgtaccagaccacaaagaagagggcaagtggacccaagtgtcctgtaactggcaagaggatccaagggattcctcatttgagacctgctgaatataagaggtctaggttacctaggaatcggaggactgttaacagggcttatggtggagtactctctggaagtgctgtcagggaaaggatcattcgtgcctttttggtggaagagcaaaaaattgtgaaaaaggtcttgaagattcagaagaccaaggaaaagcaagcctcaaagagttaagttcaagatcttagcgagcttctagcagctttagtgtaattttggctattgcagcgcgtggagaaacatggaaagtaatttgaggttttctgatttggatccgtcttttgttttggtttgaaccatgtatttgttgacaaatccattatgctaagattttgcttgtttctataatttgtctcttggtaaatatattgttgctatgtgatgtctttttagctttctattgcaagcattttttttaaagaaagtctggctcagatgcttcataggcattgatttgccatttacagttaatgtttttcgatcacctctgcctgatgttttccaatatatgatgccccaaccctaactcccaaatgctctctccgcccactcaaacgttctacagtgct

SEQ ID NO: 2917 - DNA, 671 bp, Arachis hypogaea
cagagagggagtgtgtgtgtgaagaacagagtcatcggtgacaatggttcagaggctcacttatcgtaagcgccatagctatgccaccaaatccaaccagcaccgtgttgtcaaaacccccggtgggaagctggtgtaccagagtacgaagaagagagcaagtggaccaaaatgccctgtcaccggaaagaggatccaagggattccacatctgagacctgctgaatacaagagatctaggttgcctagaaaccgccgcacagtgaaccgtgcctatggaggtgtcttgtctggaggagcagttagagaaaggattatccgtgctttccttgttgaggaacaaaaaattgtgaagaaggtgttgaagatccaaaaggcaaaagaaaagcaagcatcaaggagttaagctgagtggaccatggataaaatattaaaacctcttgaatttctgttaaaattttgacgttggattgtgttactgttaactatgaatgtggaactttatttgaagtttattttatggattcttgtgcgttttgttagttaatttttcagtttcatacattatcaggctaatgcttttcaagtgcatatcttttaaggatccctacatatagaacaattacgtatttgttattttctttgagattgaggtattaattattatacct

SEQ ID NO: 2918 - DNA, 694 bp, Populus trichocarpa
ttttaacagccgtcggatctagggttttgaaagataaaaccctatttagaacattttcccgtctcttgcctctccctcgctccactctacaaagagagacgcaggaagtaaggacaagcaagatggtgcagcgactgacataccggaagcgacatagctacgccaccaaatccaaccagcaccgtgtcgtcaaaacccctggtgggaaattggtgtaccagaccaccaagaaaagagctagtggacctaagtgtcctgtcactggcaagaggattcaagggattcctcacttgagacctgcggaatacaagaggtccagattgtctaggaatcgcaggactgtaaatcgtgcctatggtggtgtcttgtctggaagtgctgtcagggagagaattatccgagctttcttggtagaggagcaaaagattgtgaagaaggttctgaagattcagaaggcaaaggaaaaacaagcttcaaagagttaaaagagaggttcatagagtaatgtgtcctgggtttcaatgtttgagcaaaattttgatgtttttgaggatgatgatttttagcgtgtttgataattatgcttcgacttgccttttattcaatttgactagatagcactgtaagcttcatgttttatgataaccagtgttttaatgatgccttgcctgtagcattcttctacagtaactga

SEQ ID NO: 2919 - DNA, 792 bp, Glycine max
cgcatcttcttccttcctccgaaaaccctaacaacacaggcgcagacgcaaacgcaaacgcaaacgcaaacgcaaacgcagagcgtgatccattgacgaagatggtgcagcgtctcacctaccgcaagcggcacagctatgccaccaagtccaaccaacacagggtcgtcaaaacccctggtgggaagctcgtttatcagactaccaagaagagggccagcggacccaagtgccccgtcactggcaagaggattcaggggattccacacttgaggcctgcagagtacaagaggtcaaggttacccagaaaccgtaggactgtcaaccgtgcatatggtggagttttatctggaagtgccgtcagggagaggattatccgagccttcttagttgaagagcaaaagattgtgaagaaggtcttgaagatccagaaggcaaaggaaaagcaggcctcaaaggcttgaatttgaaaaacacaatgagacacatctttttggaggactgttaggtttgagtggttatagtaaatcacaaattttattagagttgttctcatgttaattgtgcttttattatttggcttgtttgaactctttctagagcaagtgttaaagttgtcgacaatgccattacgatacagttttgtttgtctcattttcttttgatggtttattggtatcatcttgtttctttatattctaatagaactttgtaattccactcgaattgggtatatctcaattctgactgctttactggtggcattctgcaaatattattttttttttgcta

SEQ ID NO: 2920 - DNA, 744 bp, Glycine max
gctttcgccgaaaaccctaacaacacaggcgcagagcgtgatccattgacgaagatggtgcagcgtctcacctaccgcaagaggcacagctatgccaccaaatccaaccaacacagggtcgtcaaaacccctggtgggaagctcgtttatcagaccaccaagaagagggccagcgggcccaagtgccccgtcactggcaagaggattcaggggattccacacttgaggcctgcagagtacaagagatcaaggttacccagaaaccgtaggactgtcaaccgtgcatatggcggagttttgtctggaagtgctgtcagggagaggattatccgagctttcttagttgaagagcaaaagattgtgaagaaggtcttgaagatccagaaggcaaaggaaaagcaagcctcaaaggcttgaatttgaacaacacaatgagacatctttttggaggacttttaggtttgagtggttatagttaatcacaaattttattagagttgtcatgttaattgtcttttattattttgcctgtttgaactctttctagagcaagtgttaactttgtcgacaatgtcattatgatacagttttgtttctcattttcttttgatggtttattggtatcttgtttctatatattctaaatagaactttgtaattccactggaattgggatataactcaattctgactgctttactggtggtattttgcaattaaaatgttttttttggctaactacaa

SEQ ID NO: 2921 - DNA, 598 bp, Citrus clementina
aatcgtgagcgagtgcaaaacctcctctgtttcggctccgtgtctttcaaaaccctaagagtgagagagaaaaatggttcaacggcttacgtaccggaagcggcacagctatgccaccaaatcaaaccagcaccgcgtcgtcaaaacccctggagggaagttggtgtaccagagcacgaagaaaagagctagtggacctaagtgtcctgtgactggcaagagaattcaagggattcctcatttgagacctgctgaatataagaggtccagattgcccagaaacaggaggactgtgaaccgtgcttatggtggagtattgtctggagctgctgtcagggaaagaatcatccgtgcctttttggtggaagagcagaagattgtgaagaaggtcttgaagattcagaaggcaaaagagaagcaagctgctaagagttaagactgaaatatttaatgagtttcgaactaccttttagaatatctgttgttttggatgatgatattgactcatggagaagtaatctaggtttttctttatttgaaattgtaatcccgcacttgctcatatgaactaaattcttaaagcactcagttgataacc

SEQ ID NO: 2922 - DNA, 598 bp, Euphorbia peplus
  misc_feature (7)..(10): n is a, c, g, or t
  misc_feature (13)..(14): n is a, c, g, or t
gggttcnnnnctnncggagaagatggtccagcggctcacttaccgtaagcggcacagctatgccaccaagtccaaccagcaccgcgtcgtcaaaacccccggtggaaagcttgtgtaccagaccacgaagaagagggccagtggtcctaaatgccctgtcactggaaagagaattcaagggattcctcacttgaggcctgctgaatacaagaggtctaggctggctaggaaccgcaggactgtaaaccgcgcttatggtggtgtattgtctggtggtgctgttagagagaggattataagagcctttttggttgaagagcaaaaaattgtgaaaaaggttttgaagatccagaaggcaaaggaaaaactagctgccaagagctagagtggctggtttgaaagtacgaactcgtttccattttatatatgctgagtgaaaattttgacttggatcaatgactttgttaatttaaatcattttggaattagctttgttttcttccagttgcattagttgtttgaagtctctcctactagaatattcagtttatcattcttatttatgctgattttgctacatttattacgtgcacacatc

SEQ ID NO: 2923 - DNA, 491 bp, Flaveria ramosissima
cgatggtgcagcgtctcacataccgcaaacgccatagctatgctaccaaatccaaccaacacagggtcgtcaaaacccctggtgggaagttggtttaccagaccacaaagaagagagctagtggacctaagtgccctgttactggcaagagaattcaagggattcctcacttaaggccagctgaatacaaaaggtctcgattgtctaggaacaggaggactgttaaccgggcatatggtggtgtattgtctgctggtgctgtgagagagaggattattcgtgccttcttggtcgaagaacagaagattgttaagaaggtcttgaaaatccagaaggcaaaagaaaagcaagctggaaagagttaaacagccggtttatcacgaagaaatttttgagtagttactgtgttttcaagtaatttgaattcgacgcaattgttacaagctgtaaactttgcattatttttgtttaagggatggattgattttaaa

SEQ ID NO: 2924 - DNA, 764 bp, Flaveria ramosissima
aacctcctaccgtagcatatatgtctcctctcattaccaaggtgggagattatcttgaagctataaagacttcgttataaatatatcattaaccaacttacacaagcccaacattgtgtttgcaggcccaaagagtgtttaacctagggcaccctttatatacacaaaacattcatcatcttcttcaaaatcgtccttctcgcagtgaaagtgtgaaaccatcagcagatcgccgccgatcgaacaatggttcaacgtctcacctatcgcaaacgccatagctacgccaccaaatcaaaccagcatcgggtcgtcaaaacccctggtggtaagcttgtttatcagaccactaagaagagggccagcggacccaaatgccccgtcactggcaaaagaatccaagggattcctcatttgaggcctgctgaatacaagaggtcaaggttatctaggaacagaagaactgtcaaccgtgcttatggtggagtgttgtctgcgggtgctgtaagagaaaggatcatccgggcgtttttggttgaagaacaaaagattgtgaagaaggttttgaagatccagaaagccaaagaaaaaactgcttcgaagagctagatttttgaaaatgtatcaaaccacttctgtcatcttttcgtcgttatttaaaacgtcttttttaggttttattcgctattttatatttcggattatttcactgttgtattcactttcaccttgtcttttctatatatctgattatatgctggagg

SEQ ID NO: 2925 - DNA, 535 bp, Flaveria ramosissima
aaaccctagagtccctccgattcaacgatggtgcagcgtctaacctaccgcaaacgccatagctatgctaccaaatccaatcaacacagggtcgtcaaaacccctggtggaaagttggtttaccagaccacaaagaagcgagcaagtggacctaagtgccctgttactggcaagagaattcaagggattcctcacttaaggccagctgaatacaaaaggtctcggctgtctaggaacaggaggactgttaaccgggcttatggcggtgtactgtctgctggtgctgtgagagagaggattattcgtgctttcttggtcgaagaacagaagattgttaagaaggtcttgaaaatccagaaggcaaaagaaaagcaagctggaaagagttgaacaccgggtttatcacgaagaaattttgagtagttactgtgttttcaagtaatttgaatttgacacaattgttacaagctgtaaactttgcattatttttgtttaagggatggattgattttaagtcccaatgaatatgttattt

SEQ ID NO: 2926 - DNA, 597 bp, Citrus sinensis
atcgtgagcgagtgcaaaacctcccctgtttcggctccgtgtctttcaaaaccctaagagtgagagagaaaaatggttcaacggcttacgtaccggaagcggcacagctatgccaccaaatcgaaccagcaccgcgtcgtcaaaacccctggagggaagttggtgtaccagagcacgaagaaaagagctagtggacctaagtgtcctgtgactggcaagagaattcaagggattcctcatttgagacctgctgaatataagaggtccagattgcccagaaacaggaggactgtgaaccgtgcttatggtggagtattgtctggagctgctgtcagggaaagaatcatccgtgcctttttggtggaagagcagaagattgtgaagaaggtcttgaagattcagaaggcaaaagagaagcaagctgctaagagttaagactgaaatatttaatgagtttcgaactaccttttagaatatctgttgttttggatgatgatattgactcatggagaagtaatctaggtttttctttatttgaaattgtaatcccgcacttgctcatatgaactaaattcttaaagcactcagttgataacc

SEQ ID NO: 2927 - DNA, 653 bp, Lippia dulcis
ctttagacaattccttcttcgcctcggctcagcgaacacccgaaatcccgatacctgattgaggtggaataatggtgcaaaggctaacatacaggacgaggcatagctatgccaccaaatccaatcaacaccgggtcgtcaaaactcctggagggaagttagtgtaccagaccacaaagaaaagggctagtggtcccaaatgccccgttactgggaagagaatccaagggattcctcatttgagacctgctgagtacaagaggtctcgattacccaggaacaggaggactgtaaatcgtccttatggcggagtgttgtctggtggtgccgtcagagagaggatcattagagctttcttggttgaagagcaaaagattgtgaagaaggtgttgaagatacaaaaggccaaggaaaagcttgcttctaagagctaagtgaaccatggtggtcctgatagttttggaaacagttagccaaggaattatgaattgttttgtgaggttttaatgctttattctcgtcattttgatggattctttcgaattatgttcaatttgtcaacaagtctactctagtaggtttttgtgtttccaacctctttttgatgcaattaaacttgttttgagttgctatgatgtaatcttaagtccctt

SEQ ID NO: 2928 - DNA, 613 bp, Lippia dulcis
gggtttcaatttcaacatcttatattctctctcttccccgcaactacgaaaactgattcacgctggaaatggtgcaacggctcacctaccggaagcgccacagctatgccactaaatccaaccagcatcgcgtcgtcaagactcccggggggaagctagtgtaccagaccacgaagaagagggcgagcggccccaagtgccctgttaccggcaagagaatccaagggattcctcatttgagacctgctgagtacaagaggtctagactatccagaaacaggcgaactgtaaaccgtgcctatggtggagtgttgtctggtggtgctgtgagagagaggatcattagagctttcttggtggaagaacaaaagatcgtgaagaaggttttgaagatacagaaggcaaaggaaaaggttgctggcaagagctaagtgtgcgttctgtgctgagtgagtgagttttgggaatataccgacagttttatgcttaatatctgtgtttttctttgggttcttttggatatcacctcccttttcgcattcagttttgaattctgtacctcccttttgaatattcatctccatcaacttaatttggatttttccttatgtca

SEQ ID NO: 2929 - DNA, 698 bp, Citrullus lanatus
tcgtcggttcttttgttccactcttacaattcttctgcaattgctttagagggttccgacgagcggagaagatggtccagcggctcacttaccgtaagcggcacagctatgccaccaagtccaaccagcaccgcgtcgtcaaaacccccggtggaaagcttgtgtaccagaccacgaagaagagggccagtggtcctaaatgccctgtcactggaaagagaattcaagggattcctcacttgaggcctgctgaatacaagaggtctaggctggctaggaaccgcaggactgtaaaccgcgcttatggtggtgtattgtctggtggtgctgttagagagaggattataagagcctttttggttgaagagcaaaaaattgtgaaaaaggttttgaagatccagaaggcaaaggaaaaactagctgccaagagctagagtggctggtttgaaagtacgaactcgtttccattttatatatgctgagtgaaaattttgacttggatcaatgactttgttaatttaaatcattttggaattagctttgttttcttccagttgcattagttgtttgaagtctctcctactagaatattcagtttatcattcttatttatgctgattttgctacatttattacgtgcacacatcaagaatatggtcttgaggtggcttgctttattattcttcaccatcctttag

SEQ ID NO: 2930 - DNA, 457 bp, Bruguiera gymnorhiza
  misc_feature (261)..(261): n is a, c, g, or t
  misc_feature (280)..(280): n is a, c, g, or t
  misc_feature (293)..(293): n is a, c, g, or t
  misc_feature (339)..(339): n is a, c, g, or t
  misc_feature (360)..(360): n is a, c, g, or t
  misc_feature (363)..(363): n is a, c, g, or t
  misc_feature (426)..(426): n is a, c, g, or t
  misc_feature (451)..(451): n is a, c, g, or t
  misc_feature (455)..(455): n is a, c, g, or t
gatctcttacactctcggaaattctcgagagagagagagagagagaaagagaaagaggaggggtggggatagagagaacaaatggttcagcggctaacgtatcgcaaacggcatagctatgccaccaaatcgaaccagcaccgcgttgttaaaacccctggagggaagctggtgtaccagaccaccaagaagagagctagtggtcctaagtgtcctgttactggcaagaggattcaagggattccccacttgagacctgcngaatataagaggtcaagantgccaagaaaccngaggacagttaatcgtgcttatggtggagtattgtccggaggtgcngtcagggaaaggattattcgngcntttttggtggaagagcaaaagattgtgaaaaaggtgttgaagattcagaaggccaaggaaaancaagccttgaagggttaagatggangagncc

SEQ ID NO: 2931 - DNA, 725 bp, Theobroma cacao
ggccttaggggagcgaatcgcctcaaaaaccctagacgaagcagagacgaacagaacagagcgactccaaaatggttcagcggctcacctaccgcacgcgccacagctacgccaccaagtccaatcagcaccgcatcgtcaaaacccccggagggaagcttgtttatcagaccacaaagaagagagctagtgggcctaaatgtcctgttactggcaagagaattcaaggaattcctcacttgaggcctgctgagtacaagaggtctagattgccaagaaaccgcaggacggtgaaccgtgcttacggtggagttttgtctggaggtgctgtcagggaaaggatcattcgtgcctttttggtggaagagcaaaagattgtgaagaaggtcctgaagattcagaaggccaaggaaaagcaatcatccaagagctagaatttcagtagagtaaatttggctacggattgatggtagcaaatcttggaatagtattttgaggtgatcgagattgggatttttatattttatcttggctgctatgaaatgtgttctacttcatcttcgtcgacaaatctacttgtgttaaaaattttgttttgttcattcacttgttagctggtcactgaaatttcatgttggaactggatttggatgatctatgtatttgcagattagtggtttctgctattatcattaaactagttatctgattgcctcaatatgaca

SEQ ID NO: 2932 - DNA, 1170 bp, Theobroma cacao
gccccaaaggaaaagatattctcgaacccaaacccaaacccatttgcaagagaaatattcatatttaaagtctagcgtccccaaccacaattactttgttttttagaattaccttaattacttattaaatactcaaataaccattaaactagaaaaaaagaagaagttgaaccatcaattattttagctttaaaacagaaaaaacacgtgcataatctcaaccgttgataaacaaaacccaaaaatagatccgttagatctagggcttccataagaatcgatatttatgcatcctcttctccaattctaagcccttaggtctcgctctgtctctcgtcttccagtaaacggagcagagaaaataaaacccaaagctttaaaaaccaaaaaaaatggttcagagacttacttaccgtactcgccatagctatgctaccaaatcgaaccaacatcgtgtcgttaagacccctggtgggaaattggtttatcagactactaagaagagagcaagtgggcctaagtgtcctgttactggcaagagaattcagggtattcctcacttgagacctgctgaatacaagaggtctagattgcctaggaaccgcaggactgtgaatcgtgcctatggtggtgttttgtctggaagtgctgttagagagaggataattcgcgccttcttggtggaagagcaaaaaattgtgaagaaggttctgaagatccaaaaaacaaaggaaaagcaagcctcaaagagctaggattctagatgttggtgaagctaaattgtgtttgggttgttagatccacctgagaaattttggttgttattttggtgatgatgaaatgtggaactgagcttcaatgtttttctttttgtttgttcgaaactgattaatttgctgcttgttcacttgacgacaaatcaattgctaattttgttttagtaatggtttatgttgaattggtttcttttccatttagccttaatatttgttatttttgtatcctcattagtttctaagaaagtaaaaattcagctggtctgagtttacttggtgtctgttaaaaggtgttcacagttgggaaatgtctcaactgcttgtaggtaggtttcatatacttgaagttggattgtgtatgcttccctgcctgctataaattcatccataaaaa

SEQ ID NO: 2933 - DNA, 698 bp, Manihot esculenta
gctttggctctccccccacatcaaaaactttaggcgagagagaggtagaaatggttcagcgactgacgtaccggaaacggcacagctatgctaccaaatcaaaccagcaccgggtagtcaaaaccccaggaggaaagttggtttaccagacaacaaagaagagagcaagtggtcctaagtgccctgttactgggaagaggattcaagggattcctcacttgagacctgctgaatataagaggtcaagattggcaagaaacaggaggactgtgaaccgggcttatggtggtgtcttgtctggtagtgctgtcagagaaaggattattcgagcctttttggttgaagaacaaaagatcgtgaaaaaggtcttgaagattcagaaagcaaaagaaaagcaagcctctagaagttaagattgaaatgtccaatgacttggacattttgtcgaaacagccaatgttaatgagccttgaaatgtattgagggtattccaatttgaatttgtattttgttttggctcttgtgaactatgctttctagtcatccattttcaaagttgtctacaaagaattgtgcaattttgtatgtgttattatttatctttgatgctttcttgaacttatttcttggttgacgtgtaactcatactggattatttacaaattgtatcagattgttagataatcacgttgagcttg

SEQ ID NO: 2934 - DNA, 666 bp, Manihot esculenta
ggtctcggcctccctgtctctcgtgtgagcatacgaagaccagagtctaagaagagatcagagaaggaaaaaaatggttcagcgactaacttaccggaaaaggcacagctatgccaccaaatctaatcagcaccgcatcgtcaagacccctggcgggaagttggtgtatcagaccaccaagaagagagcaagtgggcctaagtgtcccgtcactggcaagagaattcaagggattcctcacctgagacctgctgagtacaagagatccagattggccaggaaccgacgcactgtcaatcgcgcctatggaggtgtattgtccggaggtgctgttagggaaaggatcatccgagccttcttggtggaagagcagaagattgtgaagaaggttttgaagattcagaaggcaaaggagaagcaagcctcaaggagctaagatgggaggatgataaagcaaagacttgtgagttagaagatatgttagagagaaattttgggcaaagatggaatttgaatttggaggttgtcaattttagcttgtttggtgtctgattactgcatactttttttgttcactttgacaagagatcattgccagctagttgtttaatgtgattatttgttctgttgatcctctggaatatcacctcatgataattctagcat

SEQ ID NO: 2935 - DNA, 619 bp, Manihot esculenta
gttaaaaatggttcaacgactaacatatcggaaacgtcacagctatgccaccaaatcgaaccaacatcggatcgtcaaaacgcccggtggaaaattggtgtaccagaccacaaagaagagagcaagtggtcctaagtgccctgttactggcaagaggattcaagggatcccacacttgagacctgctgaatataagaggtcaagattagcacgtaacaggaggactgtgaaccgggcttatggtggtgtgctgtctggtggtgctgttagagagagaattattcgagcatttttggttgaagagcaaaagattgtgaaaaaggtcttgaagattcagaaggcaaaggaaaagcaagcctctagaagttaagattgaaatatccaatgtcttggatgatttatggaaacagccaatgttagtgattaaagaaaagtactgagggcattccaatttgaatcttgtattttgtttttggtttgtgtgaactatttttctaagctttatttaggagttacactgcaattttgttcggttttttttttattttttattttatctttgatgctttcttgaagtctttcttggttgacatgtctaatgatattacgtggttattgc

SEQ ID NO: 2936 - DNA, 636 bp, Citrus sinensis
gcgtccggctccgtgtctttcaaaaccctaagagtgagagagaaaaatggttcaacggcttacgtaccggaagcggcacagctatgccaccaaatcaaaccagcaccgcgtcgtcaaaacccctggagggaagttggtgtaccagagcacgaagaaaagagctagtggacctaagtgtcctgtgactggcaagagaattcaagggattcctcatttgagacctgctgaatataagaggtccagattgcccagaaacaggaggactgtgaaccgtgcttatggtggagtattgtctggagctgctgtcagggaaagaatcatccgtgcctttttggtggaagagcagaagattgtgaagaaggtcttgaagattcagaaggcaaaagagaagcaagctgctaagagttaagactggaatatttaatgagtttcgaactaccttttagtatatctgttgttttggatgatgatattgactcatggagaagtaatctaggtttttctttatttgaaattgtaatcccgcacttgctcatatgaactaaattcttaaagcactcagttgataaccattgtggtgctgttttgtgtacttttatcaatttaatgccattagagttcctttttaaatataaa

SEQ ID NO: 2937 - DNA, 688 bp, Vigna unguiculata
  misc_feature (10)..(10): n is a, c, g, or t
  misc_feature (14)..(14): n is a, c, g, or t
gggtgtttgngtcngctaggtttaacacccattacccacaaaaatggtgcagaggctcacttatcgcaagcgccacagctatgctaccaaatcaaatcagcaccgggttgttaagacccctggtggtaaattggtctaccagagcactaagaagagggctagtggacccaagtgtcctgtcactgggaagaggatccaagggatcccccacttgagacctgctgaatacaagaggtctagattgtctaggaatcgccgaacagttaaccgggcctatggaggtgttttatctggtggagctgttagagaaaggattattcgggctttccttgttgaagaacagaaaattgtgaaaaaggtattgaagatccagaaggcaaaagaaaagcaggcagctaagagttaagctgatgagtgattacaaatcttgtcgttaagaattgtgctaaagaattttgactttgaatggtgttaatcgtgaacgtggaacttgatttgaaattgattttatgattcttgttttttttggtagcttaaatcaatgatatgaaatctgagttggtacttgacaggttattggggattcgatatataatttgacggtaggattagatgtaatgaagagaaagattgagaccaatttttggtgtaatttaagattaacttcaaatattttgagcagggaata

SEQ ID NO: 2938 - DNA, 568 bp, Cucumis sativus
aacgaggttaaaatctcaatctcaatctctgcagcagcccagagcaaagaagagaaaatggtgcagcgtcttacataccgcaagcgccatagctatgctaccaagtctaaccagcaccgcgtcgtcaaaacccctggtgggaagcttgtgtatcagactaccaagaaaagagctagcggacccaaatgtccggttaccggcaaaaggattcaggggattcctcacttgaggccagctgaatacaagaggtctagactagctaggaacaggaggactgtgaatcgtgcatacggtggcgttttatctggcagtgctgtgagggagaggatcatccgggcctttttggtggaagagcagaagattgtcaagaaggtattgaagattcagaaggctaaggaaaagctggcatcaaagagctaaagtaattgtgttgaaattttgactttttttgtgacgtgatgttgaattttagcaattactatttaaagtttgtttttggaagaacgagattttagctccggagttcccttcaatgatatcatgacatttttttccctagtttttataa

SEQ ID NO: 2939 - DNA, 592 bp, Cucumis sativus
ctctgcagcagcctccactcccagagcagcgaagaagagaggaagaatcatggttcagcgtcttacataccgcaagcgccatagctatgctaccaagtctaaccagcatcgtgtcgtgaaaacccctggtgggaagcttgtgtatcagactaccaagaaaagagctagtggacccaaatgtccggttaccggcaaaaggattcaggggattcctcacttgaggccagctgaatataagaggtctagattagctaggaaccgcaggactgtgaatcgtgcatacggtggcgttttatctggcagtgctgtgagggagaggatcatccgggcctttttggtggaagagcagaagattgtcaagaaggtattgaagattcagaaggctaaggaaaaactggcatcaaagagctaaattgattatgtttgtggttttgtttttagaaaatcgatgaaattttgacgtttttgtgatgtgatgctgaattttagcgattactatttaaagtttgtttttggaagaacgatgtagaagatgtcaaagtatttgactgtttttagcatttgagttaattgaagatttaattgaagacaa

SEQ ID NO: 2940 - DNA, 662 bp, Cyamopsis tetragonoloba
cacgaggcagagatagagcttgatctaagatggtgcagcgtctcacctatcgcaagcggcacagctatgccaccaaatccaaccagcacagggttgtgaagacccctggtgggaagctcgtttatcagagtacgaagaagagggccagcggacccaagtgccctgttactggaaagaggattcaggggattccacacttgaggcctgcagaatataaacgttctaggttgcctagaaaccgtaggactgtaaaccgtgcatacggtggagttttatccggaggtgctgtcagggaaaggattatccgagcattcttggttgaagagcaaaagattgtgaagaaggtcttgaagatccagaaggcaaaggaaaagttggcctctaaggcttgagaatctgcgcacaaaatgtggaaaagatctttttggaagattttaggtttgagtgattatagtaaatcacatcacattttattagagttgtttccttgttaattgtgcttatttggtttgtttgaactactcattctagagcaattgttaactttgtcgacacttctactgtgatacagttttgtttgtctcaattttcattctggtggttaatgggttttggctcttgtttctatatattttaaatattagtctttgctgcaaaaaaaa

SEQ ID NO: 2941 - DNA, 791 bp, Panax ginseng
attcctcacactctaaaagagagagaaagcagctgtagcactcaaaaggatggctcagaggctcacatatcgcaaacggcatagttatgctaccaaatccaaccagcatagggttgtcaaaactccgggagggaagctggtttaccagaccaccaagaaaagagctagcggacctaagtgccctgtaactggaaaaagaatccaagggattcctcacttgagacccgctgaatacaagaggtctagattgtccagaaaccggagaacagtcaaccgtgcctatggtggtgtgttgtcgggaggtgctgttagggagaggatcatccgagccttcttggttgaagagcaaaagattgtcaaaaaggttctgaagattcagaagtcaaaggagaagcaagcttcaaagagttaaacgggggaacctaaagcgaagtcctttttgaattatcatatgcttgtatccaattttgactctgatgacaattaggaagaaatttggaaaacagtatattcagttttcttaaattggaatacttaaaacttgtttttgactatttggttgtgtacttgtgttatatttgtcaagaaaatcaatttccagagatcatgttttgtcatttttgtaggcttgtttgacattttgataatttcgttaagacttgtttttgttgttaaaaacaaaacaccaacgcggaaaacacgccttgtcggccgccttgggcccaagtcgactcttagactccgagcaagccttattgcttgccggcgccgcaatttggagcttcactttg

SEQ ID NO: 2942 - DNA, 554 bp, Heritiera littoralis
gctttggtctccactctctcgcttgtcttcccaagaacagagcagagaaaataaaagccaaagctttgaagacctcaaaaaatggttcaaagactcacatatcggactcgccatagctacgctaccaaatcgaaccaacaccgtgttcttaagacccctggtgggaaattggtttatcagactactaagaagagagcaagtgggcctaagtgtccagttactggaaagagaattcagggtattcctcatttgagacctgctgaatacaagagatctagattgcctaggaaccgcaggactgtgaatcgagcctatggtggtgttttgtctggaagtgcggttagagagaggataattcgagcattcttggtggaagagcaaaaaattgtgaagaaggttctgaaaatccagaaggcaaaggaaaagcaagcctcaaagagctaggaattaagttatcgatgaagctaaattggttttgggttgttagatccacctaagtgaaattttggttgttgttatggcgataatgaaatgttgaactgaatttcagtttt

SEQ ID NO: 2943 - DNA, 637 bp, Ipomoea nil
ctttacactttacagttaacctgcttcctagcctcctctcttcagcttctatctgtattgcggaggccggaaggagttccgaagatggtgcagcgtctcacttaccggaaacgccatagctatgccaccaagtccaaccagcaccgcgtcgtgaaaacccctggtgggaagctggtgtatcagaccacgaagaagagggctagtggaccaaagtgtcctgttactgggaagaggattcaagggatcccgcacttgagacctgctgagtacaagaggtccagattacctaggaataggagaactgttaaccgaccctatggtggtgtattgtctggtggggctgtgagagagaggattattcgagctttcttggtagaagagcagaagattgtgaagaaagttttgaagatccaaaaagcaaaagaaaagcaagctggcaagaactgaaattgcgatccttagaattcagattacgtgtttcagaaaaatttaggaattgagattgttacaaattgtgcacagccaagtggttgttgcaatactttccaatttgcttttctgttaggaagaactatatagaacctgtcattctaagttaaatggtttgatgctgtgtcgcttttgttaatttgatccc

SEQ ID NO: 2944 - DNA, 931 bp, Ipomoea nil
cctccgcagcttcagcactcagaatttggagagagaaaatggtgcagcgcctcacttatcgcaagcgccatagctatgccaccaagtccaaccagcaccgggttgtcaagacccctggtgggaagctagtgtatcaaactacaaagaagagagctagtggacccaagtgccctgtgactggaaagagaatccaagggattccacacttgaggcctgctgaatacaagaggtctagattatccaggaacaggagaactgtgaaccgtccttatggtggagtattatcaggcggtgctgtgcgggaaaggattatcagagcattcttggtggaagagcaaaagattgtgaagaaggtgctgaagattcagaaagccaaggaaaagcaagctggcaagagctgaagatatagcctgagtcaggtgtagttttggatacagtgctaaaatgaatcatgaaaaatgtattctgaggtttttggacttgatattgtattttgcttgccctttattgaaacatgactgttttccttgagtttgttgaaaaatcaattatctttgtatcttgttttcttctattcacactagcctagtgtaacttttccaagttttaaatttcagcaagagcagtttgattatggacaatccaaaacttattctcagtttgtaacaaggaacaatatttattatagaatggcaagtgatttagtaatggactttgcccttgtgtacaattgtacgaggaccgggtacgttcttatggatttggttgtagtgaaggagcattggacttttatggtccaaatcctcttcaacattgtcagaggatatgcctttgagcctcaacggcaaatgctattcttgtgtagtagcaacttggccaggttcttacttgggcggtgtggttgagtggaagggacttattcatccggatt

SEQ ID NO: 2945 - DNA, 654 bp, Jatropha curcas
cgggccccccccgttgccaacgcagcatccacactctaaaccctaggagagagagtgggagagggagaataaaaaaaatggttcagcggctcacatatcggaaacggcacagctatgccacgaagtcgaaccagcatcgggtcgtcaaaactcccggaggaaagttggtttaccagaccacaaagaagagagctagtggccctaaatgccctgttactggcaagaggattcaaggggttcctcacttgagacctgctgaatataagaggtcaagattgtcaagaaacaggaggactgtgaatcgggcttatggtggtgtattgtctggtggtgctgtcagagaaaggattattcgtgcctttctggttgaagagcaaaagattgtgaaaaaggtcttgaagattcaaaaggcaaaggaaaagcaagcctcaagaagttgagatagaaatgtccagtgatttggaggatttgtcgaaacagccaatgttagtgattcatggaaaatattaaggggatcccaattcgaatatgtattttgttttggctcttgtgaaccatggtttcttagctttgtccacaaattatgctgcaattttgttccgctttatcatttctctgttgtgctgtcttgaactatttgcttggatgactgtg

SEQ ID NO: 2946 - DNA, 664 bp, Cucumis melo
ttcaacacccagaccggcgaagaagggaggaagaatcatggttcagcgtcttacataccgcaagcgccatagctatgctaccaagtctaaccagcaccgtgtcgtcaaaacccctggcgggaagcttgtgtatcagactaccaagaaaagagctagtggacccaaatgtccggttaccggcaaaaggattcaggggattcctcacttgaggccagctgaatataagaggtctagactagctaggaaccgcaggaccgtgaatcgtgcatacggtggtgttttatctggcagtgctgtgagggagaggatcatccgggcctttttggtggaagagcagaagattgtcaagaaggtattgaagattcagaaggctaaggaaaaactggcatcaaagagctaaattgattgtgttggtggtttttttttttagaaaatcgatgaaattttgactgttttttgtgatgtgatgctgaattttagcgattactatttatttaaagtttgtttttggaagaacgatgtagaagatgtcaaagtattgactgtttttagcatttgagttgattgaagatttaattaaagacaactaagaagacctactgcttgaagcaggtggttggtatggtaaataagccaattaatattgaactaagaaatttcatgc

SEQ ID NO: 2947 - DNA, 528 bp, Cucumis melo
aatggtgcagcgtcttacataccgcaagcgccatagctatgctaccaagtctaaccagcaccgtgtcgtcaaaacccctggtgggaagcttgtgtatcagactaccaagaaaagagctagcggacccaaatgtccggttaccggcaaaaggattcaggggattcctcacttgaggccagctgaatataagaggtctagactagctaggaatcggaggactgtgaatcgtgcgtacggtggtgttttatctgggagtgctgtgagagagaggatcattcgggcctttttggtggaagagcagaagattgtgaagaaggtattgaagattcagaaggccaaggaaaagctggcatcaaagagctaaattaattatgttgaaattttgacttttttgtgacgtgatgttgaattttagcaattactatttaaagtttgttttttgaagaacgagattttagctccggagttcccttcaatgatgatatcatgacatttttttccctagtttttataatggcatttctcaac

SEQ ID NO: 2948 - DNA, 701 bp, Populus trichocarpa
gaagaaaaccccagctataaactttctttacctcctttcccagcctccctctcctttgtctgcccaccatacaccacacagagactgaagagctggtgatctgaaaatggtgcagcgtctgacttaccggaagcgtcacagctacgccacaaaatctaaccaacaccgtgtggtcaaaacccctggtgggaaattggtttaccaaaccaccaagaagagggctagcggacccaagtgcccagttactggcaagaggattcaagggatccctcacttgagacctgctgaatacaagaggtctagactgtcaaggaatcgcaggactgtgaaccgtgcctatggtggagtcttatctggaagtgctgttagggagagaattatccgggctttcttggtggaggagcaaaagattgtgaagaaggttttgaagattcagaaggcaaaggaaaaacaggcctcaaaatgatgaagtgaagtcttttgagttagaggatgtgtttgagcaaaattttgttatgattaatgacagtcaaatgtggagttgattgttagcgtgtttgattctctgatgacttggatgtgttcatttcaccttttgtcaatttgatttccttgcctatatttggatagattgccaatttcctggcattccatgttcttgcctactgccataagatatctagaatctgcttggtctctaa

SEQ ID NO: 2949 - DNA, 395 bp, Prunus persica
taacccagagagagagagagagagagagacgaagatggtgcagaggctcacataccgtacgcgccatagctatgcaaccaagtcaaaccagcatcggatcgtcaagacccctggtggaaagcttgtgtatcagaccactaagaagagagcaagtggacccaagtgtcctgttactggaaagaggatccaagggattcctcacctgagacctgctgaatataagaggtctagactatcaaggaacaggaggactgtgaatcgtgcatatgggggtgtgctgtctggtggagctgtacgagagaggataatccgagcctttttggtggaagagcagaagatcgtgaagaaggttttgaagattcagaaggcaaaagagaagcaggcatcaaagagca

SEQ ID NO: 2950 - DNA, 503 bp, Salvia sclarea
cgggctgcaggaattcggcacgagggccactctcaacaacgccgagttttttcgattcacgtccaaaatggtgcagcggctcacctaccggaagcgccacagttatgccaccaaatccaaccagcaccgcgtcgtcaagactcccggagggaagctagtctaccagactaccaaaaagagggcaagtggccctaagtgccctgtcactggcaagagaatccaagggattcctcacttgagacctgctgagtacaagaggtctagactatccagaaacaggaggactgtgaaccgtgcctatggtggtgttttgtctggtggtgctgtgagagaaaggatcattagagctttcttggttgaagaacaaaaaatcgtgaagaaggttttgaagatacagaaggcaaaggaaaaggctgctggcaagagctaagtgtgagttatgtgctgagttagttttggatacgagtagccaagaggaatcatggaactataccgagagtttt

SEQ ID NO: 2951 - DNA, 943 bp, Eucalyptus grandis
cggccggggactccctctccgtttctctccaaacccaaaacccaaaccctagggttgctatcctcttctctctctctgctaaaaggtgaaagccgaggtcggtgaacgagagggaaaaccctagagagagaaggcagagagagagagagaagcggggagaaatggtgcagcgtctcacgtacaggaagcggcacagctacgccaccaagtccaaccagcacagggtcgtcaaaacccctggtgggaagctagtgtaccagaccacgaagaagagagccagcggccccaaatgtcccgtcaccggcaagaggattcaagggattcctcatttgagacctgctgaatacaagagatcaagattatcaagaaaccgccgtactgtgaaccgtgcatatggtggagtattatctggaggagctgtccgtgagaggatcattcgcgcctttttggtggaagagcaaaagatcgtgaagaaggttttgaagattcaaaaggcaaaggaaaagctagcctctaagaactaagattgttataccacagtgcttttggcactttgagagtaattttggcgtttgaattcttgacagtaatgagttgttggatttgaatttgccttttcttgggctggttgaaacatatatctagtgctcctttcatcactttttcaacaagtctgacaattttgtgtttccatctaaatggttgctgatggtagggacatcatttcatcatttggcatgtaatatcagatcaaccagcaacatgtttggatgtcaagaaggtgtctctggggctgttcttttcgtcatctatgtcaaaatagtggagaacgaacctcccaaaatgtagtagaaatagggtgagtttgcagaatctgtgaatgcagcacccatggtttcatttgattcattgttctgggacccaagtctgaacacatcgatcc

SEQ ID NO: 2952 - DNA, 617 bp, Ambrosia trifida
aaaccagtagctaaaaatggtgcaacgattaacataccgtaaacgccacagttatgcaaccaaatcaaaccaacatagggttgttaaaaccccaggtggtaagctggtttatcagactactaaaaagagggcaagtggacctaaatgccctgttactggcaagaggattcaagggattcctcatttgagacctgctgaatacaagcgatcaagattatctaggaacagaagaaccgttaatcgtgcttatggtggcgtgctttctgcaggtgccgtgagggaaaggatcatcagggcgtttttggttgaagaacaaaagattgtgaaaaaggtgttgaagatccaaaaggcaaaagaaaagaccgcctctaaggcttagatttccagcatttccgcagtttatcatgagggtaattataggtttccaagattttaaatctttattcgggtaagcgcgctgttttatgttcaggttcttctactttgtcgacaaacacaaacttggttaaattgtgttttaggttttgtttggtgttttcaatgattttaggaaatctgttttggattcttttgttaatgtattcacttttgaaccttagtttctttacaaaaaaagt

SEQ ID NO: 2953 - DNA, 598 bp, Ambrosia trifida
cccataagcagatagccgccgacacaacaatggttcaacgtctcacataccgcaaatgccacagctatgccaccaaatctaaccaacacagggtcgtcaaaacccctggtggaaagttggtttatcagaccaccaaaaagagggcaagtggaccaaaatgccccgttactggtaaaagaatccaagggattccgcatttgaggcctgctgagtacaagaggtcaagattatctaggaacagaagaacggttaaccgagcttatggcggagtactgtccgctggcgctgtaagagaaaggatcattagggcgtttttggttgaagaacaaaagattgttaagaaggttttgaagattcagaaagctaaagaaaaaaccgcctcaaagagttagatgtttatttgaataatgtattgggctacatttgtctctattttttgtgttcttaggttttgtttacagtttgatgttatagtatttgttttgctgttgttttactttgaagttctgttttctaaataccttatttagttcagaaggtacatttgatctcacagtaatcaatcatcatcaacctttaacctcaaattatccttaag

SEQ ID NO: 2954 - DNA, 672 bp, Amsonia hubrichtii
cctcacacgcagagcgcacacacagagcaaggggtgcgaaaatggtgcaacgccttacctatcgcaagaggcacagctatgccaccaagtctaaccaacatcgtgtcgttaaaactcccggtgggaagctagtgtaccagagcacgaagaagagggcaagtggaccaaaatgtcctgttactgggaagaggatacaagggattccacatttgagacctgctgaatacaaaaggtcaagactatctagaaaccggaggactgtgaaccgggcttacggtggagtattgtccggaggtgctgtgagggaaaggatcattagagcttttctggtggaggaacagaagattgtgaaaaaggtgttgaagattcagaaggccaaggaaaagctagctgccaagagctaaagatgaattctatagtaatttttgactggccttaagtaatttgagatacagcttccaacatggattcatgaaatgtactgaggttttttaagcttgaagtttgtatttgtctcatcctttattggggagactcccagtattctcttttcttttgttgaaacgtccattgttctaggattctctgttcattacttttgaaatggaagttaaaagtagtacatttgtattgttaatgtaagtttagttgattttagttgatttatatttt

SEQ ID NO: 2955 - DNA, 623 bp, Cirsium arvense
agctgagcagatagccgccgatctttgcaacaatggtgcagcgtctcacctaccgcaaacgccatagctatgccaccaaatccaaccagcatcgggttgttaaaacccctggtgggaagctagtgtatcagaccaccaagaagagggcaagtggacctaaatgccctgttactggcaagagaatccaagggattcctcacttgaggccagctgaatacaagaggtctagattatctaggaacagaagaaccgttaaccgggcttatggtggagttctgtctgcaggggcagtaagggaaaggatcatcagggcttttcttgttgaagaacaaaagattgtgaagaaggttctgaagatccagaaactcaaagaaaagaccgcctcaaagagttagatttcagaatgaatctgagtcggtattctttcaaccctcagagtaattttggatacaacccaccattgtgaaatttgagttagtctatgagatgatgtgtcttgaatatgtaatcgagccgcttttgcctctacttttgtcgttaatcaaaacatttactaggttttgtttacaacttattaaatcttttgggattctttcatcgcgatatttactttgaaaaaagaa

SEQ ID NO: 2956 - DNA, 1282 bp, Cirsium arvense
gggggggggcaccctttatattgccacctctatctttcgttcctaaatttcttcttctcttccgccagacagagggaaaacgatcaccagatagccgccgatccaaatatggtgcagcgtctcacttaccgcaaacgccatagttatgccacaaaatcaaaccaacatcgggttgtcaaaacccctggtgggaagctagtgtatcagaccaccaagaagagggcaagcggaccaaaatgccctattactggcaagagaatccaagggattccccacttgaggccggctgaatacaagaggtccagattatctaggaacagaagaactgttaaccgggcttatggtggagttctgtctgcaggggcagtaagggaaaggatcattagggcttttcttgttgaagaacaaaagattgtgaagaaggttttgaagatccagaaagccaaagaaaagaccgcttcaaagagttagattttcagaatgcatctgagtcggtattctttcaaccctcagagtaattttgggtacaacccaccattgtgatatgtgagttagtttgtgagaggcgtgtcttgaatatgtaatcgagccacttttgcctctactttgtcgttaaatcaaaacatttctaggttttgtttacaacttattaaatcttttcggattcttttttgaggaaagaacttcaacccatagctaggttggaatttaggtgttgattacacaatatatgcagtttttaggaattaatgacacagtgatttgataactccctgtatcaatttttattcaaacctataaaaagttttttaattacttgtttaattacataatcatgacagagaatatagagtttgatttggagatctgaaaaacttcgagtacctctcggtccattttaatctcttgtagtaggattgctaaacctttatccggaccacaaatgaacatgccggaaggttggatatatcagctgaaacagcacaaggaattcccaatgtagaaagtgctccccttataattccacaggggaaatagagatgcatgccggttgcttgtgctgttttattttcagacatggtggaaggatcttgagcagcaccagaaatctctgatggatcccctgacatccgtgaaagccaacggaacttattatcctgcaatacaaatgtacccctgtgattagtctttaaattgtctatctgcttcttgaagagctcagaccagaaatctttgcagataaacttgattgcctcaaggtgatcagtaaaccgtggccgct

SEQ ID NO: 2957 - DNA, 561 bp, Citrus clementina
cttggtctctgctctggaaacgaaatcctctggttgttgcttcgctggcctcctcgaaagcgagcgaaaatggttcaacgtctcacataccgcacgcgccacagctatgccaccaagtccaaccagcaccgcgtcgtcaaaacccctggggggaagctggtttaccagagcaccaagaagagagcaagtgggcctaagtgtcctgtcactggaaaaaggatccaaggaattcctcacttgagacctgctgagtacaagaggtctagactatctcgaaataggaggactgtcaaccgtgcctatgggggtgtattatctggaggtgctgtcagggagaggattatccgggcctttttggtggaggagcagaagattgtcaagaaagtgctgaagattcagaaggccaaagaaaagctagcatctaagagttaaattgagacagcagcttttgttttgcagttttaattttcttatgaaattttgacttgtatgaattatttacaatggcattttgtgccgttctatttaaacgtgaatgagcatttggtttttgcttggatg

SEQ ID NO: 2958 - DNA, 412 bp, Cucurbita pepo
ccaggacacccagagaacgagaggagaatcgtccaagatggttcagcgtcttacctaccgcaagcgccatagctatgctaccaagtctaaccagcaccgtgtcgtcaaaacccctggcgggaagcttgtgtaccagactaccaagaaaagagccagtggtccgaaatgtccggttaccggcaaaaggattcagggaattcctcacttgaggccagctgaatataagaggtctagattggctagaaaccggaggactgttaatcgtgcatacggcggtgttctatctggcggtgccgttagagagagaattattcgggccttttggttggaagagcaaaagattgtgaagaaggtattgaagattcagaaggcgaaggagaagcttgcatcaaagagctaaattattaatagg

SEQ ID NO: 2959 - DNA, 561 bp, Flaveria ramosissima
aaaaccagtgaagaagcattagagaagaaaatggtgcaacgactcacttaccgtaagcgtcacagttacgccactaagtccaatcaacatcgagttgttaaaacccctggtggtaagctagtttatcagactaccaagaagagggcaagtggaccaaaatgccctgtcactgggaagagaattcaagggattcctcacttgagacctgctgaatacaagaggtcaagattgtctaggaaccgaagaactgttaatcgtgcttatggtggcgtgctttctgcaggtgccgtaagggaaaggatcattagggcctttttggttgaagaacaaaagattgttaaaaaggtgttgaagatccaaaaggcaaaagaaaagacagcatccaaagcttagatttttctgcaatttctcatgagagaatttttgagtgtcaagattttggatctgtattcgggtcgggtctggttgggctgtttttatgttttaattacttctactttgttatttatgaaacctcgttaaatttgtaggatcatgtttgatttcaaatggttttctgaa

SEQ ID NO: 2960 - DNA, 573 bp, Flaveria ramosissima
agcctccttcgtttcggccaacatatcacacagagaatccatccatcagatccgaagatggtgcagcgtctcacttaccgcaaacgccatagctatgccaccaaatccaaccagcatagggtcgtcaaaacccctggtggaaagctcgtttaccagactacaaagaagagagctagtggccctaagtgccctgttactggcaagaggatccaagggattcctcacttgaggccggctgaatacaaaaggtcaaggctatcaaggaacagaagaacagttaaccgtgcctacggtggcgtgctatctgctggtgctgtgcgtgagaggatcatccgagccttcttggttgaagagcaaaagattgtgaagaaggttctgaagattcaaaagaccaaagaaaagcaagctggaaagagttaagatgggtctgcaacaagcgattcggttagtattgtgtctgaaagaagttttgactttgacacaatgattatgagatgtgaacttatagattcttgtggaaggtattgatcgatttgaatccgagtaactttgttatgttcatgttcaattaac

SEQ ID NO: 2961 - DNA, 563 bp, Flaveria ramosissima
gaaaatggtgcaacgactcacttaccggaagcgtcacagttacgccaccaagtccaatcagcatcgagttgttaaaacccctggtggtaagctagtttatcagactaccaagaagagggcaagtggaccaaaatgccctgtaactgggaagagaatccaagggattcctcacttgagacctgctgaatacaagaggtcaagattgtctagaaaccgaagaactgttaaccgtgcttatggtggtgtgctttctgcaggtgccgtaagggaaaggatcattagggcctttttggttgaagaacagaagattgttaaaaaggtgttgaagatccaaaaggcaaaagaaaagactgcatctaaagcttagtttttttcttgcaatttcccactgagagaattttgcttgtcaaggttttggatctgtaatcgggtctggttgggttgttttatgttttaaatacttttactttcttatgaaacctggttaattttgtaggatcttgtttgttttctagatggttttctgaattatgttttctggacttgtttaatgttgtattact

SEQ ID NO: 2962 - DNA, 561 bp, Flaveria ramosissima
agcctccttcgtttcggccaacatatcacacagagaatccattcatcagatccgaagatggtgcagcgtctcacttaccgcaaacgccatagctatgccaccaaatccaaccagcatagggtcgtcaaaacccctggtggaaagctcgtttaccagactacaaagaagagagctagtggccctaagtgccctgttactggcaagaggatccaagggattcctcacttgaggccggctgaatacaaaaggtcaaggctatcaaggaacaggcgaacggttaaccgtgcctatggtggcgtgctatctgctggtgctgtgcgtgagaggatcatccgagccttcttggttgaagagcaaaagattgtgaagaaggttctgaagattcaaaagaccaaagaaaagcaagctggaaagagttaagatggatctgcaacaagcgatttcggttagtgttgtgtttgaaagaagttttgactttgacacaatgattatgagatgtgaacttacagattcttgttgaaggtattgatcgattttgaatccgagtaattttgttatgtt

SEQ ID NO: 2963 - DNA, 537 bp, Flaveria ramosissima
gaaaatggtgcaacgactcacttaccgtaagcgtcacagttacgccactaagtccaatcaacatcgagttgttaaaacccctggtggaaagctagtttatcagactaccaagaagagggcaagtggaccaaaatgccctgtcactgggaagagaatccaagggattcctcacttgagacctgctgaatacaagagatcaagattgtctaggaaccgaagaactgttaatcgtgcttatggtggcgtgctttctgcaggtgccgtaagggaaaggatcattagggcctttttggttgaagaacaaaagattgttaaaaaggtgttgaagatccaaaaggcaaaagaaaagactgcatctaaagcttagaattttttctgcaatttctcatgagagaatttttgagtgtcaagattttggatctgtaatcgggtcgggtctggttgggctgttttatttttttattttcttctactttgttatttatgaaaccttgttaaatttgtaggatcatgtttgatttacaaatggttttctga

SEQ ID NO: 2964 - DNA, 543 bp, Flaveria ramosissima
catcatatcagagagcgaattcactcatcacctccgaagatggtgcagcgtctcacttaccgcaaacgccatagctatgccaccaaatccaaccagcatagggtcgtcaaaacccctggtggaaagctggtttaccagactacaaagaagagagctagtggcccgaagtgtcctgttactggcaagaggatccaagggattcctcacttgaggccggctgaatacaaaaggtcaaggctatcaaggaacaggagaacagttaaccgtgcctatggtggagtgctatctgctggtgctgtgcgtgagaggatcatccgagccttcttggttgaagagcaaaagattgtgaagaaggttctgaagatacaaaagaccaaagaaaagcaagctggaaagagttaagatgggtctgcaacaagcgattcggttagtattgtgtttgaaagaagttttgactttgacacaatgattatgagatgtgaacttatagattcttgtggaaggtattgatcgattttgtaatccgagtaactttgttatgtt

SEQ ID NO: 2965 - DNA, 561 bp, Citrus sinensis
cttggtctctgctctggaaacgaaatcctctggttgttgcttcgctggtctcctcgaaagagagcgaaaatggttcaacgtctcacataccgcacgcgccacagctatgccaccaagtccaaccagcaccgcgtcgtcaaaacccctggggggaagctggtttaccagagcaccaagaagagagcaagtgggcctaagtgtcctgtcactggaaaaaggatccaaggaattcctcacttgagacctgctgagtacaagaggtctagactatctcgaaataggaggactgtcaaccgtgcctatgggggtgtattatctggaggtgctgtcagggagaggattatccgggcctttttggtggaggagcagaagattgtcaagaaagtgctgaagattcagaaggccaaagaaaagctagcatctaagagttaaattgagacagcagcttttgttttgcagttttaattttcttatgaaattttgacttgtatgaattatttacaatggcattttgtgccgttctatttaaacgtgaatgagcatttggtttttgcttggatg

SEQ ID NO: 2966 - DNA, 702 bp, Lippia dulcis
agtgaagcaactggaggcgtgatctagggttttggcgattagcttcggtataaattcttctgctctcacacactccaaaatccttctcgtccgaagactgtaaatagattagaggtagcatttagcgggcaaaaatggtgcagagactcacctaccggaagcgccacagctacgccaccaaatccaatcagcacagagttgtcaaaactcccggagggaagctggtgtatcagacctccaagaagagggctagtggacccaaatgccctgtcaccggcaagagaattcaagggattcctcatttgagacctgctgaatacaagagatccagattacctagaaaccgcaggacggtgaatcgtccttatggtggtgtgctatctggaaaagctgtgagggagaggattattcgggctttcttggtggaagagcaaaaaattgtgaagaaggtgttgaaaattcagaaggcaaaggaaaagcaagcttctaagatctaaactcaagtagtcctgaagcaaacttttcctccataatatgtttgcagaagttttgcctattatgttgatcaatctgtccagaatctctagatttagaaggactattccgcacccaaaaatatttttctgatgttatttctaatgcaagcacgtgcttgacattgtttgcttatactaattaaattagcctactgcaagtctgcag

SEQ ID NO: 2967 - DNA, 742 bp, Platanus occidentalis
tttattgtttccctctctaagaacaaaaccctctggttcagtctattctccttcgcccagcggcaaaaagcgagagggagggagggcttaatcgctcgaaaatggttcagcgcctcacgtatcggaagcggcatagctatgccaccaaatccaaccagacgagggtcgtcaaaacccctggtgggaagctcgtctaccagaccactaagaagagagcaagcggacccaagtgtcctgttaccggaaagagaatccaagggattcctcatttgagacctgctgaatacaagaggtctagattatctaggaaccggaggaccgtaaaccgtgcttatggaggagtgttgtctgggagtgctgtcagggaaaggatcattcgagccttcttggtggaagaacaaaagattgtgaagaaggtgctgaagatccagaaggccaaggaaaagcaaacttcaaaaagctgaggattagagagaagtgtccaaaaaaattcagttaaaattttgacttggaacagattatatggctaatttctgttttgagtttttacaagtatcttggtcaaggtgttttgaatgtgatttctactcttatgacatgtttgcttttggattatttgttttttgtagacattttaatcggtaatcatgaactcctttataagattattagattattgccttcaagcgtctagtaaaatgtcttaggttttctattcgttctttggatttctattatagtt

SEQ ID NO: 2968 - DNA, 778 bp, Platanus occidentalis
agagcagcagccaagagcgaaatagagggcttaagcgttccaagatggttcagcggctcacttatcggaaacggcacagctatgccaccaaatccaaccagacgagggtcgtcaaaacccccggtgggaagcttgtataccagaccactaagaagagagctagcgggcccaagtgtccggttactggaaagagaatccaagggattcctcacttgagacctgcagaatataagaggtctagattagctaggaaccggagaactgtaaaccgtgcttatggtggggtgctgtctggaagtgctgtcagggaaaggataattcgagcattcttggtggaagagcaaaagattgttaagaaggtgttgaagatccagaaggctaaggaaaagcagacctcaaaaagctaagatgtgagaggagaagcaaaaaaagaaagttccttcaagttttagtgcagttaaattttgacttggacagattacattgcaagtttgtttttcgaatttgaatgagcatttatgttgaggtgtttaactgtgatttctagttctattctattccatgtttgttttcaaagttatttggtttattagacatgttccatcagttatccacttacccgaagataagatgctctctgtagggcttctaactctgcaaacccgaattggaaaagaagctgcaagcttcaaactgcgggtatggtcggtatgtatcccttcagtagaggcaatgggagggtttagtcggttccaagtttagtttgatggtgcaatgt

SEQ ID NO: 2969 - DNA, 872 bp, Sarracenia psittacina
gaagcgcagccgtgggagtctaggttgcaaagagctcctatatattcccctcctgagaactggtctaccctttgcttccgtctttatcttcacacgcggaggggtgagaaaagagtgaaagatggttcagagactcacgtatcgcaaacggcacagttatgccaccaaatccaatcagaacagggttgtcaaaaccccaggagggaggttagtgtatcagagcaccaagaagagagccagcggacccaagtgtcctgtaactggaaagagaatccaagggattcctcacttgagacctgctgaatacaagaggtctagattgtccaggaaccggaggactgtaaatcgtgcctatggtggtgtattatctggaggtgctgtcagggagaggatcatccgagccttcttggtagaagagcaaaagatcgtgaaaaaggttctaaagatccagaaggccaaggaaaagcaagcctcaaagagctgaaatggagtggtgataaagcaattccttgttagctttgcgtaatgcttgaaaggaattttgactttgacgaagacaatgatgatgacgatcacaaatgaacgtgaaaatattatgtttaggcgcctcaaaatctgaggaaatgtcttttactttggttttcccaatacactgattacttggggaacaacttgttcagtttgtcgacaaatcggtcagtctcaagagatgttttcttttaattttgtgcttttgacgaagtatttgttatccgaatttgtgtttcaatttatttctcaagtgctagtctgttttgttggggctacttatgtgtcctgctgggctgtgaagggaagtgaaatttatgcttaaaaaaatgtatgctcaaata

SEQ ID NO: 2970 - DNA, 722 bp, Sarracenia psittacina
ctgaaatcgctgaacgatggttcagagacttacttatcgcaaacggcatagttatgccaccaaatccaaccagaacagggtcgtcaaaacccctggagggagattggtgtatcagagcaccaagaagagagccagcggacccaagtgtcctgttactgggaagagaatccaagggattcctcatttgagacctgctgaatacaagagatcgagattatccaggaaccgcagaacagtgaaccgtgcctacggtggtgtactgtctggtggcgctgtaagggagagaatcatccgagctttcttggttgaagagcaaaagattgtgaaaaaggtactgaaaatccagaaggcaaaggaaaagcaagcctcaaagagctgatatgggagagtgatacagcagcaagagcctgtttagattatatattattatgcttagaacaagttttgacattgagtccgttcattagtttgcccaagactatagatgggaagttcttgtttcgtttactttgtcgacaaatcgatctttcgaggtcttatttctgtaatctttatgctttgaggacacatttgttatcagatcttgcatttcaattttgtttcactcgtgaatcttgttcaatttcctttattggatttaatgtgtatttttccataattagaagtttcggatggtttttctgtctcatcaattatgagaaaagaagggggagattcatttc

SEQ ID NO: 2971 - DNA, 791 bp, Sarracenia psittacina
ggtcgactcttttgtttcagtcgttcaccccagagagagacagagagagagagagagagctgaaatcgctgaacgatggttcagagacttacttatcgcaaacggcatagttatgccaccaaatccaaccagaacagggtcgtcaaaacccccggagggagattggtgtatcagagcaccaagaagagagccagcggacccaagtgtcctgttactgggaagagaatccaagggattcctcatttgagacctgctgaatacaagagatcaagattatccaggaaccgcagaacagtgaaccgtgcctacggtggtgtactgtctggtggcgctgtaagggagagaatcatccgagctttcttggttgaagagcaaaagattgtgaaaaaggtactgaaaatccagaaggcaaaggaaaagcaagcctcaaagagctgatatgggagagtgatacagcagcaagagcctgtttagattatatattattatgcttagaacaagttttgacatttttgacattgagtctgttcattagtttgcccaagactagatgggaagttcttgtttcgtttactttgtcgacaaatcgatcttttcgaggtcttattttctgtaatctttatgctttgacgacgcttttgttatcagatcttgcatttcaattttgtttcactcgtgaatcttgttcaatttcctttattggatttaatgtgtatttttccataattagaagtttcggatggtttttctgtctcatcaattatgagaaaaagaatggggagattcatttc

SEQ ID NO: 2972 - DNA, 697 bp, Tabernaemontana elegans
taagactactctcggggagagagaatagctgtgagctcttcggcggaagaagaagatggctcagcgactcacttataggaagcggcacagctacgccacaaaatccaaccaacacagggtcgtcaaaactcccggtggcaagcttgtatatcagagcaccaagaagagagctagcggacctaaatgcccagttacagggaaaaggatccaagggattcctcacttgagacctgctgaatacaagaggtcaagactgcccaggaatcgtaggacagtaaatcgtgcttatggtggtgtgttgtctggaagtgctgtcagggagaggattatccgagcctttttggttgaagagcaaaagattgtgaagaaggttctgaagattcaaaaggctaaggaaaagctagcttcaaagagctgaatggctagctgaagttttgaaacaattttgatttcaatgatgatgatgatgtgaaagaccgcatgtggaagtggctcttactgggtctaaaaatgtttcaactttagtttgttccctgaacccattagtaatcgaaagtattttgtttcccgtttttcctgaacttacattacaaattaaacttcaattgtgggaaactgttttgatattctgaatcctgaggaccatatttatattaagtgcattggaggcaggcattttgtgctttttctaagtcgt

SEQ ID NO: 2973 - DNA, 435 bp, Thalictrum flavum
actattcgagttcttcttccagtggtggtggagaagtagaagacgacgaacaagcaaaatggttcagagacttacttaccgaaagaggcatagctatgcgaccaaatctaaccagaatcgggttgtcaaaacccctggtggcaaacttgtttatcagactacgaagaagagagcaagtggtcctaagtgtcctgttactggaaaaagaatccaagggattcctcacttgagacctgctgagtacaagaggtctagattatcaaggaatagaagaactgtcaaccgggcttatggtggtgtattgtcaggaggtgcagtcagggaaaggatcatcagagcctttttggtggaggagcaaaagattgtgaaaaaagttttgaagatccagaaggccaaggaaaagacagctccaaaaagctaaatgcaagggcatta

SEQ ID NO: 2974 - DNA, 609 bp, Thalictrum flavum
actttagcggctagagagaagaagaagaaaaggaaagcgagattgaaaatggtgcagaggttaacttatcgaaagcggcatagctatgcaaccaagtctaaccagaacagggttgttaaaacccctggtggaaagcttgtttaccagacaactaagaagagagctagtggacctaagtgccctgtcactggaaagagaatccaagggattccacacttaagacctgctgaatacaagaggtctagattatcaaggaacaggaggactgtgaaccgtgcttatgggggtgttttgtcgggaggagctgtcagagaaaggatcatccgagctttcttggtggaagagcaaaagattgttaagaaggtattgaagattcaaaaggccaaggaaaagactgccccaaagagctaaatgagagtcaaattaaagttgtacctctgtctaaagaaattttgactagacagataatgatttatgggaaagtatttctttccttgaggttttgtagactccatgtttcagtaacattactttgccgacatttccattaccatgttttgtttttaaagacttcagcaagtattatgtacctagtattaattctatttt

SEQ ID NO: 2975 - DNA, 713 bp, Solanum lycopersicum
aaggctttactcttttcgtccattcttgtctccattgcagagaaacggcaaaacttatcgtagaagatggttcagagacttacgtatcgaaagcggcacagttatgccaccaaatccaatcaacacaggattgtcaaaactccgggtggaaagctaatttaccagaccaccaagaagagagccagtggccctaaatgtccagttactggaaagagaatccaagggattccacatttgagacctgctgaatataagagatccagattgccaagaaaccgcaggactgtgaaccgtgcttatggaggtgtgctatctggaagtgctgtaagggagagaatcatccgggctttcttagttgaagaacaaaaaattgtgaaaaaagtgttgaagattcagaaggcaaaggaaaaattagcttcaaagagctgaatgtagagaccctggagtctgtcacttctattatgttttaagataacttagctttgatgacgatgaatatgtgtgaaagaacttgatgaaatgcaagtactagatttcattcagaatttaagctctagtatggttttgcaaactcctttttggaactagtgccaactgactggatgaggttgtttcctctttccggttaaatgatactttaatgcatgattactccagttcactttactgttgtgattaatactcaagccagaatattatctttttcggatgac

SEQ ID NO: 2976 - DNA, 660 bp, Trigonella foenum-graecum
ctttttatacttcaacacattcattcgttcattcatcatctttctgtctcgtcgcgaaaattagaagagaaaatggttcagaggcttacctaccgccggcgccacagctatgccaccaaatcaaaccaacatagggttgttaaaacccccggtggaaagcttgtttatcagacaactaagaagagagctagtggaccaaaatgtcctgttactggaaagaggattcaagggattccacacctaaggcccactgagtacaagagatcaaggttacctagaaacaggaggactgtgaatcgtgcctatggtggagttttatctggaggtgctgttagagaaagaatcatccgtgctttcttggttgaagagcaaaagatcgtcaagaaagtcttgaagatccaaaagacaaaggaaaagcaagcttcgaaggcctgagtttcatgaaatgagataaagatctttttggaggaattttaggtttgagtgattatagtaaaagcacaaattttattagagctgttctcttattaattttgtgctcattcgacttctttgaactctttctagtgcaactgttagctatccattatgatacaactttgtctcaattttcttttgatggtttacttttcacgtttttctctaaatatatttttgtac

SEQ ID NO: 2977 - DNA, 553 bp, Tripterygium wilfordii
aataaaaccttctgccgtatatcctctacagcgcgccagtgattgggagacagagacggcaaccatggtgcagcgtctcacttataggaaacgccatagctatgccactaagtcgaaccagcatcgggtggtcaagactcctggtgggaagcttgtgtaccagagcaccaagaagagagcaagtggtcccaaatgtcctgtcactgggaagagaatccaagggattcctcacctaagacctgctgaatacaagaggtctagactatcaaggaataggaggaccgtgaaccgtgcttatggtggtgtcttgtcaggcagtgctgtcagggagaggataattcgggcctttttggtggaagagcagaagattgtgaagaaggttctgaagattcagaaggccaaagaaaagatagcatcaaagagctaagatggaaaagagaatggaatttttagtttattgggctgagttaaattttgagccatgatagattgtgctctaagttactgtggtgtatttgttttaaacatgtatgagcaattttcgtgggttgga

SEQ ID NO: 2978 - DNA, 751 bp, Citrullus lanatus
ctccttctccaaaaatcagtaaaattctctgcagcagcctcctctagcaggacaggacacccagagcgaggaagagaagaaaatcgtccaagatggttcagcgtcttacataccgcaagcgccatagctatgctaccaagtctaacaagcaccgtgtcgtgaaaacccctggcgggaagcttgtgtatcagactaccaagaaaacagccagtggaccgaaatgtccggttaccggcaaaaggattcagggaattcctcacttgaggccagctgaatataagaggtctagattggctaggaaccggaggactgtgaatcgtgcgtatggtggcgttttatctggtggtgctgtgagggagaggatcatccgggcctttttggtggaagagcaaaagattgtgaagaaggtattgaagattcagaaggcgaaggagaagctggcatccaagagctaaattaattgtgttggtactttttagaaaattgatgaaattttgacttgtttttgtgacttgatgctgaattttaccgattattatttgaagtttgtttttgaaggaacgagattttagcttcggagttcacttcctctatgatgatatgttcgcatttcttatggttttttataatttcatttcttcaaccaatttctccatgagcccctgatcaactgtaactcaagtgtgtttggttaattagcccctttccattatcttaggtttcctcaaatcgaatttatttcactcttctt

SEQ ID NO: 2979 - DNA, 737 bp, Citrullus lanatus
cttcctctgcccaattgcagccccttctgcctcgattattctcagagacgcatagagctcactcaaggttaatcgaagatggtgcagcgacttacttaccgtaagcgccacagctacgctaccaaatccaatcagcaccgcgttgtcaaaacccctggtggaaagttgatctatcaaaccaccaaaaagagagccagcggccccaaatgtcctgttaccgggaagagaatccaggggattccgcacttgaggcctgctgaatacaagagatctagactggctaggaaccgtagaactgttaatcgggcatatggtggtgtgttgtcaggaagtgctgtaagagagaggattattcgggcatttctagtagaagagcagaagattgtgaaaaaggtattgaaaatccaaaaggcaaaggaaaagttagcttccaagagttaaaatatgattaggtaaaaagaaggggataaaagaaacaaccatggaactgctccggtttagaattgttttgtgttgaatttaagaattttagtgttgatagcgggtaggtgtttcttcttttgcttaattggtcgatcatcacattttaattcttcactttgttgacaaatcaattcccgaggtcttgttttgaaatattgtgtatctactatgacaatgttgggatgttatttaaactccctttctaaaggcttttgtattatgttgctgaatcttatacgatatatcttgtggaa

SEQ ID NO: 2980 - DNA, 691 bp, Phaseolus coccineus
  misc_feature (686)..(686): n is a, c, g, or t
aagcagtggtattctaacgtcaagactgcccattatggccggggctctgcttgccgtggaagagaaaccctaggttttggaagctgatcggaaacaatggtgcagcgtctcacctaccgcaagcgccacagctatgctacaaaatccaaccagcacagggtcgttaagactcctggtggtaagctggtttaccagaccacgaagaagagggccagtggacccaagtgccctgttactggaaagaggattcaagggattccacatttaaggcctgcagaatacaagagatcaaggttacccagaaaccgtaggactgtgaaccgggcttacggaggtgtgttgtctggcagtgctgttagagaaagaattattcgagctttcttggttgaagagcaaaagattgtgaaaaaggtcttgaagatccaaaagacaaaggaaaagcaagcactgaagggctaagttttgtgaagggatagatctttttggagaattttaggtttgggggattacagtaaagcatgaaatttattattagagctgtttccatgttaatttgtgtttggctttgttgaactcattctagtgttaattttgtcgacaactccattatgatacaattttgtatgtcacgatttgctcttgttggattaatgtttttctatcgctatattgattcttgctcgtanaaaaa

SEQ ID NO: 2981 - DNA, 730 bp, Phaseolus coccineus
gtttgcggcgcatcttcttctttcttgctaaaaccctaacaaaacagacgcaggagcatagcgtgatcgaaggaagatggtgcagcgtctcacctatcgtaagcggcacagttatgccacaaagtccaaccagcacagggttgtcaagacccctggtgggaaactcgtttatcagaccaccaagaagagggctagcggacctaagtgccccgtcactggcaagaggattcaggggattccacatttgaggcctgcagaatacaaaaggtcaaggttacctagaaaccgcaggactgtaaaccgtgcatatggtggagttttgtctggaagtgctgtcagggagaggattatccgagctttcttagttgaggagcagaagattgtgaagaaggtcttgaagatccagaagaccaaggaaaagcaggccttgaaaggttaaatttggacagcaaaatgagatacatctttttggaggaggattgttaggtttgagtgtggttatagtaaatcacaaattttattagagttgttatgttaatcatgcttctattatttggtttgacttggactcattctagagcaattgttaactttgtcaatgctattttgataacagtttttttttgtctcagaatttattttgatgtttctgtttactatgtttctacaataggactttgatattctactcgaattgtgatacatctcaatttggactatttgtttgttt

SEQ ID NO: 2982 - DNA, 681 bp, Manihot esculenta
ggtctcggcttctcttctcctcttttgctcgctcacgaagacctgagattgaagaggagatcagagaagggggaaaatggttcagcgactcacttataggaaaaggcacagctatgccaccaaatctaatcagcaccgcatcgttaaaaccccgggcggaaaattggtgtatcagaccaccaagaagagagcaagtgggcctaagtgtcctgtcactggcaagcgaattcaagggatccctcacctgagacctgccgagtacaagagatctagattgtccaggaaccggcgcactgtcaatcgtgcctatggtggcgtattgtctggaagtgctgtcagggaaagaattatccgagccttcttggtggaagagcaaaagatagtaaagaaggtgttgaagattcaaaaggcaaaggaaaagcaagcgtcaaggagctaaaatgagaggcagatacagcgaaatcctggaagttagaagatacgctacatagaaattttggggcaattgatgagaatgagatgtggaatttgaatttggagattgttaattttatcttgtttggatacctgattgccagctagttgttttatgtgataatttgtgcttttgatcgcttggaatatcccatcgtgtgttaatgtactgaaaattttaatgctgctttgaatttgcttttgtaa

SEQ ID NO: 2983 - DNA, 738 bp, Ricinus communis
atcacaataaaaccccttcttctctgctataagcgcagctctcgcactcaaaaccctaagagagagaacctagcaaaggataataaaacatggttcagcggcttacatatcggaaacggcacagctatgccaccaagtcgaaccagcaccggatcgtcaaaacccctggaggaaagttggtgtatcagaccacaaagaagagagcaagtggtcctaagtgccctgttactggcaagaggattcaagggatccctcacttgagacctgctgagtataagaggtcaagattgtcaagaaacaggaggactgtgaaccgggcttatggaggtgtattgtctggtggtgctgttagagaaaggattattcgagcatttttagttgaagagcaaaagattgtgaaaaaggtgttgaagattcaaaaggccaaggaaaagcaatcctctagaagctaggatcaaatgtccaatgttttaggcgatttgtcgaaacagccagtgctagtgaattatggaaactattgagggcattccattttgaacttgtattttgttttggctattatgaactatgttttctagtccgtcttcttttaactggtctacaaattatgttgcaattttgtcctgttttattattctcccttgatgctttcttgaacttttgcttgcatcacttgtgtaatgacaggttacttgttattgaaattaatttgtttcttaaagttaaaatgttggattg

SEQ ID NO: 2984 - DNA, 919 bp, Ricinus communis
gtcgagccttttatatcttattatctccatcacaataaaacccttcttctctgctataagcgcagctctcgcactcaaaaccctaagagagagaacctagcaaaggataataaaacatggttcagcggcttacatatcggaaacggcacagctatgccaccaagtcgaaccagcaccggatcgtcaaaacccctggaggaaagttggtgtatcagaccacaaagaagagagcaagtggtcctaagtgccctgttactggcaagaggattcaagggatccctcacttgagacctgctgagtataagaggtcaagattgtcaagaaacaggaggactgtgaaccgggcttatggaggtgtattgtctggtggtgctgttagagaaaggattattcgagcatttttagttgaagagcaaaagattgtgaaaaaggtgttgaagattcaaaaggccaaggaaaagcaatcctctagaagctaggatcaaatgtccaatgttttaggcgatttgtcgaaacagccagtgctagtgaattatggaaactattgagggcattccattttgaacttgtattttgttttggctattatgaactatgttttctagtccgtcttcttttaactggtctacaaattatgttgcaattttgtcctgttttattattctcccttgatgctttcttgaacttttgcttgcatcacttgtgtaatgacaggttacttgttattgaaattaatttgtttcttaaagtaaaaatgttggattgctaggtgaatttgcatggggatggcaatattcttttcagcacctacaattttagatcaatgaccggaatttttattgtgcaaatgctaatgttattgctttcataagcaaacgtaataattgtgtgttcgagtattctactacccagcgatggg

SEQ ID NO: 2985 - DNA, 562 bp, Cichorium intybus
caatcaccacagagccgccggccgaaaaatggtgcaacgtttaacgtaccgcaaacgtcacagctatgccaccaaatcaaaccagcatcgtgttgtgaaaacccctggtgggaagctagtgtatcagaccaccaagaagagggcaagcggacctaaatgccctgttaccggcaaaagaattcaagggattccacatttgaggcctactgaatataaaaggtcaagattatcaaggaacagaagaactgtaaaccgtgcttatggtggtgtactttctgcaggggcagtaagagaaaggatcattagggcttttttggtggaagaacaaaagattgtgaagaaggttttgaagattcaaaaagccaaagaaaaaaccgcatcaaagagttagattggtatttttttttgagtaattttggatacattgtgaaatgtgaattaggttgtgaggtgtcttgaatatgtaatcgagccacttttgcatctctactttgttgagaatttatacattattgagctttgtttatgaattgatctttaaatgatttgaggtgacaaacac

SEQ ID NO: 2986 - DNA, 593 bp, Citrus sinensis
ggcatgggatggcattaggccgggggtctctgctctggaacgaaatcctctggttgttgcttcgctggcctcctcgaaagcgagcgaaaatggttcaacgtctcacataccgcacgcgccacagctatgccaccaagtccaaccagcaccgcgtcgtcaaaacccccggggggaagctggtttaccagagcaccaagaagagagcaagtgggcctaagtgtcctgtcactggaaaaaggatccaaggaattcctcacttgagacctgctgagtacaagaggtctagactatctcgaaataggaggactgtcaaccgtgcctatgggggtgtattatctggaggtgctgtcagggagaggattatccgggcctttttggtggaggagcagaagattgtcaagaaagtgctgaagattcagaaggccaaagaaaagctggcatctaagagttaaattgagacagcagcttttgttttgcagttttaattttcttatgaaattttgacttgtatgaattatttacaatggcattttgtgccgttctatttaaacgtgaatgagcatttggtttttgcttggatgtttctttaccca

SEQ ID NO: 2987 - DNA, 714 bp, Coffea canephora
cggccgggggctactccttcagcttccccttcgcaaaaacagagagtacaccctcaaacacacacccgagggggcgcagaaatggtgcagcggctcacttatcgcaagcggcatagctatgccaccaagtccaaccaacaccgggtcgtcaaaacccctggtggcaagttagtttatcagactacgaagaagagggctagtggacccaaatgccctgttactggcaagaggatccaagggattccgcatcttagacctgctgaatacaagcggtccagactagccaggaaccggaggactgtgaaccgtgcttatggtggggttttgtccggtagcgctgtgagggaaaggatcatcagggctttcctagtggaagaacaaaagattgttaagaaggttttgaagattcaaaaggcgaaggaaaagctagctgccaagagctaagataaattatgtaataatttttgaccatgctttgagagtaattttggtgatacagcttgctgcaaggaatcgtggaaatgtattatgagattatttagctcaagatttgtgttttgtcaggcttcttttgtacgacttccggtggtctacttgtcgaaaaagcccatgatcctaggattttgttttgattttatttctggatggaatttgaaatacattttggattcttaaatgttagttcagttgttctctccacagatattttgaact

SEQ ID NO: 2988 - DNA, 706 bp, Gossypium hirsutum
atgggggatcgaatcgcctcaaaaaccctagattacttagctagaggcagagcggcttcaaaatggttcagcggctcacttatcgcactcgtcacagctatgccaccaaatccaaccagcatcgcgtcgtcaaaacgcccggaggaaagcttgtttatcagaccacaaagaaaagagctagtggacccaaatgccctgtcactggcaagagaattcaaggaattcctcacttgaggcctgcggagtataagaggtctagattgccaagaaacaggaggactgtgaaccgtgcctacggtggagttttgtctggcagtgctgttagggaaaggatcattcgtgcctttttggtggaagagcaaaagatcgtgaagaaggttctgaagattcagaaggcaaaggaaaaggtgtcatccaagagctagaaatttgatatatactatctctgtatcgtagtttgaggtgtggatttatgttttaccttggctgttatgaacttgcatttctacttatctttgtcgacaaatctacttttgttaaaattttgttttttgttcattcacttgtctgctctttcttgaaatttcctttgggaattggatgcttgatgtatttgcagatgagttgcattttctatcattattaaaactagttacgtgattgcctcaaaaagaaaaaagtaccgactgcgactctgcgttgatac

SEQ ID NO: 2989 - DNA, 779 bp, Gossypium hirsutum
tccactttgtctctcttaagtcttaccataaaacagagcagagaaggtaaaacccaaagtttgaaaaccatcaaaaatggttcaaaggctcacttaccgtactcgccatagctacgctaccaaatccaaccaacaccgtgtcgttaagacccctggtgggaaattggtctatcagacaactaagaaaagagcaagtgggcctaagtgtcctgtcactggcaagagaattcagggtattcctcacttgagacctgctgaatacaaaaggtctagattgccaaggaaccgccggactgtgaatcgtgcttatggtggtgttttgtcctgcagtgctgttagagagaggataattcgagccttcttggtggaagagcagaaaattgtgaagaaggttctgaagatccagaagtccaaggaaaagcaagcttcaaagagctaagaaattagatgtcgaatcatcatttcaattctgatatgtgatcagcaaggctttggaaagtgccaccaatgacttcagaagattagaggttctctttttctattggcaaatggacttcaatgtttacaatgttttgataattttggattacgttttgatcatcgaatttaaaaaaattatggtatgatcgctaatgttattacttttttgtattttgatcattgagtcattaattgtcatttacacatagacatgttatatcatcattttagacaaaaaaattaaggttaaattgcattagtcctacatttcctttttacgaatttctttacctgcgcgg

SEQ ID NO: 2990 - DNA, 708 bp, Vigna unguiculata
tcggaaaaccctaaaaaaacagacgcaggagcagagtgatcgaagaagaagatggtgcagcgtctcacctatcgcaagaggcacagttatgccacaaagtccaaccaacacagggttgtcaagacccctggtgggaagctcgtttatcagagcaccaagaagagggctagcggacccaagtgccccgtcactggcaagaggatccaggggattccacatttgaggcctgcggaatacaagaggtcaaggctacctagaaaccgtaggactgtaaaccgtgcatatggtggagttttgtctggaagtgctgtcagggagaggattatccgagctttcttagttgaggagcagaagattgtgaagaaggtcttgaagatccagaaggccaaggaaaagcaggccttgaagggttaaatttggacagcaaaacgagacacatctttttggagggctgttaggtttgagtggttatagtaaatcacaagttttattagagatgttaattgtgcttttattatttggtttgatttgaactcattctagagctattgttaacttcgtcgacaatgccattgtgatacagttttgtttgtctcaaattttctcttgatggtttatgtttaccatgtttctgcaataggactacgaaattctactcgaattgtgatatatctcaattctgactgcatatccggttgtagtcatcta

SEQ ID NO: 2991 - DNA, 656 bp, Cynara scolymus
aacgatcaggagatagccgccgatcccaacatggtgcagcgtctcacttaccgcaaacgccatagctatgccaccaaatcaaaccaacatcgggttgtcaaaacccctggtgggaagctagtgtaccagaccactaagaagagggcaagtggacctaaatgccctgtcactggcaagagaatccaagggattccccacttgaggcctgctgaatacaagaggtctagattatctaggaacagaagaactgttaaccgggcttatggtggagttctgtctgcaggggcagtaagggaaaggatcatcagggcttttcttgttgaagaacaaaagattgtgaagaaggttctgaagatccagaaagccaaagaaaagaccgcttcaaggagttagatgtcagaatgcatctgagtcggtattctttcaaccgtcagagtaattttggatacaacccaccatgtgaaatgtgagttagtctgtgaggtgtgtcttgaatatgtaatcgagccacttttgcctctactttgtcgttaatcaaaacatttctaggttttgtttacaacttattaaatcttttgggattctttcactcttatatttacttttgaatttggttttttcatttaattgaatgactttcttaaggtatattacac

SEQ ID NO: 2992 - DNA, 649 bp, Solanum melongena
cttttggttcattcttgtcttcagtatagagaagctgaagaattttacccacgcctgaagatggttcagagacttacatatcgaaagaggcatagttatgccaccaaatccaatcaacataggattgtcaaaactcctggtggaaagctaatttaccagaccaccaagaagagagccagtggtcctaaatgtccagttactgggaagagaatccaagggattccacatctgagacctgctgaatacaagagatccagattgccaagaaaccgcagaactgtcaatcgtgcttatggaggtgtgctttctggaagtgccgtaagggagagaatcatccgggctttcttggttgaagaacaaaaaattgtgaaaaaggtgttgaagattcagaaggcaaaagaaaaactagcttcaaagagctgagggtagagatgctgaagtctctgtcaattctattatgttttcagattacttagctttgatgacgatgaatatgtgtgaaagaacatgttgaaatgcattagaatttcagctctagtatgccttttttgtaaactcctttttggaactattattgccacctgacgtgagtatatttcctctttcctgttcaatgatacttcgatgaatgataactctagttcacttt

SEQ ID NO: 2993 - DNA, 593 bp, Eucalyptus grandis
  misc_feature (592)..(593): n is a, c, g, or t
cggccggggaaagccgaggtccgtgaacgagagggaaaaccctagagagagaaggcagagagattgagagagaagccggggaaatggtgcagcgtctcacgtacaagaagcggcacagctacgccaccaagtccaaccagcacagggtcgtcaaaacccctggtgggaagctagtgtaccagaccacgaagaagagagccagcggccccaaatgtcccgtcaccggcaagaggattcaagggattcctcatttgagacctgctgaatacaagagatcgagattatcaagaaaccgccgtactgtgaaccgtgcatatggtggagtattatctggaggagctgtccgtgagaggatcattcgcgcctttttggtggaagagcaaaagatcgtgaagaaggttttgaagattcaaaaggcaaaggaaaagctagcctctaagaactaagattgttataccacagtgcttttggcactttgagagtaattttggcgtttgaattcttgacagtaatgagttgttggatttgaatttgccttttcttgggctggttgaaacatatatctagtgctcctttcatcactttttcaacnn

SEQ ID NO: 2994 - DNA, 659 bp, Hevea brasiliensis
agcccccacattcaaaaccctaggtgaaagagatagaaaggtgttaaaaaatggttcagcgacttacttatcggaagcggcacagttatgccaccaaatcgaaccagcaccgggtcgtcaaaacacctggtggaaagttggtgtaccagaccacaaagaagagggcaagtggtcctaagtgccctgttactggcaagaggattcaagggattcctcacttgagacctgctgaatataagaggtctagattgtcaagaaataggagaactgtgaaccgggcttatggtggtgtgttgtctggtggtgctgtcagagaaaggattattcgggcctttttggttgaagaacaaaagattgtgaaaaaggtcttgaagattcagaaggcaaaggaaaagcaatcctctagaacttgagattgaaatttctaatgacttggatgatttgtcgaaatagccaattttagtgagttgtggaaagtattgagggtattccaatttgaattttgttcgggctcttgtgaactgtgttttctaatcatctattttgtaagttgtctacaaattattctgcaattttgttccgttttattattcatgttttgatgttctcttgaactcattcgtggttgacatgttacctgtaatgacagattacttggt

SEQ ID NO: 2995 - DNA, 591 bp, Ipomoea batatas
attctcctccgcagcttcagcactcagaacttggagagagaaaatggtgcagcggctcacttatcgcaagcgccatagctatgccaccaagtctaaccagcaccggattgtcaagacccctggtgggaagctagtgtatcaaactacaaagaagagagctagtggacccaagtgccctgtgactggaaagagaatccaagggattccacacttgaggcctgctgaatacaagaggtctagattatctaggaacaggagaactgtgaaccgcccttatggtggagtattatcaggcggtgctgtgcgggaaaggattatcagagcattcttggtggaagagcaaaagattgtgaagaaggtgctgaagattcagaaagccaaggaaaagcaagctggaaagagctgaagatatagcctgagtcgggtgtagttttggatacagtgctaaaatgaatcatgaaaatgtattctgaggtttttggacttgagattgtattttgttgccctttattgaaacatgactgttttccttaagtttgttgaaaaatgaattatctttgtatcttgtcttgtcctattcacactagccta

SEQ ID NO: 2996 - DNA, 589 bp, Ipomoea nil
gctttgggagaagaaacaaagaaacaaacctaacccagagcttcagagcataaaaatggtgcagcggctcacctatcgcaagaggcatagctatgccaccaaatccaaccaacaccgggtcgtcaaaacccctggtgggaagctggtgtatcagaccacgaagaagagggctagtggccccaagtgccctgtaactgggaagagaatccaagggattcctcacttgagacccgctgaatacaagaggtctaggttgcctagatgcaggaggactgtgaaccgcccctatggtggagtgttgtccggcagtgctgtcagggaaaggatcatcagagcctttttggtggaagagcaaaagattgtgaagaaagttttgaagattcagaaggccaaggaaaagcaagcttctaaagcctaagttgtgtgttttgtgttgtgcaagacatgacttgctggttttagagacaaacctatttttggatacatcttagcattgaggattcttgaatgtgtattttcatgttttttgggatactcagatttgtatttttctttatgttttgttgaatgtttatctcacttatgctaa

SEQ ID NO: 2997 - DNA, 551 bp, Actinidia deliciosa
agggagagagaggcacagatcttcgcgtctcccgaagatggtgcagcgtctcacgtaccgcaaacgccatagctatgccaccaaatcgaaccagcatagaattgtcaaaactccaggtggaaagttggtgtaccagagcactaagaagagagctagcgggcctaaatgtcctgttactggaaagagaatccaagggattcctcacttgagacctactgagtacaagagatccagattatccaggaacaggaggactgtgaaccgtgcctatggtggtgtattatctggaggggctgtcagagagaggatcatccgagccttcttggtggaagagcaaaagattgtgaagaaggttttgaagattcagaaggctaaagaaaagcaggcatctaagagctaaagatgagacgtttgacaaacttcggtataatgtgcttgaaaggaattttgacttcaaagattattgtttgattataagttgtgcactatatgattgtggggtgattgttttgaattgttgaatgataatttttcttactacggttataaaa

SEQ ID NO: 2998 - DNA, 762 bp, Liriodendron tulipifera
ctttttctatccatctcttcttctactgcaaaacccttccgccttctctttttcgtttcctccagcggcgaaagagaagagagatttgaagatggtgcagcggctaacgtaccggaagcggcacagctacgctaccaaatccaaccagacgagggtagtcaaaacccccggtgggaagctcgtctatcaaactacgaagaagagagccagcggacccaaatgccctgtcactgggaagaggatccaagggattcctcacttgagacctgctgagtataagaggtcgagattgtcaagaaacagaagaaccgtgaatcgagcttacggtggagttctttctggtggtgcagtgagagaaaggatcattcgagcgttcttagtggaagagcagaaaattgttaagaaggtgttgaagatccaaaaggccaaggaaaagctgtcctccaagagctaaagaggagagaatggagataattttgactatgacgatgaatcatgcgaagttgtggtaagatatatatttgagtgtgtttttgaaaaagggtatctgatattttccatcgtttgtttggactttgatgttttagtgcgtaatcttctttttctgtctctttgttgacaattccttaactatcttgctgttttttcccttttgatcatttgttccttcagacgtcccctatgacttggtcttttgataatactagattactgttttgatacatactatttatttatcatttagttgtggatggctttatc

SEQ ID NO: 2999 - DNA, 652 bp, Medicago truncatula
aaacacaatattacacgcccctctttcatttttctagggtttcatcacaacaatcaccatggttcagagactcacataccgtaggaggcacagctatgccaccaaatccaaccagcatcgtgttgttaagacacctggtggaaagttggtttatcagacaactaagaagagagctagtggacctaagtgtcctgttactggaaagaggatccaagggattccacacttgagacctactgaatacaagaggtccagattgcctaggaaccgccgcactgttaacagggcttatggaggtgttttatccggaggagctgttagggaaaggattatccgtgctttccttgttgaagagcaaaaaatagttaagaaagttttgaagatccagaaaacaaaagaaaagcaagcagctaagagttaagctgattttatcaatggatgcataaagttgaaaatttcttttgtttagatttgtgctcaagagttttgactttcaatgatgttaattatgaatgtggaacttactttgcaattgattttatggagttttatgtttttcttgtactctagattttgttatacattgagtattagattctgttgttccagtgcacattttaaatggataacctctactgaaattgtttctgtt

SEQ ID NO: 3000 - DNA, 730 bp, Medicago truncatula
attgttgagtttctctgaaaaccctaataagctcagcggtgaggtaggggcagcaaaatctcgatcgaaaatggtgcaacgtctcacctatcgccgtcgtcacagctacgcaaccaaatccaaccaacacagggttgtcaaaacccctggtggtaagcttgtttatcagactactaagaagagagctagtggacctaagtgccctgttactggcaagagaattcaaggaatcccacacttgaggcctacagagtacaagagatcaaggctgcctagaaaccgtaggactgtgaaccgtgcttatggcggagttttgtctggaggtgctgttcgggaaaggatcattagggctttcttggttgaagagcaaaagatcgtgaaaaaggtcctcaaaattcagaaggcaaaggaaaaggttgcctccaaggcataattttggaccacaaaatgagataacaatctttttggaagactcttaggtttgggtgattatagtaaatcacaagttttattttagagttttttcccatgttaattgtgccttattggtttgtttgaactcatttttagagcaaattgttaaaccattgtgatacagttttgaattttctggtttattggattccttgtgttactgtactttaccaatagtacctttaatttcagcgcatttgtggttattcccttaagtctaaccgcacaattgaatgcttaagtgcacttttcatcc

SEQ ID NO: 3001 - DNA, 699 bp, Elaeis guineensis
  misc_feature (17)..(17): n is a, c, g, or t
  misc_feature (64)..(64): n is a, c, g, or t
tgggtcctctgcttccngcttccgaagtggagagagagggagagaggggaggagagagcggagnccaacatggtgcagcgattaacgtataggaagcgccacagctatgccaccaagtcgaaccagactagggttgttaaaactccaggtgggaggcttgtctaccagtacaccaaaaaaagagcgagcggaccgaaatgcccggtgactggcaagagaatccaagggattcctcatttaaggcctgctgagtacaagaggtccagattgcctagaaaccggcggaccgtgaaccgtgcttatggtggtgttttatcagggagtgcagtccgagaaaggatcatccgagcttttctggttgaagagcagaagattgttaagaaagttttgaagatccagaaggccaaagaaaagcaagcctccaagagctgatacagaaaagacggaaagcaaaatgcttttgagttttgttgactcagaagaaaattttgactttatgggcgatgattaatgatgcaaaatgattgggtggtaatgtggtgaggttactgtctcatttagaggtttgtttcctatagttgctatgcatgtgatttgtagaaggttttgggacatctgatcccttctttgctttatcctgattatttgttatgttggaaccttatatttcttgaattgtctggtgatgctttctagaac

SEQ ID NO: 3002 - DNA, 888 bp, Arachis hypogaea
gggagtggtgtagtgagttaggtggtaaccagttctttctgtgggcgtgggtcttgtttatggcccatgtgatgaacaaaaaaaaaagacaagtataatgtccaaaatgagatgatgaccgtccgatctaggtcattgccaatttcaattcatccattcatcaagtaccctaccatataatccgtctctgcggcgccttttctcctctcttctaaaaaccctaacgcagcagagggagcacatcaaagaagatggtgcagcgtcttacctatcggaagcgccacagctatgctacgaaatcgaatcaacacagagtggtgaagactcctggtggcaagctcgtttaccagacaaccaagaagagagccagcggtcctaagtgccccgtcactggcaagaggattcagggtattccacacttgaggccggcggaatacaagagatcaaggttgcctagaaatcgcaggactgtgaaccgtgcatatggaggggttttgtctggaagcgctgttagggaaaggattattcgcgcttttttggttgaagagcaaaagattgtgaagaaggtcttgaagatccaaaaagctaaggaaaagcaatccttgaagggttaaatttggaaaacagaatggaatcatatctttttggaagactcttaggtttgagtgattatagtaaatcacaaattttattagtgttattgtggtgttcattgttcttgttgtcttggctgaacacattccaatacggttgttaacaaattcatttctatacagttttgtttatctcaagattctatgttattttcatcttgatttctaaatattactctactcttacacttcaaaaatgtggcatcaacataaaacaataaatttgtaattcaat

SEQ ID NO: 3003 - DNA, 809 bp, Arachis hypogaea
gccaattttcaattcatccattcatcaagtaccctaccatataatctgtctctgcggcgccttttctcctctcttctaaaaaccctaacgcagcagagggagcagatcaaagaagatggtgcagcgtcttacctatcggaagcgccacagctatgctacgaaatcgaatcaacacagagtggtgaagactcctggtggcaagctcgtttaccagaccaccaagaagagagccagcggccctaagtgccccgtcactggcaagaggattcagggtattccacacttgaggccggcggaatacaagagatcaaggttgcctagaaatcgcaggactgtgaaccgtgcatatggaggggttttgtctggaagcgctgttagggaaaggattattcgcgcttttttggttgaagagcaaaagattgtgaagaaggtgttgaagatccaaaaagctaaggaaaagcaatccttgaagggttaagtttggaaaatagaatggaatcatatctttttggaggactcttaggtttgagtgattatagtaaatcacaaattttattagtgttattgtggtgttcattgttcttgttggcttggctgaacacattccaatacggttgttaacaaattcatttctatacagttttgtttatctcaagattctatgttattttcatcttgatttctaaatattactcgactcttacacttcagaaatgtggccataaacataaaacaataaatttgtaattcaatgcgtgtattgagttatgaatgtacataaattcctaagcaacatacatagtgttgag

SEQ ID NO: 3004 - DNA, 1120 bp, Capsicum annuum
gcacgaggcttctccccccttatatacacacactacatctttcttcccttcatttagcccttctacttaccagcaaaataaggtatagagaaagtaacagagccgccgcaggaaaatggtgcaacggctaacataccgtaaaaggcatagctatgccaccaaatctaaccaacatcgggttgtcaaaacaccaggtgggaagctgatttaccagacaacaaagaagagggctagtggtcctaagtgccctgttactggaaagagaattcaagggattcctcacttgagacctgctgaatacaagaggtctagattacctagaaacaggaggacagtaaaccgtgcttatggtggtgtgttgtcaggcagtgctgtacgtgaaaggatcataagagcttttttggttgaagaacaaaagattgtgaagaaggttttgaagatccagaaagccaaggaaaagcttgcagccaagagctaagcctttaatccttgattaatggtttgagaagaatttctgataccgcaggctactagaatcatgaatgtatttgaattttggtcttaagatttgtatgttggttttcgttaaaataccttgttgaaggtctttcttcagtttgtcgaaatatctgttctgctaggtttctgttttcttcattgttctggatacttaaacttggtatgaatatttgcacttcaattcaatgaggctattagttccagttttgaattcaaaaaaaaaaaaaaaaaaaaaaaaaaaaaaaaaaaaaaaaaaaaaaaaaaaaaaaaaaaaaaaaaaaaaaaacctcaagggggggcccggaaccaaattcccccaaaaggaagtcaaataaaaattaacgggccgtcttttaaaaacgtcggaacgggaaaaacccgggcgtaaccaaactaaatccccttgaaaaaaatccccctttcccaagcggggaaaaaaccaaaaaggcccccaccaatcccccttccaaaaatttgcccacccgaaagggaaaagggaaaattgaaagcttaaaaattttgtaaaaattcccgtaaaatttttgtaaaaccacctaatttttaaacaaaaaggccaaaatcggaaaaatccctaaaaaat

SEQ ID NO: 3005 - DNA, 652 bp, Capsicum annuum
tttattatctccattgttgagtagccgaaaaactcgagatactgcaaaacatggtgcagagacttacatatcgaaagcggcacagttatgccaccaaatccaatcaacacagggttgtcaaaactcctggtggaaagttaatttaccaagccaccaagaagagagccagtggccctaaatgcccagttactggcaagagaatccaagggattccacacttgagacctgctgaatacaagagatccagattgccaagaaaccgcaggactgtgaatcgtgcttacggaggtgtgctgtctggaagtgctgtaagggagagaatcatccgggctttcttggttgaagaacaaaaaattgtgaagaaggtgttgaagattcagaaggcaaaggaaaaactagcttcaaagagctgaggggtagggacgctgaagtctctgtcaagtctattgtgttttcagataacttagctttgatgacgatgaatatatgtgaaagaacctgtcgaaatgcaactgcgattagaatttaagctctagtatggttttgtaaactccttttggaactattgccacctgattggaggaggtttttcctctttccatttcaatgatattttaacgcatgataactaagtttacctgtgcaaaaaaaa

SEQ ID NO: 3006 - DNA, 805 bp, Cajanus cajan
ggggggggatgagcgtgtctgtagaaccgttagatgtaggtcatcgaaacaaaagcctgcaatccccttttatagctccctgcggcgcatcttctgcttcctccgaaaaccctaacaacacagacgcagagcttcgaagatggtgcagcgtctcacctatcgcaagcggcatagctatgccacgaagtccaaccagcacagagtcgtcaagacccctggtggtaagctcgtttatcagaccaccaagaagagggctagcggacccaagtgccccgtcactggaaagaggattcaggggattccacacttgaggcctgcagaatataagaggtcaaggttacctagaaaccggaggactgtgaatcgtgcatacggtggagttttgtctggaagtgctgtcagagaaaggattattagagctttcttagttgaagagcaaaagattgtgaagaaggtcttgaagatccagaaagctaaggaaaagcagacattgaaggcttgaatatggacaacgaaatgagacacgtctttttggaagactgttaggtttgagtggttacggtaaatcacaatttttattagagttctcatggtaattgtgcttttattatttggcttgtttgaactcattctagagcagttaactttgtcgacaatgccattgtgttacagttttgtttgtctcattttttcttttgacgatttattgatatcatcttgtttttatatatcccaataggactttgtaattttcctcgaattggaatatctcaattctggcagctttagtggtggtattctgcta

SEQ ID NO: 3007 - DNA, 777 bp, Cajanus cajan
cgggggggatgagcgtgtctctggagccgttagatatagggcaaacaaaaccctgcaatctctcttttatatctctccctgcggcacattttgtgcgtcttctgaaaaccctagcacaggcgcagagcgtgatcgaagatggtgcagcgtctcacctatcgcaagcggcacagctatgccacaaagtccaaccagcacagagttgtcaagacccctggtggtaagctcgtttaccagaccaccaagaagagggctagcggacccaagtgccccgtcactggaaagaggattcaggggattccacatttgaggcctgctgagtataagaggtcaaggctacctagaaaccgtaggactgtgaaccgtgcatatggtggggttttgtctggaagtgccgtcagggaaaggattattcgagctttcttagttgaagagcagaagattgtgaagaaggtcttgaagatccagaagtctaaggaaaaacaggccttgaagggttgaatttggacaacaaaatgatttacatcttttggagatcaattaggtttgagtggttatagtaaatcacaaattctattagagttctcatgttaatcgtgctttgtttgaactcattctagaacaatagttaactttgtcgacaatgccattgtgatgcagttttgtttgtcttaattgctttttgatgtttattggtttcatcttgttcctatatattttaatagtactttataatttctctcgaatttggatatctcaattctaactattttgcta

SEQ ID NO: 3008 - DNA, 695 bp, Populus trichocarpa
agggtttcaaataaaaccctagctatagacgctttcccgtcttcccctttgtttgcacaccatacacaaacacggagactgaagagctgatctgaagatggtgcagcgtctgacttaccggaagcgtcacagctacgccaccaagtctaaccaacaccgtgtggtgaaaactcctggtgggaaattgatttaccaaaccaccaagaagagagctagcggacccaagtgcccagttactggcaagaggattcaagggatccctcacttgagacctgccgaatacaagaggtctagattgtctaggaaccgcaggactgtgaaccgtgcctatggaggagtcttgtctggaagcgctgttcgggagagaataatccgagccttcttggtggaggagcaaaagattgtgaagaaggttttgaagatccagaagtcaaaagaaaaacaagcctcaaagagctagatgagaggtgtatgaagtggagttttcctacttagaggatgtttcagcaaacttttgttattgcttaatggccagtcaaatgtggaattgattattagcttgcttgatactctcatgacttggatatgttaattttacttattgtcaatttgatttccttgcctatatttggatggtttgccaatttcctttcattccatgttcttgcatagggcctaaatatatctaaaatcag

SEQ ID NO: 3009 - DNA, 562 bp, Salvia sclarea
tagtggatccccgggctgcaggaattcggcacgagggaagaaagagagatttggaatagcgcacgaaaatggtgcagcgactcacttaccggaaacgccatagctacgcaaccaaatccaatcaacacagagttgtcaagactcctggagggaaattggtgtaccagaccacgaagaagagagctagcggacccaaatgtcccgtcaccggcaagagaatccaagggattcctcatcttagaccggcggaatacaagaggtctaggttatccagaaaccgcaggactgtgaaccgtgcttatggtggtgtattatctggaagtgcagtgagggagaggattatccgggccttcttggtggaagagcaaaaaattgtgaagaaggttttgaagatacaaaaggcaaaggagaaaacagctgcaaagagctaaacttaatgcaatgctaagcagattgccctatcattatatatttgcttaagttttacctatgatgatgttgaaaatgatttcaaatggattagtttggttcaccagtttagaaatatatcatccgccgacac

SEQ ID NO: 3010 - DNA, 646 bp, Salvia sclarea
gagatttggaatagggcacgaaaatggtgcagcgactcacttaccggaaacgccatagctacgccaccaaatccaatcaacacagagttgttaagactcccggagggaaattggtttaccagaccacgaagaagagagctagcgggccaaaatgccccgtcaccggaaagagaatccaagggattcctcatctccgtcctgctgaatacaagaggtctaggttatccagaaaccgcaggactgtgaaccgtgcttacggtggtgtattatctggaagtgcagtgagggagaggattatccgggccttcttggtggaagagcagaaaattgtgaagaaggttttgaagatacaaaaggccaaggaaaaggcagctggaaagagctaaacttgatgcaaagctaagcagattgtccttttattttatgtttgctttagttttgcctatgatgatgttgaaaaatatctaattttaattaaccagtttagaatattttcatccgccgactcaatgttttcattgtttttgaatgattattatgctcaaactggatgagcacagtgatgcaatttttatgttctctataatagcagctgcttcgctgtcgttgtacattttcttgtcttttgctatggaaatccgcttcg

SEQ ID NO: 3011 - DNA, 673 bp, Fragaria vesca
accctttcgtcgcaaatccgtcgcacccaaacctcgagccgcaaagcagagagccaaaatggtgcagcggctaacctaccgttcccgccacagctacgccaccaagtccaaccagcaccgcgtcgtcaaaacccccggtgggaagttggtgtatcagactactaagaagagagccagtggaccaaaatgccctgtgactggcaagagaatccaaggaattcctcacttgaggcctgctgagtacaagaggtccagattgtccaggaaccgcaggactgtgaaccgtgcttatggtggtgtcttgtctggaggtgctgtcagagagaggattattcgagccttcttggtagaagagcaaaagattgtgaagaaggttttgaagatccagaaggccaaggaaaggcaggcagccaagagctaaatgattcggcaatgaaacaaaagccttttgaattataagatatgcttgagcaaagattttgacttaggttgtgttgatgagaacaatttggagctaaattggaatgcttttattgttatttgctacttgattacttgggtatttcatttcgatgacaaatcaattgtgtttctttctcgtgataaatttccacctaaatgatatcttttaatcttgccaagtcatagaagcatcccttaaattgttggattt

SEQ ID NO: 3012 - DNA, 619 bp, Helianthus annuus
tttctttctttctcctccagcctccactcacaaaccctgtaacaaacaaaccaccggccggaaacaatggtgcaacgactcacataccggaaacgccacagttatgctaccaaatcaaaccagcacagggttgttaaaaccccaggtggtaagttggtttatcagactaccaagaagagggctagtgggcctaagtgtcctgttactggaaagaggattcaagggattcctcatttgagacctgctgaatacaagcggtcaagattatcaaggaacagaagaaccgttaatcgtgcttatggtggggtgctttccgcaggtgctgtgagggaaaggatcattagggcttttttggttgaagaacaaaagattgtgaaaaaggtgttgaagatccaaaaggcgaaagaaaagacagcctctaaggcttagattttgcagtgtttctgcaattcttcatgagggtaattatagggctcttttatgttcggactgttctactttgtcgacaaacaagcttggtaaaccgtcttaggtttttgtttggtgttcaatgattctgttttggattcttttgtacgttgaatcttgtttttcttatgaactcatgttcctgctatta

SEQ ID NO: 3013 - DNA, 514 bp, Helianthus annuus
tttcagtttctctctgaaaatggtgcagcgtctgacctaccgcaaacggcatagctatgctaccaaatccaaccagcacagggtcgtcaaaacccccggtggaaagttggtttaccagaccaccaagaagagagctagcggtcctaagtgtcctgttactggaaagagaatccaagggattcctcacttgaggccggctgaatacaaaaggtctaggctatcaaggaacaggagaacggttaaccgtgcctatggtggtgttctatccgccggtgccgtgcgtgagaggatcattcgggcattcttggttgaagagcaaaagatcgtgaagaaggttttgaagattcaaaagaccaaagaaaagcaagccggaaagagttaaaagacgggttagcaacaagagatttctattagtaatgtgtttgagagaagttttgattttggcacaatggttataagatgtgaacttatagattcttgtggaaggtattgatcgattttgaatttgagaaaa

SEQ ID NO: 3014 - DNA, 713 bp, Solanum lycopersicum
aaggctttactcttttcgtccattcttgtctccactacagagaaacggcgaaacttatcgtagaagatggttcagagacttacatatcgaaagcggcacagttatgccaccaaatccaatcaacacaggattgtcaaaactccgggtggaaagctaatttaccagaccaccaagaagagagccagcggccctaaatgtccagttactggaaagagaatccaagggattccacatttgagacctgctgaatataagagatccagattgccaagaaaccgcaggactgtgaaccgtgcttatggaggtgtgctatctggaagtgctgtaagggagagaatcatccgggctttcttagttgaagaacaaaaaattgtgaaaaaagtgttgaagattcagaaggcaaaggaaaaattagcttcaaagagctgaatgtagagaccctggagtccgtcacttctattatgttttaagataacttagctttgatgacgatgaatatgtgtgaaagaacttgatgaaatgcaagtactagatttcattcagaatttaagctctagtatggttttgcaaactcctttttggaactagtgccaactgactggatgaggttgtttcctctttccggtaaaatgatactttaatgcatgattactccagttcactttactgttgtgattaatactcaagccagaatattatctttttcggatgac

SEQ ID NO: 3015 - DNA, 660 bp, Tragopogon dubius
ctttctttcagccataacagagaaaattcgcccggcagagatactctatcgacgccgaagatggtgcagcgtctcacctaccgcaaacgccatagctatgctaccaaatccaaccagcacagggtcgtcaaaacccctggcggaaagttggtgtatcagactacgaagaagagagccagtggtcctaagtgccctgttaccggcaagagaatccaagggattcctcacttgaggccagctgaatacaaaaggtctagactttcaagaaaccgaaggacagttaaccgtgcctatggtggtgtgctatctgccggtgctgtgcgcgagaggatcatccgagctttcttggttgaagagcagaagattgtgaagaaggtcttgaagattcaaaagaccaaagaaaagcaagctggaaagagttaaaaaaacaggtttgaaagaaattttgatttgacacaatggtttttaagacatgaacttatagattattgtgtaaggtattttgattgattttgaattcgaatgaggttgttatgttagtttgcttttgagtttttatatttgcatgtcggaattttatgtgcggataatcaattatgtcattgtattttgttaaattattgttcgacaaaaaaaaaaaaggactctgcgttgatacca

SEQ ID NO: 3016 - DNA, 496 bp, Tragopogon dubius
atcaggagatagccgccggccgaaatatggtgcaacgtctcacttaccggaaacgccatagctatgccaccaaatcaaaccaacatcgggttgtcaaaacacctggtgggaagctagtgtatcagaccaccaagaagagggcgagtggacctaagtgccctattaccggcaaacgaattcaagggattccacacttgaggcctgctgaatacaagaggtcaagattatcgaggaacagaagaactgttaaccgtgcgtatggtggtgtgctatctgcaggggcagtaagagagaggatcatcagggcttttttggtggaagaacaaaagattgtgaagaaggttttgaagatccaaaaagccaaagaaaaaaccgcatccaagagttagatttgagtctgttgtattctttaaaatcttggagttgatacattattaagttttgcttatgacttgatctttacttgatatgaagttgcctttttttacatataaga

SEQ ID NO: 3017 - DNA, 734 bp, Eucalyptus grandis
cctctagccagccgctttactctgttagagagagagagagagagagagaggcgcgcgcgcgcgcggggcacggacaagatggttcagcgtctcacgtaccgcaagcggcacagctatgccaccaagtcgaaccagcacagggtcgtgaagactcccggagggaagctggtttaccagaccaccaagaagagagcgagcggccccaaatgccccgtcaccggcaagaggattcaggggattcctcacttgaggccagcagaatacaagagatcaagattgtctagaaatcgcagaactgtaaaccgggcatatggtggagtcttgtctgcaggagctgttcgagagaggatcatcagagccttcttagtggaagagcagaagattgtgaagaaggtattgaagattcagaaggcaaaggacaagcttgcctcaaaaagctgagagaatacaataacctggggccactttgagttagatctgcggagagtgtaattttggcttacatttgatgatagggagccatagaaaagcaatgtgagaccattggagttgattttgacgaccaattcatcaagctgatgttttgtttctctttcccttttaattgcttttttggtgatactgtaaaatcatgtactatctgctttcctttgataccagattagttggtttttagcgtttatacacggtccgtttccattgctctggatcaatttgcaaatgtttttaagaaa

SEQ ID NO: 3018 - DNA, 531 bp, Ambrosia trifida
cccataagcaaatagccgccgacacaacaatggttcaacgtctcacataccgcaaacgccacagctatgccaccaaatctaaccagcatcgggtcgtcaaaacccctggtgggaagttggtttatcagaccaccaaaaagagggcaagtggaccaaaatgccccgttactggtaaaagaatccaagggattccgcatttgaggcctgctgagtacaagaggtcaagattatctaggaacagaagaacggttaaccgagcttacggtggagtcctgtccgctggcgctgtaagagaaaggatcattagggcgtttttggtgaagaacaaaagattgttaagaaggttttgaagattcagaaagctaaagaaaaaaccgcctcaaagagctagatgttatttgaataatgtattgggctacatttgtctctatttttgtgttcttaggtttgttcacagtttgatgttatagtatttgttttgctgttgttttactttgaagttctgttttctaaataccttatttagttcag

SEQ ID NO: 3019 - DNA, 529 bp, Flaveria ramosissima
cgccgccgatcgacaataggttcaacgtctcacgtatcgcaaacgccatagctatgccaccaaatcaaaccagcatcgggtcgtcaaaacccctggtggtaagcttgtttatcagaccactaagaagagggctagcggacccaaatgccccgtcaccggcaaaagaatccaagggattcctcatttgaggcctgctgagtacaagaggtcaaggttatctaggaacagaagaactgtcaaccgtgcttatggtggagtgttgtctgcaggcgctgtaagagaaaggatcatccgggcgtttttggttgaagaacaaaagattgtgaagaaggttttgaagatccagaaagccaaagaaaaaactgcttcaaagagctagatttttgaatatgtatcaaaccacttcttcttttcgtcgttatttaaaacactttttaggttttgttcgctattttatacattcggattatttcactgttgtattcactttcaccttgtcttttctatatatctgattatatgctggagg

SEQ ID NO: 3020 - DNA, 577 bp, Malus domestica
aacacggttgttctgagttaacctagagagagagggagagaggttgaagatggttcagaggctcacataccgtacgcgccacagctacgcaaccaagtcgaaccaacatcggatcgtcaaaacccctggtggaaagctcgtgtatcagaccagtaagaagagagcaagtggaccaaaatgtcctgttaccggaaagagaatccaagggattcctcacttgagacccgctgaatataagaggtctagactgtcaaggaacaggaggaccgtgaatcgtgcctatgggggtgtgctgtccggtggagctgtcagagagaggatcatccgagcctttttggtggaggagcagaagatcgtgaagaaggttttgaagattcagaaggcaaaagaaaagcaggcgtccaaaagcaaatagaaagtgaactatttccgtgatatgcaagcgataaattttgactagtattatgagatgaggaaaaattgttggaaccatataatttgttgtcatctttcccttaaatttgaatgagtttcttagctaacgatatcatctcaaatatttcttattacgttgtca

SEQ ID NO: 3021 - DNA, 587 bp, Malus domestica
cacggttgttctgagttaacctagagagagagggagagaggttgaagatggttcagaggctcacataccgtacgcgccacagctacgcaaccaagtcgaaccaacatcggatcgtcaaaacccctggtggaaagctcgtgtatcagaccagtaagaagagagcaagtggaccaaaatgtcctgttaccggaaagagaatccaagggattcctcacttgagacccgctgaatataagaggtctagactgtcaaggaacaggaggaccgtgaatcgtgcctatgggggtgtgctgtccggtggagctgtcagagagaggatcatccgagcctttttggtggaggagcagaagatcgtgaagaaggttttgaagattcagaaggcaaaagaaaagcaggcgtccaaaagcaaatagaaagtgaactatttccgtgatatgcaagcgataaattttgactagtattatgagatgaggaaaaattgttggaaccatataatttgttgtcatctttcccttaaatttgaatgagtttcttagctaacgatatcatctcaaatatttcttattacgttgtccaaaaaaaaaaaa

SEQ ID NO: 3022 - DNA, 416 bp, Flaveria ramosissima
catcatatcagagagcgaactcactcatcagctccgaagatggtgcagcgtctcacttaccgcaaacgccatagctatgccaccaaatccaaccagcatagggtcgtcaaaacccctggtggaaagctggtttaccagactacaaagaagagagctagtggcccgaagtgtcctgttactggcaagaggatccaagggattcctcacttgaggccggctgaatacaaaaggtcaaggctatcaaggacaggagaacagttaaccgtgcctatggtggcgtgctatctgctggtgctgtgcgtgagaggatcatccgagccttcttggttgaagagcaaaagattgtgaagaaggttctgaagattcaaaagaccaaagaaaagcaagctggaaagagttaagatgggtctgcaaca

SEQ ID NO: 3023 - DNA, 597 bp, Fraxinus spp
ggggcctcagtaaccctaacgcgacgagtcgccacctgaacccgaggaggagaaaatggtgcaacgcctcacatacaggaagcggcatagctatgccactaaatccaaccaacaccggatcgtcaaaaacacccggagggaagctagtgtaccagagcacgaagaagagggccagtggcccaaaatgccctgtgactggcaagagaatccaagggattcctcacttgagacctgctgagtacaaaagatctagattatcaagaaatcggaggactgtgaaccgtgcttatggtggagtgttgtctggaggtgctgtaagggaaaggatcattagagctttcttggtggaagagcaaaagattgtgaagaaggttttgaagattcagaaggccaaggaaaagctatcttctaagagctgatgagtgagtcatgtgccgttatagttttggatgctgattagtcaaggattattggaattgtattctgaggtttccatgcttatgtttgtttcttagattttgtcaaatgactatgttcttcagtttgtcgaaaaattctcatatttggtttttggtttccctgcctttccataatatc

SEQ ID NO: 3024 - DNA, 606 bp, Lippia dulcis
ccgaatcccatccaaaaaaatggtgcagcggcttacgtatagaaagcgccacagctatgccactaaatctaatcagcaccgcgtcgtcaagactcccggagggaagctagtgtaccagaccacaaaaaagagggcaagcggtccgaagtgccctgttactggcaagagaatccaagggattcctcatttgagacctgctgagtacaagaggtctagactatccagaaacaggagaactgtaaatcgtgcctatggtggagtgctgtctggtggtgctgtgagagagaggatcattagagcttcttggtggaagaacaaaagatcgtgaagaaggttttaaagatacagaagacaaaggaaaaggactgctggcaagagctaagtgtgcgttctgtgctgagtgagtgagttttggttgagtagccgagcccaatcatgggaatatagcaagggtttgaagcttgatatctgtatttttctttgggttcttttgaatatcacaagtcccctttctcattcagtttgtccatgtatctgcttaattaaggtttgcagaacttattttggatttttccttatgtgtcacttataattttgtctaattaa

SEQ ID NO: 3025 - DNA, 580 bp, Lactuca sativa
agcagagaagcagtagagcgccgccgaccggaaaatggttcaacgactcacataccgtaaacggcacagttatgccaccaagtcgaatcaacatcggggttgttaaaacccctggtggtaagctagtatatcagacaaccaagaagagggcaagtggacctaagtgccctgttactgggaaaagaatccaagggattccccacttgagacctactgagtacaagagatcaagattatccagaaacagaagaactgtcaatcgtgcttatggtggtgtgctttctgcaggtgctgtaagagaaaggataattagggcttttttggttgaagaacaaaagattgtgaagaaggtgttgaagatccaaaaggcaaaagaaaagactgctggcaagagctagagagagtaattttgagtgtatgaattagatcttgaatctgtaatcggatctattatgcttgctttcattacttctttaggtttttgtttttctgttttaattgttttttgaactcctccatttcggatattctgtttttgttgcttttactttggaaattaccctcttataaattcatgttt

SEQ ID NO: 3026 - DNA, 620 bp, Ambrosia trifida
acaaaaccagtagctaaaaatggtgcaacgattaacataccgtaaacgccacagttatgcaaccaaatcaaacaacatcgggttgttaaaaccccaggtggtaagctggtatatcagactactaaaaagagggcaagtggacctaaatgccctgttactggcaagaggattcaagggattcctcatttgagacctgctgaatacaagcgatcaagattatctaggaacagaagaaccgttaatcgtgcttatggtggcgtgctttctgcaggtgccgtgagggaaaggatcatcagggcgtttttggttgaagaacaaaagattgtgaaaaaggtgttgaagatccaaaaggcaaaagaaaagaccgcctctaaggcttagatttccagcgtttccgcagtttctcatgagggtaattataggtttccaagattttaaatctttattctggtaagtgggttgttttatgttcgggttcttctactttgtcgacaaacacatacttggtcaattgtgttttaggtttttgtttggtgttttcaatgattctatgaaatctgttttggattcttttattaatgtattcactttgatcctaaaaagaaaagtaccgactgcgt

SEQ ID NO: 3027 - DNA, 515 bp, Ambrosia trifida
accactacaaacacacacagagagagctcaaaatggtgcaacggctcacttaccgtaagcgtcacagctacgccaccaagtccaaccaacatcgggttgttaaaacccctggtggtaagttggtttaccagactactaaaaagagggctagtggacctaaatgccctgttactggcaagagaattcaagggattcctcacttgagacctacggaatacaagagatcaagattatccaggaaccgaagaactgttaaccgtgcttatggcggtgttctttctgcaggtgccgtaagggaaaggatcatccgagcctttttggtcgaagaacaaaagattgtgaaaaaggtgttgaagatccaaaaggcgaaggaaaagactgcgtctaaagcttagatttttctcatgagagtaattttgggtttcaagattttgaatctgtaatctggttgtttgatgtttggatacttttactactttgtgacaatcaaacttggtaaaatctgttaggtttct

SEQ ID NO: 3028 - DNA, 637 bp, Ambrosia trifida
tcgggggagtgagaaccatacataaccgtcagatctaggtagcagcattacgatcaagggtttatcatcttcttcttccaatagcaacccccgaagcctccatcggaccccaaagatggtgcagcgtctaacctaccgcaaacgccacagctatgccaccaaatccaaccaacaccgggtcgtcaaaaccccaggtggaaagttagtgtaccagactactaagaagagagctagcggtcctaagtgtcctgtcactggcaaaagaattcaagggattcctcacctgaggccaacagaatataaacgttctaggctatcaaggaacagaagaacggttaaccgtgcatatggtggtgttctgtctgctggtgctgttcgtgagaggattattcgagccttcttggttgaagagcaaaagatcgtgaagaaggttttgaagattcaaaagaccaaagaaaagcaagccggaaagagttgaagacgggtctcaactttcaacaagagattttgattagtaatgtgtttgaaagaagttttgattttgggacaatgattataagatgtgaacttatagattcttgtggaaggtattgattgattttgaaaaagaaaaaagtatacactattcactttcata

SEQ ID NO: 3029 - DNA, 842 bp, Amsonia hubrichtii
tttggcaatgggaaatattccatataaattctatctcttgctttttgtatacgttttggttcctacttgtcctactacactgagatagagagggagagagagggagaatagctttgaggtcgtcggccgaagaagaagaagatggtccagcgacttacatatcgaaagcggcacagctatgcaacaaaatccaaccaacacaggatcgtcaaaactcctgggggcaagctagtatatcagagcaccaagaagagagccagcggacctaaatgcccagttacagggaaaaggatccaagggattcctcatctgaggcctgctgaatacaagaggtcaagattgtccaggaaccgtaggacagtaaatcgggcctatggtggcgtattgtctggaagtgctgtcagggagaggataatccgtgccttcttggtcgaagagcaaaagattgtgaagaaggttctgaagattcaaaaagccaaggaaaagctagcttcaaaaagctgaagtggaatggtctaggcgaagttttgaaacaattttgatttcaatgatgacatgaagatgtggaaagagcatgtggaagtggttcttactaattactatgtcttaaccagtgtatcgactttagtttgttccgtgacctcattagtaaccaaaagtatttcgtgtttgtgctgacttatattagtcaaatgaaaacttcaattgtgggaaaccttcttgcccatctgaaacgtgaaaacatatatttatattaagcgaaaggcagacatgtttaaatgaggatggtttttgtgcaactgtctaggtagtccatcttttgctcgaatctcgtgtttcta

SEQ ID NO: 3030 - DNA, 667 bp, Amsonia hubrichtii
ttgtaggtttttactgctagttcagcttggcaaaacgaagacctctcctcctatttgctgcctccaattacatctagtctagagggagaaagtagttggcgaagatggtgcagcgtctcacgtatcgcaaacgccatagctatgccaccaaatctaaccagcaccgggtcgtcaaaacccctggtggtaagttggtctatcagagcaccaagaagagggcgagtggtcctaagtgccccgttactgggaagagaattcaagggatcccacacttgaggccggctgagtataaaaggtctcgtttatccagaaacagaaggactgtcaaccgtgcctatggtggtgtattatctggtggtgctgtccgtgagaggattgtccgagctttcttggttgaagagcaaaagattgtcaagaaggttttgaagatccaaaaggcaaaagaaaagcttgctgcaaagagctaattgaaactctttggaattctcattcccttgttatttcaaacaaaattttgacatttagtggctctacatatgtgttatactgtctctgagctgatttcttttctacttgcatgagctttccaagttcggttttccccctattaactgcgattggatttgatagtgtttcagattggttaaattgcatgaattgtttactg

SEQ ID NO: 3031 - DNA, 586 bp, Arnica chamissonis
aaaaaaaacagcgaagccgtaaacagccgcctgccggaaaatggtgcaacgactcacctaccgtaaacggcacagttatgctaccaaatcaaaccagcaccgggttgttaaaacccctggtggtaagctagtgtaccagactaccaaaaagagggcaagtggacctaaatgccctgttactgggaagagaatccaagggattcctcatttgagacccactgaatacaagagatcaagattatctaggaacagaagaaccgttaatcgtgcttatggtggggtactttctgcaggtgccgtaagggaaaggatcattagggcttttttggtggaagaacaaaagattgtgaaaaaggtgttgaagattcaaaaggcaaaagaaaagactgcctccaaggcttagatttccagcatttgggcaattttgaatctgtaatcgggtaagctggctgttctatgtttgggttcttctactttgtcgacaaacaaacttggttaaccgtgttaggattttgcttggtgtttgatggttttatgaactccgttttggattctatttatgatgtatttactttgaaattagctt

SEQ ID NO: 3032 - DNA, 471 bp, Arnica chamissonis
cagtagagagctgccggccggaaaatggtgcaacgactcacttaccgtaaacggcacagttatgccaccaagtcgaaccaacacagggttgttaaaacccctggtggtaagctagtttatcagaccaccaagaaaagggcaagtggaccaaaatgccctgttactgggaagagaattcaagggattcctcacttgagacctactgaatacaagaggtcaagattatctcggaaccgaagaacagttaatcgtgcttatggtggtgtcctttccgcaggtgccgtaagggaaaggatcattagggcttttttggttgaagaacaaaagattgtgaaaaaggtgttgaagatccaaaaggccaaagaaaagactgcttctaaagcctagatttttctgtaagctctctcatgagagtaattttgggtttcaacattttgaatatttaattggggaagcaggctgttttgtgtt

SEQ ID NO: 3033 - DNA, 603 bp, Catharanthus roseus
atttctagggttttattcagtctggggaaaaccgaagacgtcttctcacagctgcatcctcagaatagtctaaggagagaaaaaacagtaggcgaaaatggtgcagcgtctcacatatcggaagcgccatagttatgccaccaaatccaaccagcaccgggtcgtcaaaacccccggtgggaagttggtatatcagagcaccaaaaagcgagcaagtggtcctaagtgtcctgttactggaaagaggattcaagggatcccacacttgaggccggctgagtacaagaggtctcgtctatccagaaacagaaggactgtcaaccgtccgtatggtggtgtcttatccggtggtgctgtccgcgagagaattatccgagctttcttggttgaagagcaaaagattgtcaagaaggttttgaagatccaaaaggcaaaagaaaagcttgctgccaagagctaatctgaaaagcttgtcgaaatcccaaccccttgctatttcaaacaaaattttgacatctagtgctactacatgtcttttgagctgatttcctttggacttaatgagcttgcctttatgttatttttcattcgttaaattaaact

SEQ ID NO: 3034 - DNA, 991 bp, Cirsium arvense
ttcctttctcctccagcctcctcccaaaatcgcacacagtaaccgccaccggagatccgccggccggaaaaaatggtgcagcgactgacttaccggaaacgccatagctacgccaccaagtcgaatcaacatcgggttgttaaaacccctggtggtaggctagtgtatcagactacaaagaagagggcaagtggacctaaatgtcctgttactggaaagagaatccaagggattccccacttaagacctgctgaatacaagaggtcaagattatctaggaacaggagaaccgttaaccgtgcttatggtggtgttctttctgcaggtgccgtaagggaaagaatcattagggcgttcctggttgaagaacaaaagattgtgaagaaggtgttgaagatccaaaaggcaaaggaaaagaccgccaacaagagttagacgccaagcacactcatgagagtaattttgggtacagccggcactgtgaagtgtgaattagattttatgaaggttatgtaatcgggtaagcgggctgttaagtttgggtactttttttacttttgtctacaatcaaaccttgttaactttattaggtttttgtttgctgttttaatggttttctgaactcatgttttggattcctttgatattgcatttactctcaaatggtcttctcctaaattcatgttccaactatgaatcccctttggagacatacatcatatgtaggtaaagtatattgtgagaagttgattttgcgtgagaaggggatttgaacccgtgatcactttttaatcttaagcccatttgtgaaaccaagtggaagaatcgaaatattttaattaatgaaccatgataattgcttataaatatctctattattttcaaatataatgaattgtatggtttgtaatgacctagagagaatttaggtgcctaaaatggattaggaacgtgaaaccggttatatcaggccacatgtctctttttagga

SEQ ID NO: 3035 - DNA, 651 bp, Cirsium arvense
tgcatctcatcgttcccccaaattccttctcctccagcctcccctcaaaatcacacacagagagagctgccggccggaaaaatggtgcaacgactcacataccgtaaacggcacagttacgccaccaaatcgaatcaacatcgggttgtcaaaacccctggtggtaagctagtttatcagaccaccaagaagagggcaagtggacctaaatgccctattactgggaagagaatccaagggattccccacttaagacctgctgaatacaagaggtcaagattatctaggaacagaagaaccgttaatcgtgcttatggtggtgttctttctgcaggtgccgtaagggaaagaatcattagggccttccttgttgaagaacaaaagattgtgaagaaggtgttgaagattcaaaaggcaaaagaaaagactgccaacaagagttagagcttgagagtaattttgggtacagccgacactgtgaagtgtgaattagattttatggtgtcaagtgatcttcaaatctgtaatcgggtaagcgagttgttttaagtttacctttacttttatctacaaatcaaaccttggtaactttattaggtttttgttttctgtttaatggttttctgaactttgttttggtattgcatctac

SEQ ID NO: 3036 - DNA, 746 bp, Citrus clementina
atgtctgtcactgctgttttgcttttggagatgccaaaacaagaagatgatttagggatttcagatttgcgtattggtgcaggcagtggaattggagaaagctcttcttcttccacctctatatcccacgtaggtgattttttttttttaaatctcattaaaagaaaagagactaaaatggttcagcggctaacataccgcaaacggcacagctatgccaccaaatcaaaccagcaccgggttgttaaaacccctggtggaaaattggtgtaccagagcaccaagaagagagctagtgggcctaagtgtcctgttactggcaagagaattcaagggattcctcacttgagacctgctgagtacaagaggtctagattgtcaagaaaccacaggactgtgaatcgtacttatggtggagtattgtctggtggggctgtcagggagaggataattcgagcattcttggtggaagaacagaagattgtgaagaaagttttgaagatccagaaagcaaaggaaaagcaggccttaaagagctagaaaatgggaagataaaagctaatcctttttcaactgtagaacgtgggatagagaaattttggtgtggttatgatcaatgatgtggtactgagagagttgaacgttcttttatattatttagtctgtttgatattgattacttaaattttgaagagaaatcaattaccggttcttggtttattaaaattaagtagttaattttgaga

SEQ ID NO: 3037 - DNA, 513 bp, Euonymus alatus
cggccgggggagggcacacggcacacatttaacgaacactccgctaagcaactttgtagcctccactcgaataaaaactctctgccgtttagcctctagagcgcgccagtgattgaaagagacaaagagggcaacaatggtgcagcgtcttacgtataggaaacgccatagctatgccaccaagtccaaccagcatcgagttgtcaaaactcctggtgggaagcttgtgtaccagggtaccaagaagagagcaagtggtccgaaatgtcctgtcactgggaagagaatccaagggattcctcacctaagacctactgaatacaagaggtctagactatcaaggaatagaagaaccgtgaaccgtgcttatggtggtgtcttgtcaggcggtgctgtcagggagaggatcatccgggcctttttggtggaggagcagaagattgtgaagaaagttctgaagattcaaaagtccaaagaaaagctagcatcaaagagctaagatggaaaagagcc

SEQ ID NO: 3038 - DNA, 548 bp, Euphorbia peplus
cgggggaaggatattagaatccaaaatggttcagcggctcacttatcggtccaggcacagctacgccaccaaatctaaccagcaccgcatcgtcaaaacccctggtgggaaattggtgtatcagaccaccaaaaagagagcaagtggaccgaaatgccccgtcactggcaagagaatccaagggattcctcacttaagaccagctgagtataagagatctaggttgtctaggaaccgtcggaccgtcaatcgggcctatggtggtgtgttgtctggaggcgctgttagggagaggatcatccgggcctttttggtggaggagcaaaagattgtgaagaaggtattgaagattcagaaggcaaaggagaaggtttcaaagagttagaatgagggttttgatatattaagagtgttgtgagttagacgaatttttgttggattgatccgagtcacttgatactttaattttgggatgtgtttgactctgaatacttgtttcgtcactttttgagtagaattcatggtcaattagctgtttaaaaaaaaca

SEQ ID NO: 3039 - DNA, 598 bp, Euphorbia peplus
ggccgaaggaacgagagtatcagtaaggcgaaatggttcagcgactcacctatcgctcaaggcatagttatgccaccaaatctaaccagcaccggatcgtcaagacccctggtgggaaattggtgtatcagaccacgaaaaagagggctagcggacccaaatgtcccgtaactggaaagagaatccaggggattcctcacttgcgacctgctgagtacaagaggtcgaggttgtcgaggaaccgacgtacagtcaaccgtgcgtatggtggtgtgttgtccggaggtgctgttagggagaggattatccgtgctttcttggtggaggagcagaagattgtgaagaaggtattgaagattcagaaggccaaggagaaagtgtcaaagagttagactgagaggaggtggtatatttgagtcttctgagctaaaaagaatgtgctggagatgaattttggttttgattgatcccaacaaattagaacttgattttgatgattttgtttgatgttgaatacttatttgttcacttgatagaattcatggtcaattaggtgtgttgtgttataatatgcgcttctactatatttactgaacca

SEQ ID NO: 3040 - DNA, 582 bp, Euphorbia peplus
ctcgcacttgcatagaacgaaaaggaaaaatggttcagcgactaacataccgatcgaggcatagctatgccacgaaatcaaatcagcatcgcatcgtgaagacccctggtgggaaattggtgtatcagaccaccaaaaagagggccagcggacctaaatgccctgttactggcaagaggattcaagggattcctcatttgagacctgctgagtacaagaggtccaggttgtccaggaaccgacgcacagtcaatcgtgcctatggtggtgtattgtctggcggtgctgttagggagaggatcatccgagctttcttggtggaggagcagaagattgtgaagaaggtattgaagatacaaaaggccaaggaaaaggtgtccaagagttagaaggatatgatggagaggaattttggtaattgatcctaatgaattagaggttgaatttgaagattttgtttgatgttgattacttgtttgttcacttttactagaatgaattcatggtcaattagttgttttgtgttatagtttgtgtttctactatatttgccgaaacaacccaactcctctattgcaatat

SEQ ID NO: 3041 - DNA, 494 bp, Flaveria ramosissima
aaaccctagagtccctccgattcaacgatggtgcagcgtctaacctactgcaaacgccatagctatgctaccaaatccaaccaacacagggttgtcaaaacccctggtggaaagttggtttaccagaccacaaagaagagagctagtggacctaagtgccctgttactggcaagagacttcaagggattcctcacttaaggccagctgaatacaaaaggtctcggctgtctaggaacaggaggactgttaaccgggcatatggtggtgtattgtctgctggtgccgtgagagagaggattattcgtgctttcttggttgaagaacaaaagattgttaagaaggtcttgaaaatccagaaggcaaaagaaaagcaagctggaaagagttaaacaccgggtatatcacgaagaaatttttgagtcgttactgtgttttcaagtaatttgaatttgacacaattgttacaagctgtaaactttgcattatttttgtt

SEQ ID NO: 3042 - DNA, 701 bp, Linum usitatissimum
ggcagccgtccgatttagggttccgcctcttctatattatctttcctctctactcttaaaaaagccttctcttttgctagcagagctccccccagcagtctgaaaacccctagcagaaaactagccgatccgatccgcgaaaatggttcagcggttaacttaccgtaagcgccatagctacgccacaaagtccaaccagcaccggattgtcaaaactcctggtgggaagttggtgtatcagaccaccaagaagagggccagcggaccgaaatgccctgttactgggaagaggattcaagggattccgcacttgagacctgctgagtacaagaggtcaagattgccaaggaacaggaggactgtgaaccgtgcctatggaggagttctttctggaggtgctgtcagagaaaggatcatccgtgctttcctggtcgaagagcaaaagattgtgaagaaggtcttgaagatccaaaaatccaaggaaaaggtcaccaagagctaaatgtttaacacgaaagaattgtcgttggaactggtggctgtagaggatgaatcgtttcgtatcttagatgtgtttcaatttgagattgtactttttattcttcagtgaatgatggacactcctagtgaacttatatctgttcttttatcatccgaaaatttttgtatctcttagccaatgaatatggaactagtttctg

SEQ ID NO: 3043 - DNA, 646 bp, Fraxinus spp
agaagccggtaagccgtcaaccgagaaagtggaaaatggttcaacggcttacatacaggaaacggcatagctatgccactaaatccaaccaacatcggatcgtcaaaacccccggagggaagctagtgtaccagagcactaaaaagagggctagtggccctaaatgccctgttactggcaagagaatccaagggatacctcacttgagacctgctgagtacaaaaggtctagattgtccagaaatcggaggactgtgaaccgtgcatatggtggagtgttgtccggtggtgctgtaagggaaagaattattagagctttcttggtggaagagcaaaagattgtgaagaaggttttgaagatacagaaggccaaggaaaaactggctactaagagctgaggcgctgagatagttttgtttcttttggatacaaatagtcaaggaatcaatgaaatgtactttcaggttttcgagctagatatctgcattttcatggaattttttgagatgtgacttttgttttcagtgttctaccatcttggaagttttggttctccagctatttttgacatttgaaattcattttggatttgctttgatgtaattctcagagtttttagttaatatgctaatgtccagtttcctcc

SEQ ID NO: 3044 - DNA, 628 bp, Fraxinus spp
agaagccggtgagctgtcaaccgagaaagtggaaaatggttcaacggctcacatacaggaaacggcatagctatgccactaaatccaaccaacatcggatcgtcaaaacccccggagggaagctagtgtaccagagcactaaaaagagggctagtggccctaaatgccctgttactggcaagagaatccaagggatacctcacttgagacctgctgagtacaagaggtctagattgtccagaaatcggaggactgtgaaccgtgcatatggtggagtgttgtccggtggtgccgtaagggaaagaattattagagctttcttggtggaagagcaaaagattgtgaagaaggttttgaagatacagaaggccaaggaaaaactggctactaagagctgaggcgctgagatagttatggatacaaatagtcaaggaattaatgaaatgtactttcaggttttcgagctagatatctgcattttcatgggattttttgagatgtgacttgttttcagtgttctaccatcttggaagttttggttctccagctatttttgacatttgaaattcattttggatttgctttgatgtaattctcagagttttgagttaatatgctaatgtccagt

SEQ ID NO: 3045 - DNA, 533 bp, Fraxinus spp
gaaggaccttgaccattacgtttagcagaaacgagcatctagagagtagagagagaggtcccgaagatggtgcagcgcctcacttaccgcaaacgacatagctatgccacaaaatctaaccaacaccggatcgtcaaaactcccggtgggaagttggtatatcagagcactaagaagagggcaagtgggcccaaatgccccgttactggaaagagaattcaagggattcctcacttgagacctgctgaatataagaggtccagattatctaggaataggaggaccgtgaaccgtgcctatggtggtgtattgtctggtggcgctgtgagagagaggattattcgagctttcctggtcgaagagcaaaagatcgtgaagaaggttttgaagattcaaaaggcaaaagaaaagctggcagggaagagctaagaatttttgcttttaagtattcaccaaaaaaagttttgacattgaaaatgattcgtagtgtactcaaatatcattatactggtattggttcttctcttggaatg

SEQ ID NO: 3046 - DNA, 555 bp, Olea europaea
accttctttgcctcaataaccctaaagcgccgagtgaagacctgaacccgaggaccgaataaggaggaaaatggtgcaacgcctcacatataggaagcggcatagctatgccactaaatccaatcaacaccggatcgtcaaaacacccggagggaagttagtgtaccagagcacgaagaagagggctagcggcccaaagtgccctgttactggaaagagaatccaagggattcctcacttgagacctgctgagtacaagaggtctagattatcaagaaatcggaggactgtgaaccgtgcttatggtggagttttgtctggaggtgctgtaagagaaaggatcatcagagctttcttggtggaagagcaaaagattgtgaagaaggttttgaagattcagaaggccaaggaaaagctatcttctaagagctgaagtgtgagtcatatgccagtgtagtttttggacactaattagtcaaggataattgatgtattctgaggtttccatgctcaaattatgtacgtttgttagattttgttcaaatgactgtgttc

SEQ ID NO: 3047 - DNA, 628 bp, Platanus occidentalis
agagagagattgagggcttcaacgctccaagatggttcagcggctgacttatcggaagcggcacagctacgccacgaaatccaaccagacaagggtcgtcaaaacccctggtgggcggcttgtttaccagaccactaagaagagggctagcggacccaagtgtcctgttaccggaaagagaatccaagggtttcctcacttgagacctgctgaatacaagaggtctagattatctaggaaccggaggactgtaaaccgtgcttatggtggggtgttgtctggaagtgctgtcagggagaggatcattagagccttcttagtggaagagcaaaagattgtgaagaaggtgttgaagatccagaaggcaaaagaaaagcaagcttcaaaaagctgataagagagggagagaagcaagaaattattttctgttttattgagttttaagttttgacttcgacagataacatggaaagttggtggttttgaatctgaaagagtatttatgttgaggtgtttgactgtgatttcttgtcgaatgccatgttgtttttagtttaattgttctctgtggacatatttcatcgtttttagcctgaaatgctcttttattatattattggattaacgt

SEQ ID NO: 3048 - DNA, 621 bp, Scabiosa columbaria
cttttgttgcagccctatcttggtgaggaagagggagtgaagaagaaaaaaaaaaggagcgaagatggttcaaaggctcacataccgtaagcggcacagctatgccaccaaatctaaccagaacagagtcgtcaaaaccccaggaggaaagttggtgtaccagactacgaagaagagggctagcggacctaaatgtccggttactggaaagagaatccaagggattcctcatttaagaccggctgaatacaagaggtcaagattggccaggaaccgtaggacagtcaatcgtgcttatggtggtgttttgtcaggtggtgctgttagggagaggataatccgagcgttcttggtggaggaacaaaagattgtgaagaaagttctgaagatacaaaagtcaaaggaaaaggtagctggaaagagttaaagatgaattagcagcagctataagagtaaagtatgagttcgaaaagaagttttggattatgaatgatgaaattgtggtaaatggtcatgttgctttttaaaagcttgaaactatgtcgttagttaaaagtttgttcctaggcttgctagttttattattctatttcccagtttgtcgacacaaatcagtttttc

SEQ ID NO: 3049 - DNA, 634 bp, Scabiosa columbaria
tgcagttgtaaagtaaagaagtgcgagagagaaacaagatggtccaaaggctcacataccgtaagcgccatagctatgccaccaaatccaaccagaacagggttgttaaaaccccaggaggaaagctggtgtatcaaactactaagaagagggctagtggacctaaatgccctgttactggaaagagaatccaagggattcctcatttgagaccagctgaatacaagaggtctagactcgccaggaaccgtaggacagtcaatcgtgcctatggtggtgttttgtctggtggcgctgttagggagaggataatccgagccttcttggtggaggaacagaagatagtaaagaaagttctgaagatacagaagtcaaaggaaaaggttgctggaaagagttgagagatacagaagtcgaagtttatgaattcaacatgaaattttggcttttggatgatgatgacaatggaattactttacaatagtcatgtttcttgaaaattgtgtttttagttaaaatttgcttgtaggcatcgtagtagttttgttctgttgcccagtttgtcgacacaaatctcttctgttagatgttatcttttgttgatacagtattttcaatgctctgaacattgaac

SEQ ID NO: 3050 - DNA, 653 bp, Tabernaemontana elegans
gcacacagagtacacagagagattacgggggtgcaaaaatggttcaacggctgacttatcgtaagaggcatagctatgccaccaagtctaaccaacaccgtgtcgtcaaaactcccggtgggaagctagtgtaccagagcacgaagaagagggcaagtggaccaaaatgccctgttactggcaagaggatacaagggattccacatttgagacctgctgaatacaaaaggtctagactatctagaaacaggagaactgtgaaccgtgcttacggtggagtattgtctggaagtgctgtgagagaaaggatcattagagcatttctggtggaagaacagaagattgtgaaaaaggttttgaagattcagaaggccaaggaaaagctagctgccaagagctaaaatgaattctatagtaatttttgtctagctttgagagtaattttgagatacagcttccaacatggatttatcgaaatgtatgagttcttttttttagctttaagtttgtattttgtccggcaccgtctgtcggtgactcgcagtgtttctttactttgtcaaaaagtcaattctgctaggattatgtgttcattattttgaaatggaagttaaagtagtacgtttgggactcttaatgcaagtttagtttga

SEQ ID NO: 3051 - DNA, 658 bp, Solanum lycopersicum
catttagcctcttcttcttcagcctccaaaaaccagagagtagagtaacagagccgccgtcaaaaatggtgcaacggcttacttaccgtaaacggcatagctatgcaaccaagtcgaaccaacatagggttgtgaaaaccccaggtggaaagctgatttaccagactacgaagaagagggctaatggacctaagtgccctgtaactggaaagagaattcaagggattccacacttgagacctgctgagtacaagagatccaggttatctaggaacaggaggactgtgaaccgtgcttatggtggtgtgttgtcaggcagtgctgtacgtgaaaggatcatcagagcctttttggttgaagaacaaaagatcgtgaagaaggttttgaagatccagaaagccaaggaaaagctagcatccaagagctaagccttgaatcctcgatgatgtcgtgagaggagtttctgatactgcaggtttctaggaaatcatgactgtattttgatttttggtcttgagatttgtatgttgctggtttttcgttaaaatacgatattggaggtctttcttcagtttgtcgaaatatccgttctcctaggtatctctattttcttgttctgaatatttaaacttgttatggatatttgcaacttcaattc

SEQ ID NO: 3052 - DNA, 739 bp, Trigonella foenum-graecum
acaatcgttagatctaggttatcgttctctcttttatactccttgcggcgcattgttgagtttctctgaaaaccctaactagttaagcggtgaggcagaggcttgatcgaagatggtgcagcgtctcacctatcgcaggcgtcacagctacgcaaccaaatccaatcagcacaggattgtcaaaacccctggtggtaagcttgtttatcagactactaagaagagagctagtggacctaagtgccctgttactggcaagagaattcaaggaattccacacttgaggcccacagagtacaagagatcaaggttgcctagaaaccgtaggactgtgaaccgtgcttatggtggagttttgtctggaggtgctgttcgggaaaggatcattagggctttcttggttgaagagcaaaagattgtgaaaaaggtcctcaaaattcagaaggcaaaggaaaagcaggccacaaaggcttgattttggaccacaaaatgagataaaatctttttggaggactcttaggtttgggtgattatagtaaatcacaagttttattagagtttttcccatgttaattgtgttttattggtttgtttgaactcatttttagagctattgttaaaccttgtgaactattccattgtgaaacagttttgagttttctggtttattggattccttctgtgttacgaccttaccaatagtacctttagtttccctacccgcagattcctggaaatt

SEQ ID NO: 3053 - DNA, 722 bp, Trigonella foenum-graecum
cgccaccatatttatggccacaaacacaatacacaacgcccctctttcatttttctagggtttcacagcaacaacaacaacaatcaccatggttcagcgactcacataccgaaggcgtcatagctatgccaccaaatccaaccagcatcgtattgttaagacacctggtggaaagttggtttatcagactacaaagaagagagccagtggacctaagtgtcctgttactggcaagaggatccaagggattccacacttgagacctactgaatacaagaggtccagattgcctcgtaaccgcagaactgttaacagggcatatggcggtgtgttatccggaggagctgttagggaaaggattatccgtgctttccttgttgaagagcaaaaaatagttaagaaagttttgaagatccagaagacaaaagaaaagcaagcagctaagagttaagctgatttgttaatcaatcaatggaaggcaaaaaaagttacaaattccttttgtttagatttgtgctcaagagttttgattttgaatggtgttaattatgaatgttgaacttaatttgaaattgattttgtggaatttcatgtttttcttgtactctaatttttgttatacagtattcaattctgttgtccagtgcatattttaaatggaaaacctctagtgtttctatcatcttttgaaaattaatgagatatgttagtatttactttgt

SEQ ID NO: 3054 - DNA, 746 bp, Tripterygium wilfordii
tgctgagcaatttgtcgacgttcatagagtgaagaactgaaaatggtccaaagacttacatatcgcaagcggcatagctacgcaacaaagtccaaccagcaccgggtcgtcaaaactcctggtgggaaattggtttatcagagcacgaagaagagagcgagtgggcccaaatgtcctgttactggcaagagaattcaaggaattcctcacttgcgacctgctgaatacaagaggtctagattgtctaggaaccgcaggactgtgaatcgtgcttatggtggtgttttgtctggcagtgccgtcagggagaggataattcgagccttcttggtggaagagcaaaagattgtgaagaaggtattgaagattcagaaggcaaaggaaaagctttcctcaaagagctgaaatatcatttaggggacggcgttgttttacataaattttgtttgtggctatgatgaaattaaaatatgaaattgaaatgcgtgaaaaactagctccgttgaagaccagcacttgtactttgtttctttccttaagctgcaaactgttgagtattttgtttcatgatgacgactatttgcttgttgaggtaaatcatgttattgaattctctatactagcctagtttgtgttctattgtttctccctgtatgctacatttggaagtcgaaaatgtctggtttgttttgtgagaattttctatcatctccagaagatgttcattgtttttaaaaaaaaaaaaa

SEQ ID NO: 3055 - DNA, 702 bp, Acacia harpophylla
gctgcattctcgtcgaaaaccctaagcaagaagtaggcggaggtagctcaacatggtgcagcgccttacttaccgcaagcgtcacagctatgctaccaaatccaaccaacatagggttgtcaaaaccccaggtggtaggctcgtctatcagagcactaagaagagggcaagcggacccaagtgccctgtaacaggcaagaggattcaagggattccacacttgaggcctgctgaatacaagagatcaaggttacctagaaaccgaaggactgtgaaccgtgcatatggtggagttttgtctgggggtgctgtcagagaaaggatcattcgggccttcttggttgaagagcaaaagattgtgaaaaaggtgttgaagattcagaaggccaaggaaaagcaatccttgaagggttaagtttgggcaaagagcaagataaggttctttttgaggatttttaggtttgggtgattacagaagtcacaatattctctttagatttgttcccatgtgggaattgtttttctttggcggagtttgaactcattctagcacaattaactttgtcgacaactccattatgattcagttttgtatcagtttcctcctagttctatcctgttttcaacttaccactactagttcctccgtagttagtaaataatgtgaatagcgggtttcaatcaaattactgatgttaagaa

SEQ ID NO: 3056 - DNA, 378 bp, Aquilegia formosa
caaaatggttcagagacttacttaccgaaagaggcatagctatgctaccaaatctaaccagaatcgagttgtcaaaactcctggtgggaaacttgtttatcagactacgaagaagagagcaagtggtcctaagtgtcctgttactggaaagagaatccaagggattcctcacttgagacctgctgagtataagaggactagattatctaggaatagaagaactgtcaaccgggcttatggcggtgtattgtcaggaggcgcagtcagggagaggatcatcagagcctttttggtggaagagcaaaagattgtgaagaaagttctgaagatccagaaggccaaggaaaagacagtttcaaaaagctaaattcaagggct

SEQ ID NO: 3057 - DNA, 869 bp, Aristolochia fimbriata
ttttttttctttcttctagcgttgaggcgagaggagtgagaggtgaaatcatggtgcagcggctaacctaccggaagcggcatagctatgccaccaagtccaaccagaaccgggttgtaaaaactccaggtgggcgattggtctaccagacaacgaagaagagggcgagtggtccgaaatgccccgttactggcaagagaattcaggggattcctcacctaagacctgctgagtacaagaggtctagattgtctaggaacagaaggacagtcaaccgagcgtatggtggtgttctctcaggaagtgctgttagagagagaattatccgtgccttcttagtcgaggagcaaaagattgtgaagaaagtgttgaaaattcaaaaggctaaggagaagcaggctgccaaaagctaagtggctttgagaaggcaagcttgaaaaagagcaatggatttttgagtggacatctatttgtgttttttcttcacaaatgttaggctgtatttgatgacactaccaagtactaaatctgtcgaagctgttatttttctttataattttgaatatactcttgagtgctttcatttagcaatgggtagtataattttggttcgtttctagtaggaacttttagcttgacgtttatgaaattagataaacttaatatttatttttctctttttgagcgagaggcctttaattggcctaggctttacgagtcaaggtggactcgtcgcagtaaattgttttgtatcgtatgggatggtgtatttcatgataggtgcaggctcttgtatcaattgtagatacgatggacctcccgttagcgcctggctgatgagggtaaacgcttcagtttatgttctaaaa

SEQ ID NO: 3058 - DNA, 538 bp, Phaseolus coccineus
gctagtttgtgtcctctaggttttacttccattacccacaaaaatggtgcagaggctcacttatcgcaagcgccacagctatgccaccaaatcgaatcagcatcgggttgtcaagacccctggtgggaagttggtgtaccagaccacaaagaagagggctagtggacccaagtgccctgtcactgggaagaggatccaagggatcccgcacttgagacctactgaatacaagagatctagattgtctagaaaccgcaggacagttaaccgagcctatggaggtgttttatctggaggagctgttagagaaaggattattcgagctttccttgttgaagaacagaaaattgtgaaaaaggtattgaagatccagaagacaaaagaaaagcaggcagcaaagaattaagctgatgagtgtttcatgaaatatcttgtcgttaagaattgtgctaaagaattttgactttgaatggtgtttaaccatgaatgtggaacttaatttgaaattgattttatgattcttgtgtctttttggtag

SEQ ID NO: 3059 - DNA, 568 bp, Catharanthus roseus
actagtggatccaaagaattcggcacgaggcagctgcatcctcagaatagtctaaggagagaaaaaacagtaggcgaaaatggtgcagcgtctcacatatcggaaacgccatagttatgccaccaaatccaaccagcaccgggtcgtcaaaacccccggtgggaagttggtatatcagagcaccaaaaagcgagcaagtggtcctaagtgtcctgttactggaaagaggattcaagggatcccacacttgaggccggctgagtacaagaggtctcgtctatccagaaacagaaggactgtcaaccgtccgtatggtggtgtcttatccggtggtgctgtccgcgagagaattatccgagctttcttggttgaagagcaaaagattgtcaagaaggttttgaagatccaaaaggcaaaagaaaagcttgctgccaagagctaatctgaaaagcttgtcgaaatcccaaccccttgctatttcaaacaaaattttgacatctagtgctactacatgtcttttgagctgatttcctttggacttaatgagcttgcctttatgttatttttc

SEQ ID NO: 3060 - DNA, 678 bp, Centaurea maculosa
taggcggggcgcctcctttcaattcacacacagaaaccaccgccaccggagatccgccggccggaaaaatggtgcagcgactcacttaccggaaacgccatggctacgccactaagtccaatcaacatcgggttgttaaaacccctggtggtaagctggtatatcagactaccaagaagagggcaagtggacctaaatgtcctgttactggaaagagaatccaagggattccccacttaagacctgctgaatacaagaggtcaagattatctaggaacaggagaaccgttaaccgtgcttatggtggtgttctttctgcaggtgccgtaagggaaagaatcattagggcgttcctggttgaagaacaaaagattgtgaagaaggtgttgaagatccaaaaggcaaaggaaaagaccgccaacaagagttagaggccgagcacactcacgagagtagttttgggtacagccggcactgtgaagtgtgaattagattttatgaagattatgtaatcgggtaagcgggctgtgttttaagtttgggtactttttttttacttacttttgtctacaatcaaaccttgtttaactttattaggtttttgtctgctgttttaatggttttctgaactcatgttttggattcctttgatattgcattactctcaaattgtcttcg

SEQ ID NO: 3061 - DNA, 680 bp, Cicer arietinum
gattagcgtggtcgcggccgaggtggaaatcagcctcagagaagggaacaaagatggttcagaggcttacctaccgcaggcgtcatagctatgccaccaaatccaaccaacatagggttgtcaaaacccccggtggaaagcttgtttaccagacaactaagaagagggccagtggaccaaaatgccctgttactggaaagaggattcaagggattccacatttacgacccacagagtacaagagatcaaggctatctagaaacaggaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcatgttttcttatgaatatatgaattttcatgttttcctctgaatatatgctcatacttataatatttgaagttagggta

SEQ ID NO: 3062 - DNA, 558 bp, Cicer arietinum
acgcggggacactcacacaccaacacgcccctcttttctagggttacacattcgccatggttcagagactcacataccgaaggcggcatagctatgccactaaatccaaccagcatcgtgttgttaagactcctggtggaaagttggtttaccagactacaaagaagagagccagtggacctaagtgtcctgttactggaaagagaatccaagggattccacatttgagacctactgaatacaagaggtctagattgtctcgtaaccgcagaactgtaaaccgggcatatggaggtgtattatctggaggagctgttagggaaaggattattcgtgctttccttgttgaagaacaaaagattgtgaagaaggtattgaagatccagaagacaaaagaaaagcaagcatcaaagaattaagctgaattgatcaggaatggaaaaagttcaaatattatgtctcttaagatttgtcctcaagagttttgactatgaatggtgttaattatgaatgtggaacttattttgaaattgaattaatggagttttgtgttttccg

SEQ ID NO: 3063 - DNA, 699 bp, Coffea canephora
cggccgggggctactccttcagcttctcctttgcaagaacagagagtacaccctcaaacacacacccgagggggcgcagaaatggcgcagcggctcacttatcgcaagcggcatagctatgccaccaagtccaaccaacaccgggtcgtcaaaacccctggtggcaagttagtttatcagactacgaagaagagggctagtggacccaaatgccctgttactggcaagaggatccaagggattccgcatctcagacctgctgaatacaagaggtctagactagccagaaaccggaggactgtgaaccgtgcttatggtggggttttgtccggtagtgctgtgagggaaaggatcatcagggctttcctagtggaagaacaaaagattgttaagaaggttttgaagattcaaaaggcgaaggaaaagctagctgccaagagctaagataaattatgtattaatttttgaccatgctttgagagtagtttttgtgatacagcttgctgcaaggaatcgtggaaatgtattatgagattatttagctcaagatttgtgttttgtcaggcttcttttgtacgacttccagtggtctacttgtcgaaaaagcccatgatccctaggattttgttttgattttatttctggatggaatttgaaacacattttggattcttaaatgttagttcagttgttctctcc

SEQ ID NO: 3064 - DNA, 694 bp, Gossypium hirsutum
ttcgctctggctttcgcatttctttctgaaactagagctgagaaaataaaacccaaagccttaaaaactatcaaaaatggttcaaaggctcacttaccgtactcgccatagctatgctaccaaatccaatcaacaccgtgtcgttaagacccccggtgggaaattgatctatcagactactaagaagagagcgagtgggcctaagtgtcctgttactggaaagcgaattcagggtattcctcacttgagacctgctgaatacaagcggtctcggttgcctaggaaccgtaggacggtgaatcgtgcctatggtggtgttttgtctggaagtgctgttagagaaaggataattcgagccttcttagtggaagagcaaaagattgtgaagaaggttctgaaaatccagaagactaaggaaaagcaatcctcaaagagctaggaattttaaatgctgatgaagctgaattgtgtttggcttgttagatttacctgagagaaatttttgtttgttattatggtgaattgatgaaatgtggaactgagtttgagtactttttctcatttggtagtttcatactgatatattttgctgcttggttcactagaagacaaatctattgaaaggttattgtttagtgatggttttatttgttgatgtggtttcttttattaggcattaatattatattcttgt

SEQ ID NO: 3065 - DNA, 641 bp, Cynara scolymus
cttcgttcggccatacagagagaaacttcgttcccagagatactctatctgtttcgaagatggtgcagcgtctcacctaccgcaaacgccatagctatgccaccaaatctaaccagcacagggtcgtcaaaacccctggtggaaagttggtttaccagaccacaaagaagagagctagtggtcctaagtgtcccgttaccggcaagagaatccaagggattcctcacttgaggccagctgaatacaaaagatccagactatcaaggaacagaaggacagtcaaccgtgcctatggtggtgtgctatccgctggtgccgttcgggaaaggatcatccgagcattcttggttgaagagcagaagattgtgaagaaggtattgaagattcagaagaccaaagagaaggcagctggaaagagttgagagaggggtttactagtactgaaattttgacttcaacagaatgattataagatgggaacttatggattcttgtggaaggtacttgatcgaatttgtattcgaaagagctcgttattgttagttttgtttggtttttaatatttacgttttcatactcttggtttcggatcttcgattatatgaatgtgttgccatgatctgttaagttctcttttcatc

SEQ ID NO: 3066 - DNA, 696 bp, Taraxacum officinale
acagttgcaaatagttgaatctccgccgttaaagaggaaaaaacgagccgtcagatctagggcattagtagcctagaaagggtactttcaccttagcaaaccctaataccccttttctgcaacaacgggagacagtgagcgagtctctgcgatttgaagatggtgcagcgtctcacttaccggaaacgccatagctatgctaccaaatccaaccaacatagagtcgtcaaaacccctggtggaaagctggtctaccagaccactaagaagagagctagtggacctaaatgccctgttaccggcaagagaattcaagggattcctcacttgaggccaactgaatacaaaaggtcaaggttatcaaggaacagaaggactgttaaccgtgcttatggtggtgtgttgtccgctggtgctgtaagggagaggattattcgagcttttttggtggaagagcagaagattgtgaagaaggttttgaagattcagaaaacaaaagaaaagcaagctggaaagagttgaaaaaaggggtttatggattataatgacgaaagttttgagtagttagtgtgatttgaaagatgttttgcttttttaacactatggttataagtactgaagaatgttttttctcatatttttgtggaagtcatggattggttttggagtttaatgaattttaatattttgattgca

SEQ ID NO: 3067 - DNA, 643 bp, Taraxacum officinale
gggcgggggccttttccttccgccagaacactcgttcggcagtgatacactctcgtcggcgaagatggtgcagcgtctcacctaccgcaaacgccatagctatgctaccaaatccaatcagcaccgagttgtgaaaacccccggtggaaagctggtttaccagactacaaagaagagagccagtggtcctaagtgccctgttaccggcaagagaatccaagggattcctcatttgaggccgactgaatacaaaaggtctaggttatcaaggaacagaagaacagtaaaccgtgcctatggtggcgtgctatctgctggtgctgtgcgtgagaggattatccgagctttcctggttgaagagcagaagatcgtgaagaaggttttgaagattcaaaagacgaaagaaaagcaagctggaaagagttaaaaacaggtttgaaagaaagatattttgagtagtagtgtgcgtttaaagaaattttgatatgacacaattgttataagatatcaacttatagattcttggggaaggtattgaatttgcttgagagttattgtttgggatattctttgtcttttttgtttgtttaatgacaaaatttaaaactatgtaagctgttctataaaatcttggaatttggcc

SEQ ID NO: 3068 - DNA, 533 bp, Taraxacum officinale
gcagagaagcagtccacacccgcctgccggaaaatggttcaacgactcacataccgtaaacggcacagttatgccaccaagtccaatcaacatcgggttgtcaaaacccctggtggtaagctagtataccagactaccaagaagagggccagcggacctaagtgccctgttactgggaagagaatccaagggattcctcacttgagacctactgaatacaagagatctagattatccaggaacagaagaactgttaatcgtgcctatggtggtgtactttctgcaggtgccgtaagggaaaggattattagggcttttttggttgaagaacaaaagattgtgaagaaggtgttgaagatccaaaaggcaaaagaaaagaccgctggaaagagttagagggtaattttgagtttcctatgcaatttggtccaacttgtttaggctttttgtttgctgttttaattgttctgtgaaattgacattttgtattttgttttcactttggagttggcattttataaatttatgtttca

SEQ ID NO: 3069 - DNA, 531 bp, Gerbera hybrid cultivar
ttcggacgaggtctctccgttccgaagatggtacagcgtttgacctaccggaaacgtcatagctatgccaccaaatccaatcaacacagggtcgtcaaaacccctggtggaaagttggtttaccagaccacgaagaagagagctagtggacctaagtgccccgttaccggcaagagaatccaagggattgctcacttgaggccagctgaatacaaaaggtcgaggttatctaggaacaggaggacagttaaccgtgcctatggtggcgttctatctgctggtgctgttagggagaggattatacgtgcgttcttggttgaagagcagaagattgtgaagaaggttctcaagattcagaagacaaaggaaaagcaagccggaaagagttaaaacacaggttccatttatgatgatgaaatttttgactagttagcgtgttgttttacaagttatgaacttatatattcttgtcgagtggatggattgattttgaatttgaatgagtttgttgttttaatttggataatataa

SEQ ID NO: 3070 - DNA, 650 bp, Gerbera hybrid cultivar
gacaacagatccgccggccggaaaatggtgcaacgactcacatatcgtagacgccacagctacgccaccaaatcgaaccagcatcgggttgtcaaaacccctggtggtaagcttgtgtatcagactaccaagaagagggcaagtgggcctaaatgccccgtgactgggaagagaatccaagggattcctcacttgagacctgccgaatacaagaggtctagattatccaggaacagaagaactgtgaatcgtgcttatggtggtgtactttccgcaggcgccgtaagagaaaggatcattagagcgttcttggtcgaagaacaaaagattgtgaagaaggttttgaagattcaaaaagcaaaagaaaaaacggctgccaagagttaaaccatcaactacttttttgcaccccacgagcataattttgggtacttaaagtgtgaattaaattaagtgatcgggtaagcaggctttttgaactatgtgttttggtatctctactttgtcgacaatcaaacgttgtttggtttttgtttaccatgtaatggttttatgaactttgtttggattttcttcttgttgtatttactttgaaattattagcttcttataaatttatattcttactattaaaaaaaaaaaaaaaaaaa

SEQ ID NO: 3071 - DNA, 579 bp, Guizotia abyssinica
tctttctcgcagtgaaaggatcaacttagccgccgataggaaaatggttcagcgtctcacttatcgcaaacgccatagctatgctaccaaatcaaaccagcatcgggttgtcaaaacacctggtggaaagctaatttatcagaccaccaaaaagagggcaagtggccctaaatgccccgttaccggcaaacgaatccaagggattccacacttgaggcctactgaatacaagaggtcaagattatccaggaacagaagaactgttaaccgtgcttatggtggagtattgtctgctggggctgtaagagaaaggattattcgggcctttttggttgaagaacagaagattgtgaagaaggttttgaagatccagaaagctaaagaaaaaaccgcctcaaagagctagattttttagtatgtattgggccacatttgcctctactttgtcgttaactaaaacgatctttctaggttttgtttacgatttaatcattttgggttcgttcactgttgcatgtactttgaagttgtgttttctacatatctgattatattaaggagttgcatttatatagttga

SEQ ID NO: 3072 - DNA, 862 bp, Actinidia deliciosa
cacacaaatagttcctctcgcattcagtctcactcttttgtttcagtcttatcttcacactcggaggcgaaagagagagaagatatagagagaggcgaaactatcagaagatggttcagagactcacgtatcgcaaacggcacagttacgccaccaaatccaaccagaacagggttgtcaaaacccctggagggaggttggtgtatcagaccacaaaaaagagagccagtggtcccaagtgccctgttactggaaagagaatccaagggattcctcacttgagacctgctgaatacaagaggtctagattgtcaaggaaccgcaggacagtaaaccgagcctacggtggtgtgttgtctgggggtgctgtgagggagaggatcatccgagccttcttggttgaagagcaaaagattgtgaaaaaagttctgaaaatccagaaggcaaaggagaagcaatcctcaaagaactaaaatggagtgataaaacaagagcccccctttcagatcatattatgctcgaaatggagtcttgactttgatgatgacgatcatgaagacctgcaacaatttcatgatttttcggtgcctcggaaattatcttaccctaacttgttacttgggaacaccttgttcagtttgtcgacaaatcaatctctagagacttcttgtttgccttttggcattgttgtgcgttgaccaagtatttgatgtttgattttgcacttaaaagtagttgactttgtgtttatgttttaagaaatatcgatcggatggttctgtatgtgttgtgaatgtccgtgtgtgtgttgggaaggggaaatcgtatacgaagtctgggagtttagtccacttatgactag

SEQ ID NO: 3073 - DNA, 667 bp, Actinidia deliciosa
  misc_feature (651)..(651): n is a, c, g, or t
ctcatctcagagacagagagacagcgagatggttcagagactcacatatcgcaaacggcacagttacgccaccaaatccaaccagaacagggtcgtcaaaacccctggagggaggttggtgtatcagagcaccaagaagagagccagtggacccaagtgtcccgttactgggaagagaatccaagggattcctcacttgagacctgctgaatacaagaggtctagattgtctaggaaccgcagaaccgtgaaccgagcctatggtggtgtattatctggtggtgctgtcagggagaggattatccgagccttcttggttgaagagcaaaagattgtgaagaaggttctgaagatccagaaggcaaaggagaaagcctcaaagagctaaaatccctcaaacgagtgagcaagaaagtaagggatttttcagattatatcatgattagaagttttgagttcgatgacgaagaacatgaagaaatattgaaaagattatgtttaggtgcctcaaaatctggaagaatgtcttttacttcagttaccctaaagagtggttcggaacttgtttactttgtcgacgaatctatctctagggtcttgacttttgtaatcttcgtgctttgacaacgttttcaatatttgatcttgganttcagttttgttccat

SEQ ID NO: 3074 - DNA, 631 bp, Lactuca sativa
gagagaattcgttcggcagtcgaagatggtgcaacgtctcacctaccgcaaacgccatagctatgctaccaaatccaatcagcacagggtcgtcaaaacccctggtggaaagttggtttaccagactacaaagaagagagccagtggccctaagtgccctgtaactggcaagagaatccaagggattcctcatttgaggcctactgaatacaaaaggtccaggctatcaagaaacaggagaacagtaaaccgtgcctatggtggtgtgctatctgctggtgcagtgcgtgagaggatcattcgagctttcttggtggaagagcagaagattgtgaagaaggttttgaagattcaaaagaccaaagaaaagcaagctggaaagagttgaatcaggttggaaacaaagatattttgagtagtagtgtgctttaaagaaattttgatatgacacattggttataagatgtgaacttatagattcttgttgaaggtattgaatgaatttgaatttgaatgaggtggttctctgttattattgcattgtcatggttttgttaagttactgtttgttgattctcgcgttcattgttttttgtatgtttactaaaatatcaacaagtgaacttactga

SEQ ID NO: 3075 - DNA, 597 bp, Lactuca sativa
caaaccctaatcctcattttctgcaaaacgagaaaaaaggaaacagagagagcgagagtatctgcgattcaaagatggtgcagcgtctcacgtaccggaaacgccatagctatgccaccaaatccaatcaacacagggtcgtcaaaacccctggtggaaagctggtttaccagaccactaagaagagagctagcggacctaagtgccctgttactggcaagcgaattcaagggattcctcatttgaggccaacagaatacaaaaggtcaaggctgtctaggaacaggaggacggttaaccgagcttatggtggtgtattgtctgctggtgctgtcagggagaggattattcgagcttttttggttgaagaacagaagattgtgaagaaggttttgaaaattcagaagacaaaagaaaagcaagctggaaagagttgaaaatggggtttttgaattatgatgaagaaagttttgagtagttatgcgtttggaagaaatttcgctctttttttaacactatagttataaaaattttgcatacttttgttgaagtcatggattgattttgaattccaatgaatttgttattttcagttga

SEQ ID NO: 3076 - DNA, 583 bp, Lactuca sativa
ttcccacacatcgcttctcctccagcctcccctcgaaaagcagagaagagtagagcgccgccgaccggaaaatggttcaacgactcacataccgtaaacggcacagctatgccaccaagtcgaatcaacatcgggttgttaaaacccctggtggtaagctagtatatcagactaccaagaagagggcaagtggacctaagtgccctgttactggaaagagaatccaagggattcctcacttgagacctactgagtacaagagatcaagattatccaggaacagaagaactgttaatcgtgcttatggtggtgtgctttctgcaggtgctgtaagagaaaggataattagggcttttttggttgaagaacaaaagattgtgaagaaggtgttgaagatccaaaaggcaaaagaaaagactgctggcaagagctagagagagagagagtaattttgggtgaatctgtaatcggatctatgcttgctttgattacttttttagatttttcttatttctgttttaattgttttttgatttccattctggtttggatattctgtttttgttgtttttactttgaaatt

SEQ ID NO: 3077 - DNA, 605 bp, Lactuca sativa
gagaaaaagagacagagagagcgacagtatccgcgattcaaagatggtgcagcgtctcacgtaccggaaacgccatagctatgccaccaaatccaatcaacacagggtcgtcaaaacccctggtggaaagctggtttaccagaccactaagaagagagctagtggacctaagtgccctgttactggcaagcgaattcaagggattcctcatttgaggccaacagaatacaaaaggtcaaggctatcaaggaacaggaggacagttaaccgagcttatggtggtgtattgtctgctggtgctgtcagggagaggattattcgagcttttttggttgaagaacagaagattgtgaagaaggttttgaaaattcagaagacaaaagaaaagcaagctggaaagagttgaagatgggttttttgaaagttttgagtagttatgtgtttggaagaaatttccctctttttttaacactataattataaaatcttgattttttttttgtttgcatacttttgttgaagtcatggattgattttgagtttcaatgaatttgttattttcatctgattttgaagcccggcaaactgacccccagtaccatgtc

SEQ ID NO: 3078 - DNA, 671 bp, Lotus japonicus
tcctctgaaaaccctaacaactcacacagacgcagaggcagagcttgatcgaagatggtgcagcgtctcacctaccgcaggcgtcacagctacgctaccaaatccaaccagcaccgtgttgtcaagacccccggtgggaaactcgtttatcagaccactaagaagagggccagtggacccaaatgccctgttactggcaagaggattcaagggattccacacttgaggcctactgagtacaaaagatccaggttgtccagaaaccgtaggactgtgaaccgagcatatggcggagttttatccggaggtgctgtcagggaaaggattattcgggctttcttggttgaagagcaaaagattgtgaaaaaggtcttgaagattcagaaggcaaaagaaaagcttgcctctaaggcatgaatttaaacaacttgatgagatgaagatctttttggaggacttttaggttcgggtgattacagtaatcccaaattttattagagttgttcccatgttagttgtgcttatttgccttgtttgaactctatctagagaaattgtgtgctttgccgacgattccattttgatacagttttgtttgtcctaatttgctcgctggtttactggtttcattttgttgctatatattaaaatagtacttgtaatttcaatgc

SEQ ID NO: 3079 - DNA, 729 bp, Medicago truncatula
aagcagtggtatcaacgcagagtgccattacggccggggctcgtcgctgaaagaagaagaaaatggttcagaggcttacctaccgcaggcgccacagctatgccaccaaatccaaccaacacagggttgtcaaaacacccggtggtaagcttgtttatcagacaaccaagaagagagctagtggacctaaatgccctgttactggaaagaggattcaagggattccacatctaagacccactgagtacaagagatctaggttacctagaaacaggaggactgtgaatcgtgcctatggtggagttttatctggaggtgctgttagagaaagaatcatccgtgctttcttggttgaagagcaaaagatcgtcaagaaagtcttgaagatccaaaagacaaaggaaaagcaagctttgaagggttaagtttcattaaacgagataaagatctttttggaggagttttaggtttgagtgattatagtaaaagcacaaaatttattagagctgttctcttgttagttttgtgcttgtttggcttctttgaactcattctagtgcaactgttagctatccattgtgatacagttttgtttgtctcaattttctcttgttttacttttcatgtttttctctaaatatatgttcgtacttataatattattgcattaacatatcttccattctttactgcaattttactgctgagaaaataccattggctcttgcg

SEQ ID NO: 3080 - DNA, 627 bp, Mimulus guttatus
gacacacgacgaaggcggaaaaatggtgcagcggctgacatacaggaagcgccacagctatgctaccaaatccaatcagcaccggatcgtcaaaactcccggagggaagctagtgtatcagaccaccaagaagagggcaagcggccccaaatgccctgttactggaaagagaattcaagggattcctcacttgagacctgctgagtacaagagatctagattatcgaggaaccgaaggactgtcaaccgtccatatggtggagtgttgtctggcggtgctgtaagggaaaggatcattagagctttcctagtcgaagaacaaaagatcgtaaagaaggttttgaagatacagaagacgaaggaaaaagttgcttccaagagctgaaatgtaaaccagatgtgaggcagttttgtggggagttttgaagctttttgtcttgcatgtaaaattgcctggggattaattttgaaatatgaattattctttatttcagtttacagatgggtttaaagagttttcttgattcttcaatttttaatcagattctctttgtgaaattacatttatttgcttcaaagaaatgctttatcaaaaattctaaccaaaattgaggaatgtctatatta

SEQ ID NO: 3081 - DNA, 626 bp, Orobanche aegyptiaca
tatctctctcccctcaaaacaaggttctcttcttcgcctcgttagcccacgaaaaaaaaaccgagaatcttaatacacgaattaactgattaaggcgataaaatggtgcagcggctgacatataggaagcggcatagctatgcaacgaaatccaatcagcatcgcattgtcaaaactcccggaggtaagctaatttaccagagcactaagaagagggctagtggtcccaagtgccccgttactggaaagagaattcaagggattcctcacttgagacctgctgagtacaagaggtctaggctacctaggaaccgaaggactgttaaccgcccttatggtggcgtgttatctggtggtgctgtgagggaaaggatcattagagctttcttggtggaagaacagaagattgtgaagaaagtcttgaagatacaaaaggcaaaggaaaaggttgcttctaagagctgaagtagtaaagccaggtcctgacatagttttgaaaaaaaccacttcgttaatgacttttaagttgtattttaagtttctaaagcttattacctgtgactttctgaagtttctcaagctatgaattattggttttcttcattttgtcaagaaacttaggttct

SEQ ID NO: 3082 - DNA, 522 bp, Carica papaya
accctacaactgagaggaggagtagaagagcaataatcgaaaatggtgcagcgacttacttatcgcaagcggcacagctatgccaccaaatcgaaccagcaccgtgtcgtcaaaacccccggtggaaggctggtgtaccagggcaccaagaagagagcaagtggccccaagtgtcctgttaccggcaagcggattcaagggattcctcacctgagacctgccgaatataagagatctagattgcctagaaaccggaggactgtcaaccgtgcatatggtggagttttgtctggtggtgctgtcagggaaaggattattagggccttcttggttgaagagcaaaagattgtgaagaaagtcttgaagcttcagaagaccaaggagaagcaatcaaagagctaaatattgagttaaaaaggcttatgtgtgttaagcttcttcacagtgttttatcttatgggggaaatttagtgcatcatggaaaagttatctgggtgttataattttgaagagtatttttct

SEQ ID NO: 3083 - DNA, 440 bp, Pisum sativum
aaaatcaagctcagagaagatggttcagaggctcacctaccgccggcgccacagctacgccaccaagtccaaccaacatcgggttgtcaaaacccccggtggcaaacttgtttatcagactactaagaagagagccagtggaccaaaatgccctgttactggaaagaggattcaagggattccacatttaaggcccacagaatacaagagatcaaggttatctagaaacaggaggactgtaaaccgtgcatatggtggagttttatctggaggtgctgttagagaaagaattattcgagctttcttggttgaggagcaaaagattgtcaaaaaggtcttgaagatccaaaagacaaaggaaaaacaagcttcgaaggcttgagtttcatgaaactgagataaagatctttttggaggaattttaggtttgagagattata

SEQ ID NO: 3084 - DNA, 440 bp, Pisum sativum
aaaatcaagctcagagaagatggttcagaggctcacctaccgccggcgccacagctacgccaccaagtccaaccaacatcgggttgtcaaaacccccggtggcaaacttgtttatcagactactaagaagagagccagtggaccaaaatgccctgttactggaaagaggattcaagggattccacatttaaggcccacagaatacaagagatcaaggttatctagaaacaggaggactgtaaaccgtgcatatggcggagttttatctggaggtgctgttagagaaagaattattcgagctttcttggttgaggagcaaaagattgtcaaaaaggtcttgaagatccaaaagacaaaggaaaaacaagcttcgaaggcttgagtttcatgaaactgagataaagatctttttggaggaattttaggtttgagagattata

SEQ ID NO: 3085 - DNA, 573 bp, Capsicum annuum
ggcacgagcctcaacctagagagagagagagagagagagaggttcaaaaatggtgcagagactcacttaccggaagcgccatagctatgccaccaaatccaaccagcatcgtgtcgtcaaaactcctggtgggaagttgatttatcagacaacgaagaagagggctagtggtcctaagtgccctgttactggaaagaggattcaggggattcctcacttgagaccagccgagtataagagatccaggttgtctaggaacaggaggactgtgaaccgtgcctatggtggagtattgtctggaggagcagtgagggagaggattgtccgagcttttttggtggaagagcaaaaaattgttaagaaagttttgaagatccaaaaagccaaagaaaaattggcagccaagagctaagaagagagtttaggaatttcttttatgttttggtgaaattttgacattcaagtgtttactagttgtgtgctataaattgacctatttgctacaacaatttaaggggcattttgctttagttgattttattcagactccattgccatttctatacaaaaaaa

SEQ ID NO: 3086 - DNA, 695 bp, Petunia hybrida
atttctccaccatatataatcatctccacacataatactctctcttttggtccatttccactgtagaaaagcggcaaaacaaaaatggtacaaagacttacatatcgaaagcggcacagttatgccactaaatccaatcaacacaggattgtcaaaacccctggtggaaagctaatttaccagacaaccaaaaagagagctagtggaccaaaatgtccagttactggcaaaagaattcaagggattccacacttgagacctgctgaatacaagagatccagattgtccagaaaccgcaggactgtcaatcgtgcttatggaggtgtgctctctggaagtgccgttagggagagaatcatcagggcgttcttggtagaagaacaaaaaatcgtgaagaaggtgttgaagattcagaaggcaaaggaaaaactagcctcaaagagctgaggatagaaacactcgagtctttcaattttatcatctttttggataacttactttgatgacgatgaagattgtgtgaaagaacatgttgaaatgctagtactagatttcaagtacaatgtcagctctagtattgttttgtagactcattgaaactattgtcacctgactttaggggttgccacctctttccagttcaatgaacatgttgcatgatacttgattttaaaaaacacaaacaaaaacaaaac

SEQ ID NO: 3087 - DNA, 705 bp, Solanum tuberosum
tctctcttccgtccgagcctcagcctagtgagagagagagatagtgagagagagaggttctaaagatggtgcagagactcacttaccggaagcgccacagctatgccaccaaatccaaccagcaccgcgtcgtcaaaactcctggtgggaagttgatttatcagactaccaagaagagggctaatggtcccaagtgccctgtcactggaaagaggattcaggggattcctcacctgagaccagctgagtacaagaggtccaggttgtctaggaacaggaggactgtgaaccgtgcctatggtggagtattgtctggaggagcagtgagggagaggattgtccgagctttcttggtggaagagcaaaaaattgttaagaaggttttgaagatccaaaaagccaaagaaaagttggcatctaagagttaagcagagagtttagaggaactttctttttatgttttggtgaaattttgacattcaagtgtttactagttttgtgctacaaattgaccttgttgctacaacaatttaaggcagttttttgctctagttgattatattttgactccattgccattctatatgagtttgaggtgtttgtctagtcttaattttacctcatatatcacatacaggattcatctagctagatgaatgtactaaaatgtttgtggttggtcctcaatcattgattgatggaggt

SEQ ID NO: 3088 - DNA, 706 bp, Solanum tuberosum
actctgtaaaagcatctggtattacttattagtaccatccctacaagctttaagtctgctaactgacagtattttgagagagaaatgtcaactaggcagcggccgctgtaaaacttaacctagaagatggttcagagacttacgtatcgaaagcggcacagttatgccaccaaatccaatcaacacaggattgtcaaaactccgggtggaaagctaatttaccagaccaccaagaagagagccagcggccctaaatgtccagttactgggaagagaatccaagggattccacatttgagacctgctgaatataagagatccagattgccaagaaaccgcaggactgtgaaccgtgcttatggaggtgtgctatctggaagtgctgtaagggagagaatcatccgagctttcttggttgaagaacaaaaaattgtgaaaaaggtgttgaagattcagaaggcaaaggaaaaactagcttcaaagaactgagtgtagagaccctgaagtctctgtcaattctatcatgttttcagataactagctttgatgacgatgaatatgtgtgaaagaacttgttgaaatgcaattactagtattcgattagaatttaagctctagtatggttttgcaaactcctttttggaactattgcctcctgactggaggttgtttcctctttccagttaaatgatactttattgcatga

SEQ ID NO: 3089 - DNA, 643 bp, Prunus persica
cttttgttgtagtccgtcgcgataaaacccagaggtagctgagcttaacgagcgctcgaaaatggtgcagcggctcacataccgaacgcgtcacagctacgccaccaaatccaaccagcaccgcatcgtcaaaacccccgggggtaagttggtttatcagaccaccaagaagagagccagcggtccaaaatgccctgttactggcaagagaatccaagggattcctcacttgagacctgcagagtacaagaggtctagattatccaggaaccgcaggactgtgaatcgggcttatggtggtgtattatctggaggtgctgttagagagagaattattcgagctttcttggtggaagagcaaaagatcgtgaaaaaggttctgaagatccaaaaggccaaggaaaagcaggccggcaagaactaaatgaggccaatagcctaatgaggcagagtgacggatcattagccttttgaactataagacgatatgcttgagcgagattttgatattagattttgttgattaatgaatttggggctagattgggaatgcttttattgttattttgctactttggttacttgggaatttcatatcaatgacaaatcaattgcctgtttcttgttatgtgataatcttctg

SEQ ID NO: 3090 - DNA, 616 bp, Rosa hybrid cultivar
ggttgcaaatccgtcccacccaaacccccagagagctctctccaaaatggtgcagcggctaacctaccgttcccgtcacagctacgccaccaagtcaaaccagcaccgcgtggtcaaaacccccggtgggaagcttgtgtatcagactactaagaagagagccagtggaccaaaatgccctgtgactggcaagagaatccaagggattcctcacttgagacctgctgagtacaagaggtccagactgtccaggaaccgcaggacggtgaaccgggcatatggtggtgtcttgtctggaggtgctgtcagagagaggattattcgagccttcttggtagaagagcaaaagattgtgaagaaggttttgaagatccagaaggccaaggaaaggcaggcagcccagagctaaatgatacccggcaatgaagcaaaagcctttccaattataagatatgcttgaggaaagattttgacttaggttgtgttgatgaacgatttggagctagattggaatgcttttattgttattcgctactttgattacttggttatttcatttcaatgacaactcaattgtgtttctttcttgtgataaattcctcccaaaaaaaaaaaa

SEQ ID NO: 3091 - DNA, 769 bp, Solanum phureja
ctcttccgtccgagcctcaacctagagagagagagagagagagtgaaagagagagaggttctaaagatggtgcagagactcacttaccggaagcgccacagctatgccaccaaatccaatcagcaccgcgtcgtcaaaactcctggtgggaagttgatttatcagactaccaagaagagggctaatggtcccaagtgccctgtcactggaaagaggattcaggggattcctcacctgagaccagctgagtacaagaggtccaggttgtctaggaacaggaggactgtgaaccgtgcctatggtggagtattgtctggaggagcagtgagggagaggattgtccgagctttcttggtggaagagcaaaaaattgttaagaaggttttgaagatccaaaaagccaaagaaaagttggcatccaagagttaagcagagagtttagaggaactttctttttatgttttgaaattttgacattcaagtgtttactagttttgtgctacaaattgatcttgttgctacaacaatttaaggcagttttttgctctagttgattatattttgactccattgccattctatataagtttgaggtgtttgtctagtcttaattttacctcatatatcacacacaggattcatctagctagatgaatgtagtaaaatgtttgtggttggttctcaatcattgattgatggaggtggaggtggaggtctgtctcatgtttgttattttattacactcatggagttcactatattcaaatac

SEQ ID NO: 3092 - DNA, 710 bp, Solanum phureja
aagtcttcactcttttcgtccattcttgtctcctttgtagagaagcggtaaaacttaacctagaagatggttcagagacttacgtatcgaaagcggcacagttatgccaccaaatccaatcaacacaggattgtcaaaactccgggtggaaagctaatttaccagaccaccaagaagagagccagcggccctaaatgtccagttactgggaagagaatccaagggattccacatttgagacctgctgaatataagagatccagattgccaagaaaccgcaggactgtgaaccgtgcttatggaggtgtgctatctggaagtgctgtaagggagagaatcatccgagctttcttggttgaagaacaaaaaattgtgaaaaaggtgttgaagattcagaaggcaaaggaaaaactagcttcaaagaactgagtgtagagaccctgaagtctctgtcaattctatcatgttttcagataactagctttgatgacgatgaatatgtgtgaaagaacttgttgaaatgcaattactagtattcgattagaatttaagctctagtatggttttgcaaactcctttttggaactattgcctcctgactggaggttgtttcctctttccagttaaatgataccttattgcatgataactcgagtttactttactgttgtgattaatactcaatccagaatgttagctttttcggatga

SEQ ID NO: 3093 - DNA, 752 bp, Solanum phureja
atttagccctttcttcttcagcctccaaaaaccagagagtagagttacagagccgccgtcaaaaatggtgcaacggcttacttaccgtaaacggcatagctatgcaaccaagtcgaaccaacatagggttgtcaaaaccccaggtgggaagctgatttaccagactacaaagaagagggctaatggacctaagtgccctgtaactggaaagagaattcaagggattccacacttgagacctgctgagtacaagaggtccaggttacctagaaacaggaggactgtgaaccgtgcttatggtggtgtgttgtcaggcagtgctgtacgtgaaaggatcatcagagcctttttggttgaagaacaaaagattgtgaagaaggttttgaagatccagaaagccaaggaaaagctagcatccaagaactaagcctttaatccttgatgatgtcgtgagaggagtttctgatactgcaggctactaggaaatcatgactgtatttggatttttggtcttgagatttgtatgttgctggttttcgttaaaatacgatattggaggcctttcttcagtttgtcgaaatatctgttctcgtaggtatctttattttcttcgttctggatatttaaacttcttatggatatttgcactttaattcaactaggctattcgttccagttttgaatctcaaatacatgaatatgagtttgtttcgatgcattttcaatctctatgaatcaatgttttacatctg

SEQ ID NO: 3094 - DNA, 587 bp, Fragaria vesca
gagattaacagagtcgagtgagagagagagaggtcaaaatggtgcagaggctcacataccgttcgcgccatagctatgctaccaagtccaatcagcaccggatcgtcaaaacccctggtgggaagcttgtgtatcagaccactaagaagagagcaagtgggcccaagtgtcctgttactggaaagagaatccaagggattcctcacttgagacctgctgaatataagaggtctagactatcaaggaacaggaggaccgtgaatcgtgcctacggcggggttctgtctggtggagctgttagggagaggataattcgagcctttttggtggaagagcagaagatcgtgaagaaggtattgaagattcagaaggccaaagaaagagcagcatcaaagagctaagatgctacagttcatgtttttaatatttgttgatctgcatgctagaaattttgacatttatttgagaggatgaagattgttgcaacaatgtttgttttcatcaaatgcagacaaaaattttgaactattttcccccgaatagtgtttgctatgatatctgatactatgttgcttctgcttatctta

SEQ ID NO: 3095 - DNA, 632 bp, Helianthus annuus
atcgtatcattcccccaacttcctcttcagcctccactgaatcaccatagagagagctgccggccggaaaaatggtgcaacgattgacttaccgtaaacgccacagctacgccaccaagtccaaccaacatcgggttgttaaaacccccggtggtaagttgatttatcagactaccaaaaagagggccagtggaccaaaatgccctgttactggcaagagaatccaagggattcctcacttgagacctgctgaatacaagagatcaagattatctaggaaccgaagaactgtcaaccgtgcttatggcggtgtactttctgcaggtgccgtaagggaaaggatcatccgggcttttttggttgaagaacaaaagattgtgaaaaaggtgttgaagattcaaaaggcaaaagaaaagactgcctccaaagcttagatttttctcatgagagagtaattttgggtttcaagattttgaatctgtaatctggctgtttgatgtttggatacttttactttgttgacaatcaaatttggttcagtcttttaggtttttgtttgctttccaatggttttatggactatgttttggacatgttttcgtgttgtatttactttcttctaaattccaaat

SEQ ID NO: 3096 - DNA, 664 bp, Helianthus annuus
tacgcgggggaaacgatcatcatacagccgccgccgatcgaaccatggttcagcgtctcacgtaccgcaagcgccacagctatgccaccaaatcaaaccaacatcgtgtcgtcaaaacccctggtggtaagctaatttaccagaccaccaaaaagagagcaagtggaccaaaatgccccgttactggcaaaagaatccaagggattccgcacttgaggcctgctgagtacaagcgatcaagattatcgaggaacagaagaactgttaaccgagcttacggtggagttctgtctgctggggctgtaagagaaaggatcattagggcgtttttggtcgaagaacagaagattgttaagaaggttttgaagattcagaaagctaaagaaaaaaccgctgcaaagagttagatcttcgaatatgtattgggctagttttgcctcaactttgtgttcacagtttaatctttttggattctttcgctgttgtatttacttcgatgttgcgttttctaaatacctgatttagatcaaaaggtcatctcatagttgttaatcgtcatcaacgtcgaagtatcattaggatgaatttatggagtaacatttgaaacttaaactatgtgttctggaaatgcttatgaaatcaaagtaattgaaccgaacaaaaa

SEQ ID NO: 3097 - DNA, 659 bp, Nicotiana tabacum
  misc_feature (45)..(45): n is a, c, g, or t
  misc_feature (54)..(54): n is a, c, g, or t
ggtccattcttatcttaccattgtagagaagcggaaaaactccanctacttganaagatggttcagagacttacatatcgaaagcggcacagctatgccaccaaatccaatcaacatagggttgtcaaaactcctggtggaaagctaatttaccagagcaccaagaagagagctagcggcccaaaatgtccagttactgggaagagaatccaagggattccacacctgagacctgctgaatacaagagatccagattgtccaggaaccgcaggactgtgaatcgtgcttatggaggtgtgctgtctggaagtgctgtgagggagagaatcatccgggctttcttggttgaagaacaaaaaattgtgaaaaaggtgttgaagattcagaaggcaaaggaaaagcttgcctcaaagagctgaagataaagacactgaagtctcttgcaattctattatgttttcagttaacttaggctgtgatgacgattaaaatgtttgaaagaacatgttgaaatgctagtactcatatctagtagaatctgaggctctagtatggttttgtagacccacttgttgaaactattgtcacctgactggagaggtgtttcctctttgcagttcagcgatactttaatgcatgttaacttttgaatttaagc

SEQ ID NO: 3098 - DNA, 658 bp, Solanum lycopersicum
catttagcctcttcttcttcagcctctaaaaaccagagagtagagtaacagagccgccgtcaaaaatggtgcaacggcttacttaccgtaaacggcatagctatgcaaccaagtcgaaccaacatagggttgtgaaaaccccaggtggaaagctgatttaccagactacgaagaagagggctaatggacctaagtgccctgtaactggaaagagaattcaagggattccacacttgagacctgctgagtacaagagatccaggttatctaggaacaggaggactgtgaaccgtgcttatggtggtgtgttgtccggcagtgctgtacgtgaaaggatcatcagagcctttttggttgaagaacaaaagatcgtgaagaaggttttgaagatccagaaagccaaggaaaagctagcatccaagagctaagccttgaatcctcgatgatgtcgtgagaggagtttctgatactgcaggtttctaggaaatcatgactgtattttgatttttggtcttgagatttgtatgttgctggtttttcgttaaaatacgatattggaggtctttcttcagtttgtcgaaatatccgttctcctaggtatctctattttcttgttctgaatatttaaacttgttatggatatttgcaacttctattc

SEQ ID NO: 3099 - DNA, 424 bp, Triphysaria pusilla
cagtagagagtgagatctgaggtagcacacgaaaatggttcaacggctcacttatcgttctcgccacagctacgccaccaaatcgaatcaacacagaattgtcaaaacacccggtggaaagcttgtgtaccagacgactaagaagagggctagcggacccaaatgcccagtcaccggcaagagaattcaagggattccacatttgaggccagctgagtacaagaggtctagattgcccagaaaccgaaggactgtgaaccgtccttatggtggtgtgttatcgggaagtgctgtgagggaaaggattatccgagcttttttggtggaagagcaaaagattgtgaagaaggtgttgaagattcaaaaggcaaaggagaagctagcttccaagagctaaactcgagacatttttgttatgtttgtc

SEQ ID NO: 3100 - DNA, 657 bp, Solanum melongena
tagcctcttcttcttcagcccccaaaaaccagagaggagagtaacacagccgccgtcaaaaatggtgcaacggcttacttaccgtaaacggcacagctatgccaccaaatctaatcaacatagggttgtcaaaaccccaggtgggaagctgatttaccagactacaaagaagagggccagtggacctaagtgccctgtaactgggaagagaattcaagggattccacacttgagacctgctgagtataagaggtcaagattacctagaaacaggaggactgtgaaccgtgcttatggtggtgtgttgtcaggcagtgctgtacgtgaaaggatcataagagcctttttggttgaagaacaaaagattgtgaagaaggttttgaagatccagaaagccaaggaaaagctagcatccaagggcaaagtgtaatccttgatgatgtcatgagaggaggattttctgatactgcagctgctaggaatcatgaatgtattttgatttttggtcttgagatttgtacgttgttggttttgttaaattacgaattggaggtgttttttcagtttgtcgaaatatctgttatgctaggtgtccttgttcaggatatttgaactttctatggatatttgcacttcaattcaactaggctattcatt

SEQ ID NO: 3101 - DNA, 708 bp, Ambrosia trifida
gcaacgattaacataccgtaaacgccacagttatgcaaccaaatcaaaccaacatcgggttgttaaaaccccaggtggtaagctggtttatcagactactaaaaagagggcaagtggacctaaatgccctgttactggcaagaggattcaagggattcctcatttgagacctgctgaatacaagcgatcaagattatctaggaacagaagaactgttaatcgtgcttatggtggcgtgctttctgcaggtgccgtgagggaaaggatcatcagggcgtttttggttgaagaacaaaagattgtgaaaaaggtgttgaagatccaaaaggcaaaagaaaagaccgcctctaaggcttagatttccgcagtttctcatgagggtaattataggtttccaagattttaaatctttattcgggtaagcgggctgttttatgttctggttcttctactttgtcgacaaacacaaacttggttaaccgtcgtaggtttttgtttggtgttgaatgattttatgaaatctgttttggattcttttgttaatgtcttcactttgaacctagtttctttcaacttatgttcctactattacctgcactttgaaacattctagaaatgcatactgaccatgtgtgagtcgcggttaggtgatgtttcaaacaatgtgtgtggatcaaaatagagttatttttgttgaaccagtatttc

SEQ ID NO: 3102 - DNA, 540 bp, Ambrosia trifida
agcctcctccttccattcgaccacaccagagaccaataaatcggatccgaatatggtgcagcgtctgacttaccggaaacgccatagctatgccaccaaatccaaccagcaccgggtcgttaaaacccctggtggaaagttggtttaccagactacaaagaagagagctagtggccctaagtgccctgtcactggtaaaagaatccaagggattcctcacttgaggccggctgaatacaaaaggtctagactttcaaggaacaggaggactgttaaccgtgcctatggtggtgtgctgtctgctggtgctgtgcgtgagaggatcatccgagccttcttggttgaagagcaaaagattgtgaagaaggttcttaagcttcaaaagacgaaagaaaagcaaggtggaaaaagttaagacaggtttgcaattagcaatttgattgaaagaaattttggcttcaagacaatgattataagatgtgaacttatagattcttgtgggagatattcatcgattttaaattccaatgagtttgtttc

SEQ ID NO: 3103 - DNA, 575 bp, Arnica chamissonis
taaagcctccttcctctccgccatatcaaagagataattcgttcgacagaaatactcgatccgaagatggtgcagcgtctcacttaccggaaacgccatagctatgctaccaaatccaatcagcatcgggtcgttaaaacccccggtcgggaagttggtttaccagactacaaagaagagagctagtggtcctaagtgccctgttaccggcaagagaatccaagggattcctcatttgaggccgactgaatacaaaaggtccaggctatcaaggaacaggaggactgttaatcgtgcttatggtggtgtgctatctgctggtgctgtgcgtgagaggattattcgagctttcttggttgaagagcaaaagattgtgaagaaggttctgaagattcaaaagaccaaagaaaagcaaggtggaaagagttgaggtttgcagttagtaatgtgattgaaagaaattttggcttcaacacaatgattataagatgtgaacttatagattcttgtggaagattcagtgagtttgtttcatttgatattatatgtttaccgggtcggatttttgatcatat

SEQ ID NO: 3104 - DNA, 732 bp, Catharanthus roseus
gctttgagctgatcggtcgaagaagaagaagatggtccagagactaacgtatcgaaagcggcacagctacgccacaaaatcgaaccaacacaggatcgtcaaaactcctggaggcaagcttgtataccagagcaccaagaagagagccagcggacctaaatgcccagttacagggaaaaggatccaagggattcctcacttgagacctgctgaatacaagaggtcaaggttatccaggaatcgcaggacagtaaaccgtccctatggtggcgtgttgtctggaagtgctgtcagggagaggataatccgtgctttcttggttgaagagcaaaagattgtgaagaaggttctgaagattcaaaaagctaaggaaaagctagcttcaaagagctgaaatattatgtcttaactgaagttatgaaacaattttgtgtttaaatgacgaccatgaaggtgtaagacaatatggaagggctcgttttatatcttaactaatgtttctactctattttgttcgaagaatacatatattaatagttctattttgttttgtttttgtgcttaacttgctctagtcaaatgatacatccaagtgtaggaagccatatcctcatcttaaacatgagtatatgattgaagactgttaaagcattatatatttcttgatgaattgtgttagggctctataggccgtcagtcatttttgtgcctgaatcacttatattaaaggaa

SEQ ID NO: 3105 - DNA, 722 bp, Catharanthus roseus
cacactcacagagccaagggctgcaaaaatggtgcaacgccttacttatcgcaagaggcacagttatgccaccaagtctaaccagcaccgcgtcgtcaaaactcccggtgggaagctagtctaccagagcacgaagaagagggctagtggaccaaaatgtcccgttactggaaagaggatacaagggattccacatttgagacctgctgaatacaaaaggtctagactatctagaaacaggaggactgtgaaccgtccatacggtggagtattgtccggaagtgctgtgagagaaaggatcattagagcttttttggtggaggagcagaagattgtgaaaaaggttttgaagattcagaaggccaaggaaaagctagctgccaagagttaaaaatgattccttagtaatttttgactagctttgaaagtaattttgagatacagcatcaatatggactcaatgaaaatgtactgttgaggtttttttagcttttgagttcttattttgtcttgcttacctccatcgagaggacttgccagtgttccttatttacttcatctgaattctcttaggatttgtgttgattacttattattgaaatggaagtagttgatttgggattcgttatgcaagtctcgttgattttgtatgcttgtccatcttcattgtttagcctttatttgatgagggcgaaactcaatgcaaatttctctattcgttt

SEQ ID NO: 3106 - DNA, 723 bp, Cirsium arvense
aaccgttgagtagaagtatagagagccgtcagatctagggcatcgtcagaggagaagggtttaacttccctctgcttaggaaccctaaagagcctccttccattcggccataacagagagaaacttgagagactcttatcggcttcgaaaatggtgcagcgtctcacctaccgcaaacgccatagctatgccaccaaatccaaccaacacagggtcgtcaaaacccctggtggaaagttggtgtaccagactacaaagaagagagctagtggtcctaagtgccctattaccggcaagagaatccaagggattcctcacttgaggccggctgaatacaaaagatctagactatcaaggaacagaaggacagttaaccgtgcctatggtggtgtgctatctgctggtgctgttcgtgaaaggatcattcgagcgtttttggttgaagagcagaagattgtgaagaaggtgttgaagattcagaagaccaaagaaaaggcagctggaaagagttgagagattgggttttattagtactctgaaattttgactttcaacagaatgattataagatgtgaacttatagattcttgtggaaggtattttgatcgaattcaaattcgaatgagctcgttatgttagttttgttgggttttttatatttacgttttcatactcttggttttggatcttcaattatatgaatgtattgctatgatttgttag

SEQ ID NO: 3107 - DNA, 691 bp, Euonymus alatus
cggccgggggcgagggccattaagctttgtagcctccacttcaataaagccctctgccgtttagcctctacggagcgccagtgattgagagccagggcaacgatggtgcagcgtctcacttataggaaacgccatagctatgccaccaagtccaaccagcaccgggtggtcaaaactcctggtgggaagcttgtgtaccagagcaccaagaagagagcaagcggtcccaaatgtcctgtcactgggaaaagaatccaagggattcctcacctaagacctactgaatacaagaggtctagactatcaaggaataggaggaccgttaaccgtgcttatggcggtgtcttgtcaggcagtgctgttagggagaggatcattcgcgcctttttggtggaagagcagaagattgtgaagaaggttctgaagattcagaaaaccaaagaaaaactagcatcaaagagctaagatggaaaagagaatggaatttttagtttattgggccgagtcaaatttttactcggacatgatagattgtgctctaaattactgtgaggtttttgttttgaaacatgaatgagtaatttccatggattggattttttcgccttgccaaattgaaagatggattcagataaaaatgtgatatttgtttgctagataagtctattgaattgaagttttactaatgtgc

SEQ ID NO: 3108 - DNA, 776 bp, Euonymus alatus
ctgtcgcagcctccttcaagctgctgagcaatttgtcgacgttgataagagtgaagaaccaaaaatggtccaaagacttacatatcgcaagaggcatagctacgcaaccaagtccaaccagcaccgggtcgtcaaaacccctggtgggaaattggtttatcagagcacgaagaagagagcgagtgggccaaaatgtcctgtcactggcaagagaattcaaggaattcctcacttgcgacctactgaatacaagaggtctagattgtctaggaaccgcaggactgtgaatcgtgcttatggtggtgttttgtctggcagtgccgtcagggagaggataattcgagccttcttggtggaagagcaaaagattgtgaagaaggtcttgaagattcagaagacaaaggaaaagctagcctcaaagagctaaatcatctaaaatatgatttagggaacagcgctgtttgacttgaattttgtttgtggctgtgatgaaattagagaatggaattgaaatgcttcgaaaattagctccgttgaacatcagcacttgtttttttccccttaagctgcaaattgttgagcattttgttttatgatggatgactctttgcttgttgaggtaaatcatgttattgaattttccataatagcctagttggtgttctattttttcaccttgtgcagttcgagaatgtccggtctgctttgtgtgagaattttgtcatctatgaattgctttatttggatgataaacttgttgtaccattatgaatagt

SEQ ID NO: 3109 - DNA, 663 bp, Euonymus alatus
gaacgaacactccgcgagggccattaagctttgtagcctccacttcaataaagccctctgccgtttagcctctacggagcgccagtgattgagagacagagagggcaacgatggtgcagcgtctcacttataggaaacgccatagctatgccaccaagtccaaccagcaccgggtggttaaaactcctggtgggaagcttgtgtaccagagcaccaagaagagagcaagcggtcccaaatgtcctgtcactgggaaaagaatccaagggattcctcacctaagacctactgaatacaagaggtctagactatcaaggaataggaggaccgttaaccgtgcttatggcggtgtcttgtcaggcagtgctgttagggagaggatcattcgggcctttttggtggaagagcagaagattgtgaagaaggttctgaagattcagaaaaccaaagaaaaactagcatcaaagagctaagatggaaaagagaatggaatttttagtttattgggccgagtcaaattttgactcggacatgatagattgtgctctaaattactgtgaggtttttgttttgaaacatgaatgagtaatttccatggattggattttttcgccttgccaaatttaaggatggattcagataaaaatgtgatgtttgtttgct

SEQ ID NO: 3110 - DNA, 465 bp, Euonymus alatus
gcctccactccaataaaaaacctctgccgtttagcctctagagcgcgccattgattgaaagagacaaagagggcaacaatggtgcagcgtcttacgtataggaaacgccatagctatgctaccaagtccaaccagcaccgagttgtcaaaactcctggtgggaagcttgtgtaccagggcaccaagaagagagcaagtggtccgaaatgtcctgtcactgggaagagaatccaagggattcctcacctgagacctactgaatacaagaggtctagactatcaaggaatagaagaaccgtgaaccgtgcttatggtggtgtcttgtcaagcggtgctgtcagggagaggatcatccgggcctttttggtggaggagcagaagattgtgaagaaagttctgaagattcagaagtccaaagaaaagctagcatcaaagagctaagatggaaaagagccaaagaaattg

SEQ ID NO: 3111 - DNA, 485 bp, Euphorbia peplus
cggagtaagaggaggaagaagaataaaacgaattcaaaatggttcagcggctaacttaccgatcgagacacagctacgccaccaaatctaaccaacaccgcatcgtcaaaacccctggtgggaaattggtgtaccagactaccaagaagagagctagtggacctaaatgtcccgtcactggcaagagaattcaagggattcctcacttgagacccgctgaatacaaaagatctaggttgtccaggaacagacgcaccgtgaatcgcgcctatggtggtgtcttgtccgggggagctgttagagagaggatcatccgtgcctttttggtggaggagcaaaagattgtgaagaaggtgttgaagatccagaaagcaaaggaaaaggtttccaaggcttagaaatgaaggtttgatatatattgagaggaaattctagagaggcacatttgtttttgaatgattgatctcaatggattagaacttcaa

SEQ ID NO: 3112 - DNA, 627 bp, Euphorbia peplus
agcctctgtccttggcgggtttagggaagaagaatcaaaatggttcagcggctaacataccgatccaggcactcctacgccaccaaatctaaccagcaccgcatcgtcaaaacccccggtgggaaattggtgtaccagacgactaagaagagagctagtggacctaaatgccccgttactggcaagagaattcaagggattcctcacttgagacctgcggaatacaaaaggtctaggttgtccaggaacagacgtaccgtgaatcgtgcctatggtggtgtgttgtctgggggtgctgttagggagaggatcatccgtgcctttttggtggaggagcaaaagattgtgaagaaggtgttgaagatacagaaggcaaaggaaaaggtttcaaaggcttagaatcaaggtgatatatattgagaatctcaagttgagaagaaattccggaggcatatttgtttgatcgatctcaatgaattagaacttcaatttgggaatctattttttgtttctgaatacttgtttttgtcacttttgagtagaattgattggttgtttagctgtttaatgttatactatgcagtttgaactcttttgcaacatgccttctatttctgctgtgatcac

SEQ ID NO: 3113 - DNA, 543 bp, Flaveria ramosissima
ataatcagcgaaacaatcgttcgtcggagatactccatcggatccgaacatggtgcagcgtctcacctaccgcaaacgccatagctacgctaccaaatccaaccaacatcgggtcgtcaaaacccccggtggaaagttggtgtaccagactacgaagaagagagctagcggccctaaatgccctgttaccggcaagagaatccaagggattcctcatttgaggcctgctgaatacaaaaggtctaggctatcgaggaacaggaggactgttaaccgtgcgtatggtggtgtgctgtctgctggtgctgtgcgtgagaggatcattcgagctttcttggttgaagagcaaaagattgtgaagaaggttttgaagcttcaaaagaccaaagaaaagcaaggtgggaagagttaagacaggtttgcaattagtaatgcaattgaaagaaattttgacttcaaacatgatgattataagatgtgaacttatagattcttgtggaagatattgatttattttaaatttcaacgagtctgttccatttc

SEQ ID NO: 3114 - DNA, 650 bp, Flaveria ramosissima
ctccagcctccactcagaaccaccgtgaagcagtaaacaaccaccgccggaaaatggttcaacggcttacgtaccggagacgacacagttatgccaccaaatcaaaccaacatagggttgtcaaaaccccaggtggtaagctagtgtatcagactaccaagaagagggctagtggacctaaatgtcctgttacagggaagagaattcaagggattcctcatttgagacctgctgaatacaagaggtcaagattatctaggaacagaagaactgttaaccgcgcttatggtggggtactttctgcaggtgccgtaagggaaaggatcattagggcctttttggttgaagaacaaaagattgtgaaaaaggtgttgaagatccaaaaggcaaaggaaaagactgctgcaaaggcttagatttctgcaattctcatgagagtaattataggttatctagattttgaatctttaatcgggtaagcgggatgttttatgttatcgtttttctacttcgtcgacaaacaaacatggttgactatgttaggtttttgtttggtgtttaatggctttatgagacgctgtttgttattcgtttaacgagatgtatttactcttcgatgtttagctttctataaactcgtatttgaaact

SEQ ID NO: 3115 - DNA, 516 bp, Flaveria ramosissima
ctttcctttcgaccatatcatcgaaacaatcgttcgtcggaaaatactccatcggctctgaacatggtgcagcgtcttacctaccgcaaacgccatagctatgctaccaaatccaaccagcatcgggtcgtcaaaacccccggtggaaagttggtgtaccagactacgaagaagagagctagcggccctaaatgccctgttaccggcaagagaatccaagggattcctcatttgaggcctgctgaatacaaaaggtctaggctttcaagaaacaggaggacggttaaccgtgcctatggtggtgtgctgtctgctggtgctgtgcgtgagaggatcattcgagctttcttggttgaagagcaaaagattgtgaagaaggttttgaagcttcaaaagaccaaagaaaagcaaggtgggaagagttaagacaggtttgcaattagcaattcaattgaaagtaattttgacttcaaacacaatgcttataagatgtgaacttatagattcttgtggaag

SEQ ID NO: 3116 - DNA, 484 bp, Flaveria ramosissima
gaaaatggtgcaacgactcacttaccggaagcgtcacagttacgccaccaagtctaatcagcatcgagttgttaaaacccctggtggtaagctagtttatcagactaccaagaagagggcaagtggaccaaaatgccctgtaacagggaagagaatccaagggattcctcacttgagacctgctgaatacaagaggtcaagattgtctagaaaccgaagaactgttaaccgtgcttatggtggtgtgctttctgcaggtgccgtaagggaaaggatcattagggccttttggttgaagaacagaagattgttaaaaaggtgttgaagatccaaaaggcaaaagaaagaatgcatctaaagcttagaattttctgcaatttcccatgagagaattttgcttgtcaaggttttggatctgtaatcgggtctggttgggttgttttatgtttaaatactttactttgttatgaaacctggttaattt

SEQ ID NO: 3117 - DNA, 627 bp, Linum usitatissimum
gaacatagggagaataaaaaatggtgcagcgactcacttaccgtaagcgccatagctatgccaccaagtccaatcagcaccgaattgtcaagactccaggtggtaagcttgtgtaccagaccaccaagaagcgagccagtggacctaaatgtcccgttactggaaagaggattcaagggattccacacttgaggcctgctgaatacaagagatctaggctaccgaggaacaggaggacagtgaaccgagcttacggtggtgtcttgtctggaggagctgtaagggagaggatcattagggcatttttggttgaagagcaaaagattgtgaagaaggtgctcaagattcagaagtcaaaggaaaagaccacaaaagcctagaggctagatctccattccataagacgaatgttttgatattttgctcgtttggtcgggaccgaattcttagttcacagatggtggttttttggtgtatgtcatgaatagtgttacaaatcgctgcaattcgacttatattcccagaaaactgaatggtacatctttcgtcgaatgctggtatttattcagaaaagaataatgtgtattaggcacctaagttctaacaatgctacgtatagagaagggg

SEQ ID NO: 3118 - DNA, 700 bp, Linum usitatissimum
gaatcctaaaaaccttctctttcactaagcagagctccgtccagccgtccgaaaaaccctagcaagaaactagccaattcgcggaaatggctcagcggctcacttaccgtaagcgccatagctacgccaccaagtccaaccagcacaggattgtcaaaactccaggtgggaagttggtgtatcagaccactaagaagagggccagcggaccgaaatgccctgttactgggaagaggattcaagggattccccacttgagacctgctgagtacaagaggtcaagattgccaaggaacaggaggactgtgaaccgtgcctatggaggagttctttctggtggtgctgtcagagaaaggatcatccgtgccttccttgtcgaagaacaaaagattgtgaagaaggtcctgaagatccaaaaatccaaggaaaaggtcaccaagagctaaatgtttgacagtgtgaaacaattgtcgtggctgtagaggatgaatcgtttcgtttcttaggggtgttttaatttgagactctactttttattcttcaacgaatgatgaacactcctagtgaactttttatctgttcttttatcatccgacaaattttgtatctctttgccaatgctctggagcttgtttctgtttttcttgtggctgtttttcgtttgtcgaaatcgccctagtagtcatcttttcaagttgat

SEQ ID NO: 3119 - DNA, 805 bp, Linum usitatissimum
ggcagtcatccatattacaaaaaacacgagagccgtcagatctagggtgtcggcaaaaaatcccctccctatctctgcaggtctttttctccttagtttcttccgccgcgacatccaggcttccagcttctcgacgagaaaccgagagtcagagagaggagaacaaagggagaatcgaaaatggtgcagcgactcacttaccgtaagcgccatagctacgccaccaagtccaatcagcaccgcatcgtcaagactccaggtggtaagcttgtgtaccagaccaccaagaagcgagccagtggacctaaatgtccagttactggaaagaggattcaagggattccacacttgaggcctgctgaatacaagagatctaggctaccgaggaacaggaggacagtgaaccgtgcttacggtggtgtcttatctggaggggctgtaagggagaggatcattagagcatttttggttgaagagcaaaagattgtgaagaaggtgctcaagattcagaagtcaaaggaaaagaccacaaaggcctagaggctagatctccattccataagacgaatgttttgatattttgttcatgtttgttcgggatcgaattcttagttcacagatagtggttttttggtgtatgtcatgaatagtgttacaaatccctgcaattcgacatatattcccagaaactgaatgctacatgtttcatcgaatgctggtatttattcagaaaagagtaatgtgtattaggcgccaaagttctaacaatgctacgtattgagaaggtgaaagaatctgttacgtc

SEQ ID NO: 3120 - DNA, 678 bp, Fraxinus spp
ggggcctcagtaaccctaacgcgacgactcgccaccttaacccgaggaggagaaaatggtgcaacgcctcacatacaggaagcggcatagctatgccactaaatccaaccaacaccggatcgtcaaaacacccggagggaagctagtgtaccagagcacgaagaagagggccagcggcccaaaatgccctgttactggcaagagaatccaagggattcctcacttgagacctgctgagtacaaaagatctagattatcaagaaatcggaggactgtgaaccgtgcttatggtggagtgctgtctggaggtgctgtaagggaaaggatcattagagctttcttggtggaagagcaaaagattgtgaagaaggttttgaagatccagaaggccaaggaaaagctatctgccaagagctgatgagcgagtcatgtgccgtcatagttttggatgctgattagtcaaggattattggaattgtattctgaggttttcatgcttaaattatgtttgtttcttagattttgtcaaatgactatgttattcagtttgtcgaaaatcctcatttggtttttggtttccctgcctttccataatatcttaaacttcttttggctttgttttcccttcactgagtcttgagtattgttaattagctacttctggtgagtttaaatgat

SEQ ID NO: 3121 - DNA, 513 bp, Fraxinus spp
acaagtagagtaaaatggtgcagagactcacgtatcggaagaggcatagctatgccaccaaatccaatcaacacaggattgtaaaaactccgggagggaagctggtgtaccaaagcactaagaagagagctagtggacccaagtgccctgttactggaaaaagaatccaagggattcctcatttgagacctgctgaatacaagaggtccagattatctaggaaccggaggactgtaaaccgtgcctatggtggtgtactgtctggagctgctgttagggagaggataattcgagccttcttagttgaagagcaaaaaatcgtgaagaaggttctaaagattcagaaggctaaagaaaagcaagctggcaagaactgattgattcaaagttctccattattttattttaagaaaatttcttggatgatgacgattatgaaatgtaagagcaagaattctgtccaaatggctgtggattttgaacaaattgatctttgaccccttaattttgatt

SEQ ID NO: 3122 - DNA, 601 bp, Fraxinus spp
ggcccttcttcgccctagtaaccctaaagcgccgagtcaccacctgaacccgaggacccaataaggaggaaaatggtgcaacgcctcacatacaggaagcggcatagctatgccactaaatccaaccaacaccggatcgtcaaaacaccaggagggaagttagtgtaccagagcacgaagaagagggctagtggtccaaagtgccctgttactggaaagagaatccaagggattcctcacttgagacctgccgagtacaagaggtctagattatcaagaaatcagagaactgtgaaccgtgcttatggtggagtgttgtctggaggtgccgtaagagagaggatcatcagagctttcttggtggaggagcaaaagattgtgaagaaggttttgaagattcagaaggccaaggaaaagctatcttctaagagctgaagtgtgagtcatatgccaatatagtttttggatactagttagtcaaggatgattggaattgtattctgaggctccatgcttatattatgtatgtttgttagattttgtcaattgactgttcagtttgtcgaaaattctcatatttggtttttggtttccctgcctt

SEQ ID NO: 3123 - DNA, 534 bp, Fraxinus spp
ccgaagatggtgcagcgactcacataccgcaaaaggcatagctatgccacaaaatccaaccggcaccggatcgtcaaaactcccggtgggaagttggtatatcagagcaccaagaagagggcaagtgggcccaaatgtcccgttactggcaagagaattcaagggattcctcacttgagacctgctgaatataagaggtccagattatctaggaataggaggactgtgaaccgtgcctatggtggtgtattatctggtggtgctgtgagagaaaggattattcgagctttcctagtcgaagagcaaaagatcgtgaagaaagttttgaagattcagaaggcaaaagaaaagctggcaacaaagagctaagaatatttactttttctattgttatcttaaagttttaaacaatttttgacattgaaaatgatttggtaatgtactttatatcattatactgttattcattctacttttgaatgagctcatttctcgattaagccatcatttataaaacatcatctttgactgttt

SEQ ID NO: 3124 - DNA, 626 bp, Olea europaea
gtaaccctaaagcgccgagtcgccacctgaacccgaggaggaaaatggtgcaacgcctcacttacaggaagcggcatagctatgccactaaatcaaaccaacaccggattgtcaaaacgccaggagggaagcttgtgtaccagagcacgaagaagagggccagtggcccaaagtgccctgttactggcaagagaatccaagggattcctcacttgagacctgctgagtacaagagatctagattatcaagaaatcggaggactgtgaaccgtgcttatggtggagtgttgtctggaggtgctgtaagggaaaggatcattagagctttcttggtggaagaacaaaaaattgtgaagaaggttttgaagattcagaaggccaaggaaaagctatctgctaagagctgaagagtgagtcatgtgccaatatagttttggatactattagtcaagattattggaattgtattctgaggcttccatgcttaaattatgtttgcttcttagattttgtcaaatgactgtgttcttcagtttgtcgaaaattctcatattgggttttggtttccctgcctttccataacatcttaaacttcgtttggatttactcgtgtaatccttaatttt

SEQ ID NO: 3125 - DNA, 523 bp, Pisum sativum
cagcttcaacaataatcaacatggttcagagactcacataccgaagaaggcatagctacgccaccaaatccaaccaacatcgagttgttaagactcctggtggaaagttggtttatcagacgactaagaagagggcgagtggacctaagtgtcctgttactggaaagaggatccaagggattccacatttgagacctactgaatacaagaggtctagattgtctcgcaaccgccgaacagttaacagagcatatggaggtgttttatctggaggagctgttagggaaaggattattcgtgctttccttgttgaagagcaaaaaattgttaagaaagttttgaagatacagaagacaaaagaaaagcaagcagctaagaattaagttatgttgttaatggatgaaaaacaagttagaaattccttttttgatttgttctgaagagttttgactttgaatgttgttaattatgaatgtgagacttgctttgaaattaattttatggagttttatgttttttctgt

SEQ ID NO: 3126 - DNA, 523 bp, Lippia dulcis
ctcagcctcccaaacgcagaaccccaaagaagtcgtcgattaagctgtgaaaatggtgcagcggctaacatacaggaagcgccatagctatgctaccaaatccaaccaacatagggtcgttaaaactcccggtgggaagctaatctaccagactactaagaagagggcgagtggtcccaagtgccctgttactggcaagagaatccaagggattcctcatttgagacctgctgaatacaagaggtctagattacccagaaaccgaaggactgtgaaccgtccgtatggtggtgtgttgtctggaagtgctgtgagagaaaggatcattagagccttcttggtagaagaacagaagattgtgaagaaggttttgaagatacagaaaaccaaggaaaagcttgctgccaagagctaattcatcgagatagttttggttacagagtactcgaggaatcatgaaattgtactgtgaggtttctgagcttaattaatatctgtattttgctggaattctttcgaatac

SEQ ID NO: 3127 - DNA, 637 bp, Lippia dulcis
cagcaacactctcactctccccctctcgcgctcccatcaaaaccccagtcggaaaaatggtgcagcgcctgacatacagtaagcgtcatagttatgccaccaaatccaatcaacaccgcgtcgtcaaaactcccgggggaaagctagtgtatcagaccaccaagaagagagcgagtggaccaaagtgccctgtcactggaaagagaatccaagggattcctcacctgagacctgcggaatataagaggtctagattgtccaggaaccgtagaactgtgaatcgtgcctatggcggagttttatctggttctgctgtgagggaaaggatcattagagctttcttggtggaagaacagaagattgtgaagaaggttttgaagcttcagaaggccaaggaaaaggttgcttccaagaactagattcaaagcttgaggctaagataattttgaaaagcaatttattaaggaattgtattgtgagattttcaagtgcctgtattttccgggactttttttttttctattgaaatgacttgttatcttctgtttgctgcattaggttttgggaatcttatggtttttgatgaaactcatttatggactattggtttcctctaattatgcttctcttattcaca

SEQ ID NO: 3128 - DNA, 614 bp, Plantago ovata
gggggccccttttcagttcgagaactcaagaagagagactctgtagagtaggagagaaactcggcaagatggttcagaggcttacgtaccgcaagcgtcacagctatgctaccaaatccaaccagcataggattgtgaaaactccaggtggaaagcttgtttaccagacaacaaagaagagagctagcggacctaaatgtcccgtcactggcaagaggattcaagggattcctcatttgagacccactgagtacaagaggtctaggttgcccagaagccgcaggactgtgaaccgtccttatggtggtgtattgtctggaggtgctgttagagagaggattatccgtgctttcttggttgaagaacaaaagattgtgaagaaagttctgaagatccagaagactaaggaaaagcaagctggcaagagctagacttattggagttcttaaacacatttcaaatttatgttctgtgtactcaaaattttgctatgacgatgatagagagacatggaatctgttaagagacctttatgttttattgaattagcttcatgagatcatggctatctgtcagctaaagattgtgatggttgcattcattttattttgaac

SEQ ID NO: 3129 - DNA, 605 bp, Plantago ovata
gcctcagccactccaccccgcctgtcgaagcaaagctaattgcaaaaatggtgcagaggttgacttaccgtaaacgccatagctatgccacgaaatccaaccaacaccgtattgttaaaactccaggagggaagttagtgtaccagaccaccaagaagagagctagcggtcctaaatgcccagtcaccgggaagaggattcaagggattccccacttgagacctactgagtacaagaggtctaggttacccaggaaccgaaggactgtgaatcgtccttatggtggagtcttgtctggtggtgctgtgagggaaaggatcatcagagctttcttggttgaagaacaaaagattgtgaagaaggttttgaagatacaaaagtcaaaggagaagcttgcttctaaggcctaaagtgtgagatcagagcttggtgcttcaaagagctgagtcatgttgaatttgtggtaatgagagatcgagattacattgtagttctccgacatttaaaacctatatattagccttaaatctcttttggattttcgagatgtttctggtttcctcattttgtcgaaaattctgccgtttaaaggaattttgggaatt

SEQ ID NO: 3130 - DNA, 812 bp, Sarracenia psittacina
gccgtacgatctagggcgacggacacttacaagtccttcgatataaatattgtctctccacttacagatcttatcctactgctgcttccgccgcgcacacggaggggggaagagagagatagagagagtggcggcgcaacttaggctcgaagatggtgcagcggctaacgtaccggaaacggcatagctacgccacgaaatctaaccagcacaggatcgtcaaaactcccggtgggagacttgtgtatcagagcaccaagaagagggcaagtggtccaaaatgccctgtcacggggaagagaatacaagggattcctcacttgagaccagctgaatataagagatctagattatctagaaaccgaaggactgtgaaccgtgcttatggcggggtattgtctgggggtgctgtgagggaaaggataattagagcctttctggtcgaagaacaaaagattgtgaagaaggttttgaagattcagaaggccaaagaaaagcatgctggtaaaagttgagcttaaacaaagcttaatggattttaaattggatggagacaatttttgattcggccatcgagacaatgaggatcaacgaaatgtaatatgagaggttcaaatttgattttaagtttgtatcttctcgtcgtgttttgaattttttgaatattatttttgtatttttgtttgttgttttattagcaaatccatcgagctggtgttctgtttacctatttatttggatgttatcggattcttaatttttaatcgtttcatgtaatagtagtgatcttggtttcaatagtggttggattt

SEQ ID NO: 3131 - DNA, 510 bp, Scabiosa columbaria
cctttcatttcagcctccttcaacacagagagagaaagagagctcttcaaatcttcaaaaatggtgcagcgtctcacttaccgcaagcgccatagctatgccaccaaatcaaaccagcacagagtcgtcaaaactcctggtgggaagttggtgtatcagggcactaagaagagagcaagtggacctaagtgtcctgttactggaaagagaatccaagggattcctcacttgagacctactgagtataagaggtctagactagctaggaacaggaggactgtgaaccgtgcttatggtggtgtattatctggaggtgctgtaagagaaaggatcatccgagctttcttagtggaagaacaaaagattgtgaagaaggtgttgaagattcaaaagacaaaggaaaagacagcagggaagagctagagcatggagatatttaattacttgtgtttttatttgttcgaaagcaattttgatttttgaaagatgatgattacaagttgtgcacga

SEQ ID NO: 3132 - DNA, 581 bp, Scabiosa columbaria
gttcatagggtttttaattccttcattcataagcttacagtcttctgcttcagcctccttcaagacagagatagcaagagagcttttttaatctcctgaaaatggtgcagcgtctcacttaccgcaagcgccatagctatgccactaaatctaaccagcacagagtcgtcaaaacccctggggggaagttggtgtatcagggtactaagaagagagctagtggcccaaagtgtcctgttactggaaagagaatccaagggattcctcacttgagacctactgaatacaaaaggtcaagactagctaggaaccgaaggactgtgaaccgagcatacggtggtgtgttatctggtggcgctgtaagagaaaggatcatccgagctttcttggtagaagagcaaaagattgtgaagaaggttttgaagattcagaagacaaaggaaaagacggccgggaagagctagagcagtgagatttaagaagttgtgttttgatttgtttgagagcaattttgaaagatgattacaagttgtgcactactttggtattgttggtttcatttgtttttggaattttggtgg

SEQ ID NO: 3133 - DNA, 728 bp, Thalictrum flavum
ggttacagagacttacttaccgaaagaggcacagctatgctaccaaatctaatcagaatcgggttgtcaaaacccctggtgggaaacttgtttatcagactacgaagaagagagcaagtggtcctaagtgtcctgttactggaaagagaatccaagggattcctcacttgagacctgccgagtacaagaggtctagattatctaggaatagaagaaccgtcaaccgtgcttatggtggtgtactgtcaggaggtgcagtcagggagaggatcatcagagcctttttggtggaggagcaaaagattgtgaaaaaagttttgaagatccagaaggccaaggaaaagacagctccaaaaagctaaatgcaagggctttagtctgaaagaaatttgtttatggaaagttttggcaccttgttgaatgtgttcttcatattggaatgttcttgttttgagacttaaaagatcactttagagtcaggctcagtagtatttgttatctgttgacatttctgataacttggaagttatggatagaaattcagtgtattatgcagtcatttgatttgaccctactatgccctcaaagtttcagtgtgaaacatatttattgcaagatttgcagtagtagacatttggtttttgggtatatccaatttgagatgatttccttggcatgatgaatgtgcagtggggtaacactattaactacagttgcaatggaccaat

SEQ ID NO: 3134 - DNA, 604 bp, Solanum lycopersicum
actctctcttccgtccgagcctcaacctagagagagagtgagagagtgtaagagagaggttcaaagatggtgcagagactcacttaccgtaagcgccacagctatgccaccaaatccaaccagcaccgcgtcgtcaaaactcctggtgggaagttgatttatcagactaccaagaagagggctaatggtcccaagtgccctgtcactggaaagaggattcaggggattcctcacctgagaccagctgagtacaagaggtccaggttgtctaggaacaggaggactgtgaaccgtgcctatggcggagtattgtctggaggagcagttagggagaggatcgtccgtgctttcttggtggaagagcaaaaaattgttaagaaggttttgaagatccaaaaagccaaagaaaagttggcagctaagagttaagcagagagtttagaggaactttctttttatgttttgctgaaattttgacattcaagtgtttactagttttgtgctacaaattgaccttattgctacaacaatttaaggcagttttttgctttattttgactccattgccattctatattttgtttagtcttaatttaccttatat

SEQ ID NO: 3135 - DNA, 502 bp, Tripterygium wilfordii
gcaacaatggtgcagcgtcttacgtataggaaacgccacagctacgccactaagtctaatcagcactgggtcgtcaagactcctggtgggaagcttgtgtaccagagcaccaagaagagagcaagtggtcccaaatgtcctgtcactgggaagagaatccaagggattcctcacctaagacctgctgaatacaagaggtccagactatcaaggaataggaggaccgtgaaccgtgcttatggtggtgtcttgtcaggcggtgctgtcagggagaggatcatccgggcctttttggtggaggagcagaagattgtgaagaaggttctgaagattcagaatgccaaagaaaggctagcatcaaagagctaagatggaaaagagcgaaagaaatgaaatttttagtttagttgggctgaattaaattttgaccgagacaagatagattgtgctctaaattactgtgagggtatttgttttgaacatgaatgagtaatttcatggg

SEQ ID NO: 3136 - DNA, 565 bp, Vinca minor
gaaaatggtgcaacgtcttacctatcgtaagaggcacagctatgccaccaagtctaatcaacaccgcatcgtcaaaactcccggtgggaagctagtttatcagagcacgaagaagagagctagcggaccaaaatgccctgttactggcaagagaattcaggggattccacatttgagacctgctgaatacaagaggtctagattacctagaaaccgaagaactgtgaaccgtccatatggtggtgtgttgtctggaagtgctgtgagagaaaggatcatcagagcttttctggtggaggaacagaagattgtgaaaaaggttttgaagattcagaaggccaaggaaaagcttgctgccaagagctaagatgattttatggtaaaattttgacttgctctcagagtaattttgggatacatgggagtcttggaaatgtactgtgagatcttttagcttttaagtttgtattttgtctcgtaaactcccagcgtttctttacttatttggaaattacaatgccttctgattctgtgcttcattatttggaagtagaagtatttgatt

SEQ ID NO: 3137 - DNA, 729 bp, Vinca minor
agggcgtccctaatttagccactccccttatataataaactttctctctccatctccacaaaaccctagttcttcagcccatctcacaccgagcttcaccacagtagagagatcaaaaagccgcgaaaatggtgcaacgtcttacctaccgcaagaggcatagctatgccaccaagtctaatcaacatcgcatcgtcaaaactcccggtgggaagctagtttatcagaccactaagaagagggctagtggaccaaaatgccctgttactggcaagaggattcagggaattccacatttgagacctgctgaatacaagaggtctagactatctagaaaccgaagaactgtgaaccgtccatatggtggagtattgtctggaagtgctgtgagagaaaggatcattagagcttttctggtggaggaacagaagattgtgaaaaaggttttgaagattcagaaggccaaggaaaagcttgctaccaagagctaagatgattttatagtaaaattttgacttagctctcagagtaattttgagatacatgggagtcatggaagtgtacctcaagtcttttagcttttaagtttgtactttgtctcgtaaactcccagcatttctttacttatttggaaagtacattgcattagagattctgtgttcatttattttgaaaaggaagttgaagtagttgatttgggattcttattgcaagtgtttatttgattaa

SEQ ID NO: 3138 - DNA, 676 bp, Vinca minor
aggtgagatattccgtataaattctatctctttcacttttgagaatcttttggctcctcggcgtccttcaattctcaggcggagagaaaatagcttagagctcctccggcgaagaagaagaagaagatggtccagcgactcacctaccggaagcgccacagctacgccaccaaatccaaccagcacaggatcgtcaaaactcctgggggcaagcttgtataccagagcaccaagaagagagccagcggacctaaatgcccggttactgggaaaaggatccaagggattcctcacctgagacctgctgaatacaagaggtcgagattgtccaggaatcgcaggacagttaatcgtccctatggcggtgtgttgtctggaagtgctgtcagggagaggatcatccgtgcattcttggtcgaagaacaaaagattgtgaagaaggttctgaagattcaaaaagccaaggaaaagttagcttcaaagagctgaaatagaatggcctagatgaagttttgaaacaattttgatttcaatgttgacaatgaaagtgtggaaatgtcatatggaaatggtttttattatatcttaactaatgcttgaactctattttgttctgtgaacacattagtaatcaaagtatttcattttgtgtgttgaacttaacattaatcaaatg

SEQ ID NO: 3139 - DNA, 710 bp, Antirrhinum majus
gctctgtgagaagctcgaacagtgaaaaaacttgaacaagttgaagatggtgcaaaggctcacatacaggtcgcggcacagctatgccaccaaatcgaatcaacaccgggtcgtcaaaactcccggaggaaagttggtgtatcagaccactaagaagagggcaagtggtcccaaatgccctgttactggcaagaggatccaagggattccacacttgagacctaccgaatacaagaggtctagattgtccaggaaccgcaggactgtcaaccgcccttatggcggggtgctatccggtggcgctgtgagggaaaggatcatcagagctttcttggtggaagaacaaaagattgtgaagaaggttttgaagatacagaaggcaaaggaaaagcttgcaaccaagagttaaagagaagccaggtgctgagataattttcaatacaattgaccactgaattatggaattgtattttgagatctttaaggcttactacctatattttgttgggattctttgaattttgattccttttgctcagtttgtcgaaaattctactgtgttaggttttttgggttctcctgcctcaatggtatctaaactcagttggactgctttaatgtaattttagtttattttcatcagtaactggtaaaatattctatgttcccttcttttgcttttcaaatccggtcagcaatgatggttaaga

SEQ ID NO: 3140 - DNA, 685 bp, Antirrhinum majus
aaaaaacctctagagagagagagtttagagagagagagagtgaaaatggtgcagcgactcacataccgctcacgccacagctatgccaccaaatccaaccaacaccgcgtcgtcaaaactccaggtgggaagctggtgtaccagaccacaaagaagagggcgagtgggcccaagtgtcctgttactggcaagagaattcaagggattcctcacctgaggcctactgaatataagaggtctagactatcaaggaacaggaggactgtaaaccgcccttacggtggtgtgttgtctggaggtgctgtaagagagaggataatccgagctttcttggttgaagagcagaagattgtgaagaaggttttgaagatccagaaggcaaaagaaaaggttgctgcaaagagttaatgataataccgggaattcattctgtagctttttgaaacaaattttgacattggaagtgattttgaactatgcactgtatcaaccttttgattattcgatattttcttgctgcaagttttccattgtagcatgaactcgtattatgtttttggatgatatttctctatgcttcaatgccttggggtgacttgtggtagattgtgagcttaaatcttggatgttcatcctcggtgttgaatattaattgtgtaatgttcattagagtaacctgttgaag

SEQ ID NO: 3141 - DNA, 373 bp, Aquilegia formosa
atcgaaaatggtgcagaggttaacatatcgaaagcggcatagctatgctactaagtctaaccagaacagggttgttaaaacccctggtggaaagcttgtttatcagactactaagaagagagctagtggacctaagtgccctgtcactggaaagagaatccaagggattccacacttgagacctgctgaatacaagaggactagattatcaaggaacaggaggactgtgaaccgtgcttatgggggtgttttgtcaggaggagccgtcagggaaagaatcatccgagctttcttggtggaggagcaaaagattgtgaagaaggtattgaagattcaaaaggccaaggaaaagacttcctcaaagaactaaatg

SEQ ID NO: 3142 - DNA, 546 bp, Artemisia annua
acatctcagtaaaacaccagccgccaaacaggaaaatggtgcaacgtctcacataccgcaaacgccacagctatgctaccaaatctaaccaacaccgtgttgtcaaaacccctggtggtaagctagtgtaccagacaactaaaaagagggcaagtggacctaaatgtcctgttactggcaaaagaatccaagggattccccatttgaggccaactgaatacaagaggtccagattgtcaaggaaccgaagaactgttaaccgtgcttatggtggtgtgttgtctgctggtgccgtaagagaaaggatcatcagggcttttttggttgaagaacaaaagattgtgaagaaggttttgaagatccagaaagccaaagaaaagactgctgctaagaattagatttcgttttgagtcagtattcttttagcttttttggttacaacccaccactgtgaaatgtgaattagattctgaggtcttgaatatgtatcaggccactttggcctctactttgttagttaaatttacaacttaatctttttggatt

SEQ ID NO: 3143 - DNA, 672 bp, Artemisia annua
tactccaacggggctcttccattccgccacaccaaaacacacacacttaacacaaaaatggtgcagcgtctcacataccgcaaacgccacagctatgctaccaaatccaaccaacacagggttgtcaaaacccctggtggaaagctggtttatcagactactaagaagagggctagtggccctaagtgtcctgttactggcaagaggatccaagggattcctcacttgaggcctactgaatacaaaaggtccaggctatcaaggaacaggaggacagttaaccgtgcttatggtggtgtactctctgctggtgctgtgcgagagaggatcatccgagctttcttggtcgaagagcaaaagattgtgaagaaggttttgaaaatccaaaagaccaaagaaaaggcagctggaaagagttagacaggtttgcaacagaatattccgattagtagtgtgtttgaaagaaattttgacttcaacgcaatgatgttataagatgtgaacttatagattcttgtggaagatattgatcgattttgaattcggatgagcttgttatgttagtttcatttcacttttatcttatcatttcatactttgtgctcagatcgttggtcatattcgtgtactgccatgatttcccgaattattgcttggcaacagttatttttg

SEQ ID NO: 3144 - DNA, 650 bp, Musa acuminata
ggggttcttctgcgttttgcacgccttcaccttcggagagcaggcggcggcgagtgatcctgaggcgagatggtgcagcggttaacctaccggaagaggcacagctatgccaccaaatcgaaccagaccagggtcgtcaaaacccctggtgggagacttgtgtaccagtacaccaacaagagagcgagcggaccgaaatgccctgtgactggcaagagaatccaagggattcctcacctaagacctgccgagtacaagaggtctaggttgtccagaaaccggaggactgtgaaccgggcttatggtggggtcttatctggaagtgcagtcagggaaaggattatccgggcctttctggttgaagagcagaagattgtcaagaaggttttgaagatccagaaggccaaagagaagcaagcctcaaagagctaaggcatgaaagagacgccaaatacttttttgagttattgatttatctagaagatttttgtttgacacataaagtttggtgagggtgctatcctattgatctgttcattagaatttttttgggatgatctgttctgatgtttgctttattatggttgtactttatgtttgaactaattttcttgaattgttagtcgaaattgctttatgtgcttttgatt

SEQ ID NO: 3145 - DNA, 920 bp, Ricinus communis
aagataaaaaaaaataagaaaaattaaaaagaaaacaatcccaactgtatctgagaataagatccgtccgatctcatctaatctcaacggtatagcaaaaacagtctcacaacaagacctgttcgatctagggtttctctacgcccagaaccctatttataaacattctctagagtaacatatcctttggtctcgcctcctctcgaacactcaccaaaagcgagaagcctaagcaggagaaaatggtgcagcgactcacataccgtaaaaggcacagctacgccaccaaatctaaccagcatcgcattgtcaagacccctggtgggaaattggtgtatcagaccaccaaaaagagagctagtggtcctaaatgtcctgtcactggcaagagaattcaaggaattcctcacttgagaccttctgagtacaagagatccagattgtctagaaaccgtcgcactgtcaatcgtgcctatggtggtgtattgtctggaggtgctgttagggagaggattatccgagcttttctggtggaagagcaaaagattgtgaaaaaggtcttgaagattcagaaggcaaaggagaagcaatctacaaggagctaaactgagagaggatgagagatcaaacttttatgagatagaagatgtgctagggagaaattttggtatgattgatgaaaatgagacgtggacctgaatttggagactatcaattttagcttgtttgatgctcaattatttacttacattttggttcactttgacaagagatcttcgcctgttgttttatttggtaatctgtgctttggatcacttaagagtatactgtcttgtgatattgtagtagtttatcttcaactagattatagtcgtgcaaatttttggtacacttacgaatgaaatggcttgtggtcctta

SEQ ID NO: 3146 - DNA, 982 bp, Ricinus communis
atttcacctttcaagataaaaaaaaataagaaaaattaaaaagaaaacaatcccaactgtatctgagaataagatccgtccgatctcatctaatctcaacggtatagcaaaaacagtctcacaacaagacctgttcgatctagggtttctctacgcccagaaccctatttataaacattctctagagtaacatatcctttggtctcgcctcctctcgaacactcaccaaaagcgagaagcctaagcaggagaaaatggtgcagcgactcacataccgtaaaaggcacagctacgccaccaaatctaaccagcatcgcattgtcaagacccctggtgggaaattggtgtatcagaccaccaaaaagagagctagtggtcctaaatgtcctgtcactggcaagagaattcaaggaattcctcacttgagaccttctgagtacaagagatccagattgtctagaaaccgtcgcactgtcaatcgtgcctatggtggtgtattgtctggaggtgctgttagggagaggattatccgagcttttctggtggaagagcaaaagattgtgaaaaaggtcttgaagattcagaaggcaaaggagaagcaatctacaaggagctaaactgagagaggatgagagatcaaacttttatgagatagaagatgtgctagggagaaattttggtatgattgatgaaaatgagacgtggacctgaatttggagactatcaattttagcttgtttgatgctcaattatttacttacattttggttcactttgacaagagatcttcgcctgttgttttatttggtaatctgtgctttggatcacttaagagtatactgtcttgtgatattgtagtagtttatcttcaactagattatagtcgtgcaaatttttggtacacttacgaatgaaatggcttgtggtccttaaaataatatttggaacccacttctcccatcagttagtgaaattcagttca

SEQ ID NO: 3147 - DNA, 828 bp, Catharanthus roseus
ggccgcgggaattcgattaagcagtggtatcaacgcagagtgactattacatccaaagaatttggcacgagggtgctccatagctttgagctgatcggtcgaagaagaagaagatggtccagagactaacgtatcgaaagcggcacagctacgccacaaaatcgaaccaacacaggatcgtcaaaactcctggaggcaagcttgtataccagagcaccaagaagagagccagcggacctaaatgcccagttacagggaaaaggatccaagggattcctcacttgagacctgctgaatacaagaggtcaaggttatccaggaatcgcaggacagtaaaccgtccctatggtggcgtgttgtctggaagtgctgtcagggagaggataatccgtgctttcttggttgaagagcaaaagattgtgaagaaggttctgaagattcaaaaagctaaggaaaagctagcttcaaagagctgaaatattatgtcttaactgaagttatgaaacaattttgtgtttaaatgacgaccatgaaggtgtaagacaatatggaagggctcgttttatatcttaactaatgtttctactctattttgttcgaagaatacatatattaatagttctattttgttttgtttttgtgcttaacttgctctagtcaaatgatacatccaagtgtaggaagccatatcctcatcttaaacatgagtatatgattgaagactgttaaagcattatatatttcttgatgaattgtgttagggctctataggccgtcagtcatttttgtgcctgaatcacttatattaaaggaagtctttttatgggt

SEQ ID NO: 3148 - DNA, 648 bp, Catharanthus roseus
cggcactagaggaggcacacactcacagagccaagggctgcaaaaatggtgcaacgccttacttatcgcaagaggcacagttatgccaccaagtctaaccagcaccgcgtcgtcaaaactcccggtgggaagctagtctaccagagcacgaagaagagggctagtggaccaaaatgtcccgttactggaaagaggatacaagggattccacatttgagacctgctgaatacaaaaggtctagactatctaggaacaggaggactgtgaaccgtccatacggtggagtattgtccggaagtgctgtgagagaaaggatcattagagcttttttggtggaggagcagaagattgtgaaaaaggttttgaagattcagaaggccaaggaaaagctagctgccaagagttaaaaatgattccttagtaatttttgactagctttgaaagtaattttgagatacagcatcaatatggactcaatgaaaatgtactgttgaggtttttttagcttttgagttcttattttgtcttgcttacctccatcgagaggacttgccagtgttccttatttacttcatctgaattctcttagcatttgtgttgattacttattattgaaatggaagtagttgatttgggattcgttatgc

SEQ ID NO: 3149 - DNA, 683 bp, Citrus sinensis
gaggcgaaagtgatttttttttttaaaatctcattaaaagaaaagagactaaaatggttcagcggctaacataccgcaaacggcacagctatgccaccaaatcaagccagcaccgggttgttaaaacccctggtggaaaattggtgtaccagagcaccaagaagagagctagtgggcctaagtgtcctgttactggcaagagaattcaagggattcctcacttgagacctgctgagtacaagaggtctagattgtcaagaaaccacaggactgtgaatcgtacttatggtggagtattgtctggtggggctgtcagggagaggataattcgagcattcttggtggaagaacagaagattgtgaagaaagttttgaagatccagaaagcaaaggaaaagcaggccttaaagagctagaaaatgggaagataaaagctaatcctttttcaactgtagaacgtgggatagagaaattttggtgtggttatgatcaatgatgtggtactgagagagttgaacgttcttttatattatttagtctgtttgatattgattacttaaattttgaagagaaatcaattaccggttcttggtttattaaaattaagtagttaattttgagaccctcgttcaaattgtggtgtgttcaatcattcaaagtgttgaatttctaatgaaaaaaaa

SEQ ID NO: 3150 - DNA, 668 bp, Coffea canephora
cttttcgttttctcattcattgttctacttacactccgggagaggaagacagagagaggtggagctggtggattgaaggagatggcgcagaggcttacgtatcgaaaacggcatagttatgccaccaaatccaaccaacacagggtcgtcaaaacccctggggggaggcttgtgtatcagagcaccaagaagagagccagtggtcctaaatgtccagttactgggaaaagaatccaagggattcctcacttaagacctgctgaatacaagaggtccagattgtccaggaaccgtaggacagttaatcgtgcttatggtggcgtattgtctggaagtgctgtcagggagaggattatccgtgctttcttggttgaagagcaaaagattgtgaaaaaggttctgaaaattcaaaaggcaaaagaaaagctagcttcgaagagttgaaatggaacaactatttagctgcagttgttttgtttaagaaaaatttatgatatgtttcaaagttttatcttttgtgatgacgatgaagaaatgttcaatgatcggtaatggtatagtttgaacaaatgcttcttcaacttttgtttgatgcttctgaagtacaatttattcaagaatcttgtggtgtctatttgtctgattgtccacaaaagtttgttttgcgt

SEQ ID NO: 3151 - DNA, 760 bp, Gossypium hirsutum
ctcaactgaatcgcctccaatccaaaaccctaaaccaacaccagaggcggctccaaaatggttcagcggctcacttaccgcacgcgtcacagctacgccaccaagtccaaccaacaccgcgtcgtcaaaaccccaggagggaagctggtttatcaaacgacaaagaagagagctagtggacctaaatgtcctgttaccggcaagagaattcaaggaattcctcatttgaggcctgctgagtataagaggtctagattgcctagaaaccgtaggtccgtgaaccgtgcttatggtggagttctatctggaagtgctgttcgagaaaggatcataagggccttcttggtggaagagcaaaagatcgtgaagaaggtactgaagattcagaagacaaaggaaaagcaatcatccaagtgagagctaggatttgctaatggattgatactgaatcttggaatagtagtttgaggggatttaagatttggatttatgtttttaaatttgttatgaatcatgttctactttttcattttgtcgacaaatcaactttcacgtcaaaattttgtttttggaacactcactttgtttgctcttctccaaatttggtatttccactgaatgtgcaatgttgcctggttatgcgattgcccccacattatttgtttcaccatttgagaaaagtccatgctgactggcattgagtgtttttagatgttctgagctgagcagttctcaattgtttctgaattaaaatttcgct

SEQ ID NO: 3152 - DNA, 554 bp, Gossypium hirsutum
gcttccggtctccgcctccatccacagaaagaatatcaaagaagacgaagaaaaatggttcaacggctgacataccggacccgccatagctatgccaccaagtccaaccagcaccgggtcgtcaaaactcctggtggaaaacttgtctaccagacaactaagaagagagctagcggacccaaatgtccagttactggcaaacgaatccaagggattcctcacttgagacctgcggaatacaagaggtctaggttacctaggaacaggaggactgtgaaccgtgcctatggtggtgtgttatctggcagtgcagtcagggagaggatcattcgggcctttttggttgaagaacagaagatagtgaagaaggttttgaagattcagaaaaccaaggaaaaggtttcatcaaagaactaaaagatgagataacggaagctttactttgaattttacttttgtttcgattaaattttttgacatgaagagactacgaatcgtgaacattattattgtgaggtgtttgatttaaacatgaatgagtatttagttgttag

SEQ ID NO: 3153 - DNA, 1016 bp, Gossypium hirsutum
acagaaagaatatcaaagaagacgaagaaaaatggttcaacggctgacataccggacccgccatagctatgccaccaagtccaaccagcaccgggtcgtcaaaactcctggtggaaaacttgtctaccagacaactaagaagagagctagcggacccaaatgtccagttactggcaaacgaatccaagggattcctcacttgagacctgcggaatacaagaggtctaggttacctaggaacaggaggactgtgaaccgtgcctatggtggtgtgttatctggcagtgcagtcagggagaggatcattcgggcctttttggttgaagaacagaagatagtgaagaaggttttgaagattcagaaaaccaaggaaaaggtttcatcaaagaactaaaagatgagataacggaagctttactttgaattttacttttgtttcgattaaattttttgacatgaagagactacgaatcgtgaacattattattgtgaggtgtttgatttaaacatgaatgagtatttagttgttagcccctggatctgcttagctcatcctagatgtagcgctctagtaatttttcttattgctggtaattgactaaattcttgggtgttgggtttctttttcctcgttactctttggttgttttggtgagtgatgaaaaagaatcaattgggaccggttagaagaggtgggattcagtggctggaagtaaaccagttcatctgataaaagattcattatgactggaagtaacaacgtttttcttgatttttgttttgttcttctagttctacgcattttcagacatctcttgtttaaggcttattttcctttttaatctcagttgtctctgccaactattcaagaaattacatcagcaatgacctcgtatctataactaatgggtcagttccttctttctcaaggcaatgaaggtctccagttaaactgcaacataccataaaagaccagaacgctgccttcccttatggttgaatgatgacctgcgcgg

SEQ ID NO: 3154 - DNA, 765 bp, Gossypium hirsutum
acgaagaaaaatggttcaacggctgacataccggatccgccatagctatgccaccaagtccaaccagcaccgggtcgtcaaaactcctggtggaaaacttgtctaccagacaactaagaagagagctagcggacctaaatgtccagttactggcaaacgaatccaagggattcctcacttgagacctgcggaatacaagaggtctaggttacctaggaacaggaggactgttaaccgtgcctatggtggtgtcttatctggcagtgcagtcagggagaggatcattcgggcctttttggttgaagaacagaagatagtgaagaaggttttgaagattcagaaaaccaaggaaaaggtttcatcaaagaactaaaagatgagataacggaagctttactttgaattttacttttgtttcgatttaaattttttgacatgaagagactgaatcgtgaacattattattgtgaggtgtttgatttaaacatgaatgagtatttagttgttagcccctggatctgcttagttcatcctagatgtagcgctctggtaattttcttattgctggtaattgactaaattcttggggttgggtgtctttttcctcgttactctttggttgttttggtgagtgatgaaaaagaatcaattgggaccggttagaagaggtgggattcagtggctggaagtaaaccagttcatctgataaaagattcattatgactggaagtaacaacgtttttctgatttttgttacctgcgcgg

SEQ ID NO: 3155 - DNA, 699 bp, Vigna unguiculata
  misc_feature (34)..(34): n is a, c, g, or t
  misc_feature (37)..(41): n is a, c, g, or t
  misc_feature (43)..(43): n is a, c, g, or t
  misc_feature (46)..(48): n is a, c, g, or t
  misc_feature (51)..(52): n is a, c, g, or t
  misc_feature (692)..(692): n is a, c, g, or t
atggataacatttattggaagctgataggattgngcnnnnncngannngtnnccgaccgtggaagagaaaccctaggttttggaagctgatcggaaacaatggtgcagcgtctcatctaccgcaagcgccacagttatgccacaaaatccaaccagcacagggtcgttaagacccccggtggtaagctggtttaccagagcacgaagaagagggccagcggacccaagtgccctgttactggaaagaggattcaggggattccacatttgaggcctgctgaatacaagagatccaggttatccagaaaccggaggactgtgaaccgggcatacggaggtgtgttgtctggcagtgctgttagagaaagaattattcgagctttcttggttgaagagcaaaagattgtgaaaaaggtcttgaagatccaaaaggcaaaggaaaagcaagcattgaagggctgagtttaatgaagcgatatatctttttggagggattttaggtttggtgattaccgtaaagcatgaaatttattattagagctgtttccatgttaatttgtgtttgtgttgaactcattctagtgttaactttgtcgacaactccattatgatacaattttgtatgtcacgattttttcttgttggattatcgttttctgtcagtaaaatgatacttgctcgttaaaaaaaanaaaaaaa

SEQ ID NO: 3156 - DNA, 797 bp, Taraxacum officinale
cgcggggtctgtgaacaaaagcacatagccgaccgtcgaaaatggtgcaacgtctcacctaccggaaacgccatagctatgctaccaaatccaaccagcacagggttgtcaaaaccccaggtggcaagctagtttatcagaccactaaaaagagagcaagtggacctaaatgtcctgttactggcaaaagaattcaagggattccacatttgaggcctactgaatacaagaggtcaagattatccaggaacagaagaacagtcaaccgtgcgtatggtggtgtgctgtctgcaggagcagtaagagaaaggatcattagggcttttttggtggaagaacaaaagattgtgaagaaggttttgaagattcagaaaaccaaagaaaaaacggcaaacaagagttagatttaaaaatgttatttttttatagctgttttggagtaattttggatacactgtgaaatgtgaattaggtttttgaggttacttggatatgtaatcgagccacttttgcatctattttgtttatgactttatctttatttgatttgaggttgcgttttctataattttggtcactactcatgatgcttactaaaaagaaaagaagtgtttaataagaacaaagtgtctcgtgctcttcaactttaagatatataatttgaaatccgaaaagacggcaaaagatatcactggttattgttatactctcaaaaaccttattaatgatgatttatctgttgcctactacaataattttgttgatgatattaacttctgtctaaccagaaatcctta

SEQ ID NO: 3157 - DNA, 712 bp, Solanum melongena
ctcttccgtccgagcctcaaccgagagagagagagagagtgtgtgagagagagaggttccaaagatggtgcagagactcacttacaggaagcgccatagctatgccaccaaatccaatcagcaccgtgtcgtcaaaactcctggcgggcagttggtgtatcagactagcaagaagagggctagtggtcctaagtgccctgtcactggaaagaggattcaggggattcctcacctgagaccagctgagtataagaggtccaggttgtctaggaacaggaggaccgtgaatcgtgcctatggtggagtattgtctggaggagcagtgagggagaggattgtccgagctttcttggtggaagagcaaaaaattgttaagaaggttttgaagatccaaaaagccaaagaaaaattggcagctaagagctaagcagggagtttagatgaaatttcttttgtgttttggtgaaattttgacattcaagtgtttactagttgagtggtactgattgacctcattgctacaacaatttacggagctttttgctttagttggttatattttgtctccattgcctatatatgtttgagtttttactctagaattaattatgtatcacaatcggtttcatctagttggttgaatcattgtgatgaacaacttgttcctggtggaagaaatggtctactagtaagttgacgtgtggattctgcg

SEQ ID NO: 3158 - DNA, 682 bp, Eucalyptus grandis
  misc_feature (351)..(351): n is a, c, g, or t
  misc_feature (356)..(356): n is a, c, g, or t
  misc_feature (651)..(651): n is a, c, g, or t
  misc_feature (675)..(675): n is a, c, g, or t
gttagagagagagagagagagagagaggcgcgcgcgcgcgcggggcacggacaagatggttcagcgtctcacgtaccgcaagcggcacagctatgccaccgagtcgaaccagcacagggtcgtgaagactcccggagggaagctggtttaccaagaccaccaagaagagagcgagcggccccaaatgccccgtcaccggcaagaggattcaggggattcctcacttgaggccagcagaatacaagagatcaagattgtctagaaatcgcagaactgtaaaccgggcatatggtggagtcttgtctgcaggagctgttcgagagaggatcatcagagccttcttagtggaanagcanaagattgtgaagaaggtattgaagattcagaaggcaaaggacaagcttgcctcaaaaagctgagagaatacaataacctggggccactttgagttagatctgcggagagtgtaattttggcttacatttgatgatagggagccatagaaaagcaaatgtgagaccattggagttgattttgacgaccaattcatcaagctgatgttttgtttctctttcccttttaattgcttttttggtgatactgtaaaatcatgtactatctgctttcctttgataccagattagttggttnttagcgtttatacacggtccgttnccattgc

SEQ ID NO: 3159 - DNA, 523 bp, Gerbera hybrid cultivar
atggtgcagcggctaacctaccggagacgccatagctatgctacgaagtccaatcaacacagggtcgtcaaaacccctggtggaaagctggtttaccagaccacaaagaagagagccagtggacctaagtgccctgttactggaaagagaatccaggggattcctcacttgagaccggctgaatacaaaaggtctagactatctaggaacagaaggacagttaaccgtgcttatggtggtgtattatctgctggtgccgtgcgcgaaaggattatccgagcgttcttggttgaagaacagaagattgtgaagaaggtcttgaagattcaaaagaccaaagaaaggcaagccggaaagagctagacaggttttgcaataacgatattttggtggttgtgtgcttgaaagaaattttgactttgacacaatgattataagatctgaacttataaattcttgtggaagggattgattgaatttgaattcgaatgagtttgttatttgaaaaaaaaaaaaaaaaaaa

SEQ ID NO: 3160 - DNA, 595 bp, Guizotia abyssinica
cctaaaaaaggggcttccaaaactcagtgaagctgtagattacagagctgtcggccggaaaatggtgcaacgactcacttaccgtaaacgccacagctatgccaccaagtccaatcaacaccgggttgttaaaacccctggtggtaagctagtttatcagactaccaagaagagggcaagtggaccaaaatgccctgttactgggaagagaatccaagggattccacatttgagacctactgaatacaagaggtcgagattgtctaggagccgaagaaccgttaaccgtgcttatggtggtgtcctttctgcaggtgccgtaagggaaaggatcattagggcctttttggttgaagaacaaaagattgtgaaaaaggtgttgaagatccaaaaggcaaaagaaaagactgcatctaaagcttagatttttctacaatttctcatgagagtaatttgggtttcaagattttgaatctgtaatcgggtcagactgttttatgtttggatacatctactttgttaaacattcaaaacctggttaaactttttgcttggtttctattgattttcttaattatgctttttcagattaaca

SEQ ID NO: 3161 - DNA, 717 bp, Mesembryanthemum crystallinum
gccaccgtaaaacccttcttcttcgtcgtctgctttacccttagagtgaggagagagaaaaagagagagaaaatggtgcagaggcttacatacaggaagcggcatagctatgccactaagtccaaccaacaccgtgtcgtcaaaactcccggtggaaagctagtttatcaaggaaccaagaagagagctagtggccctaaatgtcccgttactggcaagagaatccaagggattcctcaccttagacctgctgagtacaagaggtctaggttgtctaggaacagaagaaccgtgaaccgtccttatggtggagttctatcaagtggtgctgttagggagaggatcatcagagctttccttgttgaagagcagaagattgtgaagaaggttttgaagatccaaaagaccaaggaaaagcaggctggcaagagttaaactaggagcccttccgcattttgattgttaaattttggaggtctaacgaagtaagtcatggagaatgtaatgcgaggtcttgagattgaatttgtattctacagtcaggctctcgaagcatagttttagtggctacttatctttgtcgacaattccgcttcactgagttttgttctttccctttatgtttcttggttgatgttatatacatttaggctggattgttgtgcaatattagattattgattttccgtctatgatgatatcgattttctcaacttc

SEQ ID NO: 3162 - DNA, 727 bp, Actinidia deliciosa
  misc_feature (191)..(191): n is a, c, g, or t
  misc_feature (640)..(640): n is a, c, g, or t
ctagagagagacgcagagggagagacaggcagagatcttcgcgccttccgaagatggtgcagcgtctcacgtaccgcaaacgccatagctatgccaccaagtcgaaccagcatagaattgtcaaaactccaggtggaaagttggtgtaccagagcactaagaagagagcaagtggccctaaatgtcctgtnactggaaagagaatccaagggattcctcacttaagacctaccgagtataagagatccagattatccaggaacaggaggactgtgaaccgtgcctatggtggtgtattatctggaggtgctgtcagagagaggatcatccgagccttcttggtggaagagcaaaagattgtgaagaaggttttgaagattcagaagtctaaagaaaagcaggcaactaagagctaagacgagacattgaaaaacttcggtataatgtgcttgaaagaaattttgacttccaagattattgtttgattacaagttgtgcactatatatgattgcgaggtgattttgctttgaattgttgaatgataatttttctatcgttataatatccctcgtgccgaattcggcacgaggctgatttctcatttattgtacccgtcaaactcaacccaaaaccttcttnacactcttaacacgcccattaattctctgtacttctgcaactattcttcacaatcgccaccaatttttccatctcaagccccatttt

SEQ ID NO: 3163 - DNA, 589 bp, Lactuca sativa
ttctctcgtgaaaacaaattagcacatagccgccggtcgaaatggttcaacggctcacataccggagacgccatagctatgccaccaaatcaaaccagcacagggttgtgaaaacccctggcgggaagctcgtgtatcagaccactaagaagagggcaagtggacctaaatgccctgttactggcaaaagaatccaagggattccacatttaaggcctactgaatacaagagatcaagattatcaagaaacagaagaactgttaatcgtgcttatggtggtgttctttctgcaggagcagttagagaaaggatcattagggcttttttggtggaagaacaaaagattgtgaagaaggttttgaagattcagaaaaccaaagaaaaaactgcttccaagagttagattcaagaatgcatgtgagttggtattcttttaaccttttttggagtaattttggatacactgtgaaatgtgaattagggttttgaggtgtcttgagtatgtaatcgagccccttttgcctctactttgttgacaatcaatacactattcggttttgtttatgacttgatctttacttaatttga

SEQ ID NO: 3164 - DNA, 673 bp, Lactuca sativa
cggggtgaagcaattagcaatagccgccggtcgaaatggtgcaacggctcacataccggagacgccatagctatgccaccaaatcaaaccaacacagggttgtgaaaaccccaggtggaaagctcgtgtaccagaccacgaagaagagggcaagtggacctaaatgccctgttactggcaaaagaatccaagggattccgcatttaaggcctactgaatacaagagatcaagattatcaagaaacagaagaactgttaatcgtgcttatggtggtgttctttctgcaggagcagttagagaaaggatcattagggcttttttggtggaagaacaaaagattgtgaagaaggttttgaagattcagaaaatcaaagaaaaagctgcatccaagagttagatttaagaatgcatgtgagttggaattcttttaacctttttggagtaattttggatacactgtgaaatgtgaattaggttttcgaggtgtcttgaatatgtaatcgagtcacttatgcctctactttgttggcaatcaatacattattcggttttgtttatgacttgattattagttaatttgagattgccttctttatatatatgttcactattcactatgtatcattttcattctgaacttttttaatcttatgattaaactctcattcagaa

SEQ ID NO: 3165 - DNA, 700 bp, Mimulus guttatus
accatttataaacctcactcctctcaagtatttcttcatcgccaaatctcgatacacacgattaaggcggaaaaatggtgcagcgtctcacatacaggaagcgccacagctatgctaccaaatccaaccagcaccgaatcgtcaaaactcccggagggaagctagtgtatcagaccactaagaagagggcaagcggtcctaagtgccctgttactggaaagagaattcaagggattcctcatctgagacctgcagaatacaagaggtctcgattatcaaggaaccggaggaccgtaaatcgtccttatggtggagttttgtccggtggtgctgtcagggaaaggatcataagagctttcttggtggaagaacagaagattgtgaagaaggttttgaagattcagaagacaaaagaaaagcttgcttctaaagcctaagaataattctgccaacattttatcaaaagaattttgcttcgacattttgaatctaatcaccatctgtatttttcatggattcgttaaactacggctctacgctcgtttatactctgtttgaaattcagtctttactgcatcaaattattggctctatttttatttattttcccagtttttcctacctttgatattattaagcatcttgtgatagattcttgaaatatggttctattgtcttttaaaagaagtgttgatataac

SEQ ID NO: 3166 - DNA, 824 bp, Mimulus guttatus
ataaagtttatgctctgagaaattgcgtcggccggccttatccaagcagtggagagagagagagagagagagagagagagatttgtgaggtaagaggcgaaaatggttcagagactgacttaccggaagcgccacagctacgccaccaaatccaatcaacacagaattgtcaaaacccccggagggaagctcgtgtaccagaccactcagaagagagccagcggaccgaaatgccccgtcaccggcaagagaatccaagggattcctcatctgcgacctgctgaatacaagaggtctagattatcaagaaaccgcaggacagtgaatcgtccttacggtggtgttttatctggaagtgctgtaagggagaggatcattcgagctttcttggtggaagagcagaagattgtgaagaaggttttgaagattcagaaggctaaggaaaaagtagcctccaagagctaaattatgttagaaatttttttgcctatgatgatgacgatgaaagagatgtcgaacattctgttttcaaatacctctagttcttttaattcaagttttttggctctttcatcgttgtttaaaatgtttgttcatttgccgacataatattttcttgatgttttttttcgttgctaattgttgtcaaggcgttgacattgttgttatccttgttatttctttatgttctctcttttggtgttctttttttcagtgaagatttgtacaatgctatgctgggaattagggatcaaaatgggctaggattctatttattaacatgtcaattttttgccaaatgcttacgttttgccaaaaataaa

SEQ ID NO: 3167 - DNA, 770 bp, Tropaeolum majus
cggccggggatctctggtttcaatccttctcgtcagctcgcttacatacctaaagagctcgagaagatggtccaacgtctcacgtaccgaacaaggcacagctatgccactaaatcaaaccagcatcgaattgtgaaaacacctggtggcaaattggtgtaccagactacgaagaagagagcaagtggcccaaagtgtcccgttactggaaagagaattcaggggattcctcatttgaggcctactgagtacaaaaggtcaagattgcccaggaaccgcaggaccgtcaatcgtgcctatggtggtgttttatctggtagtgctgttagggagaggattatccgcgccttcctagttgaggagcaaaaaattgttaagaaagtgttgaagattcagaagacaaaggaaaagcaagcttcaaagaactaaatgatccactagccaactctacttgcaaaaaaaaaacatcccgaaatagctagctaatgaaccgtttggaattatatgatgtgattttagagaaaattttgaaatgaatgacattgaaaagtgaattacattatgagtctttgtttctttattatatttaggctgtttgatactttttacatgactactttattgttcactatgattttaagttatcctagacctttcaagctccattgttattttagcatggaccagttgtcttgtacataaaattatctctaccctctttgtttgcatttggaggctattttatggatgtatggcctaaactttgctat

SEQ ID NO: 3168 - DNA, 607 bp, Nicotiana benthamiana
  misc_feature (539)..(541): n is a, c, g, or t
  misc_feature (543)..(543): n is a, c, g, or t
  misc_feature (577)..(577): n is a, c, g, or t
  misc_feature (579)..(579): n is a, c, g, or t
gggggcttcagcccccaaaacaaagaaagaagctacagaggtaatagtgaagccgccgtgaaaaatggttcaacgacttacttaccgtaaacggcacagctatgccaccaaatctaaccaacatagggtggttaaaaccccaggtggaaagctgatttaccagagtaccaagaagagggcaagtggacctaaatgccctgttactggaaaaagaattcaagggattcctcacttgaggcctactgaatacaagaggtcaagattgtcgagaaacaggaggactgtgaaccgtgcttatggtggtgtgttgtcaggcagtgccgtacgtgaaaggatcataagagcctttttggtggaagaacaaaagattgtgaagaaggttttgaagatccagaaagccaaggaaaagctagcatccaagagctaagcttttaatgcttggcaacatcacaagaggaatgtattttgaattttgggtttaagatttgtatgttgctggttttggttaaaatgtgatattgaatatttttcttcagttnnncnaaatatcgctcctgctaggtctctgtttctgccntnactctggggtatttaaacttcctatgga

SEQ ID NO: 3169 - DNA, 612 bp, Pisum sativum
cagcttcaacaataatcaacatggttcagagactcacataccgaagaaggcatagctacgccaccaaatccaaccaacatcgagttgttaagactcctggtggaaagttggtttatcagacgactaagaagagggcgagtggacctaagtgtcctgttactggaaagaggatccaagggattccacatttgagacctactgaatacaagaggtctagattgtctcgcaaccgccgaacagttaacagagcatatggaggtgttttatctggaggagctgttagggaaaggattattcgtgctttccttgttgaagagcaaaaaattgttaagaaagttttgaagatacagaagacaaaagaaaagcaagcagctaagaattaagttatgttgttaatggatgaaaaacaagttagaaattccttttttgatttgttctgaagagttttgactttgaatgttgttaattatgaatgtgagacttgctttgaaattaattttatggagttttatgttttttctgtactctatattttgttatagcttgttgagttctgtcattccagtgcgtatgatgttaaatgaaaaactcttttgataaaaaaaaaaaaaa

SEQ ID NO: 3170 - DNA, 628 bp, Petunia hybrida
gaattcggcaccagggtaagcaaaaatggtgcaaaggctaacatacaggaaaaggcatagctatgccaccaaatccaaccaacacaggattgtcaaaaccccaggtgggaagctgatttatcagactactaagaagagagctagtggacctaagtgccctgttactggcaaaagaattcaagggattcctcacttgaggcctgctgaatacaagaggtcaagattatcaagaaacaggaggactgtgaaccgtgcttatggtggtgtgttgtcaggaagtgctgttcgcgagaggatcatcagagcctttttggtggaagaacaaaagattgtgaagaaggttttgaagatccagaaagccaaggaaaagctagcagccaagagctaagtttgtagtccttgatgaagtcgcgaggctaccatgaatctagaaaatgtattttgaattttgggcttaagatttgtatgttgctgggttttgttgaaatactatattccatgtttttgtcagtttgtcgaaaaatctattctgctaggtctttgtttttatgccttattcgggatacttaacttcctatggatatttgcatggtaattcaagtagtcattagttcttggttatgaatct

SEQ ID NO: 3171 - DNA, 598 bp, Petunia hybrida
tcgagacactgttggcctactggaatcaaaatttggtgtcgagcctgaacccagagagggaggggatacaaaaatggtgcagcggctgacgtacaggaagaggcatagctatgcaaccaagtccaatcagcaccgcatcgtcaaaacccctggtgggaagttgatataccagaccaccaagaagcgtgctagtgggcccaagtgtcccgtcactggaaagaggattcaggggatccctcacttgagaccagctgagtacaagaggtctagattatctaggaacaggagaactgtgaaccgtgcctatggtggagtattgtctggaggagcagtgagagagaggattgtcagggctttcttggtggaagagcagaaaattgtcaagaaggttttgaagatccaaaaagccaaagaaaagctggcagctaagagttaagctggattagaggaactttttgattcaagttttaaaacaattttgacattcaagatattactagttgtgtgcactataatatttgaggtgattgctacaacattgaacaagctcttttagcttcagggtggtaatattatgtgacgaaatcaatcttttgct

SEQ ID NO: 3172 - DNA, 718 bp, Prunus persica
agactgagtgatagctgaaaatcaagcaaaaatggtgcagcgtctcacatatcgtacccggcacagctacgccaccaaatccaaccaacacaggatcgtcaaaacccccggagggaagctagtgtaccagaccactaagaagagggcgagtggacccaagtgccctgtcactggcaagaggattcaagggatccctcacttgagacctgctgaatataagaggtctagattatctaggaatcggaggactgttaaccgtgcttatggtggcgtattgtctggagctgctgtcaaggaaaggatcatcagggcctttttgattgaagaacaaaagattgtgaaaaaggtgttgaagattcagaaggcaaaggaaaagcaagcctcaaagagctagatttcaaaatcgagtgagtgttacgtagctaccagagtgattttggcttgtggtgggctatgggaagtaatttgagttccagtttgtacttttacattttgttgtggatggtttaattatgatgttaagtacttaattttgttcagaaatccattcttaccgtggattttccctgttttgtatttcagtggtaacatatacattttccaattgtttgtgtaatgcccgtttagtagctttatttatgactccagttatgtgtggatcttttccaaacctttcatgtagttgattgtttttcattgcaagactggaactttcttt

SEQ ID NO: 3173 - DNA, 459 bp, Sesamum indicum
agaactcgagaatccgagaatccgattgaagtgggaaatggtgcagcggctaacatacagaaagcggcatagctatgccacgaagtccaaccaacatcgggtcgtcaaaacacccggtgggaagctagtataccagagtactaagaagagggcaagcggccctaagtgccctgttactggcaagagaatccaagggattcctcacttgagacctgccgagtacaagaggtctaggttatccagaaatcggaggactgtcaaccgtccatatggtggagtgttgtctggtggtgctgtgagggaaaggatcattagagctttcttggtggaagaacaacagattgtgaagaaggttctgaagatacagaaggcaaaggaaaagcttgctgctaagagctaaagtgcgagtctggtgttgagatagtgacggaaacaactagccaaggatcatggaattgt

SEQ ID NO: 3174 - DNA, 815 bp, Glycine max
attatatgtacctcagcgcgtccacagaaactttttttttctgtttgccgtggaagagagaaaccctagggtttggaagaagctgatcggagaagatggtgcagcgtctcacctaccgcaagcgccacagctatgccaccaaatccaaccagcacagagtcgtcaagactcccggtggcaagcttgtttatcagaccacgaagaagagggccagcggacccaagtgccctgtcactggaaagaggattcaagggattccacatttaaggccaacagaatataagagatcaaggttacccaaaaaccgaaggactgtgaaccgtgcatatggtggtgtgttgtctggcagtgctgttagagagagaatcattcgagctttcttggttgaagagcaaaagattgtgaaaaaggtattgaagatccaaaagacaaaggaaaagcaagctttgaagggctgagttttgagaaaagtgataaagatctttttggagggattttaggtttgggtgattaatgattatagtaatgcatgaaatttgttagagctgtttctgtgttaattttgtgcttatttggctttttaaaactcattctagtgcaactgttaactttgttgacaactccattacgatacagttttgtatgtcaccattttctcttgctggattattaattttctctctgcatattagtgctttgctccaaaacctgttgcagctagaattctgctttgtcactgtaattttactgaatatccattggtttttgtagcttgaaataacatgttctctaatactgatggttttttggaaagc

SEQ ID NO: 3175 - DNA, 758 bp, Glycine max
ctctctttttgctgtgggaagaggaaccctagctagggtttggaagaagctgatccgagaagatggtgcagcgtctcacctaccgcaaacgccacagctatgctaccaaatccaaccagcacagagtcgtcaagactcccggtggcaagcttgtttatcagaccacgaagaagagggccagcggacccaagtgccctgtcactggaaagaggattcaagggattccacatttaaggccagcagagtataatagatcaaggttacacagaaaccgaaggactgtgaaccgtgcatatggtggtgtgttgtctggcagtgctgttagagaaagaatcattcgagctttcttggttgaagagcaaaagattgtgaaaaaggtcttgaagatccaaaagacaaaggaaaaacaagctttgaagggctgagttttgagaaagagtgataaagatctttttggagggattttaggtttgggtgattatagtaaagcatgaaatttgttagagctgtttctgtgttaattttgtgcttatttggctttgttaaactcattctagtgcaactggtaactttgtcgacaactccattatgatacagtttttgtatgtcatgattttctcttgctggattattgattttatttctgcatattagtactttgcttgaaaacctgttgcagctagaataactctgctttttcactgcagtttttactgaacgaacattggttttgtagcttgaaataacaagttctctaa

SEQ ID NO: 3176 - DNA, 602 bp, Euphorbia esula
  misc_feature (398)..(398): n is a, c, g, or t
  misc_feature (444)..(444): n is a, c, g, or t
  misc_feature (471)..(471): n is a, c, g, or t
  misc_feature (499)..(499): n is a, c, g, or t
  misc_feature (525)..(525): n is a, c, g, or t
cggagtaagaggaggaagaagaataaaacgaattcaaaatggttcagcggctaacttaccgatcgagacacagctacgccaccaaatctaaccaacaccgcatcgtcaaaacccctggtgggaaattggtgtaccagactaccaagaagagagctagtggacctaaatgtcccgtcactggcaagagaattcaagggattcctcacttgagacccgctgaatacaaaagatctaggttgtccaggaacagacgcaccgtgaatcgcgcctatggtggtgtcttgtccgggggagctgttagagagaggatcatccgtgcctttttggtggaggagcaaaagattgtgaagaaggtgttgaagatccagaaagcaaaggaaaaggtttccaaggcttanaaatgaaggtttgatatatattgagaggaaattctgagagaggcanatttgtttttgaatgattgatctcaanggattagaacttcaatttggggattttntttttgttttggattacttgtttttntcacttatgagtagaattcatggttgattagctgtttaatgttttactatgcagtttgaactcctttgcaacttgcc

SEQ ID NO: 3177 - DNA, 648 bp, Helianthus annuus
cccctccctccctcccctttcggccagagctacaattattcggatccgaagatggtgcagcgtctgacttaccggaaacgccacagctatgccaccaaatccaatcagcaccgggtcgttaaaacccccgggggaaagttggtttaccagaccacaaagaagagagccagtggtcccaagtgccctgttactggcaagagaattcaagggattcctcacttgaggccggctgaatacaaaaggtctaggctatcaaggaacaggaggaccgttaaccgtgcctatggtggtgtgctgtccgctggcgctgtgcgcgagaggatcatccgagctttcttggtagaagagcaaaagattgtgaagaaggttctgaagcttcaaaagacaaaagaaaagcaaggtggaaagagttaagtgaggtttgcaattagtaatgtgattgaaagaaattttggcttcaacaccaaatattataagatgtcaacttattgattcttgtgagagatattgatcatttttaagttttaatgcgtttgtttcatttgaatttacgcttgctgggtcggattgtgatcttatcagtgtctctgtgctgtcaaaatttgttaaattatatgtttactgattcggctcgttggtcaaaaaaaa

SEQ ID NO: 3178 - DNA, 604 bp, Solanum lycopersicum
actctctcttccgtccgagcctcaacctagagagagagtgagagagtgtaagagagaggttcaaagatggtgcagagactcacttaccgtaagcgccacagctatgccaccaaatccaaccaacaccgcgtcgtcaaaactcctggtgggaagttgatttatcagactaccaagaagagggctaatggtcccaagtgccctgtcactggaaagaggattcaggggattcctcacctgagaccagctgagtacaagaggtccaggttgtctaggaacaggaggactgtgaaccgtgcctatggcggagtattgtctggaggagcagttagggagaggatcgtccgtgctttcttggtggaagagcaaaaaattgttaagaaggttttgaagatccaaaaagccaaagaaaagttggcagctaagagttaagcagagagtttagaggaactttctttttatgttttgctgaaattttgacattcaagtgtttactagttttgtgctacaaattgaccttattgctacaacaatttacggcagttttttgctttattttgactccattgccattctatattttgtttagtcttaatttaccttatat

SEQ ID NO: 3179 - DNA, 610 bp, Triphysaria pusilla
ggcccttcgcccagccaaaacccgaggaccaaaaacgcggcggcgagagtgagaaaatggtgcaacgtctcacttacaggtcgcgtcacagctacgccacaaaatcaaaccaacaccggattgttaaaaccccaggtggtaaactagtataccagaccactaagaagagggcaagtggaccaaaatgccctgttaccggcaagagaattcaagggattcctcatttgaggccggccgagtacaagaggtctaggctatccaggaaccgtaggacagtaaatcgtccttatggtggtgtattatctggtggtgctgtaagggaaaggatcattagggcattcttggttgaagagcaaaagattgtgaagaaggttttgaagatacagaaggcgaaagaaaagcttgcttccaagaattaaatttgaagcctgtggctgatatagttttgcgggactcgtattttgagtttttaaagctttatttcctttggatatttgaattatgacattctgctttctatcttctgtttattgcattagattttccgatcgacatcatgttcatgatagtggaactaatttatggattgggttgcttaatttgattttgt

SEQ ID NO: 3180 - DNA, 540 bp, Triphysaria pusilla
cccgaggaccaaaaacgcggcggcgagagtgagaaaatggtgcaacgtctcacttacaggtcgcgtcacagctacgccacaaaatcaaaccaacaccggattgttaaaaccccaggtggtaaactagtataccagaccactaagaagagggcaagtggaccaaaatgccctgttaccggcaagagaattcaagggattcctcatttgaggcctgccgagtacaagaggtctaggttatccaggaaccgtaggacagtaaatcgtccttatggtggtgtattatctggtggtgctgtaagggaaaggatcattagggcattcttggttgaggaacaaaagattgtgaagaaggttttgaagatacaaaaggcaaaagaaaagcttgcttccaaggcttaaatttttggaatcctatgatatccaaggaattttgtattttgaggttttaaagcttgatattatgtttattttgtcgggatcctttgaaattttatctacaacatgtttatgacaattaaactaatttaaggattgggttct

SEQ ID NO: 3181 - DNA, 473 bp, Fraxinus spp
acaagtagagtaaaatggtgcagagactcacgtatcggagaggcatagctatgccaccaaatccaatcaacacaggattgtaaaaactccgggagggaagctggtgtaccagagcactaagaagagagccagtggacccaagtgccctgttactggaaaaagaatccaagggattcctcatttgcgacctgctgaatacaagaggtccagattatctaggaaccggaggactgtaaaccgtgcctatggtggtgtactgtctggagccgctgttagggagaggataattcgagccttcttagttgaagagcaaaaaatcgtgaagaaggttctaaagattcagaaagctaaagaaaagcaagctgccaagagctgattgattcgaagttgtccattatttattttaagaaaatgtacttggatgttgacgattatgaaatgtaagagcaagaattctgtccaaatggctgtgg

SEQ ID NO: 3182 - DNA, 554 bp, Ambrosia trifida
tgtagcaacccctaaagcctcctccttcccattcggccacaccagagagcagcaattcggatccgaatatggtgcagcgtctgacttatcggaaacgccatagctatgccaccaaatccaaccagcaccgggtcgttaaaacccccggtggaaagttggtttaccagactacaaagaagagagctagtggccctaagtgccctgttactggtaaaagaatccaagggattcctcacttgaggccgactgaatacaaaaggtctagactttcaaggaacaggaggactgttaaccgtgcctatggtggtgttctgtctgctggtgctgtgcgtgagaggatcatccgtgctttcttggttgaagagcaaaagattgtgaagaaggttcttaagcttcaaaagacaaaagaaaagcaaggtggaaaaagttaagacaggtttgcaattagtaatttgattgaaagaaattttggcttcaagacaatgattataagatgtgaacttatagattcttgtgagagatattcatcgatttaaaattccaatgcgtttgtt

SEQ ID NO: 3183 - DNA, 919 bp, Amorphophallus konjac
tgccatctcctctcggcggcgcctgcggagaagtacgggaggaaggagaagggggggagggcgagaagatggttcagaggctgacgtaccggaagcggcacagctatgccaccaagtccaaccagcaccgggttgtaaagactcccggtgggagactcgtctaccagtcgacgaagaagagggcaagcgggccgaaatgtccggtgacggggaagaggatccaagggattcctcacctgcgtcctgccgagtataagaggtcaaggctgtctagaaaccggaggactatcaaccgggcctatggtggagttctttctgggaacgctgtccgtgaaaggatcattcgtgccttcttggtcgaagagcagaagattgtaaagaaggtgttgaagatccagaaagcaaaggagaagcaggctgcgaagcagtgacagcagttgagggaagaggaagcatgagctctgttttgctgctcaagggaaattttgacgtttccaagatgatgggtgccttggtttgaaaaaaaaatgtagctttgttcttcacttggacaatagattgccatatttcttttgcacattatttgctcttgttttgactgacagtctagctgtaatgtgtggagtgttgtgtcttcctttaatatatttttgcttcaaatttaaggccaaaagtgttttcatggcttgcttatgatagatgaagcttctacaggcggagctcgcatcagaaggttatgaatttgtttgagaacgttcggatttcggagagccatgggcttttatcgtcggtggtgctttaccagtgaagtattttccatcacacctggttgtgatttgattgtatcggtcttcagatttaacgaatgttgagtcggttaatatgatagaatttataagttgccttgaacgatgcagac

SEQ ID NO: 3184 - DNA, 661 bp, Amorphophallus konjac
ccatcggatctagggcattcttaaatttgatttgcgccatttgcccataagagcacacatttgctggttctcctcctctcgccatctgcgcccagagagagagagaagatggttcagcggctgacgtaccgcaaacggcatagctacgccaccaaatccaaccagcaccgggttgtgaagacccctggtgggaggctggtctaccacaccacgaagaagagggctagtggtccgaaatgcccggttacagggaagaggatccaagggattcctcacctacgccctgctgaatacaagaggtcaaggttgtcaagaaaccggaggactgtcaaccgggcttatggtggagttctatctggaagtgctgttcgcgagaggatcattcgtgccttcttggttgaagaacaaaagattgtaaagaaggtattaaagatccagaaggctaaagaaaagctggctgcaaagcagtagggggaagcaatagttcttttttggcttgctgtttagttatgaggaagttttgactgttgcgttgcgacgattgcttgcttgagaagtgaagttatattagtcactgagacagcagattcccctgctatctatcccattgtggagtactttgttttgttatcactgccttgcccatatccttgttgatttt

SEQ ID NO: 3185 - DNA, 711 bp, Euonymus alatus
ttgcgtgtctcagcggccggggcttctgtcgcggcctccttcaagctgctgagcaatttgtcgacttagagatagagacaggaggaaccaaaaatggtgcagagacttacatatcgcaagcggcatagctacgcaaccaagtccaaccagcaccgggttgtcaaaacccctggtggcaaattggtttatcagagcacgaagaagagagcgagtggacccaaatgtcctgtaactggcaagagaattcaaggaattcctcacttgcgtcctactgaatacaagaggtctcgattgtctaggaaccgcaggactgtgaatcgtgcttatggtggtgttttgtctggcagtgctgtcagggagaggataattcgagccttcttggtggaagagcaaaagattgtgaagaaggtcttgaagattcagaaggcaaaggaaaagataactgcaaagagctgaagtatgatttaggggctgctgttgtttttgataaattttgtttgtgggaagatgaaatcagaaaatgaaattgtaacgtgtcgaaaattagcttggttgaaggtcagtcacttgttgtactttgtttcttctttatgttttgagtattttgttttatgatgactttttgtttgttgaggtacatcacgttattgaatcttcctataagactagtttgtgttctattttttctccttgtatgctacatttggaagt

SEQ ID NO: 3186 - DNA, 539 bp, Flaveria ramosissima
caaaccctaaagccctgtttcctctcgaccataatccgctaaacaatttaacatcttctacttacacccaacatcagatccgaacatggtgcagcgtctcacctaccgcaaacgccatagctacgctaccaaatccaaccaacatcgggtcgtcaaaacccccggtggaaagttggtgtaccagactacgaagaagagagctagcggccctaaatgccctgttaccggcaggagaatccaagggattcctcatttgaggcctgctgaatacaaaaggtctaggttatcgaggaacaggaggactgttaaccgtgcctatggtggtgtgctgtctgctggtgctgtgcgtgagaggatcattcgagctttcttggttgaagagcaaaagattgtgaagaaggttttgaagcttcaaaagaccaaagaaaagcaaggtgggaagagttaagactggtttgcaattagtaatgcaattgaaagaaattttgacttcaaacatgatgattataagatgtgaacttatagattattgtggaagg

SEQ ID NO: 3187 - DNA, 647 bp, Linum usitatissimum
gcagtctcggagaaaaaccctacacagagcaagaaaaggctaagggattgagagcctgcgaagatggttcagcgcctaacttaccgcaagcgccacagctatgccaccaagtcgaaccagcacaggatcgtcaagactcctggtggtaagttggtgtaccagaccactaagaagagagccagtggacctaagtgccctgttactggaaagaggattcaagggattccgcatttgagacctgctgagtacaagaggtccagattgccgaggaacaggagaaccgttaaccgtgcttatggtggcgttctctctggtggtgctgttcgtgaaaggatcatccgtgctttccttgtcgaagagcagaagatcgtaaagaaggtgttgaagatccagaagtccaaggagaaggtcactaagtagatgtgatgtgtaacttttgagaaaggttgtgtcgaaacagccagtaatagaagtgatccgtttgattacattagagttgcttttctgatttttggattttctttgtgcttctgttttcatctcagaactaatgttgaattcctattactctcttgagctttctcttaaaaagttttgtgccctaagctcaagttccacattgttgatctatcgattcgccctatttt

SEQ ID NO: 3188 - DNA, 609 bp, Linum usitatissimum
agcagtctcggagaaaacccctacacagagcaagaaaacgtaaagggactgagaacctgcgaagatggttcagcgcctcacttaccgcaagcgccacagctatgccaccaagtcgaaccagcacaggatcgtcaagactcctggtggtaagttggtgtatcagaccactaagaagagggccagtggacctaagtgccctgttactgggaagaggattcaagggattccccatttgagacctgctgagtacaagaggtcgagattgccgaggaacaggaggaccgttaaccgtgcttatggtggtgttctctctggtggtgctgttcgtgaaaggatcatccgagctttcctagtcgaagagcagaagatcgtaaagaaggtgttgaagatccagaagtccaaggagaaggtcactaagtaaatgtgatgtgtaactcttgagaaaagatgtgtcgaaacacccagtaatagaaggaatccgtttgattccattagagttggtttctgatttttggattttgtttgtgcttctgtttttatctccgaatgaatgttgaattgttattactcttttgagctttcgtttaaaaagttttgtgccctaagccc

SEQ ID NO: 3189 - DNA, 627 bp, Linum usitatissimum
agcagtctcggagaaaacccctacacagagcaagaaaacgtaaagggactgagaacctgcgaagatggttcagcgcctcacttaccgcaagcgccacagctatgccaccaagtcgaaccagcacaggatcgtcaagactcctggtggtaagttggtgtatcagaccactaagaagagggccagtggacctaagtgccctgttactgggaagaggattcaagggattccacatttgagacctgctgagtacaagaggtcgagattgccgaggaacaggaggaccgttaaccgtgcttatggtggtgttctctctggtggtgctgttcgtgaaaggatcatccgagctttcctagtcgaagagcagaagatcgtaaagaaggtgttgaagatccagaagtccaaggagaaggtcactaagtaaatgtgatgtgtaactcttgagaaaagatgtgtcgaaacagccagtaatagaaggaatccgtttgattacattagagttggtttctgatttttggattttgtttgtgcttctgtttttatctccgaatgaatgttgaattgttattactcttttgagctttcgtttaaaaagttttgtgccctaagctcaagttcccccctggtgtt

SEQ ID NO: 3190 - DNA, 650 bp, Linum usitatissimum
agcagtctcggagaaaaaccctacacagagcaagaaaaggctaagggattgagagcctgcgaagatggttcagcgcctaacttaccgcaagcgccacagctatgccaccaagtcgaaccagcacaggatcgtcaagactcctggtggtaagttggtgtaccagaccactaagaagagagccagtggacctaagtgccctgttactggaaagaggattcaagggattccgcatttgagacctgctgagtacaagaggtccagattgccgaggaacaggagaaccgttaaccgtgcttatggtggcgttctctctggtggtgctgttcgtgaaaggatcatccgtgctttccttgtcgaagagcagaagatcgtaaagaaggtgttgaagatccagaagtccaaggagaaggtcactaagtagatgtgatgtgtaacttttgagaaaggttgtgtcgaaacagcccgtaatagaagtgatccgtttgattacattagagttgcttttctgatttttggattttctttgtgcttctgttttcatctcagaactaatgttgaattcctattactctcttgagctttctcttaaaaagttttgtgccctaagctcaagttccccattgttgatctatcgattcgccctattttgt

SEQ ID NO: 3191 - DNA, 722 bp, Humulus lupulus
ccgaacttttgctggcagtccagaatcgcagagctcgttcatcaagcaatcgaaaatggtgcagcgtctcacatatcgcacccgacacagctacgccaccaaatcgaaccagcaccggatcgtcaaaacaccaggtgggaagttggtttaccagaccaccaagaagagagctagcggcccaaaatgccctattactggcaagagaattcaggggattcctcacttgagaccaactgaatacaagcgctctagattgtcgaggaaccgtaggactgtgaatcgggcctatggtggtgttctttctggaggtgctgttagggagaggatcattcgtgctttcttggtggaagagcaaaagattgtgaagaaggttttgaagattcaaaaggccaaggaaaagttggcctccaagaactaaatgagtggacatgatgttgttgagtgaaattttgacttccttttaagtcgactattcagtatggatcaaaatgtttaatggctttactgtattctgtttgctacttcagttagttgagtacactcttattagtgcaatttgtagacactcaatcttacttttgaaacatgatatttctagtagtttgatttccgagatctttaatctatagtttgtcaaaaaatttactgatctggtattacgtgtgtacactagattttcatcttgcgtcattctcgggtttttcaagtcttttacaaggttt

SEQ ID NO: 3192 - DNA, 509 bp, Humulus lupulus
gtcaaaatggttcagaggctcacgtatcgcaagcgccatagctatgccaccaagtccaaccaacatcgcatcgtcaagacaccaggtgggaagcttgtttaccagaccgctaagaagagagcgagcggtcctaagtgccctgttactggaaagagaatccaagggattccacacttgagacctactgagtacaagaggtctagactatcaaggaacaggaggaccgtaaaccgtccatatggtggtgtgttatctggtggagctgtcagagagagaattatcagagcatttttggtggaagagcagaagattgtgaagaaggttttgaagatccagaaagcaaaagaaaagttggcttcaaagaactaagatgtcaatgtgaggttttgttcattttgatttgatggaaacaaaatttgaattttattgtgatgattacattttggaaactataggtatgacgtttttcttataattgtgaacaagctttacttggaatattcagttaa

SEQ ID NO: 3193 - DNA, 700 bp, Plantago ovata
ccctgaataaacagtattattaataatactgtactcctacagtcgtcttctacttttccttctctgcccctgctgctaattcgctgtttggaatctccttggttgattgctaagatggtgcagaggctaacgtaccggaagaggcatagctatgccaccaagtccaaccaacaccggatcgtcaaaactcctggtggaaagctggtttaccagacaaccaagaagagggctagcggtccaaaatgcccggttaccggaaagaggatccaaggaattcctcatttgagacctagtcagtacaagaggtctagattgccaaggaaccgcaggactgttaatcgtccatatggcggagtcttgtttgggggagctgtgagagaaaggattattcgagctttcttggtcgaagaacaaaagattgtcaagaaggtcttgaagattcagaagtccaaggaaaaggttgcctccaagagctaagtgtagcctagtgctaagatagttttgaatataatttagctatcgggtgaagaaattgtatcgtgaggttgaaaagtttacatgtacttcgactttttctggagcatttgttttattctacatttcagtcttaacttctactgtcaggattttgcttctcctttttttgtacatggcattctattttggtattttattctgaaactttagtttttctataccc

SEQ ID NO: 3194 - DNA, 644 bp, Silene vulgaris
ttttgtagagagagaaagtgagcaaagaggagagagaaacaatggtgcaaaggctaacttaccgtaggcgtcacagctatgctactaaatccaaccaacatcgcatcgtcaaaacccctggtggtaagttggtgtatcagaccacaaagaagagagctagtggacctaagtgccctgtcactggcaagagaattcaagggattcctcacttgagaccaactgaatacaagagatccagattgccaaggaacaggagaactgttaaccgaccttatggtggagttctgtctggtggtgctgttagagaaaggatcataagagcattcctcattgaagagcagaagattgtgaagaaagttttgaagatccaaaagaccaaggaaaagcaagctggaaagagttaaactgtgaaccatccttgttgatgctaaattttgttgcttagtggaagttagccgtggaaaagttgtgtgagaagtcattgacaattggactttgtatcgtaacgctgagcgcattgatcttagttttactgaatctagtcgacaaggctttacttgtttcattccctgctgttttatgttaagtacattcgagattgtgttatcccagatcagttattttctcagataacctctttaatt

SEQ ID NO: 3195 - DNA, 698 bp, Silene vulgaris
gaggagagagccaacaatggtgcaacgtttaacttatcgtaggcgtcacagttacgctactaaatctaatcaacatcgcatcgtcaaaaccccaggtgggaaattggtgtatcagactacaaagaagagagcaagtggccctaaatgtcctgttactggcaaaagaattcaagggattcctcacttgagacctactgagtacaagagatccagattgccaaggaacaggaggactgtaaaccgtccttatggtggagttctttctggcggcgcagtccgagagcggatcattagagcattcctgattgaagagcaaaagattgtcaagaaggttttgaagatccaaaagaccaaggaaaagcaagctggaaagagctaaaccctggtagcggtcttttgtgatagtaatttttgaagttgcaaagaagtttgtctcgcaaatgtgatgatatgaggtcttgacaatttggttttgtaatagctgagctcttgaagctcgtttagtggaagttaaatctttgtcgacaatgttttactcgtttttgttccttcctacttacctttacttaagtctattataactcttggattcgtacatttttaatctacactttgcagctgtttgtttttgtaatgaacaaatcctctttgtaccccgtatatgctaccttcttctctttcatatctgctcagcagaa

SEQ ID NO: 3196 - DNA, 651 bp, Silene vulgaris
gagagagacaacaatggtgcaacgtttaacttatcgtaggcgtcacagttacgctactaaatctaatcaacatcgcatcgtcaaaaccccaggtgggaaattggtgtatcagactacaaagaagagagcaagtggccctaaatgtcctgttactggcaaaagaattcaagggattcctcacttgagacctactgaatacaagagatccagattgccaaggaacaggaggactgtaaaccgtccttatggtggagttctttctggcggcgcagtccgagagcggatcattagagcattcctgattgaagagcagaagattgtcaaaaaggttttgaagatccaaaagaccaaggaaaagcaagctggaaagagctaaacactggtagccgtcttttgagatagtaatttttgaagttgcaaagaagtttgtcgtgctaatgtgatgatatgaggtcttgacaatttggatttgtaatagctgagcccttgaagctcgtttagtggaagttaaatctttgtcgacaatgttttactcgtttttgttccttcctacttccctttactcaagtctattataactcttggattcgtacatttttaatctacactttgcagctgtttgtttttgtaatgaacaaatcctctttgtac

SEQ ID NO: 3197 - DNA, 695 bp, Vinca minor
ccaatcccatacagtgaagtctagagagagaaagtagtaaacgaaaatggtgcagcgtctcacctaccggaaacgccatagctacgccaccaaatccaaccagcaccggatcgtcaaaacccctggtgggaaattggtatatcaaaccaccaagaagagagccagtggtcctaagtgtcctgtcactggaaagagaattcaagggattccacacttgaggccggctgagtataaaaggtctcgtttatccagaaacaggaggacggttaatcgtccatatggtggtgtattatctggcagtgctgtccgcgagaggattgtccgagctttcttagttgaagagcaaaagattgtcaagaaggttttgaagatccaaaaggcaaaagaaaagcttgctgcaaagagctaatgtgtgaaagttttcgggaaatctcatgcccttgttatttgaaacaaattttgacattccgcgctactatatatgtcttatacagtctctgagctgatttcttttttacttgaatgatctttcatttagatttcgttctttatcttgctaaattaaactgcaaatggggcttaacggggtgtgagcgtttatcagatctcggttaaactgcatttcatgaacttttactggtctatgtgatcttaattcccctggttatgtatttggttctcaaagcatttgattt

SEQ ID NO: 3198 - DNA, 809 bp, Amborella trichopoda
  misc_feature (188)..(188): n is a, c, g, or t
  misc_feature (257)..(257): n is a, c, g, or t
  misc_feature (281)..(281): n is a, c, g, or t
  misc_feature (299)..(299): n is a, c, g, or t
gttgccatagacccttctgtttcacttcggggttgctctgttgcagaggaagagagagaaggtttagagagggaggaaacatggtgcagcggctcacctatcgcacgcgccatagctacgcgaccaaatcgaaccagaccagggtcgtcaaaaccccaggtggaaagctcgtgtatcagactgctaanaagagggcaagtgggccaaaatgcccagtcacaggcaaaagaatccaagggattcctcatctgagaccnactgaatataagaggactaggctntcaaggaaccggaggacngtgaatcgtgcttatgggggggttttgtctggtggtgctgttcgtgaaaggatcattcgggcctttttggtggaggagcaaaagattgtcaagaaggttttgaaaatccagaaggccaaagaaaagcaggctgccaagagttaagtacgaaaagcttccgtgtgctctgtacgcgaaacaaattttggattacagttaaatgaagctcatgataaaagactgtatcggctgtgtacttggcgacaattcctcttttcaatcttgttggtttcttattatttgttccatcctgtcccttttctggtgtttctccagcaatatcagttagtgatttctttgtgaaaggaactgtaaggtttaagttttcagtagtttcctatttgcatgtctgtttggctctctcatttccttttaatactatcagaaattttcttgtaatgctgtctggaatttttgtagtgttgcttttctatcctgttataatttatttgagggctttcattacttccc

SEQ ID NO: 3199 - DNA, 637 bp, Malus domestica
tggcagctgaaactcgattgcaaaaatggtgcagcgtctcacgtatcgcgcccggcacagctacgccaccaaatccaaccagcacaggatcgtcaaaacccctggagggaagctagtttaccagaccactaagaagagggcaagcgggcccaagtgccctgttaccggcaagaggattcaagggatccctcacttgaggcctactgagtataagaggtccagattatctaggaatcggaggactgttaaccgagcttatggaggtgtattgtctggaggtgctgtcaaagaaaggatcatcagggcctttctggtggaggaacagaagattgtgaaaaaagtgttgaagatccagaaggcaaaggaaaagcaagcttcaaagaccaaatgaaactcaaccgagttttaagtagcttcagactacgctgattttggcttatggtgagctatgggatctaattcgaggtgttccaatttgtacttttatattttgttgtggatggtttaagttatgatgttaagtacattttcttcagaagtgcatcctaccatggaatttcctgttttgtatttcagtggtaacatatacgctttggagttatttgtgtagtgtcagattactagctttatttgcgat

SEQ ID NO: 3200 - DNA, 608 bp, Malus domestica
ggcagctgaaactcgattgcaaaaatggtgcagcgtctcacgtatcgcgcccggcacagctacgccaccaaatccaaccagcacaggatcgtcaaaacccctggagggaagctagtttaccagaccactaagaagagggcaagcgggcccaagtgccctgttaccggcaagaggattcaagggatccctcacttgaggcctactgagtataagaggtccagattatctaggaatcggaggactgttaaccgagcttatggaggtgtattgtctggaggtgctgtcaaagaaaggatcatcagggcctttctggtggaggaacagaagattgtgaaaaaagtgttgaagatccagaaggcaaaggaaaagcaagcttcaaagaccaaatgaaactcaaccgagttttaagtagcttcagactacgctgattttggcttatggtgagctatgggatctaattcgaggtgttccaatttgtacttttatattttgttgtggatggtttaagttatgatgttaagtacattttcttcagaagtgcatcctaccatggaatttcctgttttgtatttcagtggtaacatatacgctttggagttatttgtgta

SEQ ID NO: 3201 - DNA, 716 bp, Persea americana
aagagagagagagagggagagagcacaaaagcagaaggagagagaccgatcggtcgatctgaaaatggtgcagaggttaacttatcggaagcggcatagctatgccacgaaatccaatcagaccagggtcgtcaaaaccccaggtgggaagctcgtgtttcagtatacaaagaagagcgcgagcggacccaaatgtcctgttactggaaagagaatccaagggattcctcatttgagacctgcagagtacaagaggtccaggctgtcaagaaaccgaaggactgttaaccgagcatatggcggggttctttctggaagtgcagttagagaaaggatcatccgagccttcttggttgaagaacagaagattgtgaagaaggttttgaagatccaaaaggctaaggaaaaacaagctggaaagagctagagaggagagaagcgaaagcttttttgagtcattttttagcaggaaagagattttgtcatgataatgacaatgaaatatggcatggagatggtaagatacttgaatgtatttccttgaaggattgttattttgttgagttggtttggatctgtttagtgcctttacacactaaaacattatgcctgcctttctgcaatgatctgtttgttttggacaaacaccatttggatgtctttgatagtatgtagttcgatcggtactgtaccaggggacttaatttgttccatta

SEQ ID NO: 3202 - DNA, 876 bp, Persea americana
tttggattgtgggttcagtgatggagatccagcatgtgtttcacttaacaccattccgcgatgtgatcccaactcgtgatgaatgaaccgatgattcagtcggcctggggactggtttttctctgtcttgtccacttcacttcatcttagccgttgaaacgaagcatcatcggattaaaacgttgctgaccatcggatctaaaaaggcacctccttttcctttttaagcgcatcggctctgccctcgcaaaaccctcttccctttggttttcttcgtgtctctcgtgctttcgacgagatcgagaggtcgaagatggtgcacagattgacttatcggaaacggcatagctatgcaaccaaatctaatcaaacccgagtcgtcaaaaccccaggtgggaaactcggttatcagaacacgaagaagagagccagcggaccaaagtgtcctgtcactggaaagagaatccaagggattcctcacctgagaccggccgagtataagaggtctagactgtccagaaatcgaaggactgtcaaccgaacttatggtggggttctttctggaggcgctgttagagaaaggatcatcagagcctttttggttgaagaacaaaagattgtcaagaaggtattgaagatccaaaaggccaaggaaaagcaagctgcaaagagctagaagaggaggggagagacgagagacaggctaaagcttgagtttttttcctttctttttgtttctttttaatttggtaatggattttgactggatgatgacgaaatgtgccatgggcatggtaatacattttagctctttctaaagggcattaatatttttttccattggtttggatctgattaaaaaaaaaaaaaaaaaaa

SEQ ID NO: 3203 - DNA, 667 bp, Musa acuminata
ggggctctttggtgggagggaggaggtaggcggagagagagagagagagagagagagaggcgagatggtgcaacgattaacgtatcggaagaggcatagctatgccaccaaatcgaatcagaccagggttgtcaaaaccccaggtgggagccttgtgtatcagtacacgaacaagagggcgagcgggccgaaatgccctgtgactggcaagaggatccaaggaatacctcatctaagacctgctcagtacaagaggtccaggttgtccagaaatcgccggactgtgaaccgtgcttatggtggggtcttatctggaagtgctgtcagagaacggattatccgagcttttttggttgaagagcagaagattgttaagaaagttctgaagatccagaaggccaaagaaaaacaagcctcaaagagctagacaagggtgagagagaagcataaatgctgagtatgtatccacacaagggaggtgataatgatgtgtgagtttcaatgtaactgttggatattaggggttccggggagttgtttagcacaagttccataacctaaatcctctggtaatctttgattatttgttatgcttgaactatctttccttgtattctcagttatctagtaactatttttgcttcactggaaaaaaaaaaaaaaaaaa

SEQ ID NO: 3204 - DNA, 1271 bp, Beta vulgaris
  misc_feature (20)..(21): n is a, c, g, or t
  misc_feature (24)..(25): n is a, c, g, or t
  misc_feature (29)..(29): n is a, c, g, or t
  misc_feature (31)..(31): n is a, c, g, or t
  misc_feature (38)..(38): n is a, c, g, or t
  misc_feature (40)..(40): n is a, c, g, or t
  misc_feature (47)..(47): n is a, c, g, or t
  misc_feature (50)..(51): n is a, c, g, or t
  misc_feature (53)..(53): n is a, c, g, or t
  misc_feature (68)..(69): n is a, c, g, or t
  misc_feature (74)..(74): n is a, c, g, or t
  misc_feature (80)..(80): n is a, c, g, or t
  misc_feature (82)..(82): n is a, c, g, or t
  misc_feature (85)..(86): n is a, c, g, or t
  misc_feature (106)..(106): n is a, c, g, or t
  misc_feature (109)..(109): n is a, c, g, or t
  misc_feature (116)..(116): n is a, c, g, or t
  misc_feature (119)..(121): n is a, c, g, or t
  misc_feature (129)..(129): n is a, c, g, or t
  misc_feature (131)..(131): n is a, c, g, or t
  misc_feature (136)..(136): n is a, c, g, or t
  misc_feature (146)..(147): n is a, c, g, or t
  misc_feature (159)..(159): n is a, c, g, or t
  misc_feature (176)..(176): n is a, c, g, or t
  misc_feature (187)..(187): n is a, c, g, or t
  misc_feature (196)..(196): n is a, c, g, or t
  misc_feature (204)..(205): n is a, c, g, or t
  misc_feature (212)..(212): n is a, c, g, or t
  misc_feature (222)..(222): n is a, c, g, or t
  misc_feature (224)..(224): n is a, c, g, or t
  misc_feature (238)..(238): n is a, c, g, or t
  misc_feature (241)..(241): n is a, c, g, or t
  misc_feature (246)..(246): n is a, c, g, or t
  misc_feature (248)..(249): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (264)..(266): n is a, c, g, or t
  misc_feature (276)..(276): n is a, c, g, or t
  misc_feature (279)..(279): n is a, c, g, or t
  misc_feature (291)..(291): n is a, c, g, or t
  misc_feature (298)..(298): n is a, c, g, or t
  misc_feature (307)..(307): n is a, c, g, or t
  misc_feature (309)..(309): n is a, c, g, or t
  misc_feature (311)..(312): n is a, c, g, or t
  misc_feature (316)..(317): n is a, c, g, or t
  misc_feature (322)..(323): n is a, c, g, or t
  misc_feature (361)..(361): n is a, c, g, or t
  misc_feature (373)..(373): n is a, c, g, or t
  misc_feature (395)..(395): n is a, c, g, or t
  misc_feature (412)..(412): n is a, c, g, or t
  misc_feature (417)..(417): n is a, c, g, or t
  misc_feature (428)..(428): n is a, c, g, or t
  misc_feature (432)..(432): n is a, c, g, or t
  misc_feature (434)..(434): n is a, c, g, or t
  misc_feature (438)..(439): n is a, c, g, or t
  misc_feature (452)..(452): n is a, c, g, or t
  misc_feature (455)..(455): n is a, c, g, or t
  misc_feature (464)..(464): n is a, c, g, or t
  misc_feature (478)..(478): n is a, c, g, or t
  misc_feature (486)..(486): n is a, c, g, or t
  misc_feature (490)..(490): n is a, c, g, or t
  misc_feature (492)..(492): n is a, c, g, or t
  misc_feature (498)..(498): n is a, c, g, or t
  misc_feature (512)..(512): n is a, c, g, or t
  misc_feature (520)..(520): n is a, c, g, or t
  misc_feature (522)..(522): n is a, c, g, or t
  misc_feature (532)..(532): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (559)..(559): n is a, c, g, or t
  misc_feature (564)..(564): n is a, c, g, or t
  misc_feature (566)..(566): n is a, c, g, or t
  misc_feature (1262)..(1262): n is a, c, g, or t
ttattctcgaggattttttnnaanncggngntttttgngnaattttntgnncnaaccccctttttttnnggaanttttgnanaanngaggggggggggcccccggnccnccatttnttnnnaaaccccncnaaganttttttaggnnaaaaccgggttnggaccttttttttcggncccccttaggntttttttcngggggggnnaaaacancccgcctttngnccctttggctttcnatnttttntnntcccnttggnganannncccctggagnaanccccccccccancccgggngggttttgngngnngganngcccnnacaaccccttcccggggggggtttttaaaaggccccanttttccgggaangggggggggcacctttttgggnttcccttttggcccccnggttncctttttttcnggtntntttnngggaattgggggnaanatttccccngaaacctttgcccnttttcccnagcngnaattanccccctaaaggaanaaaggggngntcccccgggnggggnccnttnaaattagggttccccnggggncngaattggcacgaggctcatttcaccaaaccctaacagaggagagagaaaactcaaaaaaacacaaaaatggtgcagaggctgacttatcgtagacggcatagctatgctactaagtctaaccagcatcgcatcgtcaaaactcctggtggtaaattagtttaccagactactaagaagagggctagcggtcctaaatgtcctgttactggcaagagaatccaagggattcctcacttgagacccactgaatacaagagatctagattgcctaggaatagaagaactgtgaaccgtccttatggtggagttctgtctggtagtgctgtcagagagcgtatcataagagcattccttgttgaagagcaaaagattgtgaagaaggttttgaagatccaaaaaaccaaggaaaagcaggctggaaagagttgaagctaggagccattgtatttgatggtaaattttggagcctcattgagcaaactatggaacttggaaagtgtgatgtgaaggtcttgaaaattggatttgtattttacagttggggttactcaagagcgtagttgtagttgcactttgtcgacaattctgccattctctgttatttctgttcaaaattttcttggtttttatgtcaaatacatctaagatgaattgttgtgcaatattagatgattggatttctttgaatcagcagntgagtttgt

SEQ ID NO: 3205 - DNA, 529 bp, Beta vulgaris
cccacgcgtccgttttcaataagagagaaagttattcgacgacaaaacaactgaaaatggtgcaacgtctcacctacagaaaacggcacagttatgccaccaagtctaaccaacataggatcgtcaaaactcctggggggaaattggtgtatcaaactaccaagaagagagctagcggtcctaaatgccctgttacaggaaagagaattcaagggtatccacacctgagacccactgaatacaagaggtctagattgcctagaaaccgtaggactgtcaaccgaccttacggtggtgtgttgtctggatctgctgttcgagagaggataatccgtgccttcttggtggaggagcagaagattgtgaaaaaggtattgaagatccagaagacgaaggaaaagcaagctggcaaaagctagaatggacagacttcaagtaggctgtctctggattagcgacttctggcttttctaggtgcaattttgtttaatgatgacgatgatgacaatatctatgactgaagaaaatt

SEQ ID NO: 3206 - DNA, 671 bp, Centaurea maculosa
  misc_feature (25)..(25): n is a, c, g, or t
  misc_feature (27)..(27): n is a, c, g, or t
  misc_feature (32)..(33): n is a, c, g, or t
  misc_feature (47)..(47): n is a, c, g, or t
  misc_feature (52)..(53): n is a, c, g, or t
  misc_feature (55)..(55): n is a, c, g, or t
  misc_feature (75)..(75): n is a, c, g, or t
  misc_feature (108)..(108): n is a, c, g, or t
  misc_feature (237)..(237): n is a, c, g, or t
  misc_feature (286)..(286): n is a, c, g, or t
  misc_feature (304)..(304): n is a, c, g, or t
  misc_feature (394)..(395): n is a, c, g, or t
  misc_feature (411)..(411): n is a, c, g, or t
  misc_feature (419)..(419): n is a, c, g, or t
  misc_feature (431)..(431): n is a, c, g, or t
  misc_feature (435)..(435): n is a, c, g, or t
  misc_feature (437)..(437): n is a, c, g, or t
  misc_feature (541)..(541): n is a, c, g, or t
  misc_feature (547)..(547): n is a, c, g, or t
  misc_feature (670)..(670): n is a, c, g, or t
cttggcgggggttctctccgatccnancagannagattagccgccgntccanntncaacaatggtgcagcgtctnacctaccgcaaacgccatagctatgccaccaantccaaccagcatagggttgtcaaaacccctggtgggaagctagtgtatcagaccaccaagaagagggcaagtggacctaaatgccctgttactggcaagagaatccaagggattcctcacttgaggccngctgaatacaagaggtctagattatctaggaacagaagaaccgttaacngggcttatggtggagttntgtctgcaggggcagtaagggaaaggatcatcagggcttttcttgttgaagaacaaaagattgtgaagaaggttctgaagatccagaaanncaaagaaaagaccgcntcaaaganttagatttcagnatgnanctgagtcggtattctttcaaccctcagagtaattttggatacaacccaccatttgtgaaatttgagttagtctgtgagatgatgtgtcttgaatatgtaatcgngccgcntttgcctctactacttttgtcgttaatcaaaacatttactaggttttgtttacaacttattaaatcttttgggattctttttctttcaccgttatgtttacgttgaatttgctttttctcatnc

SEQ ID NO: 3207 - DNA, 643 bp, Centaurea maculosa
cgcgggggcattacagaaaaagagagaaacttcattccacaaagaaactctgaaaaatggtgcagcgtctcgcctaccgcaaacgccatagctatgccaccaaatccaaccagcacagggtcgtcaaaacccctggtggaaagctggtttatcagacaacaaagaagggagctagtggtcctaagtgccctgttactggcaagagaatccaagggattcctcacttgaggccagctgaatacaaaagatctagactttcaagaaacagaaggacggttaaccgtgcttatggtggtgtgttatctgctggtgctgttcgggaaaggatcatccgagcgttcttggttgaagaacagaagattgtgaagaaggtgctcaagattcaaaagaccaaagaaaaggcagctggaaagagttagagaaatgggttttattacaacaagatatttggattagtactgaaattttgacttcaacagaattgttataagatgtgaacttatggattcttgtggaaggtgttttgatcgaatttgaattcgaatgagcttgttatgttcgttacatttgatttttatgttttcgtttttcatactctttgtccggatcttcgattatatgaatgtattgccatgatttgtcg

SEQ ID NO: 3208 - DNA, 723 bp, Gossypium hirsutum
ctcaactgaatcgcctccaatccaaaaccctaaaccaacaccagaggcggctccaaaatggttcagcggctcacttaccgcacgcgtcacagctacgccaccaagtccaaccaacaccacgtcgtcaaaaccccaggagggaagctggtttatcaaacgacaaagaagagagctagtggacctaaatgtcctgttaccggcaagagaattcaaggaattcctcatttgaggcctgctgagtataagaggtctagattgcctagaaaccgtaggtccgtgaaccgtgcttatggtggagttctatctggaagtgctgttcgagaaaggatcataagggccttcttggtggaagagcaaaagatcgtgaagaaggtactgaagattcagaagacaaaggaaaagcaatcatccaagtgagagctaggatttgctaatggattgatactgaatcttggaatagtagtttgaggggatttaagatttggatttatgtttttaaatttgttatgaatcatgttctactttttcattttgtcgacaaatcaactttcatgtcaaaattttgtttttggaacactcactttgtttgctcttctccaaatttggtatttccactgaaatgtgcaatgttgcctggttatgcgattgcccccacattatttatttcaccatttgagaaaagtccatgctggctggcattgagtttttttagatgttctgagc

SEQ ID NO: 3209 - DNA, 595 bp, Curcuma longa
ggtggaaggatcggtgagatggtgcagaggttaacctaccgcaagaggcatagctatgccaccaaatctaatcagactcgcgtcgtcaaaactccaggtgggaagctcgtgtatcagtacacgcataagagagccagcggcccgaaatgccctgttaccgggaagaggattcaagggattcctcacctaagacctacccagtacaagagatcccgactgtcccgaaacaggaggactgttaaccgagcctatggtggagttttatctggtggtgcagtaagagaaaggatcattcgtgcttttttagtcgaagagcagaagatcgtgaagaaagttctgaagattcagaaggctaaagagaagcaaacatccaagagctaagccatcatttgaacagagtcaagatgcccatcatttgaagagtcaaaatgctttactctcattttgaattttgtttgtttttcactcgatctatatctttatggcaactttaaagacagtagttggttgaattgtttgcagttactgtcgtttatctgcatgttgaacaagtgaattattatatttcctgaaatttagtaggtttttattcgat

SEQ ID NO: 3210 - DNA, 516 bp, Linum usitatissimum
ggcttctcctttggtagcagtctcggagaaaacccctacacagagcaagaaaacgtaaagggactgagaacctgcgaagatggttcagcgcctcacttaccgcaagcgccacagctatgccaccaagtcgaaccagcacaggatcgtcaagactcctggtggtaagttggtgtatcagaccactaagaagagggccagtggacctaagtgccctgttactgggaagaggattcaagggattccacatttgagacctgctgagtacaagaggtcgagattgccgaggaacaggaggaccgttaaccgtgcttatggtggtgttctctctggtggtgctgttcgtgaaaggatcatccgagctttcctagtcgaagagcagaagatcgtaaagaaggtgttgaagatccagaagtccaaggagaaggtcactaagtaaatgtgatgtgtaactcttgagaaaagatgtgtcgaaacagccagtaatagaaggaatccgtttgattacattagagttgg

SEQ ID NO: 3211 - DNA, 651 bp, Linum usitatissimum
ggtagcagtctcggagaaaacccctacacagagcaagaaaacgtaaagggactgagaacctgcgaagatggttcagcgcctcacttaccgcaagcgccacagctatgccaccaagtcgaaccagcacaggatcgtcaagactcctggtggtaagttggtgtatcagaccactaagaagagggccagtggacctaagtgccctgttactgggaagaggattcaagggattccacatttgagacctgctgagtacaagaggtcgagattgccgaggaacaggaggaccgttaaccgtgcttatggtggtgttctctctggtggtgctgttcgtgaaaggatcatccgagctttcctagtcgaagagcagaagatcgtaaagaaggtgttgaagatccagaagtccaaggagaaggtcactaagtaaatgtgatgtgtaactcttgagaaaagatgtgtcgaaacagccagtaatagaaggaatccgtttgattacattagagttggtttctgatttttggattttgtttgtgcttctgtttttatctccgaatgaatgttgaattgttattactcttttgagctttcgtttaaaaagttttgtgccctaagctcaagttccccactggtgttctatctatttgctccattttg

SEQ ID NO: 3212 - DNA, 659 bp, Mesembryanthemum crystallinum
  misc_feature (3)..(3): n is a, c, g, or t
  misc_feature (6)..(7): n is a, c, g, or t
  misc_feature (10)..(10): n is a, c, g, or t
  misc_feature (12)..(13): n is a, c, g, or t
  misc_feature (15)..(16): n is a, c, g, or t
  misc_feature (19)..(21): n is a, c, g, or t
  misc_feature (23)..(27): n is a, c, g, or t
  misc_feature (31)..(32): n is a, c, g, or t
  misc_feature (34)..(34): n is a, c, g, or t
  misc_feature (36)..(36): n is a, c, g, or t
  misc_feature (38)..(40): n is a, c, g, or t
  misc_feature (47)..(47): n is a, c, g, or t
gcntcnngcngnnanntcnnnannnnntttnntngntnnntggttgnggagagagagtgagacgccaagaggagttccagagaaaatggttcagcgtctcacttaccgtaaacggcacagctatgccaccaaatccaaccaacaccgcattgtcaaaacccctgggggaaagcttgtctaccagagcacaaagaagagagccagcggtcccaagtgccctgtcactggaaagagaatccaagggattccccatttgaggcctgctgagtacaagagaagtagattgcccaggaacaggcgtactgttaatcgtccctatggcggtgttctatctggcagtgcagttcgcgaaaggatcatccgggcctttttggtggaagagcagaagattgtgaagaaggttttgaagattcagaagaccaaagaaaaggctacaaagagctagattggcagtgaaaaacgtgtgttagttttttggtcctagtttcttgaaaagaaattttgttttcttaagcaatgttgatttaggcagattactgtttacagttggtaattgttcgtaatactatgaggtgattgtttgccagtttgaatgagcatttttgttccaggaacatgttactaaatagatcgtattaaatcttacactttacggtttc

SEQ ID NO: 3213 - DNA, 817 bp, Mimulus guttatus
cttcgccctcagccaacagacgccgagaattcaaaagcccgaatacccgacccgactgtaactgggaaaatggtgcagcggctaacctacaggaagaggcacagctatgccaccaaatccaaccagcaccgcatcgtcaaaacacccggtgggaagctagtttaccagactactaagaagagggcaagcggtcccaaatgccctgttactggcaagagaatccaagggattccacacttgagacctgctgagtacaagcggtctaggttgtccaggaataggaggaccgtgaaccgcccgtatggtggagttttgtctggtggtgctgtgagggaaaggatcattagagctttcttggtcgaagaacaaaagatcgtgaagaaggttttgaagatacagaagaccaaggaaaagcttgctgccaagccttgataagtgttcgagtgtggtgctgagatagttttgcataattagtgaagggaaaatcatggaattgtattttgaggtttactaagcttgaaatatgttatgtactttgttggtattctttcgtatttgactctttattttgtcgaattcaactattagttttttttttttgagtttttggccgtttgaaggccaattgaactaatttggattttgctttttgtgttattttaaaattttggtcccttttatttttgaggctttcggaattattcggtttaaatcctttgtcgtagattaaattttaagtgcaatggtcggttgtattattatagggctgtgatttagtttgaatacttgtgtattattatgcacgtgttttcatact

SEQ ID NO: 3214 - DNA, 738 bp, Nicotiana benthamiana
acggccggggcttttggtccattcttatcttaccattgtagagaagcggaaaaactccatctacttgaaaagatggttcagagacttacatatcgaaagtggcacagctatgccaccaaatccaatcaacatagggttgtcaaaactcccggtggaaaactaatttaccagagcacaaagaagagagctagcggcccaaaatgtccagttactgggaagagaatccaagggattccgcacctgagacctactgaatacaagagatccagattgtccaggaatcgcaggactgtgaatcgtgcttatggaggtgtgctgtctggaagtgctgtaagggagagaatcattcgcgctttcttggttgaagaacaaaaaattgtgaaaaaggtgttgaagattcagaaggcaaaggaaaagcttgcctcaaagagctgaagataaagacaccgaagtctcttgcaattctattatgtcttcagttaacttaggctgtgatgacgattaagatgtgtgaaagaacatgttgaaatgctagtactcgatatctagtagaatctgaatctctagtattgttttgtagactcacttgttgacattattgccacctgactggagaggttgtttcctctttccagttcagtgatactttaatgcatggtaacttttgaatttaatttaggattatacctactttttaaatgaaacgatgcatgcttgagctcttcaaaaaaaaaaaag

SEQ ID NO: 3215 - DNA, 772 bp, Nicotiana tabacum
agagagagagagaggggttccgaagatggtgcagcgactcacttaccggaagcgccacagctatgccaccaaatccaaccagcaccgtgtcgtcaaaacccctggtgggaagctgatttaccagagtaccaagaagcgggctagtggtcctaagtgtcctgtaactggaaagaggattcaggggattcctcacttgagaccagccgagtataagagatccagattatctaggaacaggaggactgtgaaccgtccctatggtggagtattgtctggaagtgcagtaagggagaggattattcgagctttcttggtggaagagcagaaaattgtgaagaaggttttgaagatccaaaaagccaaagaaaagctggcggccaagagctaagctgagagtttagagggactttattttaagttttggtgaaattttgacattcaagtgtttactaattgtgcactacaaattgatctgattgctgcaacttttgaggagcattttgctttagttgattatatccgacttcattccccattctatataaattgagttgtcgatcttgtcttaatttacctaatatatcacacaacggtttcatcttgctagttgagtcattgttatgagcagctcagttgatggtgaaagaaatgtgccaaaagcaagtagtagtgtaagcattgtctgaatattgggaggtcattgtgcttgcttctcggttgatggcggtctatctcttgtttgattgttgttattcatgaagctgcagctagg

SEQ ID NO: 3216 - DNA, 636 bp, Nicotiana tabacum
gaaagaagctacagagagaatagcagcgccgccgtgaaaaatggtccaacgattaacttaccgtaaacggcacagctatgccaccaaatctaaccaacatagggttgtcaaaaccccaggtggaaagctgatttaccagagtaccaagaagagggctagtggacctaagtgccctgttactggaaaaagaattcaagggattcctcacttgaggcctactgaatacaagaggtcaagattgtcgagaaacaggaggactgtgaaccgtgcttatggtggtgtgttgtcaggcagtgctgtacgtgaaaggatcataagagcctttttggtggaagaacaaaagattgtgaagaaggttttgaagatccagaaagccaaggaaaagctagctgccaagagctaagcttttaatgcttggcgacgtcacaagaggaatgtattttgaattttgggtttaagatttgtattttgctggttttggttaaaatgtgatattgaatatttttcttcagtttgtcgaaatatcgcttctgctaggtctctgtttctgccttactctgggtattcaaacttcctatggatatttgatgatatttcaagtcagtattagttccagttttgcattttaaaaaaaaa

SEQ ID NO: 3217 - DNA, 559 bp, Triphysaria pusilla
cctcatctcagtgaccaaaactctagaccagaaaacgcggctagactgagaaaaaatggtgcaacgattgacttacaggtcgcgtcatagctacgccaccaaatctaatcaacatcggatcgtcaaaacaccaggtggtaaactagtgtaccagaccactaagaagagggccagtggaccaaaatgccctgttaccggcaagagaatccaagggattcctcatttgaggcctgctgagtacaagaggtctaggttatccaggaaccgaaggactgtaaatcgtccttatggtggtgtattatctggtggtgctgtgagggaaaggatcattagggcattcttggttgaagagcaaaagattgtgaagaaggttttgaagatacaaaaggcaaaagaaaagcttgctggaaaggcttaaatttttggaatcctatgatatccaaggaattttgtattttgaggttttaaagcttgatattatgtttattttgtcgggatcctttgaaattttatctacaacatgtttatgacaattaaactaatttaaggattgggttct

SEQ ID NO: 3218 - DNA, 692 bp, Triphysaria pusilla
ttcatcgtctttcttcttcgcctccagccccaaatccacaaactcgaaaccctaaaaatggtgcagcggctaacttataggtcgaggcatagctatgccacgaaatctaaccagcaccgcatcgtcaaaactcccggaggtaagctagtttaccagactactaagaagagggctagtggacctaagtgccctgtaactggcaagcgaattcaagggattcctcacttgagacctgccgagtacaagaggtctcgattgtccagaaaccgtaggactgtgaatcgtccttatggtggcgtgttgtccggcggtgctgtgagggaaaggatcatcagagcttttttggttgaagagcagaagattgtgaagaaggttttgaagatacagaagacaaaggaaaagcttgctgccaagagctagtgtgagtttgttgtggtgctgagaaaattttgaatactatttagccaaacttatggaactgtattttgaggttttggaagcttgaattaatatctgaatttgatttgaaacatgattatctttattttgttgagaaatatctgtttttaggattctgggttttattaaccaatcttgatggtcattgaattccatttcgattttgcttttatgaggttttaaagattttgtttcattttttataatgtaaaaaaggaattcctaattggttg

SEQ ID NO: 3219 - DNA, 741 bp, Triphysaria pusilla
gggcctccgctcaaaggcaataacctaaagccctatcagagtgaaaagtaaaaaatggttcagcggctaacttacaggtcgcggcatagctatgccacgaaatctaaccagcaccgcatcgtcaaaacaccaggaggtaagctagtttaccagactactaagaagagggctagcggcccgaagtgccctgttactggcaagaggatccaagggattcctcacttgagacctgctgagtacaagagatcccgattgtccaggaaccggaggactgtgaatcgtccttatggtggagtgttgtctggcagtgctgtgagggaaaggatcatcagagcttttttggttgaagagcagaagattgtgaagaaggttttgaagatacagaaggcaaaggaaaagcttgctggcaagagctaaatttgttgtggtgctgagataattttgggtagccaacaagtaatcatggaattgtattttgtcgtttttggaagctttaatctttatttggttggaaacatgacttgattttaacttctttattttgttgagatatcatctgttcgttggattttgggttttattagccatcttggtggctattgaattccatttggattttgatctttgtggtttaaaagttttggtgttcttattttgttcttctatttggtaagttcaatgattccgtattacttttgtgtgtttagtaatgctaaatcgaaagaaaaatatcatttgttt

SEQ ID NO: 3220 - DNA, 685 bp, Pteridium aquilinum
tggttcagcggctcacccaccgcacgcgccacagctacgccaccaagtccaatcagcaccgcatcgtcaaaacccccggagggaagcttgtttatcagaccacaaagaagagagctagtgggcctaaatgtcctgttactggcaagtgaattcaaggaattcctcacttgaggccgctgagtacaagaggtctagattgccaagaaaccgcaggacggtgaaccgtgcttacggtggagttttgtctggaggtgctgtcagggaaaggatcattcgtgcctttttggtggaagagcaaaagattgtgaagaaggtcctgaagattcagaaggccaaggaaaagcaatcatccaagagctagaatttcagtagagtaaatttggctacggattgatggtagcaaatcttggaatagtattttgaggtgatcgagattgggattttttatattttatcttggctgctatgaaatgtgttctacttcatcttcgtcgacaaatctacttgtgttaaaaattttgttttgttcattcacttgttagctggtcactgaaatttcatgttggaactggatttggatgatctatgtatttgcagattagtggttactgctattatcattaaactagttatctgattgcctcaatatgacatatgctgctccttattcttattcaaaaaagaa

SEQ ID NO: 3221 - DNA, 757 bp, Antirrhinum majus
  misc_feature (18)..(18): n is a, c, g, or t
agtaaaaatggttcagangctaacgtacaggtcgcggcacagttatgccaccaaatcgaatcaacacaggggtcgtcaaaacaccaggaggcaagctagtctaccagaccaccaagaagagggccagtggtcccaaatgccctgttaccggcaagagaattcaaggaatccctcacttgagacctaccgagtacaagaggtctagattatccaggaaccggaggactgtcaatcgtccatatggtggagtattatctggtggtgctgtgagggaaaggatcattagagctttcttggtcgaagaacaaaagattgtgaagaaggttttgaagatacagaaggcaaaggaaaaggttgctgccaagagttaaaatgaagccaggtgctgatatagttttgaatgcaattaccggccgagctgtggaattgtattttgaggtttaaaagcttattacatgtgttttctttggattctttgaagtatgtcttgatgttttccagtttgtcgaaaatactactttgttaggtttcggattctccagtctttgatgggagttaaactcatttttgactgctttaatgtaattttagttttttcatgttttggagtcattttctgttgctataatcgtggagtctctctctatgttgatgtttcggttgtttggttccttttctttatctatattttctttttctgcccctctaactcgtgcctaatgtcaatttacccgtcactgtgccgaataaaatattt

SEQ ID NO: 3222 - DNA, 1474 bp, Zingiber officinale
  misc_feature (339)..(339): n is a, c, g, or t
  misc_feature (966)..(966): n is a, c, g, or t
  misc_feature (1173)..(1173): n is a, c, g, or t
  misc_feature (1176)..(1176): n is a, c, g, or t
  misc_feature (1286)..(1286): n is a, c, g, or t
  misc_feature (1298)..(1298): n is a, c, g, or t
  misc_feature (1360)..(1360): n is a, c, g, or t
  misc_feature (1378)..(1378): n is a, c, g, or t
gcacgaggcctcgtgccgaattcggcacgaggaaaacctactagatttcaggaaatataataattcacttgttcagcatgcagataaacgacaaacaattcaaccaactattgtctttaaagttgccataaagatatagatcgagtgaaaaacaaacaaaattcaaaatgagagtaaagcatttagactcttcaaatgatggcatttcaaatgatggcttagctcttggatgtttgcttttctttagccttctgaatcttcagaactttcttcacgatcttctgctcttcgactaaaaaagcacgaatgatcctttctcttactgcaccaccagataanactccaccataggctcggttaacagtcctcctgtttcgggacagtcgggatctcttgtactgggtaggtctcaagtgaggaatcccttgaatcctcttcccggtaacagggcatttcgggccgctggctctcttatgcgtgtactgatacacgagcttcccccctggggttttgacgacgcgagtctgattagatttggtggcatagctatgcctcttgcggtaggttaacctctgcaccatctcaccgattcttcgactctcactccggcgccgcctcgctaatgtcgcatttatcgttgacgctgatactggaggtggcaatgctcttaatgtccaaaggactgtgagggatataattaactctggcgctgctggtttattcctagaggatcaagtatggcccaagaagtgtggccatatgcagggcaaacaggtgatacctgctgaggagcatgctgctaaaatcgctgctgcaagagaagccattggtgattctgacttttttctcattgctcgtactgatgctcgtggaactgcaggtggcctagccgaagcaattgcacgcgctaatctctacatggaggcaggagctgatgcctgctttgttgaggcaccaaggagtgangacgagatgagagaagtgtgcaagaaaaccagcggtttcagagctgccaacatgcttgaaggtggatacacacccttgcacacaccccaggagctcaaggaaatgggtttccacctcattgtgcactccaccacggctgtctatgcttctgcccgcgcacttattgacgtcctgaaagcactcaaggatgaaggatcaagcagaggncanttccacaagctcaccacattcgaggagttcaacggtttgattggtctcaaagaactcaatgagattggcgctcgctttgagaagttcacagtgcccaaaaactaagagcnctcgatgctgtntatgtcctgagcatctagatcttaaactgctgttgaggtcaagtattgtgttgagcttctcntgttagggtgtgcacttntttacttatcttgtaattatgtggtgtggctgtgttcattctattttgtaataaggatgattgcataatatcgagtatagcttaatctatttccat

SEQ ID NO: 3223 - DNA, 619 bp, Cucurbita pepo
atttttcttatagacgcgtagacacccgaaatcaagggtaattgaagatggttcagcgacttacttaccgtaagcgccacagctacgccaccaaatccaatcagcaccgcgttgtcaagactcccggtggaaagttgatctatcaaaccaccaagaagagggccagcggtcccaaatgtcccgttaccgggaagagaatccaagggattccgcacttgaggcctgctgaatacaagaggtctagactggctaggaaccgaagaactgtaaaccgggcatatggtggagtgttgtcaggaagtgctgtcagagagaggatcatgcgggcttttctggtagaagagcagaagattgtgaaaaaggtattgaaaatccaaaaggcaaaggaaaagttagctgccaagagttcaaaatgagtatttttgcttgaatttgcgaattttagtgttgatagtgattagatgtttctgggttcttccttaaatgggtcattgttgacaaatcaatcccccaagtgtcctgttttgtgatatcaccgtaacctactatgtcacaatttcagaccctttctagagatttttgtatcattacattgctgaatctaataccatcttgcttg

SEQ ID NO: 3224 - DNA, 646 bp, Zingiber officinale
gcacgaggcctcgtgccgaattcggcacgaggtaagctcctgcgaggcgccgacggagtgagatcggaagaagaggcgggatggtgcagagattaacctaccggaagcggcatagctatgccaccaaatcgaaccagacgcgtgtcgtcaaaacaccaggtgggaagctcgtgtaccagtacacacacaagagagctagcggacctaaatgccctgttaccggaaagagaattcaagggattcctcacttgagacccacccagtacaagagatcccggttgtcccgaaaccggaggactgtgaaccgagcatatggtggagtgctttctggaggtgctgttcgtgagaggatcattcgtgcctttttggtcgaagaacagaagattgtaaaaaaagttttgaagatccagaaggcgaaagagaagcaaactacttccaaaagctaagccgagcagtaaaccagtgactctagatgttctactgccattttgaatctagtctttttgttttcactcaaacaatatgtttactacaacttcaaagtctgtaattggttgaattgtttgtgtttacgttcatgattctccatgttcatctagtgacttattttttgtttcctgaaatactacccagcactagtttgttt

SEQ ID NO: 3225 - DNA, 509 bp, Orobanche aegyptiaca
ctctccacttataaccctcagtcttcagccacagctttcttcttcgcctcagccacttataaccccaaaaactcacccaaaaaaataaaaaaataaaaatggtgcagaggctaacatacaggaagcgccatagctacgctaccaaatccaaccagcaccggatcgtcaaaactccgggcgggaagctcgtgtatcagagtacgaagaagagggcaagcggtcctaagtgccctgtaactggcaagagaatccaagggattccacacttgagacctactgagtacaagagatccagattacccagaaaccgaaggactgtgaatcgtccctatggtggagtgttgtctggtggtgccgttagagaaaggatcataagagctttcttggttgaagaacaaaagattgtgaagaaggtcttgaagatgcagaaagcaaaggaaaaagttgctgccgctaagagctaaagcttgtgagtatggtgagataattttgggttcaaaattaattag

SEQ ID NO: 3226 - DNA, 597 bp, Linum usitatissimum
agcagtctcggagaaaacccctacacagagcaagaaaacgtaaagggactgagaacctgcgaagatggttcagcgcctcacttaccgcaagcgccacagctatgccaccaagtcgaaccagcacaggatcgtcaagactcctggtggtaagttggtgtatcagaccactaagaagagggccagtggacctaagtgccccgttactgggaagaggattcaagggattccacatttgagccctgctgagtacaagaggtagagattgccgaggaacaggaggaccgttaaccgtgcttatggtggtgttctttctggtggtgctgttcgtgaaaggatcatccgagctttcctagtcgaagagcagaagttcgtaaagaaggtgttgaagatccagaagtccaaggagaaggtcactaagtaaatgtgatgtgtaactcttgagaaaagatgtgtcgaaacagccagtaatagaaggaatccgtttgattccattagagttggtttctgatttttggattttgtttgtgcttctgtttttatctccgaatgaatgttgaattgttattactcttttgagctttcttttaaaaagttttg

SEQ ID NO: 3227 - DNA, 404 bp, Heritiera littoralis
ggcaaaaaccctagactaagcgaaattgagaccagagcagctccacaatggttcagcggctcacttaccgcacgcgtcacagctacgccaccaaatccaaccagcaccgcgtcgttaaaacccctggagggaagcttgtttatcagaccacaaggaagagagctagtgggcccaaatgtcccgttactggcaagagaattcaagggattcctcatttaaggcctgctgagtacaagagaactagattgccaagaaaccgtaggactgtgaaccgagcttatggtggagttttgtctggaggtgctgctagggaaaggatcattcgtgcattttggtagaagagcaaaagattgtgaagaaggtactgaagattcaaaagacaaaggaaaacaagcatccaagag

SEQ ID NO: 3228 - DNA, 1254 bp, Ipomoea nil
cagcatacattgaggctcacagtgcatatcatggcattggagtggtcaagttgatgggaagaagcagtggattcatagcaatgcatgcatctctagcaagtggacaaattgatgtctgcctcatccccgaggtgcctttcaagctggatggagaaaatggagtgctaaagcatttagaacaccttatagagaccaaaggatcagctgtggtatgtgtagctgaaggagctggacaagatttgatggaaaagtcgaacttgaaagatgcatctgggaatccaattctttcagatgttggtgtccatatccagcatcagatcaagaagcacttcaagaagatcgagcaactagtggatgtcaagtacattgaccctacatacattctccggggctgtcgggcaagcgcctcagatgcaataatgtgcactgttctaggacaaaacgctgtgcatggtgcatttgcgggattcactggaataacggtgggcatatgcaacacgcattacatttacctgccgattccagaagtgattgctgcctcgaggcatgtcgatccaaacagcagaatgtggcaccgctgtctgacttccactggccagcctgatttcagctaatatcgacaaagccaatgctataaaacgaaaaattgttataacaagaatgactgtatgaaataaggttgtttttcacgggaatactttcggattatgagtggtaatcatactcgaaggtcgagtctagaaagtaaacgttcaactaaatgttcacaccgaattctgaacacactaaacatcatgcttcatgacacttttattaatcccttatgattttcagttcttcgaggcttgcttttccttagctttctgaatcttcaaaaccttcttcacaattttttgttcttcaaccaagaaagcgcggatgattctctccctaacggcactgccagaaaggacaccaccgtagggacgattcacagtcctcctcttcctaggcaatctggatctcttgtattcagcaggccttaggtgcgggatcccttgaattcttttcccagaaacaggacatttaggaccactagctctcttcttggtactctggtaaatcagctttccaccgggagttttgatgaccctgtgttggtttgatttggtggcatagctatgccgcttccgatacgtcaatctctgaaccatcttcttcacttcttctctttcagtgctcactgtatcttctactcgtcgctgacggtaaacc

SEQ ID NO: 3229 - DNA, 617 bp, Linum usitatissimum
agcagtctcggagaaaaaccctacacagagcaagaaaaggctaagggattgagagcctgcgaagatggttcagcgcctaacttaccgcaagcgccacagctatgccaccaagtcgaaccagcacaggatcgtcaagactcctggtggtaagttggtgtaccagaccactaagaagagagccagtggacctaagtgccctgttactggaaagaggattcaagggattccgcatttgagacctgctgagtccaagaggtccagattgccgaggaacaggagaaccgttaaccgtgcttatggtggcgttctctctggtggtgctgttcgtgaaaggatcatccgtgctttccttgtcgaagagcagaagatcgtaaagaaggtgttgaagatccagaagtccaaggagaaggtcactaagtagatgtgatgtgtaacttttgagaaaggttgtgtcgaaacacccagtaatagaagtgatccgtttgattccattagagttgcttttctgatttttggattttctttgtgcttctgttttcatctcagaactaatgttgaattcctattactctcttgagctttctcttaaaaagttttgtgccctaagcccaagttcc

SEQ ID NO: 3230 - DNA, 535 bp, Fraxinus spp
gtccgttccaagaaaacaggcaatccagaggaaagatggtgcagcggctgacatacagaaagcggcatagctatgccactaaatccaaccagcatcggatcgtcaaaactcccggtggaaagctagtgtaccagagctcgaagaagagggcaagtggtcccaagtgcccagttactggcaggagaattcaagggattcctcacttgagacctgctgaatacaagaggtctagattatctagaaaccggaggactgtaaaccgagcttatggtggggttttatctggtggtgctgtaagggaaaggatcatcagagcttttttggtagaagagcaaaagattgtgaagaaggttttgaagattcagaaggccaaggaaaggcttgcttccaaggcctgaacttgactatggagcaatggtgtttttgacagtgtattgtgtggttaacttgcttaatatcattattttcttcttattatctgtaaacgggataccttgttttcttcagtttgccgaaatgtcaatttagttaggat

SEQ ID NO: 3231 - DNA, 542 bp, Silene vulgaris
ggaaaaatggtgcaacgtctcacttatcgcaggcgccatagttatgccaccaaatccaatcaacatcgcatcgtcaaaacacctggtggtcgattggtgtaccagactacaaagaagagagcaagcggtccaaaatgccctgtaactggaaagagaattcaagggattcctcacttgaggcctactgagtacaagagaagcagactacccagaaacaggcgtactgtgaaccgtccttatggtggtgttctatctggtggggctgttcgtgaaaggattatccgagcttttttgattgaagagcagaagatagtgaagaaggttttgaagattcagaagaccaaagaaaagcaggctgctaaaagctagactgtcagtgatcttatgccttatcaaacttagttttccagatgaatttttgcttttaatgccggattttctaggaagagtgctttcatagcttgtacttgtgcttattactattgcgaggtactctataattgcttgcagtttgaatgagattttttgttttcgtgcttatt

SEQ ID NO: 3232 - DNA, 516 bp, Tripterygium wilfordii
acggcaacgatggttcagcggctgacgtttcgtacacgccatagctatgccacgaaatccaaccagaaccgggttgtcaaaactcctggtgggaagcttgtgtaccaaagcaccaagaagagagcaagtggtcccaaatgtcctgtcactggaaagagaatccaagggattcctcatctaagacctgctgaatacaagaggtctagactatccaggaataggaggactgtgaaccgttcttacggtggtgtcttgtctggtggtgctgtcagggagaggatcattcgagcctttttggtggaagagcagaagattgtgaagaaggttctgaagattcagaaggccaaagaaaagctatcgtcaaagagctaagatggaaaaagtgaaaagaaatgtgattttgttagttcattgggctgaattaatttttgacttagacatgatagattgtgttctaaattattatgaggtatttattttgaacatgaatgagtaattttcatggattggattttt

SEQ ID NO: 3233 - DNA, 530 bp, Valeriana officinalis
gatggtgcaacgtctaacttaccgcaagcgccatagctatgccaccaaatccaaccagcacaggatcgtcaaaacccctggaggaaagttagtgtaccagggaacgaagaagagagcaagcggaccaaagtgtcctgttactggcaagaggatacaagggattcctcacttaagacctaccgagtacaaaagatcaagattgtctagaaacaggaggaccgtgaatcgtgcttatggcggtgttctatctggtggtgcagttagagagagaatcatccgtgcgtttttggttgaggagcaaaagatcgtcaagaaggttttgaagattcagaaaacaaaagaaaagctgtcgtctaaggcttaatttgcttgaggattagttttttgtgatgaaattttgactacattgtgttatttgtgattgttattgcattttaatgaatttttaccattcttagttattttctttttaccaagcttctgttacactttaagaatttttattcagtaattttgtttggattctctcc

SEQ ID NO: 3234 - DNA, 565 bp, Valeriana officinalis
gatggtgcaacgtctaacttaccgcaagcgccatagctatgccaccaaatccaaccagcacaggatcgtcaaaacccctggaggaaagttagtgtaccagggaacgaagaagagagcaagcggaccaaagtgtcctgtaactggcaagaggatacaagggattcctcacttgagacctaccgagtacaaaagatcaagattgtctagaaacaggaggaccgtgaatcgtgcttatggcggtgttctatctggtggtgcagttagagagagaatcatccgtgcgtttttggttgaggagcaaaagatcgtcaagaaggttttgaagattcagaaaacaaaagaaaagctgtcgtctaaggcttaatttgcttgaggattagttttctgtgatgaaattttgactacattgtgttatttgtgattgttattggattttaatgaattttaccattcttagttattttctttttaccaagcttctgttacactttaagaatttttattcagtaattttgtttggattctctccatcgtccttttttttttatatctttccgaattttac

SEQ ID NO: 3235 - DNA, 529 bp, Vinca minor
cgaagatggtgcagcgtttaacctaccggaaacgccatagctacgccaccaaatcgaaccagcaccggatcgtcaaaacccctggtgggaaattggtatatcaaagcaccaagaaaagggcaagtggtcctaagtgtcctgttactggaaagaggattcaagggatcccacacttgaggccggctgagtataaaaggtctcgattatccagaaacagaagaaccgtcaatcgtccttacggtggtgtattatctggtggcgctgtccgtgagaggatcgtccgagctttcttggttgaagaacaaaagattgtcaagaaggttttgaagatccaaaaggcaaaagaaaagcttgctgcaaaaaactgatgtgaaactttttaacaatcttattccctttgttatttgaaactaaactttgacatttagtgctcaactacatgtcttgtaacagtctttgagctgatttatttttggaattggatgggaattcctttagatatcttcctttatattgataaattaaactg

SEQ ID NO: 3236 - DNA, 630 bp, Musa acuminata
ttgctgggtttcgctcgccttcacctcaccttgagagaaaaggcggcggagagggatcgtgaggcgagatggtgcagcgattaacctacaggaaaaggcacagctatgccaccaagtcgaatcagactagggtcgtcaaaaccccaggtgggaggcttgtgtatcagtacacgaacaagcgagctagtgggccgaaatgccctgtgactggcaagaggatccaagggattcctcacctaagaccagctgagtataagagatctagattgtcccgaaaccagaggactgtgaaccgtgcttatggtggggtgttatctggaagcgccgtcagggaaaggatcattcgggcattcttggtcgaagaacagaagattgtcaaaaaggttttgaagacccagaaggccaaagagaagcaagcctcaaagagctaaggcatgaaagcaggcttcaaatatttaagagttttgttttatcttgaaaattttgttccgattcattaagtgctattgctctgtccaatagaattttggtaatatggtctgttccattgtttgcgcacttatggttgtacttcatgcttgaaccagttaactttttcttgaatttataatcagtagtattttacgatac

SEQ ID NO: 3237 - DNA, 493 bp, Ocimum basilicum
gcacgaggcaaaaaccttgaagtagcgaaaatggtgcagcggctgacatacagaacgcgacacagctacgcaaccaaatccaataagcaccgtatcgtcaaaactccaggaggtaagctggtgtatcagacaacgaagaagcgtgcaagtggaccgaaatgccctgttactgggaagagaattcaagggattcctcacctgagacctgctgagtacaagaggtctagattacccagaaatgagaggaccgtcaaccgcccatatggtggagtgctatccggtactgccgtgagagaaaggatcattcgagctttcttggtggaagagcaaaagatcgtgaagaaggtgttgaagatacagaaagccaaagaaaagcttgcatcaaggagctagatgctttgtttcttttgtgagccatttagttgagaaattttggatttgttttgagagattttaaagcctgtttgtcccttatttctctggaatcttgaaa

SEQ ID NO: 3238 - DNA, 646 bp, Beta vulgaris
ccaggaagagagagaaagagaaagacaggggtgagacttagaccttcattcgctcaaaaatggtgcaacgtctcacctaccgtagacggcatagctatgccaccaaatccaaccaacaccgcatcgtcaaaacccctggtgggcggcttgtttatcagaccacaaagaagagagcaagtgggcccaaatgccctgttactggaaagaggattcaagggattcctcatttgaggcccactgagtacaagagaagcagattacccaggaacaggcgtactgtgaatcgtccatatggaggcgttctatctggcagtgctgttcgtgaaagaatcatccgagctttcttggtcgaagagcagaagattgtgaagaaggtgttgaagattcagaaaacaaaagaaaagcagtcttcaaagagctagagtggcagtgtaatgatgcttttttgttggtcctagttttccaagaggaaattttgttttttaagaggagatgatgacttaggaagaatcctgtttacagtccgtacttgtgtctattactactatgaggtgattgcattttgaatgagcatttttgttttcctgttgacggccgtttttttaaatggattgaccatatgaatttatatagtaaaaaaaaaaaa

SEQ ID NO: 3239 - DNA, 779 bp, Pennisetum glaucum
gccacgctttgagagaggaagaagcgcgcgcggagagcggaagcccgggagaaggcggctgccgtcgtcggcaagatggtgcagcggctcacgtaccggaagcggcacagctacgccaccaagtccaaccagacccgcgtcgtcaagacccctggcgggaagcttgtgtaccagtacaccaagaagcgcgcgagtgggccgaagtgccctgtcaccgggaagaagatccaaggaattccacacctcagacctgctgagtacaagaggtccaggttgccaaggaaccggaggactgtgaaccgtccttatggtggtgttctgtctggtactgcagttagggagaggatcattcgggcatttttggtcgaggagcagaagattgtgaagaaggtgttgaagatccaaaagaccaaggacaaggcctccaagagctagacgcagttgccaataggcacctgcttccccatgctttaattctctttcgaatttgtttcagtatgaaaattttctcgtggtaatcctggttctagtgttagtgtcagatggatgtgagtgaattgaattctgagcgaatcctttaagttttggaacttaagttcggtgggatatttttcgcttggctgaggatgtcagatattatgtcagatattatgcccttgtttgttccatccctgtctaattaaccctgtatggctttgttttgagttttccctcagcttaactttgcccgtccttatggtggtgttctgtctggtactgccgttagggagaggatcatt

SEQ ID NO: 3240 - DNA, 597 bp, Tropaeolum majus
attcggccattacggccggggcttttcgtcggctgagaaagaaatcccgataagtgagaaacgagcgagtaaaggacttgaaaaatggtgcagcgccttacataccgcacccggcacagctatgccacaaaatcgaatcagcaccgaatcgtcaaaacccctggtggtaaattggtgtatcagaccacaaaaaagagagcaagtggccctaagtgccctgttaccggcaagcgtattcaggggattccccatttgagaccaactgaatataaacgatcaagacttccaagaaaccgtaggactgtcaaccgtgcttatggtggagttttatcagctggtgctgttagggagaggatcattcgagcttttcttgttgaagagcaaaagattgtcaagaaggtcttgaagcttcagaagacaaaggagaagcaatcctctaagaattaagttcaacttcatctgttgttttttagttgttggaagtaattttgcttttaagttgatgttagtgaaattatgaaagattgatttctacagtcacttcataactttgtcgacaatccatgtttctactttgtttgatcttgtgtttgattc

SEQ ID NO: 3241 - DNA, 628 bp, Tropaeolum majus
ttacggccggggatagaggaagccttcaaccctcgcgtgaaaagtggagaaaaaccctaggagaggaagagcgagcgcgagagggagagaaaaaggagatcgaagatggtgcagaggctaacctatcgcacgaggcacagttatgcaacaaagtcgaaccagcaccgtatcgtcaagacccctggaggtaagctagtgtaccagaccaccaagaagagagcaagtggccccaaatgtcctgttactgggaagcgtattcaagggatcccccacttgagaccaacagaatataagaggtctaggttgcccagaaaccgaagaacggttaaccgtgcctatggtggtgttctatccggtagtgcggtcagagaaaggatcatccgagcttttcttgttgaagagcaaaagattgtgaagaaggtcctgaaacttcaaaaggcaaaggagaaggtctccaagaactaaatttgaagaatttgtttcgaaaggcctggggattttccttgttattgctgatcttaaatgcagttatgggtgagtaatagattattattttttatcggattattgtaatttctactgctactttaactttgtcgacaattcaagctgcttcagttttgttgtt

SEQ ID NO: 3242 - DNA, 668 bp, Ananas comosus
agctttacattacacagagaaagagagcttcgcgaagaagcagaagcgaaaatggtgcagcgactaacgtatcgaaagaggcatagctacgccaccaaatccaaccaaactagggttgttaaaacccctggtggtaggcttgtgtaccaatacacgaataagagggcgagcggacctaaatgcccggtgacgggcaagagaattcaaggaattcctcacttaaggccagctgagtacaagaggtcgagattatccaggaaccggaggaccgtgaaccgcgcctacggtggagttctatctggaggtgcagttagagaaagaattattcgagcatttttgattgaagagcaaaagatcgtgaagaaggttttgaagatccaaaaagccaaagacaaacaagctcctaagagctaggagacccaagccacaaaagtaaacggcgatgctcgagttttatacactcggtgtaatgtttaacttgatgcttaagtgtagttcaactgttaaagtgtggagagttaaccgtcgcgttgagtgagttattcggtataattagttttcagtaactattgtttgagatttgtgaaagtttgacattcacaatcagtatttggttgtattttgaattttgagttggttaaacagtttcaaattccgcttaatttggt

SEQ ID NO: 3243 - DNA, 455 bp, Tamarix hispida
gggatactagtaaaatcggagaaaatggtgcagcgtctcacatatcgcacaaggcacagctatgccaccaaatccaaccaacacagaatcgttaaaacccccggtgggaaattggtttaccagacaaccaagaagagagccagcggtcccaagtgccctgttactggcaagagaatccaagggatccctcacctgagacccgctgagtacagaaggactaggctgcccagaaaccggagaactgtaaaccgtgcctatggtggtgtgttgtccggatctgctgttcgcgagaggatcattcgtgcatttttggtggaggagcaaaagattgttaaaaaggtgctgaagatccagaaggcaaaagaaaagctagctgctaggagttgaagtacgaggccgggtgctttcaaacttaacgttctgtttcatctcaaccaaaattcgttgaacggtga

SEQ ID NO: 3244 - DNA, 667 bp, Malus domestica
gttgcagtcgatcgcactgacagagagagaggcagccgagctaaacgagcattccaaaaatggtgcagcggctcacgtaccggaagcgtcacagctacgccaccaagtccaaccagcaccgcatcgtcaaaactcccggggggaaattgatctatcagaccaccaagaagagagccagcggtcccaaatgccctgttaccggcaagagaatccaagggattcctcacttgagacctgctgagtacaagaggtctagattatctaggaaccgcaggactgtgaaccgggcctatggtggtgtattgtctggaggtgcagttagggagaggatcattcgagctttcttggtcgaagagcaaaagatcgtgaagaaggttttgaagattcaaaaggctaaggaaaggcaggcggagaaaggagccaaacattgatagtcgtttgaatgaattataagaaatgagcgagattttgtcgttaggttttgttgattgatgaatttggatctgagatttgggatgcttttattgttatgtgttgctcgtctactcggttaatttcgtttcaatgataactaattccctgtttcttcctttgtgataatcttgttcgtttatctttatctttttactggtaaatggcaatgcttcagtttgtttttcagtgcaaa

SEQ ID NO: 3245 - DNA, 673 bp, Malus domestica
cgaattccgttgcggtcggtcgatcgcactgacagagagagaggcagccgagctaaacgagcattccaaaaatggtgcagcggctcacgtaccggaagcgtcacagctacgccaccaagtccaaccagcaccgcatcgtcaaaactcccggggggaaattgatctatcagaccaccaagaagagagccagcggtcccaaatgccctgttaccggcaagagaatccaagggattcctcacttgagacctgctgagtacaagaggtctagattatctaggaaccgcaggactgtgaaccgggcctatggtggtgtattgtctggaggtgcagttagggagaggatcattcgagctttcttggtcgaagagcaaaagatcgtgaagaaggttttgaagattcaaaaggctaaggaaaggcaggcggagaaaggagccaaacattgatagtcgtttgaatgaattataagaaatgagcgagattttgtcgttaggttttgttgattgatgaatttggatctgagatttgggatgcttttattgttatgtgttgctcgtctactcggttaatttcgtttcaatgataactaattccctgtttcttcctttgtgataatcttgttcgtttatcttatctttttactggcaaatggcaatgcttcagtttgtttttcagt

SEQ ID NO: 3246 - DNA, 784 bp, Chelidonium majus
aaaagagtgagggagagagagagagagaaagctcgagagttcgggaaaaatggtgcagaggttaacctaccgatcccggcacagctatgccaccaaatccaaccagacgagggtcgtcaaaacccctggtggaaagttggtttaccagaggactaagaagagagctagtggtcctaagtgccctgtcactggaaagagaatccaagggattccacacttgagacctactgagtacaaaaggtctaggttgtctaggaaccggaggactgttaaccgtgcttatggtggtgtattgtctggtagcgcagtcagggagagaatcatccgtgcctttttggtggaggaacagaaaattgtcaagaaggtgttgaagatacaaaagacaaaggagaagcaagctgccacaaagagctagatgaagagagaaagcaaaagcttttgagttttagtgttatagctcagaagaaattttgacttgagaatctgagattgatgaatcatgacaaaattatggtatcatgtgttagtttgttcttcatttgaaatatcttgttttccagttcgttttagactgttattagtagtagtatttcttgattgcctttgatgacaaatcgtaattagggcttctgttccaaattatttgctggttgatgacactttcagatttatcttttagtcttttaattatcagattagcaaattatgattgtatgttattttttcactctttaaatcttgattatcaattcaagaggcactggtcttacctgcctagaggcga

SEQ ID NO: 3247 - DNA, 691 bp, Malus domestica
agacttagggacagctgaaactcgatagcaaaaatggtgcagcgtctcacatatcgcgcccggcacagctacgccaccaaatccaaccagcacaggatcgtcaaaacccctggagggaagctagtgtaccagaccactaagaagagggcaagtggccccaagtgccctgttactggcaagagaattcaagggatccctcacttgaggcctaccgagtataagaggtccagattatctaggaatcggaggactgttaaccgtgcttatggaggtgtgttgtctggaggtgcagtcaaggaaaggatcatcagggcctttctggtggaggaacaaaagatcgtgaaaaaggtgttgaagattcaaaagacaaaggaaaagcaagctgcaaagaccaagtgaaatcaaccgaattttaagtagtttctacagactacgttgattttggcttatggtgcgggaagtaattcaaggtgttccaatctgtacttttacattttgttgtggatggtttaagttatgatgttgagtgcttcattttgttcggaaatccatcccaccatggaatttcctgttttgtattggtaacatgtacgtttttgaattatttgtgtaatgtcagatttactagcttcatttgcgattttagttatatttggattacttcataaccctttcctttttttgattgctt

SEQ ID NO: 3248 - DNA, 652 bp, Malus domestica
agctgaaactcgatagcaaaaatggtgcagcgtctcacatatcgcgcccggcacagctacgccaccaaatccaaccagcacaggatcgtcaaaacccctggagggaagctagtgtaccagaccactaagaagagggcaagtggccccaagtgccctgttactggcaagagaattcaagggatccctcacttgaggcctaccgagtataagaggtccagattatctaggaatcggaggactgttaaccgtgcttatggaggtgtgttgtctggaggtgcagtcaaggaaaggatcatcagggcctttctggtggaggaacaaaagatcgtgaaaaaggtgttgaagattcaaaagacaaaggaaaagcaagctgcaaagaccaagtgaaatcaaccgaattttaagtagtttctacagactacgttgattttggcttatggtgcgggaagtaattcaaggtgttccaatctgtacttttacattttgttgtggatggtttaagttatgatgttgagtgcttcattttgttcggaaatccatcccaccatggaatttcctgttttgtattggtaacatgtacgtttttgaattatttgtgtaatgtcagatttactagcttcatttgcgattttagttatatttggattacttc

SEQ ID NO: 3249 - DNA, 573 bp, Camellia sinensis
ggggctttagcttcagtccacaaagaaagccggaagagatcgaagatggtgcaacgtctcacgtatcgcaaacgccatagctatgccaccaaatcaaaccagcacaggatcgtcaaaaccccaggtgggaagctagtgtatcagagcaccaagaagagggcaagtggtcccaaatgccctgttactgggaagagaatccaagggattcctcacttgagacctgctgaatacaagagatccagattatctagaaaccggaggactgtgaaccgtgcttatggtggagtattgtctggcggtgctgtgagggaaaggatcatcagagcctttttagtggaagagcaaaagattgtgaagaaggttttgaagattcagaagtccaaagaaaaacaagccgcaagagctaaactttgaaaagtattgaattttcaactgcatcgagagaattttgaatacagccgatgactaggaatcaggaaaatgtaatgtgaggtgttatgaattaggtttagtatcttcttgggctgctactactattggtgattttgtcgacaaatccattgtgctactgtg

SEQ ID NO: 3250 - DNA, 389 bp, Orobanche aegyptiaca
taggtgcagaggctaacatacaggaagcgccatagctacgctaccaaatccaaccagcaccggatcgtcaaaactccgggtgggaagctcgtgtaccagagtacgaagaagagggcaagcggtcctaagtgccctgtaactggcaagagaatccaagggattcctcatttgagacctaccgagtacaagagatccagattacccagaaatcgaaggactgtgaatcgtccctatggtggagtgctgtctggtggtgccgttagagaaaggatcataagagctttcttggttgaagaacaaaagattgtgaagaaggtcttgaagatgcagaaagcaaaggaaaaagttgctgccgctaagagctaaagcttgtgagtatggtgagatta

SEQ ID NO: 3251 - DNA, 1865 bp, Cannabis sativa
acacagaacccaaaacacgccagaaaagttaagaatcaacagggccgcaaacccacaaaaaggctataaaaaaataggcataattgaactcgaaccaagaaaccccagaaacgggacctgctcttcccagtaagcgtaattctcgataacttcatagtcaaggctctcgacactgttcacatcgctctttgcgatgccaagagcgtcggtttccccttcctccgcgttcggaagtctagaccacgccagcttggctgtctccatcccattctgcaaatgattcgacaacatcccgaattctaatagaaaacccctcacaaaaatcctcaatcaatccaccgaaactctaaaaggaatcggcgaagctcgggacttcttccagcacaaaatggaaaccgttggcgatacggaagttggtccgtacagcatctgatccgcaaaatattaatctcggaaatggcgaaatcaagaatcagaatccgaattggatcccgaaatacgctcctaaactggtccgatttgagtatcaaacatcaaagagcttaagctctgagctctgtcactgtaatgaatcaataaatgatgagaagactcacaaaaaagtccctcctctgaaagcagaggaattggggctattatcaaatgcgggcagactcacagttgttgagtcctctcaattgaaagtcagatcgtgatctttttccaatccaattttgaagagcgtgttggtctcgggagataggcccattacaatagcccaaacataagcccaatccaaaagcccaataacacaaattactgtatcatcaaattagggtttcatcttatttctcatacattacagagtggagactgaagacaaacttctttctgtctcttcttctctttcggagctcaagagtttttaccaagtaatcgaaaatggtgcagcgtctcacttatcgctcgcggcacagctacgcaaccaaatcgaaccagcaccgaatcgtcaaaaccccaggtgggaagttggtctaccagaccaccaagaagagagctagtggcccaaaatgtcctattactggcaagagaattcaagggatccctcacctgagaccaactgaatacaagcgctctagattgtcgaggaaccgtaggactgtgaaccgtgcctatggtggcgttctttctggaagtgctgttagggagaggatcattcgtgctttcttggtggaagagcaaaagattgtgaagaaggttttgaagattcaaaaggcaaaggaaaaattggcagctaaatgagtgatataatgttattgagcgaaattttgacttccttttaagtctcaagtattcaatatggaacaaaatgtttaaatggttttactgtattctgtttgctacctcagttagttgagtactcttgttagtgcgaatttgcagacaatcaatcttttgaaacatggtatttctagtagtttgatttccaagtttattaatctatagtttgtcaaattcttaacgatctggtatcagtgtcactatatttgtcactttagatttgcattttgcaactatggttttttgaagtcttttgatggtttctctttcacaaatcacaaaattacccttgcagtttgttgtttcactatatttggtattttgcaccttttgtatgctgatctacgtattttgtgagcaagttttctttagtgcatgtttggtttgagggagtgaaggttgtagtggaatcaaaagttgcattccattgttgtctttgaatcttttgtaatgcttttcattgcaattaatgttacactacttaatatacaaatgttgtatccatgtaatgtaatgagctttacattattgtattgaaagtaaaa

SEQ ID NO: 3252 - DNA, 868 bp, Cannabis sativa
acatgtaactctctctctctcatctcaaatctcaaatatatatgcggaactagggtttacactcatcttctccaagaaccctactttcttacagtcagcggcgccaagaggaacaaactgttttagagttcgttcccaagcaatcaaaaatggtgcagcgtctcacttatcgttctcgacacagctacgccaccaaatcgaaccagcaccgaatcgtcaaaaccccaggagggaagttggtttaccagaccaccaagaagagagctagcggcccaaaatgccctattactggcaagagaattcaggggattcctcacttgagacccactgaatacaagcgctctagattgtcaaggaaccgtaggactgttaaccgtgcctatggtggtgttctttctggaagtgctgttagggagaggatcattcgtgctttcttggtggaagaacaaaagattgtgaagaaggttttgaagattcaaaaggctaaggaaaagttggcagctaaataagtgacattatgttgctaagagtgaaattttgacttccttttaagtcgactattcaatattggaacaaaatgtttaaatggttttactactgtattctgtttgctacttaagttagtgcaaaatttgcagacaatcaatcttttgaaacatggtatttgtagtagtttgatttgatttccaagttatagtttgttaaattcttactgatttggttttgcttcggttttcggttctacgtctttgttgctatgtttttgtttgatatttcatcaagcttaatgtttttaaatctgcctactcaaaccttacatcccaaaagtttggaaaataccaatgagtagacctttcaaaataagcaa

SEQ ID NO: 3253 - DNA, 561 bp, Chelidonium majus
ttctccttcacattttgagtggagcggcgaagaaaaacctagagcaggagacagagatcgaagaagaatggttcagagactcacttaccggtcacggcatagctatgccaccaaatccaaccagaatagggtcgtgaaaactcctggtggaaagcttgtctaccagcgcactaagaagagagccagcggaccaaagtgccctgttactggaaagagaatccaagggattccacacttgagacctactgagtacaagaggtccagattgtctagaaacaggaggactgtaaaccgtgcatatggtggtgtcttgtctggaagcgcagtcagggaaaggattatccgagctttcttggttgaggaacaaaaaatcgtgaagaaggtcttgaaaattcagaagaccaaggagaagatagctgcaaagagctaaatgtttgaaacacaactactattaaactttattccggtcgaaagaaattttgacttaattagatgatgatgatgattcatgacaggaatattgggtgagctaagtgtgttctgcatgtgaaagagtatgtt

SEQ ID NO: 3254 - DNA, 738 bp, Fagopyrum esculentum
ggcctccattcttccgcgagagacagacgcaggaggagcttcgtcgattgttcaaaaatggtgcaacgtctcacttaccgtaaacgtcatagctatgctaccaaatctaaccagcatagaatagttaaaacccctggtggaaagcttgtctatcagacgactaagaagagagctagcggacctaaatgtcccgttactggaaagagaattcaagggattcctcatttgagacctactgagtacaagagatccagattagcaaggaataggcgcactgtcaaccgcccttatggcggtgtgttgtctggtagtgctgtccgtgaaaggatcatcagggcctttttgattgaggagcaaaagattgtgaagaaagttttgaagattcagaaggccaaggacaagcagtcttccaaggcctaaatccttaaaaaatgattgtgaacttactgtttctaccccttccggtttcatcatatgaaagttttgccttttagtagtgattgcagttcaaatgacattgttcttgactatatctgtgcaaaagattgtggtttctactgctttttgaattttcatcagcagtttgggtacttgctttacatattgctgatatatatcatcaaaccatgttgacatactagttttcttttgtcactgctttgtttctgtgttgaagtagtattttagggttgtaggcttactgaattgataataaccataatatgagctgtgttcagt

SEQ ID NO: 3255 - DNA, 588 bp, Fagopyrum esculentum
cgtcttccagttcaaccctgcgcttgcttgagagaggagcttaatcggtcgtacgaaaatggtgcagcgtcttacctaccgaaagcgccacagctatgccaccaaatccaaccagcacaggattgtgaaaacccctggtggaaagcttgtgtaccagaccaccaagaagagagccagtggacctaagtgccccgttactggaaagagaattcaagggattcctcacttgagacctactgaatacaagaggtctaggttggccaggaacaggcgaacagtcaaccgtccttatggtggtgtgctttccggcagtgctgttcgtgaaaggatcattagggcctttttgatagaagagcagaagattgtgaagaaggttttgaagatccagaagacaaaagaaaagcaagctgcaaagaactagatacccgaaatgtcttgtaatttgcattgccttgcccattttctgccatcctagagttttgtttgatttttgtttggaagatacaagaatgacttcggtaatggttaatgtttgttgcacgttactagtgtgctaaggtgattgtttcttttttcaatgagcatttt

SEQ ID NO: 3256 - DNA, 630 bp, Fagopyrum esculentum
gcgcttgctagagagaggagcttaatcggtggtacgaaaatggtgcagcgtcttacctaccgaaagcgtcacagctatgccaccaaatccaaccaacacaggattgtgaaaactcctggtggaaagcttgtgtaccagaccaccaagaagagagccagtggacctaagtgccccgttaccggaaagagaattcaagggattcctcacttgaggccaaccgaatacaagaggtctaggttagccaggaacaggcgaacagtcaaccgtccttatggtggtgtgctgtccggcagtgctgttcgtgaaaggatcatcagggcctttttgatagaagagcagaagattgtgaagaaagttttgaagatccagaagacaaaagaaaagcaagctgcaaagaactagatgcctgaaatggcttgtaatttgcatcacctcacccattttctgccatcttagattcgagttttgtttgatttttgtttggaagatacaagaatgacttcagtaatggttaatgttcggtgcacgttactagtgtgctaagattgattgtttcttatttcaatgagcatttttcttttggaatttaagtgctgggttttgtttattgaacctcaatagtcaatattg

SEQ ID NO: 3257 - DNA, 631 bp, Linum usitatissimum
agcagtctcggagaaaacccctacacagagcaagaaaacgtaaagggactgagaacctgcgaagatggttcagcgcctcacttaccgcaagcgccacagctatgcccccaagtcgaaccagcacaggatcgtcaagactcctggtggtaagttggtgtatcagacccctaagaagagggccagtggacctaagtgccctgttactgggaagaggattcaagggattccccatttgagacctgctgagtacaagaggtcgagattgccgaggaacaggaggaccgttaaccgtgcttatggtggtgttctctctggtggtgctgttcgtgaaaggatcatccgagctttcctagtcgaagagcagaagatcgtaaagaaggtgttgaagatccagaagtccaaggagaaggtccctaagtaaatgtgatgtgtaactcttgagaaaagatgtgtcgaaacagcccgtaatagaaggaatccgtttgattacattagagttggtttctgatttttggattttgtttgtgcttctgtttttatctccgaatgaatgttgaattgttattactcttttgagctttcgtttaaaaagttttgtgccctaagctcaagttcccccctggtgttctat

SEQ ID NO: 3258 - DNA, 520 bp, Fraxinus spp
ggaaaatggttcaacggctgacgtacagggaacggcatagctatgccaccaaatccaaccagcatcggatcatcaaaacccctggagggaagttagtgtaccagagcactaagaagagagctagtggccctaaatgccctgttactggcaagagaatccaagggatacctcacttgagacctgctgagtacaagaggtctagattgtccagaaatcggaggactgtgaaccgtgcatatggtggagtgttgtccggcagtgctgtaagggaaagaattattagagctttcttggttgaagagcaaaagattgtgaagaaggttttgaagatacaaaagaccaaggaaaagctggctaccaagagctgaggtctgatatagttttggtcctttttgatacaactagttgaggaatcactgaaatgtactttgaggttttcaagctagatatctgtattttcatggtattcttggaaatgtgacattcatctgcattgttctactatatgttgggagctttt

SEQ ID NO: 3259 - DNA, 608 bp, Phalaenopsis aphrodite
aagaggcggagcttgaggggaacggcaaagtgaaagatggtgcagcgtctcacctacagaaagcggcatagctatgccacaaagtctaatcaaaccagggttgtcaaaaccccaggcggaaagcttgtttatcaatacacaaagaagagggcgagtgggccaaaatgtcccgtgactggaaaaagaattatcgggattcctcgactgaggccagctgaatacaagagatcaagattacagcggaatcgaagaacagttcaccgagcttatggcggcgttctatctggtggagctgtccgcgaaaggatcatccgagcctttctggtagaggagcagaagattgttaagaaggttctgaagattcagaaagccaaagacaaactggctgcaaagagctgatcagttgatatgttggagccacccattggaaagacctttctagttttattttataatgaagagaattttgactacataatcattattgtcatttgtatgtgtctgttttaaatgtgcctggattgaattttattttgaattcttctttttatattgttttctgtagaacttggtggaagacattttgttcattttcaaatgttattcag

SEQ ID NO: 3260 - DNA, 757 bp, Primula obconica
tgcagcggctaacatacagaggaaggcatagctatgccaccaaatactaaccagcatcgcattgtaccaaaacccctggtgggaagcttgtgtatcagacgactaagaagagagcaagtggtccaaagtgccctgtcacaggaaagaggatccaagggattcctcatttgagacccactgaatataagaggtccagattgtctagaaacaggaggactgtaaaccgtgcgtatggtggggttttgtctggaggtgctgtaagggaaaggatcattagagcctttctagtggaagagcaaaaaatagtgaagaaggttctgaaaatccagaaggcaaaagaaaaggttgctggcaagagctgatcatagttatcttgaaatttatcgaaagaaaattttggagccttatcgatggataggtatcagggaaatgtactatgttatctttggattttgtgttttctatttgtacttgtttcttgaatttgctgtcaattcgaatgagctatctcatgtttgtttcaaattatggatctgttcctcttgtggttctggctattgttattttaaagttataaatgtttcttgtccccatcgtgtgtggaataggccatatggttgtgacatttttagtggtctacttctgaatcttttagtttgcgcatttggaataacagtcttgtattcgagttctgtttccctgtactggactacgggtctgaacttttaagatgaattgatttattttgtctaataaa

SEQ ID NO: 3261 - DNA, 765 bp, Sarracenia psittacina
cggtgaagcggctgggaaaatggtgcaacgcctcacctaccgcaaacggcatggctatgccaccaaatctaaccagcacaggatcgtcaaaacccccggtgggaggttagtgtatcagagcaccatgaaaagggcaagtggtcccaaatgccctgtcactgggaagagaatccaagggattcctcacttgaggcctgcggaatacaagagatctagattatctagaaaccagaggacagtgaatcgcgcgtatggtggggtcttgtctgggggtactgttagggaaaggatcattagagcctttttggtggaagagcaaaagattgtgaagaaagttttgaagattcagaaggctaaagaaaagcaagctggcaagagctgagctttaggaaagtatactgaatcttaaaccgcactaaaaaagaacttttgcatatgaccgaatacggaatcgtggagatgcatcctgaggtgatcatggttttgtatcttattattgggctgttttgaactattattttttttgtaacttgttggttttgttgacaaattaccggtggtagtctttttcccctattttgcaattgatgttgttgacttgggattcggatgattgcaggtttgttatttttatagatagattggattttgttacatgatttccagttttcgtttagtgcttttaactcatggctgtgtacgaatattgctgtcgtattcttgcacatgttattgagaaaactacatgcacaaaaatcgtattga

SEQ ID NO: 3262 - DNA, 533 bp, Utricularia gibba
tttctcctctttccgctgccgacctcttagccggcaaaaaatggtgcagcggctgacgtatagaacgcggcatagctatgctactaaatccaaccagcatcggattgttaagactcctggagggaagctcgtgtatcaaaccactaagaagagggccagcggacccaagtgccctgtaactggaaagaggattcaggggattcctcacttaaggccaacagagtacagcaagtccagattgtcccggaatagaagaaccgtaagccgtgcttatggtggagtattatccggtggtgctgtgagagaaaggattatcagagcattcttgattgaagagcagaagattgtgaagaaagtattgaagattcagaaggcaaaggagaaacttgcttccaagagctgaagctggagaatggaaacataagtcaacttggcaagttttggaagtttgtttatgagctttgagtgaacctggtttcttattcttgactgtagcacgatttgaaattctgttctatgaactaaagcgagtc

SEQ ID NO: 3263 - DNA, 668 bp, Valeriana officinalis
aaaggctaacataccgcaaacggcatagctatgctaccaaatccaaccagaacagagtcgtcaaaacccctggtgggaagcttgtttatcagactactaagaagagggctagcggacctaaatgtcccgttactggaaagagaatccaagggattccgcatttgagacctgccgaatacaagaggtccagattgtctaggaaccgtaggacagtcaaccgtgcttatggtggtgttttgtctggcagcgccgtcagggaaaggattatccgagctttcttggtcgaggaacagaagattgtgaagaaagttctcaagatccaaaagaccaaggaaaaagctgctggaaagagttagagctgaaatgtaaaagcaaatgctttttttgggaagtgttttgaagaaattttggctttcgaatgatgatgatattactgtatggttaaagattgtaacgtttgattgccgattgaacttcttttcctttttgttttgaaatactttgaagctatgaatctagtttaaggtttgtttgtgaagcatcttagttttatgcatacatccagtttgtcgacatgatttgattttggtagctgttttgttgatacatttatctactatcatttgagcattattaccgtttgttcgattattgctatttgattattc

SEQ ID NO: 3264 - DNA, 640 bp, Artemisia annua
tatcaacgcagtactccgacgggggtagcttcttgagcctcctccagttgatatcatatcacagccgtcgtacggaaagaaggaaggaagaaatggtgcagcgattgacatacaggaagaggcacagctatgccaccaaatccaaccaacaccgggttctcaaaacccctggtggtaagctagtgtatcagactaccaagaagagggctagtggacctaaatgccctgttactggcaagagaatccaagggattcctcacttgagacctactgagtacaagaggtccagattatccaggaacaggagaactgttaaccgtgcttatggtggtgtactttctgctggtgccgtaagggaaaggatcattagggccttcttggttgaagaacaaaagatcgtgaagaaagtgttgaagattcaaaagcaaaaggaaaagacctcagcaaagaattagaattctagtacttctgcaccctcgtgagagtaattttggttgttaagattttgaatctgtaatcgggatgtttttatgttatggtacttctactttgtcaacaatcaaacatggttcgactttattagttatttttccgtttgatgtttcctgaattctgtctgaatttgtttgatgttctatgc

SEQ ID NO: 3265 - DNA, 668 bp, Musa acuminata
agccagggaggagagaggagggtggaggaagaggtgggaaggcgagatggtgcaaagattgacgtaccggaagaggcatggctatgccaccaaatcgaatcagacgagggtcgtcaaaaccccaggtgggaggcttgtgtatcaatacgcgaacaagagggcgagcgggccgaaatgccctgtgaccggcaagaggatccaaggaatacctcatctaagacctgctcagtacaagagatccaggttgtccagaaaccggaggactgtgaaccgcgcttatggtggtgtgttatctggtagtgctgttagagaaaggattattcgtgcatttctagttgaagagcagaagattgtaaagaaggttctgaagatccaaaaggctaaagaaaaacaagcttcaaagagctagacaaggctgaagataacatgaatgctttgggttatatttacccaggagaaatttttgacatgataatggttatggtggaagcttggttatattactggatttcaggggctgatcttatatttctgtggatttgtttagcacaagttcttgagacatcaaacccctctttttgtccatgattatttgctgtgcttgagccatatttacatactcgtattactcagcaatatcgtgtgagaaatcaaatgtcttgctttgt

SEQ ID NO: 3266 - DNA, 710 bp, Cleome gynandra
ttgggtgaagaaggaaccctagacgaagacaaataagagcagcgaaaatggtgcaacggctcgtttaccggtcgcggcacagctatgccactaaatcgaaccagcaccgcgttgtcaaaaccccaggagggaagctggtatatcaaaccacgaagaagagagctagtggcccgaaatgccctgttaccggcaagcggattcagggtattcctcacctgaggccagttgaatacaagaggtccagattgtctagaaacagaaggactgtaaaccgtgcatatggtggagtcttgtctggttctgctgtcagggaaaggatcataagggctttccttgttgaagagcaaaagattgtgaagaaggtgttgaagctccaaaaggccaaggagaagctatctgccaagagttaagttaagccattctgttatctccaaatagattgtgtttttatggttgtgttctaatgataggactgcttcaattatcaaagaacttgatgtatccattcgatttttatgctttttactctgtcgacgattcacttttacttcagttttgttttcgtttaaattgctggagtttccatttgatttagagattatgttgtgagatccgttgaatgtgttgagggacaagatctattcagttcttctggttctgtcttgtctctgttgtagttgtcaattatttggttaatatgttctaaagta

SEQ ID NO: 3267 - DNA, 623 bp, Cleome gynandra
tcgggggtatagggaaagaagaaaccctagactaaagaagacgaagatcatcgaaaatggtgcagcggcttgtttaccggtcgcgccatagctatgccactaaatctaaccagcatcgcatcgtcaaaaccccaggagggaaattagtatatcaaaccacgaagaagagagctagtggtccgaaatgtcctgtcacaggcaagcgaattcagggtatccctcatttaaggcctgttgaatacaagagatcaagattatctagaaacagaagaacagttaaccgtgcatacggtggagttttgtctggttccgctgttagagaaaggatcattcgtgctttccttgttgaagagcaaaagatagtgaagaaagttttgaagcttcaaaaggctaaggaaaagttagctggaaaaagttaagtaattctattaccttaaatagtttgtctctttatggtaatgttattttaatgctttgaattgcaatttgggtctggtcttgtcgacaatttactctacttgcagttttgttttttgtccaaattgttaagttttttgttcattgttgaattataagttgtgattgttgattaattaggttcatatattcactaatttataaac

SEQ ID NO: 3268 - DNA, 644 bp, Cleome spinosa
ccctttgtttctctctctgcttcgccgccggtgccagtaagaaccctaaaagaggaaattcaggaattcggaggaaatggtgcagagacttacgtatcgtggaaggcatagctatgccacaaagtcgaaccagcaccgtgttgtcaaaactcctggaggaaagctggtttaccagactacgaagaagagagcaagtggacccaagtgccctgtcaccggcaagaggattcaagggattccgcatatgagacctgctgaatacaagaggtctagattgtcaagaaaccggagaacagtgaaccgtccttacggtggagtattatctggttctgctgtcagggaaaggatcatccgagccttcctggtggaggagcagaagattgtgaagaaggttttgaaacttcaaaaagccaaggagaagctttcagcaaagagctgaataatcatacactgaatgttgtttagtctattaagggtttcaggatttgcagtccatgtttggttttctgctttagtgtgtaatcttctgtggctagtctgaattttgttctttcttacccacctttggagacatattgcatataaaattttaggatatttattatttgaattttggatttcaacttcaagtattcttttcattt

SEQ ID NO: 3269 - DNA, 722 bp, Eschscholzia californica
cggaaatacgtttttagtgagagagaaggaagaagaagaagaagagagagaaaatggtccagagactaacataccgttcaaggcatagctatgccaccaaatccaaccagacaagggtcgtcaaaacccctggtgggaagttggtttaccagaggactaagaagagagcaagtggacctaagtgccctgtaactgggaagagaatccaagggattcctcacttgagacctgctgaatacaagaggtctagattatctaggaaccgaagaactgtgaaccgtgcttatggtggagtattgtctggtagcgcagtcagggaaaggatcatccgagctttcttggttgaggaacaaaaaatcgtgaagaaggttttgaagattcagaaggccaaggagaaaaccaccaaggcctagacttacagagaaagcaaaaaaagcttttgagttagttgctcaaaagaatttttgactttgagagattgatgaatcaattatcaatggtgtttcctattttaagagtactctatattttggacctcatgttttcagttggttttggatcgtgttctcactagtagtagtactatttcttgttcgactttgacgacaaatccataattagtccttttttcccctcacgatgtgttccttatcgactcttttgaacatcttagaatggtatttgaatgttagcttagcaaagtatgatcacttcagatttac

SEQ ID NO: 3270 - DNA, 700 bp, Actinidia deliciosa
gagactcacatatcgcaaacggcacagttacgccaccaaatcgaaccagaacagggtcgtcaaaacccctggagggaggttggtgtatcagagcaccaagaagagagccagtggacccaaatgtcccgttactgggaagagaatccaagggattcctcacttgagacctactgaatacaagaggtctagattgtctaggaaccgcagaaccgtgaaccgtgcttatggtggtgtattgtccggaggtgctgtcagggagaggatcatccgagccttcttggttgaagagcaaaagattgtgaagaaggttctgaagatccagaaggcaaaggagaaagcctcaaagagctagaaatcaaatcactcacgagggagcgagaaagtaagggatttttcagattatataacgattagaagttcgaacatgaagaaatattgaaaagattatgtttaggtggcctcaaaatctgaaagaatgtcttttacttcagttttcccaagagttgtcgggaactcgttcactttgtcgacaaatctatctctaggggtcttggtttttgtaatcttcttgctttgacaacgagttcgatatttgatcttgcatttcaattttgttccataactgggttttgttccttctttactttagcggatttagtgcttatttttacataatttctatttgtcttaaaaaaaaaaa

SEQ ID NO: 3271 - DNA, 582 bp, Nicotiana benthamiana
  misc_feature (400)..(400): n is a, c, g, or t
  misc_feature (406)..(406): n is a, c, g, or t
  misc_feature (546)..(546): n is a, c, g, or t
  misc_feature (548)..(548): n is a, c, g, or t
  misc_feature (554)..(554): n is a, c, g, or t
  misc_feature (574)..(574): n is a, c, g, or t
gcacgagggagagccagagaaagcgagagagaggttctcaagatggtgcagcgactcacctaccggaagcgccacagctatgccaccaaatccaaccagcaccgtgtcgtcaaaacccctggtgggaagttgatttaccagagtaccaagaagcgggctagtggtcctaagtgtcctgtaactggaaagaggattcaggggattccacacttgcgaccaactgagtataagagatccagattatctaggaacaggaggactgtaaaccgtccctatggtggagtattgtctggaagtgcagtaagggagaggattattcgagctttcttggtggaagagcagaaaattgtgaagaaggttttgaagattcaaaaagccaaagaaaagctggcggccaaangttaanctaaaagtttagagggactttgttttaagttttggtgaaattttgacattcaagtgtttactagttgtgcactacaaattgacctgattgctgcaattttgaggagcttttacgttagttgattatatcagacttcattntnccattnctatataaattgagttttcnaaaaaaaa

SEQ ID NO: 3272 - DNA, 879 bp, Fragaria vesca
agccgtataaagcctcctctttcacccaaaaccctaatcgagagggagagagtcgactgcgaagatggttcagcgtctcgtgtatcgctcgcgtcacagctacgccaccaagtccaaccagcacaggatcgtcaaaacccctggagggaagctagtgtaccagaccactaagaagagggcaagtggacccaagtgtcctgttacaggcaagaggattcaagggatccctcatttgaggcctgctgaatacaagaggtctagattgtctaggaatcggaggactgtcaatcgtgcttatggaggagtattgtctggagctgctgtcaaggagaggatcatccgtgcctttttggtcgaagaacaaaagattgtgaaaaaggttttgaagattcagaaggctaaggaaaagctagctgccaagcactgattgaatgaagagtctagtgagtttcaagtagcttctagagtgattttggctgatagtgcgcgatggaaagtagttggaggtgttccaatttctttttctgtgttttggtactaccattttatgttataatgtcgagtacattttctttgagaatccactgcctttaatttgcttgttgtctgtcggtggtatgatatacgttccaatttgttgtgtaatgacagatgagtagcctttcatggaagtattatgtgttggtttagttatccttgggtttcaaatccctctgtttcctcaacttgcacaaagcaactagctggtaatcagtttgcgtgttttgtaaggaagatttaaaaatgccattgtttagaatgtccctggaacaataatgatcataacgttctgcaattttaattcccttaatgtaatgaaggaaaataacattggtgatc

SEQ ID NO: 3273 - DNA, 634 bp, Zinnia violacea
taccagccacagcaaaaccagtaaccaccaccttctcagcaaaatggtgcaacggctcacataccgtaacacgtcacagttactccaccaaatcaaaccaacatcgggttgttaaaaccccaggtggtaagttggtttatcagactactaaaaagagagcaagtggacctaaatgccctgttactggcaagaggattcaagggattcctcatttcgacgacctgctgaatacaagcggtcgagcattatcgaggaacagaagtaactgttaaccgtgcttatggtggcgtcctttctgcaggcgccgtgagggaaaggatcatcagggcttttttggttgaagaacaaaagattgtgaaaaaggtgttgaagatccaaaaggcaaaagaaaagactgcatctaaggcttagatttctatcagtttctcatgagagggtaattataggttttcaagattttaaatctttatgttcgagttctctactttgtcgacaaacaaacatggatattgtcttagttttagtttggtgttcaatgaatttctgaacatctgtttggattctttatgttaacccgttttctttgaactcgtgtttcttaaacacgcattgtatgtcacggccttgttatgta

SEQ ID NO: 3274 - DNA, 752 bp, Malus domestica
ctcttgttgcactccatcgcagttacagagagagaggggcagccgagctaaaccagcactccaaaaatggtgcagcggctcacgtaccggaagcgacacagctacgccaccaagtccaaccagcaccgcatcgtcaaaacccccggtgggaaattgatctatcagaccaccaagaagagagccagcggccccaaatgccctgttactggcaagagaatccaagggattcctcacttgagaccggctgagtacaagaggtctagactatctaggaaccgcaggactgtgaaccgtgcctatggtggtgtattgtctggaggtgctgttaaggagaggatcattcgagctttcttggtggaagagcagaaaattgtgaagaaggttttgaagatccaaaaggccaaggaaaggcaggcggagaaaggagctaggagctaaacgaggcgagaatcgatagtcttttgatcgaagtacaagaaatggttgagcgagattttgtcgttaggttttgttgatcgatgaatttggatcgtagattggaatgcttttattgttatgtgctactcggttactcggttaatttcgtttcaatgacaaaccagttgcctgtttcgtatgtgataatcttgttcgttgatcgtcatcctctctagaaagctctagcttttcgattttgttgtttattttgcgcatgataattttgtaagtgtaattaaaaggatggaagcaatcacatggaaggattcatagaa

SEQ ID NO: 3275 - DNA, 601 bp, Malus domestica
tccatcgcagttacagagagagaggggcagccgagctaaaccagcactccaaaaatggtgcagcggctcacgtaccggaagcgacacagctacgccaccaagtccaaccagcaccgcatcgtcaaaacccccggtgggaaattgatctatcagaccaccaagaagagagccagcggccccaaatgccctgttactggcaagagaatccaagggattcctcacttgagaccggctgagtacaagaggtctagactatctaggaaccgcaggactgtgaaccgtgcctatggtggtgtattgtctggaggtgctgttaaggagaggatcattcgagctttcttggtggaagagcagaaaattgtgaagaaggttttgaagatccaaaaggccaaggaaaggcaggcggagaaaggagctaggagctaaacgaggcgagaatcgatagtcttttgatcgaagtacaagaaatggttgagcgagattttgtcgttaggttttgttgatcgatgaatttggatcgtagattggaatgcttttattgttatgtgctactcggttactcggttaatttcgtttcaatgacaaaccagttgcctgtttc

SEQ ID NO: 3276 - DNA, 578 bp, Fagopyrum esculentum
cttagacgactaggtagctattccgatcgtccgaagatggtgcaacgtctcacataccgtaaacgccacagctatgccaccaaatctaaccaacacaggattgtcaaaacccctggtggaaagcttgtgtaccagaccacaaagaagagggccagtggacccaaatgccccgtcaccggaaagagaattcaaggaattcctcacttgaggcctactgagtacaagaggtcaagattggccaggaacaggcgcacagtcaatcgtccttatggcggtgtgctctctggtagtgctgtccgtgaaaggatcattagagctttcttgattgaagagcaaaagattgtgaagaaggttctgaagatccagaaggctaaagataagcaatctgccaaggcttaggcgacatcttgaccatcttttgctttttaaatttattaaatgctttctatgaagttttggttcattggagttgtagggaaacatgttttagtatgttgtttacaggctttgacagttgtttctttgatgggtctagatactgttatggacctaattgtttgtcctttcaatgagcaatt

SEQ ID NO: 3277 - DNA, 688 bp, Fagopyrum esculentum
tagacgactaggtagctattccgatcgtccgaagatggtgcaacgtctcacataccgtaaacgccacagctatgccaccaaatctaaccaacacaggattgtcaaaactcctggtggaaagcttgtctaccagaccacaaagaagagggccagtggacccaaatgccccgtaaccggaaagagaattcaaggaattcctcacttgaggcctactgagtacaagaggtcgagattggccaggaacaggcgtacagtcaaccgtccttatggcggtgtgctctctggtagtgctgtccgtgaaaggatcattagagctttcttgattgaagagcaaaagattgtgaagaaggttctgaagatccagaaggctaaagataagcaatctgccaaggcttagacaacatcgagactgtcttttgcttttctaaattcattaagtgctttttatgaagttttggttcattggagtttagggaaacgtgttttagtatgttgtttacaggctttgacaattgtttctttaatggatttagatactattatggagctgattgtttgtcctttcaatgagcaatcatctttttggcttgattgatgtcttatgaatagcgccaatgagttattgtctggcttagaaattttactagacttctcactgaagctgatggtggcaaatagcttttcatct

SEQ ID NO: 3278 - DNA, 691 bp, Fagopyrum esculentum
tttcgaccttctttcttccgcgagagacagacgcaggaggagcttcgtcgattgttcgaaaatggttcaacgtctcacttaccgcaaacgtcatagctatgctaccaagtctaaccagcataggatagtaaaaacccctggtggaaagcttgtctatcagacgactaagaagagagctagcggacctaaatgtccagttactggaaagagaattcaagggattcctcatttgagaccaactgaatacaagagatccagattagcaagaaataggcgcacagtcaaccgtccttatggcggcgtgttgtctggtagtgctgtccgtgaaaggatcattagggcctttttgatcgaggagcagaagattgtgaagaaggttttgaagattcagaaggccaaggacaagcagtctgccaaggcctaaatctttaaaaatgattgtgaacttaccgtttcaaccctttttggtttcatgatatgaaagttttgccttttagtagtgattgcaattcaaatgacattgttgtagacgatatttgtgcaaaagtttgtggctgctactgctcttgaattttcatcggtaggtttgttgcttgcgttacatattgctgatatatatatcatccaactatggagacggtacaattttaattgtctggatcttttgtccaattcatgctatacttcaatg

SEQ ID NO: 3279 - DNA, 680 bp, Phalaenopsis aphrodite
agcgaccagcggaggaagacgtcgaaatggtgcagcgtttaacctaccggaagcggcatagctatgcgacaaaatcaaaccagactagggttgtgaaaactccaggtggcaggcttatttaccaatacactaagaaaagggcgagtggtccaaaatgccctgtcaccggcaagaggattataggtattccccggctaagacctgctgagtacaaaagatctaggttgtctagaaataggagaactgtccaccgtgcatatggaggggttttatctggcggtgctgtcagggaaaggattattcgtgcgtttcttgttgaagaacagaagattgttaaaaaggttctgaagatgcagaaggccaaggaaaagcaagctgcgaagagttgattagtagaagcaaaatgaagagttttgtaactaaagttaaattttggcatttatggttagcgcttgtctggtattcttggtgagatgaccgttttcagtattgaaatttgtttccgagagcagttgtggacagttaattaggaaaaatgtggtgaaatatggtgtatttgttctttgttactctgcccttgttttgttttgactatcataactggattgataagtttatgatttggaaatatttgaaacattcttattgatgtattcttgagaacttgtgttataggcctt

SEQ ID NO: 3280 - DNA, 542 bp, Silene vulgaris
acattttcacaattctaatcaatttgggaaaaatggtgcaacgtctcacataccgcaggagccatagttatgccaccaaatccaaccaacaccgtatcgtcaaaacacctggtggtcgtttggtgtaccagaccacaaagaagagagcaagtggtcctaagtgccctgtcaccggaaagaggatccaaggaattccacacttgaggccaacagaatataagagaagtagattacctaggaacaggcgtactgtgaatcgcccatatggtggtgtactatctggtggggccgttcgtgagaggattattcgcgctttcttgatagaagagcagaagattgtgaagaaggttttgaagattcagaagaccaaagaaaagcaggcttccagaacctagactgtccgtgttttggttagttttgtttgttaaacccagatttgtaggaagaacactttaccggttggtagtttggtacacttgtccgtattactacctcgacactgtgaggtgattgtctggagtttcaatgagcatttttgttta

SEQ ID NO: 3281 - DNA, 758 bp, Eutrema parvulum
gtgggaaggccctttatatagataatctaggttataaagcctctgctctgctccgtcaagctgaggaggataaaaccctaaaggagaaaagaggagggttgtgagcaggcaaagaagcgaaaaaatggtgcagcgtcttgtttaccgttcgcgtcacagttacgccaccaaatcgaaccagcacaggatcgtcaaaaccccaggtggtaaattgacctatcagaccactaagaagcgtgcaagtggaccgaaatgccccgttaccggcaagcgtattcagggtatccctcacttgaggcctgctgagtacaagagatctcgattatccagaaacaggaggaccgtgaaccgtgcttatggtggtgttctttccgctttggctgttagagaaagaatcatccgtgctttccttgttgaggagcaaaagattgtgaagaaggtcttgaagctccaaaaggctaaggaaaaggttgctcccaagagctagatcctattagctttttttctttttctaaaatgttttatggctctgttctagcaatagtactggttgcagagtttgagagaaacattgtgtactcgtccaaattcttaagctttttgtattcgttttgggtcttgactctgtcgacatttcgcaaatcgtgggttttgttttctcgtttaaatgctgcgtttacatttcacgtttctactcttaccaacaatcttctttgttggatattaacattgtcattcctaatactctgttaataaat

SEQ ID NO: 3282 - DNA, 578 bp, Arabidopsis lyrata
atattcttcgttccaaacgaaaaccctaaaagagaaaaggaggcgaaaatggtgcagcgtcttgtttaccggtcgcgacacagctacgccaccaaatctaaccagcaccgtatcgtcaagactccaggaggtaaattggtgtatcaaaccacaaagaagagagctagtggccccaaatgtcctgttactggcaagcgaattcaaggaatccctcacttgaggccctctgaatacaagaggtcaagattatcaagaaacaggagaactgtaaaccgagcatacggtggagtcttgtctggttctgcagtcagggaaaggattattcgggcattccttgttgaagagcaaaagattgtgaagaaagtgttgaaactccaaaaggccaaggagaaagtagcccccaaggcttaagctttttatgttttcatcttctctgttttgggattatggctatgttcaagtgataggacttggtgcagtcatgtgagaacatctttgttactcatccaatttttaagctttgtattgtgttttcggttcttaactttgtctacatttctcttctcttcagttttggt

SEQ ID NO: 3283 - DNA, 608 bp, Arabidopsis lyrata
tctctgctccgtcaagctgaggataaaaccctagggtgagtgagagagagagaagcgaaaatggtgcagcgtcttgtttaccgatcacgacacagttacgccaccaaatcaaaccagcaccggatcgtcaaaactccaggaggtaaattgacgtatcagaccactaagaagagagctagtggacctaaatgtcccgttaccggcaagcgtattcagggtatccctcacttgaggccatctgagtacaagaggtctcgtttatcaagaaacaggaggactgtgaaccgtgcttatggtggggttttgtctggttctgctgttagggaaagaatcattcgtgctttccttgtggaggagcaaaagattgtgaagaaggttttgaagcttcaaaaggcaaaggaaaaggttgctcccaagagctagaccctattagtttttatgttttatggctctgttctagcgatagtactggttgcagagaaaaaacattgtgtactcatcaaaaattttaagcttttttgtattggtttcggatctttggctctgtcgacaattcgttttcgattttggtttcttgttcatgttgagttcacaacttcaatttttca

SEQ ID NO: 3284 - DNA, 677 bp, Arabidopsis thaliana
atattcttcgttccaaacgaaaaccctaaaagagaaaaggaggcgaaaatggtgcagcgtcttgtttaccggtcgcgacacagctacgccaccaaatcgaaccagcaccgtatcgtcaagactccaggaggtaaattggtgtatcaaaccacaaagaagagagctagtggccccaaatgtcctgttactggcaagcgtattcaaggaatccctcacttgaggccctctgagtacaagaggtcaagattatcaagaaacaggaggactgtaaaccgagcatacggtggagtcttgtctggttctgcagtcagggaaaggatcattcgggcattccttgtcgaagagcaaaagattgtgaagaaagtgttgaaactccaaaaggctaaggagaaagtagcccccaaggcttaagcttttatgttttattcttctctgttttggaattatggctatgttcaagtgataggacttggtgcagtcatgtgaggacatctatgttactcgaccaatttttaagctttgtattctgttatcagttcttaactttgtcgacaattctcttctcttcagttttggaattgttgaattcatctttaatgttctattgttgatgcatatcacataagctgttgtgattaccttcttggttaatataatatttctgaatctctcggagg

SEQ ID NO: 3285 - DNA, 543 bp, Musa acuminata
gggggggttctgcttcgcctacggcttcagagaagaggcggtggagcgcgatcgtgaggcgggatggtgcaacgcttgacctacaggaaacggcacggctacgccaccaagtcgaatcagactagggtggtcaaaaccccaggtgggaagcttgtttaccagtacacgaacaagagagcgagcgggccgatttgccctgtgactggcaagagaatccaagggatacctcacttaagacctgctgagtacaagaggtctagattggccagaagccagaggactgtgaatcgtgcttatggtggcgtgctagctggaggtgctgtgaaggaaaggattattcgagcctttttagttgaagagcagaagattgtgaagaaggttttgaagatccagaaggccaaagagaagcaagcctcaaagagttaaggcatgataccggtgcgtaagggtgatgtggtgatgttccatattactattggtctgttcatcagaattgttggaactgtctgttccttttgtctgcttagatatggatgtactctg

SEQ ID NO: 3286 - DNA, 358 bp, Bruguiera gymnorhiza
gtgccccagaaacagctaaaagaagaaaatggttcagcgactcacataccgtaaacggcacagctacgccaccaagtccaaccagcaccgcgtcgtcaagacccccggtgggaaattggtgtatcagaccacgaagaagagggcaagtgggcccaagtgtcctgtcactgggaagaggattcaagggattcctcatttgagacctgcagaatacaagaggtctagattgcctaggaaccgcaggactgtaaatcgtgcctatggtggcgtgttgtcaggaggtgctgttagggagaggatcatccgggccttcttagttgaggaacaaaagattgtgaagaaggttttgaagattcag

SEQ ID NO: 3287 - DNA, 434 bp, Eschscholzia californica
cttcttcagtgagggaagaaaaaaaccagagagagagaaaatggtgcagagattgacttatcgttcaaggcatagctatgctaccaaatccaaccaaactagggttgtcaaaacccctggtggaaagttggtttaccagaggaccaagaagagagcaagtggtcctaagtgtcctgttacagggaaaagaatccaagggattcctcacttgagacccgctgaatacaagagatctagattgtcaaggaaccgtagaactgtgaaccgtgcttatggtggggtattgtctggaagcgctgttagagaaaggatcatccgtgctttcttggtggaagaacaaaaaattgtgaaaaaggtattgaagatccagaaatctaaggagaaaacatcaacaaaggcttaagatcaaaaaagatttcgagttgtagttgctc

SEQ ID NO: 3288 - DNA, 659 bp, Setaria italica
ccacgcttgagagaggaagagcgcgcgcggagagcggaagcccgggagaaggcggcggccggcggcaagatggtgcagcggctcacgtaccggaagcggcacagctacgccaccaagtccaaccagacccgcgtcgtcaagacccctggtgggaggcttgtgtaccagtacaccaagaagcgcgcgagtgggccgaagtgcccggtcaccgggaagaagatccaaggaattccacacctcagacctgctgagtacaagaggtccaggttgtcaaggaaccggaggactgtgaaccgtccgtatggtggtgttctgtctggtactgcagttagggagaggatcattcgggcatttttggttgaggagcagaagatcgtgaagaaggtgttgaaaatccaaaagaccaaggacaaggcctccaagagctagtcacaattgcaataggcatttgccaccatgtttaattctcttcgaatttgtttcagtatgaaattttctcgtggtttctggaaatcctggttctagtgctagtatcagatcgatgtgagtgattgaattttgagcgaatccttttaacttttggaacttaagatcggtggaatgtttttcgcttggctatgaggatgtcatatattttgcccttgttcatgtgatcccgg

SEQ ID NO: 3289 - DNA, 878 bp, Setaria italica
ccaaattcggcccaaccaatattcatctcgagcgagcctggtaatcggcggaacggatctgaccgtccgctcaccgaccagatcgcatatccgccgtcagatttaggtcacccggcacaccggccatcctataaaacgtctcctccataccctctcactcccctccccgccgccacgcttgagagaggaagagcgcgcgcggagagcggaagcccgggagaaggcggcggccggcggcaagatggtgcagcggctcacgtaccggaagcggcacagctacgccaccaagtccaaccagacccgcgtcgtcaagacccctggtgggaggcttgtgtaccagtacaccaagaagcgcgcgagtgggccgaagtgcccggtcaccgggaagaagatccaaggaattccacacctcagacctgctgagtacaagaggtccaggttgtcaaggaaccggaggactgtgaaccgtccgtatggtggtgttctgtctggtactgcagttagggagaggatcattcgggcatttttggttgaggagcagaagatcgtgaagaaggtgttgaaaatccaaaagaccaaggacaaggcctccaagagctagtcacaattgcaataggcatttgccaccatgtttaattctcttcgaatttgtttcagtatgaaattttctcgtggtttctggaaatcctggttctagtgctagtatcagatcgatgtgagtgattgaattttgagcgaatccttttaacttttggaacttaagatcggtggaatgtttttcgcttggctatgaggatgtcatatattttgcccttgttcatgtgatcccggtctatttaaccccgtcatacataactgtgaatatgttttgagttttc

SEQ ID NO: 3290 - DNA, 638 bp, Lolium multiflorum
ggctcgcccagggttttagccgccgccgccaccgccgccgccgccggacccctcgcagagagaagcgcgcgacagcgacgccgacgccatggtgcagcgcctgacgtaccggaagcgccacagctacgcgaccaagtccaaccagaccagggtcgtcaagaccccaggagggaagctcgtgtaccagtacaccaagaagagagccagcgggccgaaatgcccggtcaccggcaagaatatccaggggattcctcaccttaggcccactgagtacaaaagatccagattatccaggaacaggagaactgtgaatcgtccttatggtggtgttctatctggtccagctgttagggagaggatcatccgcgctttccttgtcgaagagcaaaagatcgtgaagaaggttctgaagatccagaagaccaaggagaagcaaccatcgaagtgaaatggctgaggccctttatactcatgagattttttggaggacacttggtgacaagtgctgagtcaagcctgctcagtatgctaagctggtggttttctgaattgaacaagatttcagtccattttcttgttttgatggtggatctggatattgttacccaatgctattactttgtgtttgacctgagtac

SEQ ID NO: 3291 - DNA, 788 bp, Zea mays
ccaaattcagaccatccatatcagatgaaggtgctggtaatctcaagtcacagatcggaccgcccattctcttggaaaatcatctcccgccgtcagatctaggtcacccggcagccatcctataaaacctctccatctctcctccttacttccgtccccgccgccacgccagagaggagaggaagagcgcgcggagagtgagagcccgggagaagcagcggctgggagcaagatggtgcagcgcctcacctaccggaagcggcacagctacgccaccaaatcgaaccagacccgcgtcgtcaagacacctggtgggaaacttgtgtaccagtacaccaagaagcgcgcgagcggaccgaagtgcccagtcaccgggaagaagatccaaggaattccacacctgagacctgctgagtacaagaggtccaggttggcaaggaaccaaaggactgtgaatcgtccatatggtggtgttctgtctggtactgcagttagggagaggatcatccgtgcctttttggtcgaggaacagaagatagtgaagaaggtgttgaagatccaaaagaccaaggataaggcctccaagagctagacgatataggccacaatgtttgagtccattcgaatttatttcagcaggaaaatttctcgcgggtatggggaatcttggtacttatgctagtagtatgtgagatgggtgtggtttaaattttgagcgtaagttgagttctgttaacttgttaagttcggtggaatgttttaaactatgtggatgtcagattttgtta

SEQ ID NO: 3292 - DNA, 793 bp, Pennisetum glaucum
gccatccatttatacccctatcgccgccgccgcgcaggcctcttctcctcttttcccaccccctccttaccacacgccgcaccccaagcctcctcactagggttttatcggcggcggcggcggcggcggcgagatggtgcagcgtctcacctaccggaagcgtcacagctacgcgaccaagtctaaccagacccgggtcgtcaagaccccaggtggcaagcttgtttaccagtacaccaagaagagggcgagcgggcccaagtgccccgtcaccgggaagaagatccaggggattccccacttgaggcctgctgagtacaagaggtccaggttgcctaggaaccgcaggactgtgaaccgtccttacggtggagtgctctctggaactgctgttagggagaggatcatccgtgctttcttggtcgaggagcagaagattgtcaagaaggtcctgaaaatacagaaaaccaaggacaaggcagccacaaagtagagctcctgaaatggaagcattgcgctgttttgtacactgtgagaagtcttttttggtggatggaaaatcttgttgccttctgtgttaaatgtttagcatgtgagagacatacctatcaagtttagagtgtctggctcttcacttttcattgtcggaataccgggacaactgttcccctagttgctttgttacaaattcagatcttatttggggtaccatcagcttgtcgaattcaccttgttgtagcaatctttatcgtccatgacgtgttgctctcctgttctatgccttaaccgttta

SEQ ID NO: 3293 - DNA, 615 bp, Nuphar advena
  misc_feature (141)..(141): n is a, c, g, or t
  misc_feature (372)..(372): n is a, c, g, or t
  misc_feature (404)..(404): n is a, c, g, or t
  misc_feature (421)..(421): n is a, c, g, or t
aaagagagggagatggttcagcggctcacctaccggaaacggcacagttatgccaccaaatccaaccagacgagggtcgtcaagactcctggggggaagcttgtttaccaaacttcaaaaaagagggccaagggaccccgntgtcccgtgactaagaagaggatacaagggattccgcacttgagaccaactgaatacaagaggtctagattatcaaggaaccggaggactgtcaacagagcttatggtggggttttgtctggcagtgctgtcagagaaagaatcatccgggctttcttggttgaagagcagaagatcgttaagaaggtcttgaagatccagaaagccaaggaaaaacaggctgcaaagagntaggagaagaaaagctttgagtttcccaccangaaaattttgatctgangatgacgaagggcttggcaaatggtgaatttgagagtgaatttgtttagaagaaataggtagagacatgtttcagctatcccagtttgacgacaaaccatgtcttttaccatttgttgctatttcagttatactcttttaaggcacattgctccattgctactgttgggtatttctaaatataaacataaagag

SEQ ID NO: 3294 - DNA, 700 bp, Elaeis guineensis
tcgtatccgaccaagcagactctctctgctagttctgggttctagcctcctctttcgaagaagggtgaggagcgaagggagtctgagatggtgcagcgattaacgtatcgaaagaggcatagctatgccactaaatcgaatcaaactagggttgtcaaaaccccaggtggcaagcttgtgtatcagtacactaataagagggcaagtgggccgagatgccctgtgacaggcaagagaatccaagggattcctcaccgaagacctgccgaatacaggaggtctagattgtctagaaaccggagaaccgtgaaccgtgcttatggtggggttttatctggaagtgctgtcagggaaaggatcattcgagcttttttggtggaagaacagaagattgttaagaaagttttgaagatccagaaggtcaaagaaaagcaagcctttaagagctaaaacaggagagtagcagcaaaacgcttaagttttgattaatcagcagaaaattttgactagcacgatgatgattatgaggagtttggcataaagtgtggtgagataattgtttaatttacagggccatggatttgttgtagatgttcagggatgtcagtcccttcttggacgtatttttgacttatttgttattagcactggatcatttgttgaattgtcagttggtaatactcgttgctgtgttttttag

SEQ ID NO: 3295 - DNA, 657 bp, Carica papaya
gcctcctccacagacgcagggaagggtgagagagagagatcggcaaaatggtccagcgtctcacataccgcacgcgtcacggctacgctacaaaatccaatcagcatcgtgtcgtcaagacccctggtgggaggcttgtgtaccagagcacaaagaagagagccagtggacccaagtgtcctgtaactgggaaaagaatccaggggattcctcatttgagacctgcggaatacaagaggtctagactacctagaaataggagaaccgtgaaccgtgcctatggtggagtattatctggaggagctgtcagggaaaggattatccgagcttttctggtggaagagcagaagattgtgaagaaagttttgaagctccggaagacaaaagaaaaggagacatcaaagtgagagagaaactcttatatcttagctttaggttgaatgaaattttgacttttagaattttattatgaattgtggttgatgttattcttgtgaggttgtttaacaatgctcgggcatttgttttatgttatgctacttttacttcgactggtagtttaattactgtttttttgatattgtttaacaccttgtggttatctccccaatgagaatggatccccctacctagagaaccctctccggagggaatcaa

SEQ ID NO: 3296 - DNA, 706 bp, Oryza sativa
tctctaccatttcctcctcctcctcctcctcctcctctagggtttatccatcggcgactacgcggcggcggcggcggcggcgacggcgagatggtgcagcgcctgacgtaccgcaaaaggcacagctatgccacgaagtctaatcagacgcgggtcgtcaagactccaggtggcaagctcgtgtaccagtacaccaagaagagggcgagcgggcccaagtgccccgtgaccgggaagaagatccagggaattccccatctcaggcctgctgagtacaagagatccaggttgtctaggaaccgcagaactgtgaaccgtccctatggtggagtgctctctggaactgcagttagggaaaggatcattcgtgctttcttggttgaagagcagaagattgtgaagaaagtcttgaaaatacagaaaaccaaggacaagtcagcctcaaagtagacaactcttggaagtggaagcaaggcgatgtgctataaacaaggaaaacatttttgttgatggtgatgatcaatggtctagcctcttctagctgaatgttttagtataactgtctgagtttggagtacttgaaatccgtctaccattgtgatgcacttgatgtcaaatgttgctgagacatatttgatccgctcttttgttcacttctctgaattgcgaatgaattttacttacttgagctggtgttttgtttcta

SEQ ID NO: 3297 - DNA, 877 bp, Sorghum bicolor
aaattcagaccatccacacagattgaaaggtgctggtaatcccccgagtcacagatcggaccgtccattcgcttggcaaatcatctcccgccgtcagatctaggtcggccggcccatcagccatcctataaaacctctcctccatctctcctcctcacccccttccacgccgccacgccagagaggaagagcgcgcggagagccagagcccgggagaagcggcggccggcggcaagatggtgcagcggctcacctaccggaagcggcatagctacgccaccaaatccaaccagacccgcgtcgtcaagacccctggcgggaggcttgtgtaccagtacaccaagaagcgcgcgagcggaccgaagtgccccgtcaccgggaagaagatccaaggaattccacacctgagacctgctgagtacaagaggtccaggttgtcaaggaaccgcaggactgtgaaccgtccatatggtggtgttctgtctggtactgcagttagagagaggatcatccgtgcctttttggtcgaggagcagaagatcgtgaagaaggtgttgaagatccaaaagaccaaggacaaggcctccaagagctagacactattgcaatataggcatttaccacaatgtttaagtcaaattcgaatttgtttcggcaagaaattttctcgtgggtttggggaatcctggtacttatgctagtatgtgagatggatgtggttgtttaaattttgagcgtaagttgcagatcctttttaagttttgtaactcaagttcggtggaatgttttttcacttggctatgtggatgtcagatattttgttaatgttgcttgcccagttgctccagttttcgccgtcaaatcgacctcttagcac

SEQ ID NO: 3298 - DNA, 859 bp, Sorghum bicolor
aaattcagaccatccacacagattgaaaggtgctggtaatcccccgagtcacagatcggaccgtccattcgcttggcaaatcatctcccgccgtcagatctaggtcggccggcccatcagccatcctataaaacctctcctccatctctcctcctcacccccttccacgccgccacgccagagaggaagagcgcgcggagagccagagcccgggagaagcggcggccggcggcaagatggtgcagcggctcacctaccggaagcggcatagctacgccaccaaatccaaccagacccgcgtcgtcaagacccctggcgggaggcttgtgtaccagtacaccaagaagcgcgcgagcggaccgaagtgccccgtcaccgggaagaagatccaaggaattccacacctgagacctgctgagtacaagaggtccaggttgtcaaggaaccgcaggactgtgaaccgtccatatggtggtgttctgtctggtactgcagttagagagaggatcatccgtgcctttttggtcgaggagcagaagatcgtgaagaaggtgttgaagatccaaaagaccaaggacaaggcctccaagagctagacactattgcaatataggcatttaccacaatgtttaagtcaaattcgaatttgtttcggcaagaaattttctcgtgggtttggggaatcctggtacttatgctagtatgtgagatggatgtggttgtttaaattttgagcgtaagttgcagatcctttttaagttttgtaactcaagttcggtggaatgttttttcacttggctatgtggatgtcagatattttgttaatgttgcttgcccagttgctccagttttcgccgtc

SEQ ID NO: 3299 - DNA, 750 bp, Panicum virgatum
ggcttctcttttcccgcggcctttctcctccagcctcccaccaaggtttatccaccggcggcgtgcgcggcggcgacgagatggtgcagcgtctgacctaccggaagcggcacagctatgccaccaagtccaaccagacgcgggtcgtcaagaccccaggtggcaagctcgtgtaccagtacaccaagaagagagccagcgggcccaagtgccccgtcaccgggaagaagatccaggggattccccacctcaggcctgctgagtacaagaggtccaggttgtctaggaaccgcagaactgtgaaccgtccctatggtggagtgctctctggaactgcagttagagaaaggatcatccgtgccttcctggtcgaagagcagaagattgtgaagaaggtgttgaaaatacagaagaccaaagacaagactgcctcaaagtaactctgaaatggaactgagctcctgttctgtaaacaatgggagatatttttgtcaatggtgaattggtgatgatcgatgtcttagtctcttctagctaagtgttctagtgtgtcgtggtgctgtttctaggattcttgaaatcctgtctaccattgtgatgttgaaggttatgagacaacaatgatccctctgttgcttttgtccaaatcaccaaacaccttcaaatgcacacgagtaatgagtgggtttagtgtctgagatgcagcctttgagctcggatctcttatttttctaactgattgttcgtgcc

SEQ ID NO: 3300 - DNA, 706 bp, Panicum virgatum
ataccccttgccgccgccacgctctcgctcctctttcccccagcctcccaccaaggtttatccaccggcggcgtgcgcggcggcgacaagatggtgcagcgtctgacctaccggaagcggcacagctatgccaccaagtccaaccagacccgggtcgtcaagaccccaggtggcaagctcgtgtaccagtacaccaagaagagagccagcgggcccaagtgccccgtcaccgggaagaagatccaggggattccccacctcaggcctgctgagtacaagaggtccaggttgtctaggaaccgcagaactgtgaaccgtccctatggtggagtgctctctggaactgctgttagagaaaggatcatccgtgccttcctggtggaagagcagaagattgtaaagaaggtgttgaaaattcagaagaccaaagacaagactgcctcaaagtaactctgaaatggaactggagagataattttgtcaatggtgacgatcgatgtcttagtctcttctagctactagccaaatgttctagtgtgtcgtggtgacagctgtttctaggattcttgacgtcctgtctgccattgtgatgttgaaggttatgagacaacaatgatccccccattgcttttgttcacatcgccaaacaccaaatcaaattcacatgagtaatgagttggcttgagttagtgtctgattttctgac

SEQ ID NO: 3301 - DNA, 652 bp, Panicum virgatum
gactcccttccccgccgccacgcttgagagaggaagagcgcgcgcggagagcggaagcccgggacaaggcggcggccggcggcaagatggtgcagcggctcacctaccggaagcggcacagctacgccaccaagtccaaccagacccgcgtcgtcaagacccctggtgggaggcttgtgtaccagtacaccaagaagcgcgcgagtgggccgaagtgccccgtcaccgggaagaagatccaaggaattcctcacctcagacctgctgagtacaagaggtccaggttgtcaaggaacaggaggactgtgaaccgtccatatggtggtgttctgtctggtaccgcagttagggagaggatcattcgggcatttttggtcgaggagcaaaagatcgtaaagaaggtgttgaagatccaaaagaccaaggacaaggcctccaagagctagatataattgcaataggcattttgccaccatgtttaattctctcgaatttgtttcagtatgaaattttctcgtgggtctgagaatcttgctagatcgatgtgagtgattgaattttcggtgctgttgcgtatccttttaagttttggaacataggtggaatgtttttcgcttggctatgttgatatcagatatttttccatttgccc

SEQ ID NO: 3302 - DNA, 771 bp, Panicum virgatum
gacttccctccccgccgccacgcttgagagaggggagcggaagcccgggagaaggcggcggccggcggcaagatggtgcagcggctcacctaccggaagcggcacagctacgccaccaagtccaaccagacccgcgtcgtcaagacccctggtgggaggcttgtgtaccagtacaccaagaagcgtgcgagtggaccgaagtgcccggtcaccgggaagaagattcaaggaattcctcacctcagacctgctgagtacaagaggtccagattgtcaaggaacaggaggaccgtgaaccgtccatatggtggtgttctgtctggtactgcagttagggagaggatcattcgggcatttttggttgaggagcaaaagatcgtaaagaaggtgttgaagatccaaaagaccaaggacaaggcctccaagagctagacattattgcaataggcatatgccaccatgtttaattctctcgaacttgtttcggtatggaattttctcgtgggtctgagaatcttgctagatcgatgtgagtgattgaattttgggcgcagttgcggatccactaggttttggaaacttaggtggaatgtttttcgcttggctatgaggatatcagatacttgttaattccatttgcccttgttcacgcggtcacggtctaatcaaccttatacataactgtcagtatcttgagtttgacttaagcttaacgttgtctattgtggaatataaatgtgggcaatgttaaacctaatgaatttgctattc

SEQ ID NO: 3303 - DNA, 593 bp, Tamarix hispida
gggggctcttcttccgcggcctcagacagagagaaggacgcagagctgggagacgatagccgaatctgccaataatggtgcagcgtctcacgtaccgttcacgccatagctatgctaccaagtctaaccagcacaggatcgtaaaaactcctggtggaaagctcgtgtaccagaccacaaagaagagagctagtggtcccaaatgccctgtcactggcaagagaattcaagggattcctcatctgagacctgctgaatataggagaactaggttacccaggaacaggcgtacagtgaatcgtgcctatggtggtgtactagctgcaagtgctgtccgtgaaaggatcatccgagcctttcttgttgaagagcagaagatcgtgaaaaaggttttgaagattcagaaggcaaaggaaaagctggctgctaggagctagaatggaagtattacatcgtcttttgtagaccttgtgttgagagaaaaatttgttttgtgaaactgacatgcattgaagaaaaatattgtttatgttcgcgcgaggccctctactactaccttattggttttaatttgaatgggcatcttttcttct

SEQ ID NO: 3304 - DNA, 705 bp, Zamia vazquezii
  misc_feature (492)..(492): n is a, c, g, or t
  misc_feature (559)..(559): n is a, c, g, or t
  misc_feature (594)..(594): n is a, c, g, or t
  misc_feature (614)..(614): n is a, c, g, or t
gctaccgggagaacaacagaggaagaagatggtacagcgactcacataccgtcggcgtcacagctacgccaccaaatccaataagaccagggttgtcaagaccccaggcgggaaattaatctaccaaaccgccaagaagagagccagcggaccaaaatgcgcggttacaggcaagaggatccaggggattcctcatctaaggcctgctgaatacaaacggtctagattgcccagaaacaggagaactgtcaacagagcttatggaggagttttgtctggatcagctgtccgagaaaggattattcgggcctttttggttgaagaacagaagattgttaagaaggttctgaagattcagaaggccaaggaaaagcagactgctaggagttagagttgatcaggtgttttgatttgtttaacttagaatggaattttgctcgagtgtgatggcaattgaaattcatctcgaaatattttgttaaaattgagtgngaccttttattgtgccagtgttttggtgcatgtgatggcgattcctttgttaacttttccttaaganagtgtcgtagttgtggtaattatagttagtacaantctttatatgactgtgctgnctacctattttatcatttgaagcataacatttaaaattgttgtaaattgtattaaattataatcaatacagggatttaatactccggtagc

SEQ ID NO: 3305 - DNA, 429 bp, Humulus lupulus
tggcagtccagaatcgcagagctcgttcatcaagcaatcgaaaatggtgcagcgtctcacatatcgcacccgacacagctacgccaccaaatcgaaccagcaccggatcgtcaaaacaccaggtgggaagttggtttaccagaccaccaagaagagagctagcggcccaaaatgccctattactggcaagagaattcagggggattcctcacttgagaccaactgaatacaagcgctctagattgtcgaggaaccgtaggactgtgaatcgggcctatggtggtgttctttctggaggtgctgttagggagaggatcattcgtgtctttcttggtggaagagacaaaagattgtgaagaaggttttgaagattcaaaaaggccaaaggaaaagttggcctcaagaactaaatgagtggacatgatgttg

SEQ ID NO: 3306 - DNA, 643 bp, Lippia dulcis
ccacagccactctctgcaactcattcacgcaaaaatggtgcagcgtctcacctacaggaagcgtcacagctatgccaccaaatccaaccagcaccgggtcgtcaagactcccgggggaaagctagtttaccagacaacgaagaagagggcaagcggccctaagtgtcctgttactggcaagagaatccaagggattcctcacttgagacctgctgagtacaagaggtctagactctccagaaacaggaggactgtgaaccgtgcctatggtggtattttgtccggtggtgctgtgagagaaaggattatcagagctttcttggtggaagaacaaaagatcgtgaagaaggtgttgaagttacagaagctaaaggaaaggctgctggcaagagctaagtgtgatttctgtgccgagttagttttttatcatggaactatagtgagagtgttaagcttgatatcagtatttttctttccttcagtttgttgagatatctgcttaattaggatttcctgattttggctctttgatgattatcaactcattttggattcctttatgtcacttcaaattttgtcgtattaatttgttgttatgttatactatttcctgtcaaaaagaaaagtaccgactgcgactctg

SEQ ID NO: 3307 - DNA, 686 bp, Curcuma longa
gaagaaatctgcaatatggtgcagaggtaaacctacccgaagaggcatagctatgccaccaaatcgaatcagactcgtgtagtcaaaacccctggtgggaagctcgtgtaccagtacactcacaagagagccagcggaccgaaatgccctgtgactggaaagagaatccaagggattcctcacttgagacccactcagtacaagaggtctaggctatccagaaaccgaaggactgtgaaccgagcttatggtggagttttatctggaggtgctgtcagagagaggatcattcgagcctttctggtagaagagcagaagatagtgaagaaggtcttgaaaattcaaaagactaaagagaagcagtcgtccaagagctaggccaataaactaaatgagttgtgttatgcaatagttcggtcgatattctcagtagaattatctacttcccttgtcgtgttaatgtggcggcactgtacgtggtataattgtattatttcctgagattttaggtgtatttggtttattattccatggatctgttttgttcctgtgtttgcggcattgtttgtggtgatgttagaattgatgttatacatgaggtaattgggctgcagatttttatgtgtttttttttcattcacgtgcatgttagaaataaacctcctgccgaattcggcacgaagcgg

SEQ ID NO: 3308 - DNA, 625 bp, Mesembryanthemum crystallinum
ctagttctagagcgttcggcacgagcggctcacgtaccgaaagcgtcacagctacgccaccaagtctaaccagcacaggattgttaaaacacctgggggcaggttggtatatcagggaaccaagaagagagcgagcggtccgaaatgccctgttacaggaaagagaattcaagggattcctcacttgagacctgctgagtacaagaggtctagactgcctagaaaccgtagaacagtaaaccgaccttatggaggtgtcttgtctgcagccgctgttcgtgaaaggatcattcgtgccttcttggtggaggagcagaagattgtgaaaaaagtattgaagattcagaaaaccaaagagaagcaagctggaaaaagctaaactggtagatagacaatgaagagaagtagaaactctctttgggttaggaaattatctctcctaagtaaatctgcttaatgttgatgatgacgatctcttatgaccggaataacattgtgaattatcaggttttgttcaattgtgtaatctgctccatgatttgctatttagaggcttctttcatcactttgtcgacaaaccattggtagatctcttcaatgactaatgggaaggacatattgtttt

SEQ ID NO: 3309 - DNA, 529 bp, Actinidia deliciosa
  misc_feature (185)..(185): n is a, c, g, or t
ccgaacaaagaggagggggagagagagagagagagagagagagaggggcgaagatggtgcaacggctcacatactgcaagcggcatagctatgccactaaatcgaaccagctcaggatcgtcaaaacccctggagggaagttagtgtatcagagcaccaagaagagggcaagtggacccaagtgncctgtgactgggaagagaatccaagggattcctcacttgagacctgctgaataaagacatctagattatctagaaaccggagggctgtgaaccgtgcctttggtggggtattgtctggaggtgctgtgagggaaaggatcattagagccttcttagttgaagagcaaaagatagtgaagaaggttttgaagattcagaaggccaaagaaaagcaagcaggcaagagctgaacttggggaagtgtaccaaattttgaaccgcgtgagaggatattggatacatcccaatgactaagaatcatggcaatgtatccagaggggtgcaaatttgcttttgtatctttt

SEQ ID NO: 3310 - DNA, 1439 bp, Brassica napus
tataaaacgagaagacaagatttgataaatgtcgacagagtaaagagcacagcgaataacaaaagcgtaaaatttttgacgaacacataatgtttctctcaacgtctgcaaccagtaactattgctaggacagagtcacacaacaattaaattatttttttatgaaagagaaaaaggatctctagctcttgggagccaccttttccttggccttttggagcttcaagaccttcttcacaatcttttgctcttccacaaggaaagcacggacgattctctccctaacagccaaagcagacaaaacaccgccataagcacggttcacggtcctcctgtttctggataatcgagacctcttgtactcagcaggcctcaagtgagggataccctggatacgcttgccggtaacggggcattttggtccacttgcacgcttcttagtggtctggtatgtcaatttaccacctggggttttgacgatcctgtgctggttggacttggtggcgtagctgtgacgcgaacggtatacaaggcgctgcaccatttctccttttaggtctttatcctcctcgacgacggagcggatctctatctctctctctccctctctcgattccgaaactattccgcagagtgaagaaggatggggttgtctttcgggaagcttttcagcaggctttttgccaagaaggagatgaggattctgatggttggtcttgatgctgctggtaagaccaccatcttgtacaagctcaagctcggagagattgtcaccaccattcccactattgggttcaatgttgaaactgtggagtacaagaacatcagcttcacagtgtgggatgtcgggggtcaagacaagattcgtccgttgtggaggcactacttccagaacactcaaggtctcatctttgtggtggacagcaatgacagagaccgtgttgttgaggctagagatgaattgcacagaatgctcaatgaggatgagctgcgtgatgctgttctgctcgtgtttgctaacaagcaggatcttccaaatgccatgaacgcagctgagatcaccgataagcttggtctccactctctccgtcagcgtcactggtacatccagagcacatgtgccacttcaggagaggggctttacgaaggtcttgactggttgtccaacaacatcgccggcaaggcgtagagggaaagattgtggttgagctgattttgctgggcaaatctggatgcaggggcaaacattatctgattttttctttattgttctgtttcttttttggtttcgggtatttggatttgattttgtgatcgttgttctgattgtgcaaggaggagtctattgcacgtagaacatagaaactgcctttttatatagtttgtaatcgaagatttactctacttctttctgcttcacgtttcatttttgaatttca

SEQ ID NO: 3311 - DNA, 628 bp, Brassica oleracea
ctaaccaacggtaagtgtggtcaacatatataaaacgagaagacaagatttgataaatgtcgacagagtaaagagcacaacgaataacaaaagcgtaaaatttttgacgaacacataatgtttctctcaacgtctgcaaccagtaactattgctaggacagagtcacacaacaattaaaatatatttttttaagaaaaggagaaaaaaggatctctagctcttgggagcaaccttttccttggccttttggagcttcaagaccttcttcacaatcttttgctcttccacaaggaaagcacggacgattctctccctaacagccaaagcagacaaaacaccgccataagcacggttcacggtcctcctgtttctggataatcgagacctcttgtactcagcaggcctcaagtgagggataccctggatacgcttgccggtaacggggcatttgggtccacttgcacgcttcttagtggtctggtatgtcaatttaccacctggggttttaacgatcctgtgctggttggacttggtggcgtagctgtgacgcgaacggtatacaagacgctgcaccatttctccttttatctccttttaggtctttatcctcctcgacgacggagcagc

SEQ ID NO: 3312 - DNA, 758 bp, Setaria italica
atgtgggccagtgcagcagatgccttgacatgcgccgagttcggagtagtcttttattcgcccagggttttagccgccgccgccgccgcttcccgagcagagagagagagagagagagaggtcgacgccatggtgcagcggctcacgtaccggaagcggcacagctacgccaccaagtccaaccagaccagggtcgtcaagaccccaggagggaggcttgtgtaccagtacaccaagaagcgggcgagcgggcccaagtgcccggtcaccggcaagaagatccaggggatacctcacctgaggcctgctgagtacaagagatccagattatccaggaacaggaggaccgtgaaccgtccttatggtggtgttctgtctggtcaggctgttagggaaaggatcatccgtgctttccttgttgaggagcaaaagatcgtgaagaaggttcttaagatccaaaagaccaaggagaagacgacttcaaaatgagacggcaaaatctttctatacccatgagaactttttggaggacggtggtgatcaatgcttagtcaaaaatccttatcggtatgctaggctggtggtttctgaatctagctagagattgtgatcaattttccatgttgtcgggatggaagtctagacatcttctcccatgttctgatccttgtggttggctactagttatatatcaacagattttcagtgctttctgagcattatttgtgcccctctgttcttgaaaaagaatgttctac

SEQ ID NO: 3313 - DNA, 641 bp, Avena sativa
cgccgcaaccccagcagagagaagcgagcgacagcgaggtcgacgccatggtgcagcgcctgacgtaccggaagcggcacagctacgccaccaagtccaaccagaccagggtcgtcaagaccccaggagggaagctcgtgtaccagtacaccaagaagagggcgagcgggccgaaatgcccggtcaccggcaaaaagatccaggggattcctcaccttaggcctactgagtacaaaagatccagattatccaggaacaggagaaccgtgaaccgtccttatggtggtgttctatctggcccggctgttagggagaggatcatccgcgcattccttgtggaagagcaaaagatcgtgaagaaggttctgaagatccagaagaccaaggagaagcaaccagcaaagtaaaatggccgaggccctttatactcgtggaattttttggaggacagatggtgatcagtgctgagtcaagcctgctcagctggtggcttctgaattgcgcaagacttcagtccatttttcttgtttggatggtggatctggatatctttacccaatgctattactttgtgtttgacctgagcacttggtttatatatcgcggttttaggattgtgctattttcagtgttttctcgtg

SEQ ID NO: 3314 - DNA, 580 bp, Avena sativa
gaaaagcgcgcggcgagagaactccagagagggcggcgagatggtgcagcggctgacctaccggaagcggcatagctacgcaaccaagtccaaccagacccgtgtcgtcaagaccccaggtgggaagcttgtgtaccagtacaccaagaagcgggcgagtgggccgaaatgccctgtcacagggaagaagatccaaggaatcccgcacctcagacctactgagtacaagaggtccagattgtcaaggaaccggaggactgtgaaccgtccttatggtggtgttctgtctggtcctgcagtcagggagagaatcatccgggcatttttggttgaggagcagaagattgtgaagaaggtgctgaagatccagaagaccaaggaaaagaccaccaagagctaaacattgtgccgagataggcatcgccgtgatgttttgagttccttcgaatttgtttttaaacaatcaagaaaatttcctcttcggatatgttccttgctctagtttgcctgctagtatgtgatattgatgtggttctcaagattttgcgcggtagttatctatgaatgcataacctttgat

SEQ ID NO: 3315 - DNA, 663 bp, Eutrema halophilum
gcctcctctctgctccgtcaagctgaggaggataaaacccataggaggagaaaggagtgtgtgagcaagcgaagtagcgaaaatggtgcagcgtcttgtttaccgttcgcgtcacagctacgccaccaaatcgaaccagcacaggatcgtcaaaaccccaggtggtaaattgacgtaccagaccacgaagaagagagccagtggaccgaaatgccccgtgaccggcaagcgtattcagggtatcccacacttgaggccttctgagtacaagagatcccgattatccagaaacaggaggaccgtgaaccgtgcttatggtggagttttgtccgcctctgctgttagagaaagaatcatccgtgctttccttgtggaggagcaaaagattgtgaagaaggttttgaagctgcaaaaggccaaggaaaaggttgctcccaagagctagattcctaatagtttttcttaaaaatgtttttgtggcgctctgttctctagcgaatagtttactggttgcaaagtttgggagaaacattgtgtactcgttccaaaattcttaagctttttgtattcgtttttccttcttgactctgccgacatttcgcttgcccttcggttttgctttctcgtttaatttctgagtaaatcgatactcattttattgac

SEQ ID NO: 3316 - DNA, 581 bp, Eutrema halophilum
ttatattctccgccccagaaaaagcaaaaccctaagagaaaagaggcgaaaatggtgcagcgtcttgtttaccggtcgcgacacagctacgccaccaaatcgaaccagcaccggatcgtcaagactccaggaggtaaattggtgtatcaaacctcaaagaagagagccagtggccccaaatgccctgttaccggcaagagaattcaaggaattcctcacttgaggcctgctgaatacaagaggtctagattatcaagaaacaggaggaccgtaaaccgtgcatacggtggagtcttgtctgcttctgcagtcagggaaaggatcatccgagcattccttgtggaggagcaaaagattgtgaagaaagttttgaaactccaaaaggccaaggagaaagtagctcccaaggcttaagtgtttatctttctttcttctttcttgttttgggattatggctatgttcaagaaataggatttggtcagccatgagagatattctatgtactcatccgattttcaatctttgtattgtgttttggcttttcaactttgtcgacaattcactctgcttcagttttggt

SEQ ID NO: 3317 - DNA, 656 bp, Utricularia gibba
ccagcggctgacctacagaacgaggcatagctatgctactaagtccaatcagcaccgcatcgtcaaaactcctggggggaagctggtgtatcagactacaaagaagagggccagcggacctaagtgccctgtaactggaaagaggatccaagggattcctcacctaaggccagctgagtacagcaattccagattgtctaggaatagaagaaccatcagccgtgcttatggtggagtattatccggtggtgccgtcagagaaaggattatccgagcattcttgattgaggagcagaagatagtgaagaaagtattgaagattcagaaggccaaagaaaaacttgcttccaagagctgaacctggagaagcaaaagaaattcaactcggcaagttttgaagctttggcatttcagtaaaccgtggcgcattactgctttttagtgtcaagaaactccctttacacttggtttgctgctgcattaatggaagaagtgccttgtagctacacattctattctcaacagactaaggagccattttcaaagcatttcggacaccattaaccaggaaataggagtgcaggtggtgggtgtcttctcaatgcatccaatacacactaaaatgacgtctttggagggatctccacagaaggctg

SEQ ID NO: 3318 - DNA, 689 bp, Arabidopsis thaliana
tctctgctccgtcaagctgaggaggataaaaaccctagggtgagtgagacagagagaagcgaaaatggtgcagcgccttgtttaccgatcacgacacagttacgccaccaaatccaaccagcacaggatcgtcaaaactccaggaggtaaattgacgtaccagaccactaagaagagagctagtggacctaaatgtcccgttaccggcaagcgtattcagggtattcctcacttgaggccaactgagtacaagaggtcacgtttatcaagaaacaggaggaccgtgaaccgtgcttatggtggggttttgtctggttctgctgttagggaaagaatcattcgtgccttccttgtggaggagcaaaagattgtgaagaaggttttgaagcttcagaaggcaaaggaaaaggttgctcccaagtgatctagaccctattagtttttatgttttatggctctgttctagcgatagtactggttgcagagaaaaacattgtgtactcatcaaaaaatttaagcttttttgtattggttttggatctttggctctgtctacaattcgtttcggttttcgtttcttgttcatgttgagttcacatttcacgttttcaattcttacccccgaaacttcctattggttacaaatgatttatactctttttttctcttttgagcctaaaactttaact

SEQ ID NO: 3319 - DNA, 663 bp, Brassica juncea
ctgctccgtcgtcgaggaggataaagacctaaaaggagaaatggtgcagcgccttgtataccgttcgcgtcacagctacgccaccaagtccaaccagcacaggatcgtcaaaaccccaggtggtaaattgacataccagaccactaagaagcgtgcaagtggaccaaaatgccccgttaccggcaagcgtatccagggtatccctcacttgaggcctgctgagtacaagaggtctcgattatccagaaacaggaggaccgtgaaccgtgcttatggcggtgttttgtctgctttggctgttagggagagaatcgtccgtgctttccttgtggaagagcaaaagattgtgaagaaggtcttgaagctccaaaaggccaaggaaaaggtggctcccaagagctagagatccttttttctccttttcttaaaaaaaaaatatttaattgttgtgtgactctgtcctagcaatagtttgtggttgcagacgttgagagaaacattatgtgttcgtcaaaaattttacgctttcgttattcgttgtggtctttactctgtcgacatttatcaaatcttgtcttctcgttttataaatgttgaccacgcttagcgttggtttgttataaatgtgattcctgggaatatcactcaggaacattagtaaaa

SEQ ID NO: 3320 - DNA, 685 bp, Brassica rapa
gcagcctcttctctgctccgtcgtcgaggaggataaagacctaaaaggagaaatggtgcagcgccttgtataccgttcgcgtcacagctacgccaccaagtccaaccagcacaggatcgtcaaaaccccaggtggtaaattgacataccagaccactaagaagcgtgcaagtggaccaaaatgccccgttaccggcaagcgtatccagggtatccctcacttgaggcctgctgagtacaagaggtctcgattatccagaaacaggaggaccgtgaaccgtgcttatggcggtgttttgtctgctttggctgttagggagagaatcgtccgtgctttccttgtggaagagcaaaagattgtgaagaaggtcttgaagctccaaaaggccaaggaaaaggtggctcccaagagctagagatccttttttctccttttcttaaaaaaaaaaatatttaattgttgtgtgactctgtcctagcaatagtttgtggttgcagacgttgagagaaacattatgtgttcgtcaaaaattttacgctttcgttattcgttgtggtctttactctgtcgacatttatcaaatcttgtcttctcgttttataaatgttgaccacgcttagcgttggtttgttataaatgtgattcctgggaatatcactcaggaacattagtaatgattaagagc

SEQ ID NO: 3321 - DNA, 683 bp, Brassica rapa
gcacgaggcagcctcttctctgctccgtcgtcgaggaggataaagacctaaaaggagaaatggtgcagcgccttgtataccgttcgcgtcacagctacgccaccaagtccaaccagcacaggatcgtcaaaaccccaggtggtaaattgacataccagaccactaagaagcgtgcaagtggaccaaaatgccctgttaccggcaagcgtatccagggtatccctcacttgaggcctgctgagtacaagaggtctcgattatccagaaacaggaggaccgtgaaccgtgcttatggtggtgttttgtccgctttggctgttagggagagaatcgtccgtgctttccttgtggaagagcaaaagattgtgaagaaggtcttgaagctccaaaaggccaaggaaaaggtcgctcccaagagctagagatccttttttctccttttcttaaaaaaaaaaaaatttaattgttgtgtgactctgtcctagcaatagttactggttgcagacgttgagagaaacattatgtgttcgtcaaaatttttacgcttttgttattcgttgtggtctttactctgtcgacatttatcaaatcttgtcttctcgttttatatatgttgaccacacttagcgttggttactttgttataaatgtgattcctgggaatatcactcaggaacattagt

SEQ ID NO: 3322 - DNA, 688 bp, Hordeum vulgare
cgccgccgccgccgcccccgccccccgcagagagaagcgagcgacagcgaggtcgacgccatggtgcagcgcctgacgtaccggaagcggcacagctacgccaccaagtctaaccagaccagggttgtcaaaaccccaggagggaggcttgtgtaccagtacacgaagaagagggcgagcgggccgaaatgtccggtcaccggcaagaagatccaggggatacctcatctaaggcctactgagtacaaaaggtccagattatccaggaacaggagaacagtgaaccgtccttatggtggtgttctatctggtcaggctgttcgggagaggatcatccgtgctttccttgtggaagagcaaaagattgtgaagaaggttctgaagatccagaagaccaaggagaagcagccatcaaagtgaaatggctgaggcttttttttggaggacagatggtgatgagtgttcagtcaaaagcctgcgtagtatgctaagctcgtggttactgaattaaactagagatttccgtccattttcttgttccgagggtggatctggatctcattacccgtatgctattactttgtgtttgacggtttgacctgagtacttggttatattacagttttggataccctttgcaatgctgttgcccgtggatttctactgcaagctgcagtgttttcttgca

SEQ ID NO: 3323 - DNA, 710 bp, Brassica napus
atcgaataacacccctccccgcctccccccgcattcggattccgggtcgaccccgcgtccggaggataaagacctaaaaggagaaatggtgcagcgccttgtataccgttcgcgtcacagctacgccaccaagtccaaccagcacaggatcgtcaaaaccccaggtggtaaattgacataccagaccactaagaagcgtgcaagtggaccaaaatgccccgttaccggcaagcgtatccagggtatccctcacttgaggcctgctgagtacaagaggtctcgattatccagaaacaggaggaccgtgaaccgtgcttatggcggtgttttgtctgctttggctgttagggagagaatcgtccgtgctttccttgtggaagagcaaaagattgtgaagaaggtcttgaagctccaaaaggccaaggaaaaggtggctcccaagagctagagatccttttttctccttttcttaaaaaaaaaatatttaattgttgtgtgactctgtcctagcaatagtttgtggttgcagacgttgagagaaacattatgtgttcgtcaaaaattttacgctttcgttattcgttgtggtctttactctgtcgacatttatcaaatcttgtcttctcgttttataaatgttgaccacgcttagcgttggtttgttataaatgtgattcctgggaatatcactcaggaacattagtaatgat

SEQ ID NO: 3324 - DNA, 604 bp, Brassica napus
aaagacctaaaaggagataaaaggagaaatggttcagcgtcttgtataccgttcgcgtcacagctacgccaccaagtccaaccagcacaggatcgtcaaaaccccaggtggtaaattgacataccagaccactaagaagcgtgcaagtggacccaaatgccccgttaccggcaagcgtatccagggtatccctcacttgaggcctgctgagtacaagaggtctcgattatccagaaacaggaggaccgtgaaccgtgcttatggtggtgttttgtctgctttggctgttagggagagaatcgtccgtgctttccttgtggaagagcaaaagattgtgaagaaggtcttgaagctccaaaaggccaaggaaaaggttgctcccaagagctagagatccttttttctccttttcttaaaaaaaaaatattttaattgttgtgtgactctgtcctagcaatagttactggttgcagacgttgagagaaacattatgtgttcgtcaaaaattttacgcttttgttattcgctgtgctctttactctgtcgacatttatcaaatcttgtcttctcgttttatatatgttgaccacacttagcgttggtt

SEQ ID NO: 3325 - DNA, 607 bp, Brassica napus
tggtgcagaggttagtgtaccgttcaaggcatagttatgccactaaatcaaaccagcatcgcattgttaaaacccctggaggaaggttggtgtatcagacgacaaagaagagagcaagtggacccaaatgccctgtcactggcaaaagaattcaagggattcctcacttgaggccaactgaatacaagaggtcgaggttgcctaggaacaggaggactgtaaaccgtccatacggtggagttctatctggtggtgctgtcagagaacgcatcattagagcgtttctgattgaagagcaaaagattgtgaagaaggttttgaagatgcaaaaggccaaggaaaaggtggccggaaagagctaaattgaaaaccgtctatgttgatgctaaattttggtgttttaccatgttggttttgcaaatgttacgtgaaattgttatgttctggctgttggatatgtaactcatagctgagcttcttttggcagcatagtttagttgaacatgtttcgtccacaacactattcgtttctgttaaaaaccctttgcttatgtgaactatacatttggggtcatttatctatgatacgggtgctccatttgtttga

SEQ ID NO: 3326 - DNA, 609 bp, Brassica napus
tggtgcagaggttagtgtaccgttcaaggcatagttatgccactaaatcaaaccagcatcgcattgttaaaacccctggaggaaggttggtgtatcagacgacaaagaagagagcaagtggacccaaatgccctgtcactggcaaaagaattcaagggattcctcacttgaggccaactgaatacaagaggtcgaggttgcctaggaacaggaggactgtaaaccgtccatacggtggagttctatctggtggtgctgtcagagaacgcatcattagagcgtttctgattgaagagcaaaagattgtgaagaaggttttgaagatgcaaaaggccaaggaaaaggtggccggaaagagctaaattgaaaaccgtctatgttgatgctaaattttggtgttttaccatgttggttttgcaaatgttacgtgaaattgttatgttctggctgttggatatgtaactcatagctgagcttcttttggcagcatagtttagttgaacatgtttcgtccacaacactattcgtttctgttaaaaaccctttgcttatgtgaactatacatttggggtcatttatctatgatacgggtgctccatttgtttgatt

SEQ ID NO: 3327 - DNA, 659 bp, Cenchrus ciliaris
cgcaccccaagcctcactagggttttatcggcggcggcggcaagatggtgcagcgcctcacctaccggaagcgtcacagctacgcgaccaagtctaaccagacccgggtcgtcaagaccccaggtgggaagcttgtgtaccagtacaccaagaagagggcaagcgggcccaagtgccccgtcaccgggaagaagattcaggggattcctcacttgaggcctgctgagtacaagaggtccaggttgtcaaggaaccgcaggactgtgaaccgtccttatggtggagtgctttctggaactgctgttagggagaggatcatccgtgctttcttggttgaggagcagaagattgtcaagaaggtcctgaaaatacagaaaaccaaggacaagacagccacaaagtagagctcctgaaatgggcatagtgatgttttgtacgctgccaaaagtttttttttggtgatgggtaatcttgttgccttttgtattgaatctttagcatgtgagacataactgtcgagtttagactgaatcctcttcacctttcattgtctgaatatcgggactatttcctagttgctttattataaattcagatcttatctggggtaccatcagcttgtcgaatttaccttaaattcttaaccgtttaattgtttg

SEQ ID NO: 3328 - DNA, 673 bp, Cleome gynandra
tttcggggtagggatctgaagatccaattaatatcttcgtctccgtcaacaaagttgcaacccttttttctctcttttgtttcgccgggacaaactaagaattccagacgagaaaatcagggattccgggtaatggtgcagaggcttacataccagggaaggcatagctatgccacgaagtcgaaccagcaccgtgtcgtcaaaactcctgggggaaagcttgtttaccagactacgaagaagagagctagtggacccaagtgtcctgtcaccggaaagaggattcaagggattccgcatttgaggcctgctgaatacaagaggtctaggttgggaagaaacaagaggacagtaaaccgtgtttacggtggagtactctctggttcatctgtcagggaaaggataattcgagctttccttgtggaggagcaaaagattgtgaagaaggttttaaaacttcaaaaagccaaggaaaagttagcggccaagaactaaaacttatcattgctgtttagttttcaaattgtttttttttatattcagtttttatgtttgagatcttagggacttttaagggttagtatcttttgtggttagttgcctgttctccaactttgtcgacaacacaacacattggctagttttgcttttattgtcattggaaacctctcaa

SEQ ID NO: 3329 - DNA, 601 bp, Cynodon dactylon
gagagagagagagagagagaagtcgacgccatggtgcagcgcctgacgtaccggaagcggcacagctacgccaccaagtccaaccagaccagggtcgtcaagaccccaggaggacggcttgtctaccagtacaccaacaagagggcgagcgggccgaaatgcccggtcaccggcaagaagatccaggggatacctcacctaaggcctgctcagtacaaaagatccagattgcccaggaacaggaggactgtgaaccgtccctatggtggtgttctatctggtcaggctgtgagggaaaggatcatccgtgccttccttgttgaggagcaaaagatcgtgaagaaggttctgaagatccaaaagaccaaggagaagcaaccatctaaatgaagtggtcaaagcttttaatacccttgaaggttttttgaggatgagtgatcagtgcttagtcaagagcctgttctgtatcatgctgatgctggtggtttctgaattaagctagggatttctctcagttttccttgttaatgggtggaaatttggacatcatttcccatgttctgattcttgtggttgagtactagtatatccacgagttatc

SEQ ID NO: 3330 - DNA, 642 bp, Festuca arundinacea
  misc_feature (120)..(120): n is a, c, g, or t
  misc_feature (126)..(126): n is a, c, g, or t
  misc_feature (138)..(138): n is a, c, g, or t
  misc_feature (201)..(201): n is a, c, g, or t
  misc_feature (216)..(216): n is a, c, g, or t
ggcacgaggtagagcgagacagacagagggagagaaaacgcgcgcggcgagagaaccccgggagagggcggcgagatggtgcagcggctgacctaccggaagcggcacagctacgctacnaagtcnaaccagacccgngtcgtcaagaccccaggtgggaagcttgtgtaccagtacacaaagaagcgggcgagtgggccnaaatgcccggtcacngggaagaagatccaaggaattccacacctgagacctactgagtacaagaggtccagattgtcaaggaaccggaggactgtgaaccgtccttatggtggtgttctgtctggtcctgcagtcagggagagaatcatccgggcgtttttggtcgaggagcagaagattgtgaagaaggtgctgaagatccagaagaccaaggaaaagaccaccaagagctaagcagttgtgcgagataggcatcgccgtgatgttttgagtttcttcgaatttgttttaagcaatcaagggaattttctcttcggatatggggaatcctggctctagtgtttgcctgctagtatgtgagattgatgtggttctcaggattttgggcgctagttctctatgaatgcttgaccttttgatgactcacatttggtctcgttc

SEQ ID NO: 3331 - DNA, 601 bp, Festuca arundinacea
ggcacgaggcaaccctttgcctcattctcctactaccggcggcggagacgacggcaacatggtgcagcgtctgacctaccggaagaggcatagctatgccaccaagtccaaccagacgcgggtcgtcaagaccccaggtggtaagctcgtctaccagtacacaaagaagagggcgagcggcccaaagtgccctgtgaccgggaagaagatccagggaattccccacctgaggcctactgagtacaaaagatcaaggttgtctaggaaccgcaggactgtgaaccgtccctacggtggagtgctctctggacctgcagtgagagaaaggatcatccgtgctttccttgtcgaggagcagaagattgtgaagaaagtcttgaaaatacagaaaaccaaggacaagacggcctcaaagtagagaacttatcgaaacagaagtgagatgctgttatgtaaacaaggaaatatttttgtggatggtgatcatgaatggttttagtcccttctagctaaatgctttagtatgtcgaggagatctgctgaattcagagattgtgagacatttgatacccatttgcttttccatttctgaatctcatgt

SEQ ID NO: 3332 - DNA, 784 bp, Setaria italica
tctttccctcacactctcctccagcctccctccagggtttatccaccggcggcgcgcgcggcggcggcgagatggtgcagcgtctgacctaccggaagcggcacagctatgccaccaagtccaaccagacgcgggtcgtcaagaccccaggtggcaagctcgtgtaccagtacaccaagaagagagccagcgggcccaagtgccccgtgactgggaagaagatccaggggattccccacctcaggcctgctgagtacaagaggtccaggttgtccaggaaccgcagaactgtgaaccgtccctatggtggagtgctctcaggaactgcagttagagaaaggatcatccgtgctttcctggttgaagagcagaagattgtgaagaaggtgttgaaaatacagaagaccaaagacaagactgccacaaagtaactctgaaatggaagtgagctcctgttctgtaaacaagggaaggtatttttgtcaatggtgatgatcgatggcttagtctcatctagctaaatgttctagtatttcgtggtgacaactgtttgtaggattctcgaaatcctatctaccattgtgatgtcaaaggttatgagacaacaatgatccctctgttgcttttgttcactttgccaaaccgcgatcgaattcacatgagtaatgagttggtttgagttagtgtttgattttctgacagttgcttggtgatgcagccttcgatctcttcttttctgactgatagtttgtgtcagtgaatgagtttgtggccctcgttgctc

SEQ ID NO: 3333 - DNA, 809 bp, Setaria italica
ataccccttaccgccgccacgcgctcgctcctctttccctcacactctcctccagcctccctccagggtttatccaccggcggcgcgcgcggcggcggcgagatggtgcagcgtctgacctaccggaagcggcacagctatgccaccaagtccaaccagacgcgggtcgtcaagaccccaggtggcaagctcgtgtaccagtacaccaagaagagagccagcgggcccaagtgccccgtgactgggaagaagatccaggggattccccacctcaggcctgctgagtacaagaggtccaggttgtccaggaaccgcagaactgtgaaccgtccctatggtggagtgctctcaggaactgcagttagagaaaggatcatccgtgctttcctggttgaagagcagaagattgtgaagaaggtgttgaaaatacagaagaccaaagacaagactgccacaaagtaactctgaaatggaagtgagctcctgttctgtaaacaagggaaggtatttttgtcaatggtgatgatcgatggcttagtctcatctagctaaatgttctagtatttcgtggtgacaactgtttgtaggattctcgaaatcctatctaccattgtgatgtcaaaggttatgagacaacaatgatccctctgttgcttttgttcactttgccaaaccgcgatcgaattcacatgagtaatgagttggtttgagttagtgtttgattttctgacagttgcttggtgatgcagccttcgatctcttcttttctgactgatagtttgtgtcagtgaatgagtttgtggccctcg

SEQ ID NO: 3334 - DNA, 488 bp, Eragrostis curvula
acgcggtggcggccgcgggggcgcgtccagggttttagccgccgccgccaccccgagcgcagagagagagagagaggtcgacgccatggtgcagcgcctgacgtaccggaagcggcacagctacgccaccaagtcgaaccagaccagggtcgtcaagaccccaggagggcggcttgtgtaccagtacaccaacaagagggcgagcgggccgaaatgcccggtcaccggcaagaagatccaggggatacctcacctaaggccagctcagtacaaaagatccagactgcccaggaacaggaggaccgtgaaccgtccctatggtggtgttttatctggtcaggctgttagggaaaggatcatccgcgccttccttgttgaggagcaaaagattgtgaagaaggttctgaagatccaaaagaccaaggagaagcaaccatcaaaatgaagtggtcaaagttttttatgcccttgagagttttgaggacgat

SEQ ID NO: 3335 - DNA, 682 bp, Zea mays
ccgacgtcagatctaggtcactaggcctatcagccatcctataaaagctcccctccatctctcctcctcactcccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcaggactgtgaaccgtccatatggtggtgttctgtctggtaccgcagtgagagagaggatcatccgtgcctttttggtcgaggagcagaagatcgtgaagaaggttttgaagatccaaaaaaccaaggataaggcctccaagaactaggcgatataggcatcttccacaatgtttaagtcccttagaatttgtttcagcaagaaattttctcgtgggtttggggaatcctgatacttacacaagatatgcgagatgatatggtttaaattttgaacggaagttgcggatccttttattttttaaaatctcggtgcaatgtt

SEQ ID NO: 3336 - DNA, 815 bp, Zea mays
atcaatcctagccgtctgttacctcttcagagccaaccattaatacgccccaatcgccgccgccagagccgcggagctctccactcctctcttacccttcctctccccacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccaggaatggggaagcctagccctgttttgtacactgcgaaaattaattttggtggatggaaaatctaggtgccttgttgagcatttagcatgtgagtttagagattctggacactgaatccctttcacctttgaattgttggaatatcgggaatctgttcccctagttgcttttattatgaattcagatcctatctatgcaaagatcaaccttctggtttgtaacatcttttgtccatgttgctcgttgttgctcttgatgcccattcatatctatgcaagcagtgtggccgtgtattattta

SEQ ID NO: 3337 - DNA, 698 bp, Pennisetum glaucum
atccgctccctgcctcatcccaccaagtttactcaccagggtttagccgcctccgccgccgccgccgccgccgcttcccgagagagaaagagggagaggtcgacgccatggtgcagcggctcacgtaccggaagcggcacagctacgccaccaagtccaaccagaccagggtcgtcaagaccccaggagggaggcttgtgtaccagtacaccaagaagagggcgagcggacccaagtgcccggtcaccggcaagaagatccaggggatacctcacctcagacctgctgagtacaagagatccagattacccaggaacaggaggaccgtaaaccgtccttatggtggtgttctgtctggtcaagctgttagggaaaggatcatccgtgctttccttgttgaggagcaaaagattgtgaagaaggttctgaagatccaaaataccaaggagaagacgacttcaaaataagatagccaaagctctctgtagtgtacccatgggaacttttttggggatgatggtgatcaatgcttagtcaaaaattattatcagtttgctaggctggtggtttctgaatctagctagagattgcaatcaattttccatgttgttggggtcgaagtctgtcatcttcgcccatgttctgaatcttgtctactcttaagttatatatccacaaattttcaatgtgtctgagca

SEQ ID NO: 3338 - DNA, 741 bp, Nuphar advena
  misc_feature (76)..(76): n is a, c, g, or t
  misc_feature (88)..(88): n is a, c, g, or t
  misc_feature (97)..(97): n is a, c, g, or t
  misc_feature (120)..(120): n is a, c, g, or t
  misc_feature (184)..(184): n is a, c, g, or t
  misc_feature (199)..(199): n is a, c, g, or t
  misc_feature (613)..(613): n is a, c, g, or t
  misc_feature (670)..(670): n is a, c, g, or t
gagactaagatagactaagagagcgaggagaagcggaagggaaagggaggcggaaggaaggatggttcagcgactnacctaccggaancggcatagntatgccaccaagtccaaccagancagggtcgtcaagactcccggggggagactggtttaccaaacttcaaagaagagagccaagggncctcaatgccctgtnactcacaagagaatccaagggattccgcatttgaggcctactgaatacaagaggtctagattatcaaggaaccggaggacagttaacagagcttatggtggtgttttgtcaggcagtgctgtcagagaaaggatcatccgggccttcttggttgaagagcagaaaatcgttaagaaggtcttgaagatccagaaagcgaaggaaaagcaggctgccaagagttgaagagtattaaaacctcttgcgcttcttcacccataagaaattttgattttagatgatggcgagtggcttggcaaaatggtgtttctgagtgtggcactacgagtaatttgtttggcagaaataggtggacatgtattagctatgcagttttgcattttgacagacgaatcgttgctgtgttgatttttntttttttatttgtttctgctccagttactctgttaagattaatgcgctcttgatacngttggttcttttttgaacatcgaacggtaagaggatttgcagttaggtattttcgtcaaatcatttttccc

SEQ ID NO: 3339 - DNA, 717 bp, Avena sativa
cgccgccccgccgccccgccgcaaccccagcagagagaagcgagcgacagcgaggtcgacgccatggtgcagcgcctgacgtaccggaagcggcacagctacgccaccaagtccaaccagaccagggtcgtcaagaccccaggagggaagctcgtgtaccagtacaccaagaagagggcgagcgggccgaaatgcccggtcaccggcaaaaagatccaggggattcctcaccttaggcctactgagtacaaaagatccagattatccaggaacaggagaaccgtgaaccgtccttatggtggtgttctatctggcccggctgttagggagaggatcatccgcgcattccttgtggaagagcaaaagatcgtgaagaaggttctgaagatccagaagaccaaggagaagcaaccagcaaagtaaaatggccgaggccctttatactcgtggaattttttggaggacagatggtgatcagtgctgagtcaagcctgctcagctggtggcttctgaattgcgcaagacttcagtccatttttcttgtttggatggtggatctggatatctttacccaatgctattactttgtgtttgacctgagcacttggtttatatatcgcggttttaggattgtgctattttcagtgttttctcgtgaaatgctctgtgcaccattgcgtcttgttggctaaaagaagttatatatggctgctctag

SEQ ID NO: 3340 - DNA, 644 bp, Avena sativa
gcctccgccgccgcctcgctacatcagagagagggagaggaaaagcgcgcggcgtgagaactccagagagggcggcgagatggtgcagcggctgacctaccggaagcggcatagctacgcaaccaagtccaaccagacccgtgtcgtcaagaccccaggtgggaagcttgtgtaccagtacaccaagaagcgggcgagtgggccgaaatgccctgtcaccgggaagaagatccaaggaatcccacacctcagacctactgagtacaagaggtccagattgtcaaggaaccggaggactgtgaaccgtccttatggtggtgttctgtctggtcctgcagtcagggagagaatcatccgggcatttttggttgaggagcagaagattgtgaagaaggtgctgaagatccagaagaccaaggaaaagaccaccaagagctaaactgttgtgccgagataggcattcccgtgatgttttgagttcctttgaatttgtttttaagcaatcaagaaaattttctctttggatattgggaatcctggctctagtttgcctgctagtatgtgagattgatgatgtggttctcaagattttgcgcggtagttatctatgaatgattaacctttgatgactcatttggttttag

SEQ ID NO: 3341 - DNA, 678 bp, Avena sativa
ggccgccgcctcgctacatcagagagagggagaggaaaagcgcgcggcgtgagaactccagagagggcggcgagatggtgcagcggctgacctaccggaagcggcatagctacgcaaccaagtccaaccagacccgtgtcgtcaagaccccaggtgggaagcttgtgtaccagtacaccaagaagcgggcgagtgggccgaaatgccctgtcaccgggaagaagatccaaggaatcccacacctcagacctactgagtacaagaggtccagattgtcaaggaaccggaggactgtgaaccgtccttatggtggtgttctgtctggtcctgctgtcagggagagaatcatccgggcatttttggttgaggagcagaagattgtgaagaaggtgctgaagatccagaagaccaaggaaaagaccaccaagagctaaactgttgtgccgagataggcattcccgtgatgttttgagttcctttgaatttgtttttaagcaatcaagaaaattttctctttggatattgggaatcctggctctagtttgcctgctagtatgtgagattgatgatgtggttctcaagattttgcgcggtagttatctatgaatgcttaacctttgatgactcatttggttttggttactcttctgcttgggcgcacaatggcgtatatcttac

SEQ ID NO: 3342 - DNA, 653 bp, Papaver somniferum
ttctctttcacattttccagagcggcgatagaaaaaccctaatccaggagtaagtagatcgaagaagaagaagaagatggttcagaggcttatttaccgatcaagacacagttatgccaccaaatccaaccaaaacagggttgtcaaaacccctggtggaaacaatgtttaccagaggactaagaagagggcaagtggacctaagtgccctgttactggaaagagaatccaagggattcctcacttgaggcctgcagagtacaagaggagtaggctctccaggaacagaaggactgtcaaccgtgcttatggtggagttttatctggaagcgcagtcagagaaaggattatccgtgctttcttggttgaggagcagaagattgtcaagaaggttttgaagatccagaaacagaaggagaaggttgctggaaagagctagatttgtgagaactttttcggagttatattagctgaaagaaatttcagactttcaagtagattatgatgatgatgatttgtgacagaaatatgggtttaaaatgttggtaccttttcaatagtattttcagttttctttttgagttttaattccaaatacttctgagctcttctatcattaatatctatgacaaatccatcatcaggattacgac

SEQ ID NO: 3343 - DNA, 638 bp, Rosa hybrid cultivar
gaatcgagaggaagagagtcgactgcgaagatggttcagcgtctcgtgtatcgctcgcgtcacagctacgccaccaagtccaaccagcacaggatcgtcaaaacccctggagggaagctagtgtaccagacctctaagaagagggcaagcggacccaagtgtcctgttactggcaagaggattcaagggatccctcatttgaggcctgctgaatacaagaggtctagactgtctaggaatcggaggactgtcaaccgtgcttatggaggagtattgtctggagctgccgtcaaggagaggattatccgcgcctttttggttgaagaacaaaagattgtgaaaaaggtgttgaagattcagaaggctaaggaaaagctatctgccaagcactgagcttgaatgaagagtctagcgagttttaagtagcttctagagtgattttggctattagtgggctatggaaagtagttggaggtgttccaatttctttttctgtgttttggtactgctgatttatgttataatgttgagtacattttcgttgagaaatccactgccttgaatttgcttgttgtctttcggtggtaaggtatacgtttcaatttgttgtgtaatgacagatcagtagtgtttccttc

SEQ ID NO: 3344 - DNA, 840 bp, Sorghum bicolor
gggccaaccatttatacccctatcgccctcccttccttcccctacccacgcacgcagcctcactagggttttatcggcggcggcggcgagatggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgctttcttggttgaggaacagaagattgtcaagaaggtcctgaaaatacagaaaaccaaggacaagacagctgcaaaatagagctccaggaatggaagcctagcactgttttgtacactgcgaaaagtatttttggtggatggaaaatctagttgccttgtgttgagcatttagcatgtgagacatacctgttgaagtgttgagtttagagagtctggacactggaatatccctttcacctttgaattgttggaatattgggacatctgttccccaagttgctttgttatgaattcagaccatatctgggtaagatcagcttgtcgaataccttgtggcttgtagcaactttttcgtccatgttgcttcttgttgctcttcatttccattctatttcttgcacaaccattgacccttgttgtattgctggtataaacaaaattcttaatcaccatttgattgtttgatcaa

SEQ ID NO: 3345 - DNA, 872 bp, Sorghum bicolor
ccaatcaatcccagccgtccgctccccgtcgcctcccgggccaaccatttatacccctatcgccctcccttccttccccaacccacgcacgcagcctcactagggttttatcggcggcggcggcgagatggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgctttcttggttgaggaacagaagattgtcaagaaggtcctgaaaatacagaaaaccaaggacaagacagctgcaaaatagagctccaggaatggaagcctagcactgttttgtacactgcgaaaagtatttttggtggatggaaaatctagttgccttgtgttgagcatttagcatgtgagacatacctgttgaagtgttgagtttagagagtctggacactggaatatccctttcacctttgaattgttggaatattgggacatctgttccccaagttgctttgttatgaattcagaccatatctgggtaagatcagcttgtcgaataccttgtggcttgtagcaactttttcgtccatgttgcttcttgttgctcttcatttccattctatttcttgcacaaccattgacccttgttgtattgctggtataaacaaaattcttaatcaccatttgattgtttg

SEQ ID NO: 3346 - DNA, 713 bp, Saccharum officinarum
tatacccctatcgccgccgccgcggagctctccccctcctcttgcccttccttcccccacccacgcagcctcactagggttttatcggcggcggcggcgcgatggtgcagcgcctcacctaccggaagcgtcacagctacgcgaccaagtccaaccagacccgggtcgtcaagaccccaggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggaccgtgaaccgtccttatggtggagtactctctggaattgctgttagggagagaatcatccgtgctttcttggttgaggagcagaagattgtcaagaaggtcctgaaaatacagaaaaccaaggacaagacagctgcaaagtagagctccagggatggaagcctagcactgttttgtacactgcgaaaagtaattttggtggatggaaaatctagttgccttgtgttgagcatttagcatgtgagacatacctgttgaagtgttgagtttagagagtctggacactggaatccctttcacctttgaattgttggaatatcgggacatctgttcccctagttgctttgttatgaattcagaccatatctgggtaaagatcagcttgtcgaatacctt

SEQ ID NO: 3347 - DNA, 803 bp, Panicum virgatum
gggagctcacgcgcccagggtttcagccgccgccgcgcccgagcagagagagagagggaggggggagagggaggtcgacgccatggtgcagcggctcacgtaccggaagaggcacagctacgccaccaagtccaaccagaccagggtcgtcaagaccccaggagggaggctcgtgtaccagtacaccaagaagagggcgagcgggcccaagtgccccgtcaccggcaagaagatccaggggatacctcatctaaggcctgctgagtacaagaggtccagattatccaggaacaggaggaccgtgaaccgtccttatggtggtgttctatctggtcaggctgttagggaaaggatcatccgtgctttccttgttgaggagcaaaagatcgtgaagaaggttctgaagatccaaaagaccaaggagaagacaacttcaaaatgagacagccaaagctctctgcactcttgaggactttttggaggacaatggtgatagatgcttagtaaaaaatctctatctgtatgctaggctggtggtttctgaattctgaatctagctagagattgcaatcaattttccatgttgtctggttggaagtctagacatcttccatgttacttgtcgttggctactctaaattatatatccacagattttctatgcctgagcattatttgtgtcaggttgctctttggtgtggttttctggtggtctatccgcgaaactctccttgtgagcaacgtaatgtttggatttagcccacgccaaatgaagagattgaaaagcgcagggtatgattttc

SEQ ID NO: 3348 - DNA, 688 bp, Panicum virgatum
gaagtttactcgccccagcgtttcagccgccgccgcccccgcgccccgagcagagactgagagagggagggggagagagaggtcgacgccatggtgcagcggctcacgtaccggaagcggcacagctacgccaccaagtccaaccagaccagggtcgtcaagaccccaggagggaggcttgtgtaccagtacaccaaaaagagggcgagcgggcccaagtgcccggtcaccggcaagaagatccaggggatacctcacctaaggcctgctgagtacaagagatccagattatccaggaacaggaggaccgtgaaccgtccttatggtggtgttctgtctggtcaggctgttagggaaaggatcatccgcgctttcctggttgaggagcaaaagatcgtgaagaaggttctaaagatccaaaagaccaaggagaagacaacttcaaaatgaggcagccaaagctctctacacccttgaggactttttggaggacgatggtgatggatgtttagtaaaaaaatctctatctgtatgctaggctggtggtttctgaatttgaatctagctagagattgcgatcaattttccatgttgtcgagttggaagtctagacatcttccatgttccttgtggttgtctactctaaattatatatccacagattttctctgtctgggcattatttgtg

SEQ ID NO: 3349 - DNA, 668 bp, Thellungiella halophila
aatcggccatcacgctgctccgtcaagctgaggaggataaaacccataggaggagaaaggagtgtgtgagcaagcgaagtagcgaaaatggtgcagcgtcttgtttaccgttcgcgtcacagctacgccaccaaatcgaaccagcacaggatcgtcaaaaccccaggtggtaaattgacgtaccagaccacgaagaagagagccagtggaccgaaatgccccgtgaccggcaagcgtattcagggtatcccacacttgaggccttctgagtacaagagatcccgattatccagaaacaggaggaccgtgaaccgtgcttatggtggagttttgtccgcctctgctgttagagaaagaatcatccgtgctttccttgtggaggagcaaaagattgtgaagaaggttttgaagctgcaaaaggccaaggaaaaggttgctcccaagagctagattcctaatagtttttcttaaaaatgtttttgtggcgctctgttctctagcgaatagtttactggttgcaaagtttgggagaaacattgtgtactcgttccaaaattcttaagctttttgtattcgtttttccttcttgactctgccgacatttcgcttgcccttcggttttgctttctcgtttaatttctgagtaaatcgatactcattttattgac

SEQ ID NO: 3350 - DNA, 732 bp, Triticum aestivum
tcggcgccgcctcgttacagacagcgggagcgaaagagcgagcggcgagagaactccgggagagggcggcgagatggtgcagcggctgacataccgaaagcgccacagctacgccaccaagtcgaatcagactcgcgtcgtcaagaccccaggtgggaagcttgtctaccagtacaccaagaagcgggcgagtgggccaaaatgcccggttaccggcaagaagatccaaggaatcccacacctgaggcctactgagtacaagaggtccagattgtcgaggaacaggaggactgtgaaccgtccttatggtggtgttctgtctggtcctgcagtcagggagaggatcattagggcgtttttggtggaggagcagaagattgtgaagaaggtgcttaagatccagaagaccaaggagaagaccaccaagagctaaacaactgggcgagataggcgtcgcggtgatgttttgtgtttctccgaatttgttttaagcaatcaagaattttctctcttgggatttgcagaatcctggttctagtatgtgaggtttgatgtgcttctctagattttgcgcctggttctctatggatgcttagcctttgatgcaagagcttttgggctccaattcggcttagatgctcttgagctgcttagctcagttaacgctgtcaggctttatttgtcacacgagaacagtttgctgcaccctattctgctttcacgcattttgga

SEQ ID NO: 3351 - DNA, 818 bp, Triticum aestivum
cgtcgagaaccgattgctcgtccagggttttagccgccgccgccgccgcccccgccccagcccccccccacagagagaagcgagcgacagcgaggtcgacgccatggtgcagcgcctgacgtaccggaagcggcacagctacgccaccaagtccaaccagaccagggtcgtcaaaaccccaggagggaggcttgtgtaccagtacaccaagaagagggcgagcgggccgaaatgtccggtcaccggcaagaagatccaggggatacctcatctaaggcctactgagtacaaaagatccagattatccaggaacaggagaacagtgaaccgtccttatggtggtgttctatctggtcaggctgttagggagaggatcatccgtgctttccttgtcgaagagcaaaagattgtgaagaaggttttgaagatccagaagaccaaggagaagcagccatcaaagtgaaatggccgaggcttttttttggaggacagatggtgatgagtgttcagtcaagcctgcgcagtatgctaagcccgtggttactgaattaagctagagatttccgtccattttcttgttccgagggtggatctggatctcattacccgtatgctattactttgtgtttgacggtttgacctgagtacttggttatattacagttttggataccctttgcagtattgttcgtggatttctactgcaagctgcagtattttctggcaatatttgaagattcttgatgcagcgttgtagctaatttgctattcaaaacctataaccgagtacatctgcttgcacagcaacaaaaaaaaaa

SEQ ID NO: 3352 - DNA, 616 bp, Triticum aestivum
agggttttatcggcggcggcggcgatatggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgccttcttggttgaggaacagaagattgtcaagaaggtcctgaaaatacagaaaaccaaggacaagacagctgcaaaatagagctccaggaatggaagcctagcactgttttgtacactgcgaaaagtatttttggtggatggaaaatctagttgccttgtgttgagcatttagcatgtgagacatacctgttgaagtgttgagtttagagagtctggacactggaatatccctttcacctttgaattgttggaatattgggacatctgttccccaagttgctttgttatgaattcagaccatatctgggt

SEQ ID NO: 3353 - DNA, 679 bp, Zostera marina
gggggccttcttcccattctaatttctctccttcgaccgtcccctccgctcgccgctaccaccatagccgaagatggtgcaaagacttacctatcggaagcgacacagttatgctaccaagtctaatcaaacccgagttgtaaaaacccctggtggtaagttggtttaccagaatactaagaagcgggcaagtggaccaaaatgtccagtcactgggaagagaattcagggaattcctcatttgagaccaactgagtacaagagatctagattatctaggaacaggagaacagttaatcgagcctatggtggagtgctctctggaaatgctgtaagagaaagagttgtccgagcttttctcattgaggaacaaaaaattgtcaagaaagttttgaagatccaaaagaccaaggaaaagcaatcaaagaattaatcaatgggtagaagcatcatccattaccatcatgattttgagtgttttcatttgtcagtcattgtctcaaggatttttgaagctgtctttgaaagctttttattagtatgtttcttttctttgtttatctggtttatgttgagacttgagattataatatgtcattctgtttattttttctagtttggtttttccttatatttatgtatttgtctgataatattgaattgttgatacctttttcta

SEQ ID NO: 3354 - DNA, 591 bp, Brassica napus
ttgcacagatagtgcatgctcttttggtctctattgcttggaccttctcgctccgtcaagccaaaaaccctgagaggagagtgtgtgtgagaatcggagaaaatggtgcagcgtcttgtctaccgttcccgtcacagctacgccaccaaatccaaccagcacaggatcgtcaagaccccaggtggtaaattgacataccagaccactaagaagcgtgcaagtggacccaagtgccccgtcaccggcaagcgtattcagggtatccctcacttgaggcctgctgagtacaagagatcccgattgtccagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagtacttttttttaaaaactattgtctacttgcctaaattacttaaaacttttagttattcgtttgtcttgtactttgtcgtactatttctactaaattgttttgttattggtttct

SEQ ID NO: 3355 - DNA, 626 bp, Brassica napus
ggagcgaagaagctgcgggaacaaaaaaaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgtcccgttaccggcaagcgtattcagggtatccctcacttgaggcctgctgagtacaagagatctagattgtctagaaacaggaggaccgtgaaccgagcttatggtggtgttttgtctgctttggctgttagagaaagaatcgttcgtgctttccttgtggaggagcagaagattgtgaagaaggtgttgaagctccaaaaggctaaggaaaaggttgcccccaggagctagatgatcatatttgtttctttcggaaaaaaaatgtttaatggatctgttctagcaatagtactggttgcagaatttgagagaaatactttttgttatccgttgagttttgattctgtcgacatttctcaaatattgcgttttgttttctctttcacgtttctacttttaccaacgaagctgcattgtgaattggcttctaccattagtaacatttagaatcagtcattgtccttt

SEQ ID NO: 3356 - DNA, 520 bp, Brassica napus
gccaaaaaccctaagagaagcggagaaaatggtgcagcgtcttgtatatcgttcgcgtcacagctacgccaccaaatccaaccagcacaggatcgtcaagaccccaggtggtaaattgacataccagaccaccaagaagcgtgcaagtggacccaagtgccccgttaccggcaagcgtattcagggtatccctcacttgaggcctgctgagtacaagagatcccgattgtccagaaacagaaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaagcttgctcccaggagctagatcctcttagcttttttaaaacattgtctacttgccaaattttaaaactttttgtattcgtttgcttgactttgtcgacatttctcaaaatgtttggttatggtttctctttcaaatgctgcgtttaac

SEQ ID NO: 3357 - DNA, 452 bp, Brassica napus
ggccaaaaaccctgagaggagagtgtgtgtgagaatcggagaaaatggtgcagcgtcttgtctaccgttcccgtcacagctacgccaccaaatccaaccagcacaggatcgtcaagaccccaggtggtaaattgacataccagaccactaagaagcgtgcaagtggacccaagtgccccgtcaccggcaagcgtattcagggtatccctcacttgaggcctgctgagtacaagagatcccgattgtccagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagctttttttttaaaaactaattgtctacttgccaa

SEQ ID NO: 3358 - DNA, 658 bp, Avena sativa
acgcgaggaagccatttatacccgcagcagccgccacgcgctcgctctcctctttcccaacccttctgcccaagcctcctactaccggcggcggagacgacggcgacatggtgcagcgtctgacctaccggaagaggcacagctatgccaccaagtccaaccagacgcgggtcgtcaagaccccaggtggtaagctcgtgtaccagtacaccaagaagagggctagcggccccaagtgccctgtgaccgggaagaagatccaggggattccccacctgaggcctaccgagtacaaaagatcaaggttgtctaggaaccgcaggactgtcaaccgtccctatggtggagtgctctctggacctgcagttagagaaaggatcattcgtgctttcctggtcgaggagcagaagattgtgaagaaagtcttgaaaatacagaaaaccaaggacaagaccacctcaaagtagagaacttgtttgaaactgaagtgagagactgttatgtaaacaaggaaatatttttgtggatggtgatcatgaatggttttagtcccttctagctaaatgctttagtatgtcgaggagatctgttgaattcagagattgtgagacatttgatacccatttgctattccatttctgaatctcatgttgaattt

SEQ ID NO: 3359 - DNA, 623 bp, Arabidopsis thaliana
atcccctttggccgactcttactgacctcagagctcagcaaaaatggttcaacgtcttgtttaccgatcacgtcactcttacgccaccaagtccaaccaacaccgcatcgtcaaaactcctggtggaaaattgacttaccagacgacgaacaagagagctagtggacctaagtgccctgttactggcaagagaatccaagggattccgcatttgagacctgctgagtacaaaaggtcaaggttggcaaggaacgagaggacagtgaatcgtgcatatggtggtgttctatctggagttgctgttagggagaggatcgtcagggccttcttggttgaagaacagaagattgtgaagaaggttttgaagcttcagaaggcgaaagagaagactgcaccaaagagttagaagaaaactttttggagtcttataagatctatggagaaacttattttgtagggatcgatagacatgagtttttgttcacgaaaaaaagaggcaaatgtttgttttttgataatttctgagttctgttttgttctccattcagattttactttctcaaagtgtctccgtttgtgttcattggtctttttttttttcactggaaatatagatttcattg

SEQ ID NO: 3360 - DNA, 583 bp, Brassica juncea
ggaggataaaaccttgaaaggagcgtaaaaaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgagtacaagagatctagattgtctagaaacaggaggaccgtgaaccgtgcttatggtggtgttttgtctgctttggctgttagagaaagaatcgttcgtgctttccttgtggaggagcagaagattgtgaagaaggtgttgaagctccaaaaggctaaggaaaaggttgcccccaggagctagatgatcatatttgtttctttcggaaaaaaaaatgtttaatggatctgttctagcaatagtactggttgcagaatttgagagatactttttgttatccgtttgagttttgattctgtcgacatttctcaaatattgcgtgttgttttctctttcacgtttctacttttaccaacgaagctgcattgtgaa

SEQ ID NO: 3361 - DNA, 489 bp, Brassica juncea
taaaaccttgaaaggagcgtaaaaatggtgcagcgtcttgtataccgttcgcgtcacagctacgccaccaaatctaaccagcacaggatcctcaaaaccccaggtggtaaattgacataccagaccactaagaagcgtgctagtggacccaaatgccccgttaccggcaagcgtattcagggtatccctcacttgaggcctgctgagtacaagaggtctcgattatcccgaaacaggaggaccgtgaaccgtgcttacggtggagttttgtccgctttggctgttagagagagaatcgtccgtgctttccttgtggaagagcaaaagattgtgaagaaggtcttgaagctccaaaaggccaaggaaaaggttgctcccaagagctagagatcctattttctccttttaattttttttaaaaaatgttgtttgactctgtcctagcaatagttactggttgcagacgttgggagaaacaatatgtgttcg

SEQ ID NO: 3362 - DNA, 635 bp, Brassica juncea
ttgcgaaaatggttcaacggcttgtgtaccggtcacgccactcttacgccaccaaatccaaccaacaccgcatcgtcaaaactcctggtgggaagttgacttaccagacgacgaagaagagagctagtggacctaagtgccctgtcactggcaagagaatccaagggataccgcatctgagacctgctgagtacaagaggtcgaggttgtcaaggaacaggaggacagtgaaccgtgcatacggtggtgttctctctggactagctgttaaagacaggatcgttagggcattcttggtggaagagcagaagattgtgaagaaggttttgaagcttcagaaggctaaggagaagactgcaccaaagagttagatgacttctttttggagagttttgcagtaacattacgagaagtgatgtgggagagaaggttatgtcttgtaagagagatcgatagacttgagtttggttcaccagatttttgtttttgttttaatgtgttttgacttcagttgagattttactttctatgtttgtgtttttcggtttaccattataattcgtcttgccgatatatatttgttaataagctcagaaatataaaataaacatctgaaaatggctcattggacaagc

SEQ ID NO: 3363 - DNA, 557 bp, Brassica oleracea
cctcagcgtgtgagcgaagaagctgcgggaaaaaaaaaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttcaaaaggctaaggaaaaggttgctcccaggagctagatgattcatattagcttcttttggaaaaaaaaaatgtttaatggatctgttctagcaatagtactggttgcagacgttgagagaaatactttttgttatccgttgagttttgattctgtcgacatttctcaaatattgcgttttgttttctcgaag

SEQ ID NO: 3364 - DNA, 560 bp, Brassica oleracea
gacttctcgctccgtcaagccaaaaaccctcaagaggagagtgtgtgagcagcaaaaatggtgcagcgtcttgtataccgttcgcgtcacagctacgccaccaaatcgaaccagcacaggatcgtcaagaccccaggtggtaaattgacataccagaccaccaagaagcgtgcaagtggacccaagtgccccgttaccggcaagcgtattcagggtatccctcacttgaggcctgctgagtacaagagatcccgattgtccagaaacagaaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctcttagcttttttttaaaacactgtctacttgccaaattctaaaactttttgtattcgtttgcttgactttgtcgacatttctcaaatgtttggttatggtttctctttcaaatgctgcgtttaacaaatcacgct

SEQ ID NO: 3365 - DNA, 584 bp, Brassica rapa
gtgtgagcgaagcaggaaaaaatggttcagcgtcttgtataccgttcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgagtacaagagatctagattgtctagaaacaggaggaccgtgaaccgtgcttatggtggtgttttgtctgctttggctgttagagaaagaatcgttcgtgctttccttgtggaggagcagaagattgtgaagaaggtgttgaagctccaaaaggctaaggaaaaggttgcccccaggagctagatgatcatatttgtttgtttcggaaaaaaaatgtttaatggatctgttctagcaatagtactggttgcagaagttgagagaaaatactttttgttatccgttgagttttgattctgtcgacatttctcaaatattgcgtgttgttttctctttcacgtttctacttttaccaacgaagctgcattgtgaattggcttcta

SEQ ID NO: 3366 - DNA, 662 bp, Brassica rapa
ggacttctcgctccgtcaagccaaaaaccctaagaggagagtgtgtgtgtgtgtgagcagcaacaaaaaatggtgcagcgtcttgtataccgttcgcgtcacagctacgccaccaaatcgaaccagcacaggatcgtcaaaacccctggtggtaaattgacataccagaccactaagaagcgtgcaagtggacccaagtgccccgtcaccggcaagcgtattcagggtatccctcacttgaggccggctgagtacaagagatcccgattgtctagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagcttttttttaaaaaaacattgtctacttgccaaattctaaaactttttgtattcgtttgcttgactttgtcgacatttctcaaaatgtttggttatggtttctctttcaaatgctgcgtttaacaattcacgttttctacttatttggtgtttacaatgtgatttacattactcggttaataaaattgtgcaattttaaagcagctttatccgagctag

SEQ ID NO: 3367 - DNA, 606 bp, Brassica rapa
ctcgctccgtcaagccaaaaaccctgagaggagagtgtgtgtgagaatcggagaaaatggtgcagcgtcttgtctaccgttcccgtcacagctacgccaccaaatccaaccagcacaggatcgtcaagaccccaggtggtaaattgacataccagaccactaagaagcgtgcaagtggacccaagtgccccgtcaccggcaagcgtattcagggtatccctcacttgaggcctgctgagtacaagagatcccgattgtccagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagcttttttttaaaaaaacattgtctacttgccaaattctaaaactttttgtattcgtttgcttgactttgtcgacatttctcaaaatgttttgttatggtttctctttcaaatgctgcgtttaacaattcacgttttctacttatttggtgtttacaatgtgatttacattactcgg

SEQ ID NO: 3368 - DNA, 629 bp, Brassica rapa
tgttactcctcatcagagctttgcgaaaatggttcaacggcttgtgtaccggtcacgccactcttacgccaccaaatccaaccaacaccgcatcgtcaaaactcctggtgggaagttgacttaccagacgacgaagaagagagctagtggacctaagtgccctgtcactggcaagagaatccaagggataccgcatcttagacctgctgagtacaagaggtcgaggctgtcgaggaacaggaggacagtgaaccgtgcatacggtggtgttctatctggactagctgttaaagacaggatcgttagggcattcttggtggaagagcagaagattgtgaagaaggttttgaagcttcagaaggctaaggagaagactgcaccaaagagttagatgacttctttttggagagttttgcagtaacattacgagaagtgatgtgggagagaaggttatgtcttgtaagagagatcgatagacttgagtttggttcaccagatttttgtttttgttttaatgtgttttgacttcagttgagattttactttctatgtttgtgtttttcggtttaccattataattcgtcttgccgatatatatttgttaataagctcagaaatataaaataaac

SEQ ID NO: 3369 - DNA, 665 bp, Brassica rapa
gagtgtgtgagcgaagaagctgagcgaagcaggaaaaaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgagtacaagagatctagattgtctagaaacaggaggaccgtgaaccgagcttatggtggtgttttgtctgctttggctgttagagaaagaatcgttcgtgctttccttgtggaggagcagaagattgtgaagaaggtgttgaagctccaaaaggctaaggaaaaggttgctcccaggagctagatgatcatattagcttctttcgggaaaaaaatgtttaatggatctgttctagcaatagtactggttgcagaattggagagaaatactttttgttatccgttgagttttgattctgtcgacatttctcaaatattgcgttttgttttctctttcacgtttctacttttaccaacgaagctgcattgtgaattggcttctattattagtaacatttagaatcagtcattgtccttttgcccaaacgttactgcctgcactttactg

SEQ ID NO: 3370 - DNA, 1163 bp, Hordeum vulgare
cccactcttacccccaagcccccctactgccggcggcggagacgacggaaacatggtgcagcgtctgacctaccggaagaggcacagctatgccaccaagtccaaccagacgcgggtcgtcaagaccccaggtggcaagctcgtgtaccagtacaccaagaagagggcgagcggccccaagtgccctgtgaccgggaagaagatccagggtattccccacctcaggcctactgaatacaaaagatcaaggctgtctaggaaccgcaggactgtgaaccgtccctatggtggagtgctctctggaactgcagtgagggaaaggatcatccgtgctttcttggttgaggagcagaagattgtgaagaaggtgttgaaaatacagaagaccaaggacaagacgacctcaaagtaatctgtttgaaacggaagtgcgaagtgagatggtattctgtaaacaaggaaaatatttttgttggtggttatgatcaatggtttagtcccttctagctaaatgttttagagtacttgaaatccttctgccgctgtgacatcagagattgtgaaacatttgatacccatttgcaatttcatttctgaatgcatgttgaatctacttgagttaaaaaaaaaaaaaaaaaacttcgagggggggccccggtacccaatttcgccctattgggggagtccgaatatacgcccggttacacttgggcccgctctcatgttgaaccggtatctatgtggtgcgagtctttgtcgtcttttatcgtaatttcgtcgtgtgtctgtgatgtagcgtcatctgaccgttggtgtctgcgcttagactctagatgcattatcgagtacgtcctaggttcatgtcgtgagtgcgctttttttttgatcttgctccttcatctcccctcctctccgtcctcctgcttcccccggcccgatttgtgtatgtaagtggtagttatattgggtgttgatttttgctctccgctctcgtggcccctggctggtcgctttctccccccccccccccccttcccgccctgctcccgctcacacgcctccccccgcccgcccctccccgctgcgctcacaccctcccctgccacttctcccgccgtcccctcggggctcccgcccttcaccgcccccccccccccccccct

SEQ ID NO: 3371 - DNA, 684 bp, Hordeum vulgare
ttcggcgccgcctcgttacagacagcgggagcgaaagagcgagcggtgagagaactccgggagagggcggcgagatggtgcagcggctgacataccgaaagcgccacagctacgccaccaagtcgaaccagactcgcgtcgtcaagaccccaggtgggaggcttgtgtaccagtacaccaaaaagcgggcgagtgggccaaaatgcccggttaccgggaagaagatccaaggaattccacacctgaggcctactgagtacaagaggtccagattgtcaaggaaccggaggactgtaaaccgtccttacggtggtgttctgtctggtcctgcagtcagggagaggatcatcagggcgtttttggttgaggagcagaagattgtgaagaaggtgctgaagatccagaagaccaaggaaaagaccaccaagagctaaacaattgtgtgagataggcgtcgtggcgatgttttgtttttcttcgaatttgttttaagcaatcaagaatttttcttgtcggatttgcaaaatcctgattctagcatgtgaggttggtgttgttctctagattttgcgagatggttctctatggatgcttagcctttgatgcaagagcttttgaactccagtttggtttggatgctattgagctgctcagcccagttaacactgtcggatttatctgtcc

SEQ ID NO: 3372 - DNA, 694 bp, Brassica napus
gcgggaaaaaaaaaagaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttcaaaaggctaaggaaaaggttgctcccaggagctagataattcatattagcttcttttggaaaaaaaaaatgtttaatggatctgttctagcaaatggtactggttgcagaagttgagggaaatacttattgttatccgttgagttttgattctgaagacatttctcaaatattgcgttttgttttctctttcacgttatcgtctctcaaatgggaagttaaagctgcttgtctcgtaaggcgcaacagcatcatctatgaggctgcacacaaaataccgacctcaacgctttcatcggttattgtgtctgtaaattttgatactaataattaactaaacttgtttggtg

SEQ ID NO: 3373 - DNA, 719 bp, Brassica napus
actcgaggtgagcgaagaagactagacgggaaaaaaaaaagaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttcaaaaggctaaggaaaaggttgctcccaggagctagataattcatattagcttcttttggaaaaaaaaaatgtttaatggatctgttctagcaaatggtactggttgcagaagttgagggaaatacttattgttatccgttgagttttgattctgaagacatttctcaaatattgcgttttgttttctctttcacgttatcgtctctcaaatgggaagttaaagctgcttgtctcgtaaggcgcaacagcatcatctatgaggctgcacacaaaataccgacctcaacgctttcatcggttattgtgtctgtaaattttgatactaataattaactaaacttgtttggtg

SEQ ID NO: 3374 - DNA, 740 bp, Brassica napus
agatagatacattaggttaaaacaagcctcctcagcgtgtgagcgaagcaggaaaaaatggttcagcgtcttgtataccgttcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgagtacaagagatctagattgtctagaaacaggaggaccgtgaaccgtgcttatggtggtgttttgtctgctttggctgttagagaaagaatcgttcgtgctttccttgtggaggagcagaagattgtgaagaaggtgttgaagctccaaaaggctaaggaaaaggttgcccccaggagctagatgatcatatttgtttgtttcggaaaaaaaatgtttaatggatctgttctagcaatagtactggttgcagaagttgagagaaaatactttttgttatccgttgagttttgattctgtcgacatttctcaaatattgcgtgttgttttctctttcacgtttctacttttaccaacgaagctgcattgtgaattggcttctaccagtagtaaaatttagaattagtcattgtccttttgcccaaatgttactgcctgcactttactgactttctaaatgttaagaacaaccgatgcctaataataaagagaattgtagaagc

SEQ ID NO: 3375 - DNA, 746 bp, Brassica napus
atggacgcctgcggaccggtccggaatttcgggtcgacccacgcgtccgcgaagcaggaaaaaatggttcagcgtcttgtataccgttcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgagtacaagagatctagattgtctagaaacaggaggaccgtgaaccgtgcttatggtggtgttttgtctgctttggctgttagagaaagaatcgttcgtgctttccttgtggaggagcagaagattgtgaagaaggtgttgaagctccaaaaggctaaggaaaaggttgcccccaggagctagatgatcatatttgtttgtttcggaaaaaaaatgtttaatggatctgttctagcaatagtactggttgcagaagttgagagaaaatactttttgttatccgttgagttttgattctgtcgacatttctcaaatattgcgtgttgttttctctttcacgtttctacttttaccaacgaagctgcattgtgaattggcttctaccagtagtaaaatttagaattagtcattgtccttttgcccaaatgttactgcctgcactttactgactttctaaatgttaagaacaaccgatgcctaataataaagagaattgtagaagc

SEQ ID NO: 3376 - DNA, 605 bp, Brassica napus
gacttgctcgctccgtcaagccaaaaaccctaagagaagcggagaaaatggtgcagcgtcttgtatatcgttcgcgtcacagctacgccaccaaatccaaccagcacaggatcgtcaagaccccaggtggtaaattgacataccagaccaccaagaagcgtgcaagtggacccaagtgccccgttaccggcaagcgtattcagggtatccctcacttgaggcctgctgagtacaagagatcccgattgtccagaaacagaaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaagcttgctcccaggagctagatcctcttagcttttttaaaacattgtctacttgccaaattttaaaactttttgtattcgtttgcttgactttgtcgacatttctcaaaatgtttggttatggtttctctttcaaatgctgcgtttaacaattcacgttttctacttatttggtgtttacaatgtgatttacattactcggttaataaattgtgc

SEQ ID NO: 3377 - DNA, 572 bp, Brassica napus
ctgagaggagagtgtgtgtgagaagcggagaaaatggtgcagcgtcttgtatatcgttcgcgtcacagctacgccaccaaatccaaccagcacaggatcgtcaagaccccaggtggtaaattgacataccagaccaccaagaagcgtgcaagtggacccaagtgccccgttaccggcaagcgtattcagggtatccctcacttgaggcctgctgagtacaagagatcccgattgtccagaaacagaaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaagcttgctcccaggagctagatcctcttagcttttttaaaacattgtctacttgccaaattttaaaactttttgtattcgtttgcttgactttgtcgacatttctcaaaatgtttggttatggtttctctttcaaatgctgcgtttaacaattcacgttttctacttatttggtgtttacaatgtgatttacatta

SEQ ID NO: 3378 - DNA, 681 bp, Brassica napus
cctgcggaccggtccggaattccgggtcgacacacgcgtcaagccaaaaaccctgagaggagagtgtgtgtgagaatcggagaaaatggtgcagcgtcttgtctaccgttcccgtcacagctacgccaccaaatccaaccagcacaggatcgtcaagaccccaggtggtaaattgacataccagaccactaagaagcgtgcaagtggacccaagtgccccgtcaccggcaagcgtattcagggtatccctcacttgaggcctgctgagtacaagagatcccgattgtccagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagctttttttttaaaaaacattgtctacttgccaaattctaaaactttttgtattcgtttgcttgactttgtcgacatttctcaaaatgttttgttatggtttctctttcaaatgctgcgtttaacaattcacgttttctacttatttggtgtttacaatgtgatttacattactcggttaataaattgtgcaatttaaggcagcttaatcttagctacctaat

SEQ ID NO: 3379 - DNA, 635 bp, Brassica napus
cctgcggaccggtccggaattccgggtcgacacacgcgtccggccaaaaaccctgagaggagagtgtgtgtgagaatcggagaaaatggtgcagcgtcttgtctaccgttcccgtcacagctacgccaccaaatccaaccagcacaggatcgtcaagaccccaggtggtaaattgacataccagaccactaagaagcgtgcaagtggacccaagtgccccgtcaccggcaagcgtattcagggtatccctcacttgaggcctgctgagtacaagagatcccgattgtccagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagctttttttttaaaaaacattgtctacttgccaaattctaaaactttttgtattcgtttgcttgactttgtcgacatttctcaaaatgttttgttatggtttctctttcaaatgctgcgtttaacaattcacgttttctacttatttggtgtttacaatgtgatttacattactcgg

SEQ ID NO: 3380 - DNA, 824 bp, Brassica napus
atcaacgcagagtacgcggggattccattgtctgttctgttactcctcatcagagctttgcgaaaatggttcaacggcttgtgtaccggtcacgccactcttacgccaccaaatccaaccaacaccgcatcgtcaaaactcctggtgggaagttgacttaccagacgacgaagaagagagctagtggacctaagtgccctgtgactggcaagcgaatccaagggattccgcatctgagacctgctgagtacaagaggtcgaggttgtcaaggaacaggaggacagtgaaccgtgcatacggtggtgttctctctggactagctgttaaagacaggatcgttagggcattcttggtggaagagcagaagattgtgaagaaggttttgaagcttcagaaggctaaggagaagactgcaccaaagagttagatgacttctttttggagagttttgcagtaacattacgagaagtgatgtgggagagaaggttatgtcttgtaagagagatcgatagacttgagtttggttcaccagatttttgtttttgttttaatgagttttgacttcagttgagattttactttctatgtttgtgttttttggtttacaattataattcgtcttgccgataaaaaaaaaaaaaaaagggcgggcgctctataggaatcaagcttagtacgctgcatgcaacgtatagctttttatggtacctaattcaattactggcgcgtttaaacgtctgatgggaaacctgggttcccattaatgctttagaaatcccttttgcagtggtaaacaaaagcccgccgacgcctttcacatggc

SEQ ID NO: 3381 - DNA, 522 bp, Brassica napus
cttcatcagagctttgcgaaaatggttcaacggcttgtgtaccggtcacgccactcttacgccaccaaatccaaccaacaccgcatcgtcaaaactcctggtgggaagttgacttaccagacgacgaagaagagagctagtggacctaagtgccctgtcactggcaagagaatccaagggataccgcatctgagacctgctgagtacaagaggtcgaggttgtcgaggaacaggaggacagtgaaccgtgcatacggtggtgttctctctggactagctgttaaagacaggatcgttagggcattcttggtggaagagcagaagattgtgaagaaggttttgaagcttcagaaggctaaggagaagactgcaccaaagagttagatgacttcttttttggagagttttgcagtaacattacaagaagtgatgtgggagagagggttatgtcttgtaagagcgatcatagacttgagtttgattcaccagatttttgtttttgttttaatgaattttgacttc

SEQ ID NO: 3382 - DNA, 597 bp, Brassica napus
gttctgttactcctcatcagagctttgcgaaaatggttcaacggcttgtgtaccggtcacgccactcttacgccaccaaatccaaccaacaccgcatcgtcaaaactcctggtgggaagttgacttaccagacgacgaagaagagagctagtggacctaagtgccctgtgactggcaagcgaatccaagggattccgcatctgagacctgctgagtacaagaggtcgaggttgtcaaggaacaggaggacagtgaaccgtgcatacggtggtgttctctctggactagctgttaaagacaggatcgttagggcattcttggtggaagagcagaagattgtgaagaaggttttgaagcttcagaaggctaaggagaagactgcaccaaagagttagatgacttctttttggagagttttgcagtaacattacgagaagtgatgtgggagagaaggttatgtcttgtaagagagatcgatagacttgagtttggttcaccagatttttgtttttgttttaatgagttttgacttcagttgagattttactttctatgtttgtgttttttggtttacaattataattcgtcttgccgata

SEQ ID NO: 3383 - DNA, 521 bp, Cleome spinosa
aaaccagaaccctacaagaggaaatttaggaattcggtggaaatggtgcagaggcttacgtatcgtggaaggcatagctttgccacgaagtccaaccagcaccgggtcgtcaaaactcctggtggaaggctggtttaccagacaacgaagaagagagctagtggacccaagtgccctgtcactggcaagaggattcaagggatcccgcatttgaggcctgcagaatacaaggtgtcgagattggcaagaaaccggaggacagtgaaccgtgtttatggtggagtactctctagttctgctgttaaggagaggatcattcgtgcttttctggtggaagaacaaaagattgtgaagaaggttttgaaacttcagaaagccaaggagaagcttgcttccaggagctagatttaaataactgttgctgtctggttttcagattctcttgtcagtacttgccctttaactttgttttcaactcatggctttggcaatttctgcctttatatgatctctcttgctta

SEQ ID NO: 3384 - DNA, 815 bp, Setaria italica
cccctcttccccccccacctccttcccccacgcgcaaccaagcctcactagggttttatcggcggcggcggcgagatggtgcagcgcctcacctaccggaagcgtcacagctacgcgaccaagtccaaccagacccgggtcgtcaagaccccaggtgggaggctcgtgtaccagtacaccaagaagagggcgagcgggcccaagtgccccgttaccgggaagaagatccaggggattccccacttgaggcctgctgagtacaagaggtccaggttgtctaggaaccgcaggactgtgaaccgtccttatggtggagtgctctctggaactgctgttagggagaggatcatccgtgctttcttggttgaggagcagaagattgtcaagaaggtcctgaaaatacagaaaaccaaggacaaggcagccacaaagtagagctcctgaatggaagcgtagcgctgttttgtacactgcgaaaaatatttttggtggatggaaaatctagttgccttttgtgttgaatgtttagcatgtgagagacatacctgtcgagtttagagcgtctggagactgaaatcctcttcacctttcattgtcgaaatatcgggacttctgttcccctagttgctttgttatgaattcaaatgttatctggggtacgatcagcttgtcgaatttaccttctgttttgtagcaatctttttcgtccatgacctgttgctcttctgttctatgccatttcttgcatgaccattgtgcctattttattgctactgtaagcaaaattcttaaccgtttaattgttcaaatcaagc

SEQ ID NO: 3385 - DNA, 906 bp, Setaria italica
atcaagcgaatcgatccgagccgtccgctccccgtggccacgcgagccaaccatttatacccctatcgccgccgccgcgcagccctctcctcccctcttccccccccccacctccttcccccacgcgcaaccaagcctcactagggttttatcggcggcggcggcgagatggtgcagcgcctcacctaccggaagcgtcacagctacgcgaccaagtccaaccagacccgggtcgtcaagaccccaggtgggaggctcgtgtaccagtacaccaagaagagggcgagcgggcccaagtgccccgttaccgggaagaagatccaggggattccccacttgaggcctgctgagtacaagaggtccaggttgtctaggaaccgcaggactgtgaaccgtccttatggtggagtgctctctggaactgctgttagggagaggatcatccgtgctttcttggttgaggagcagaagattgtcaagaaggtcctgaaaatacagaaaaccaaggacaaggcagccacaaagtagagctcctgaatggaagcgtagcgctgttttgtacactgcgaaaaatatttttggtggatggaaaatctagttgccttttgtgttgaatgtttagcatgtgagagacatacctgtcgagtttagagcgtctggagactgaaatcctcttcacctttcattgtcgaaatatcgggacttctgttcccctagttgctttgttatgaattcaaatgttatctggggtacgatcagcttgtcgaatttaccttctgttttgtagcaatctttttcgtccatgacctgttgctcttctgttctatgccatttcttgcatgaccattgtgcctattttattgctactgtaagcaaaattcttaaccgtttaattgttcaaatcaa

SEQ ID NO: 3386 - DNA, 718 bp, Lolium multiflorum
gccagcgtctctagggtttatcagcaagaccatcggcggcggcggcggcggcaagatggtgcagcgcctgacctaccgcaagcgtcacagctacgcgacaaagtcgaaccagacccgggtcgtcaagaccccaggtgggaagcttgtgtaccagtataccaagaagagggctagcggacccaagtgccccgtcactggaaagaagatccagggaattccacacctgaggccaacagagtacaagaggtcaaggttgtctaggaaccgcaggactgtgaaccgtccttatggtggagtgctttcaggacctgctgttagggagaggatcattcgtgctttcttggtcgaagagcagaagattgtcaagaaggtcctgaaaatccagaaaaccaaagacaagacagccacaaagtagagctcctctgagaaggatgcacactgctgttttgtgcaagtgaaaagtatttttgatggtgatgaaaggatctagttgcctcttgtgaaatgtagcatgtgagtttagggtgtttcaaatccttttacctcttgttatcgggacatctgatcccctagttgatttgtcattgattctgatcttgtctttgaaccataagttagtcaaatctgccgacttgtttgttgcgatctcttcattcgtgacataccccctcatttaccgtttctgttaatgtatcctgggaattttgttgcactgttg

SEQ ID NO: 3387 - DNA, 634 bp, Eragrostis curvula
  misc_feature (633)..(634): n is a, c, g, or t
gccctgtcaattcttcctcacccagcctcactagggtttacaccggcggcggcgacaagatggtgcagcgtctcacctaccggaagcgtcacagctacgcgaccaagtccaaccagacccgtgtggtcaagaccccaggtgggaggctcgtctaccagtacaccaacaagagggcgagcggacccaagtgccccgtgaccgggaagaagatccaggggattccacacctgaggcctgccgagtacaagaggtccaggttgcctaggaaccgcagaactgtgaaccgtccttatggtggagtgctctccggaattgcagtcagggagaggatcatccgtgctttcctggttgaagagcagaagattgtcaagaaggtcctgaaaatacagaaaaccaaggacaagacagccacaaagtagagcttctgaaatggaagcataacgctgttttgtacacaacgaaaagtaattttgatggtggatgttggaaaatctagtggcctccgttaaatgtttagtatgtgagagacatacttgttgcatttagagtgcttcagacccttgtaccttttgttggagtaccatgacatcagttcccctagttgttttgttatgaattcagattgcattatcnn

SEQ ID NO: 3388 - DNA, 858 bp, Zea mays
catcgagccaatgaatctagccgtccgctccctgttgccccccaagccaaccatatccactctcggcggcgccgcgcatctctcctctcttcttgcccttccttccccccaggccccaacccacgcagcctcactaggggtctaccggcggcggcaacgagatggtgcagcgcctcacctaccgaaagcgtcacagctacgcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaggtccaggttgtctaggaaccacaggactgttaaccgtccttatggtggagtactctctggaattgctgttagggagagaattatccgtgctttcttggttgaggagcagaagattgtcaagaaggtcctgaaaatacagaaaaccaaggacaagacagctgcaaagtagagctccaggaatggaatggaagcctagacactgcgagaagtaattttggtggatggaaaatatgtttgccttgtgtcgagcatttagcatgtgagacatgcctgttgaagtgtttgagtttagagaccggaatccctttcacctttgaattgttgctatgtcgggacatctgctcccctagttgctttgttatgaattgagatcatatctgggtaagataatcttgtctaacaccttggcttgtagcatctttttcgtccatgttgcttttcatttccatctgattttttacacaaccactgtgtctgggttattgctaggatcgacaatattcttg

SEQ ID NO: 3389 - DNA, 1200 bp, Zea mays
gctggccggcagtgaggtgcgcctggagaaggtggcccccgtagagcctggttacttcggcccggcccattatgtcatcaaacagatccgagccgtccgattcaggttattcctcgcgacacatccatttatacccctgccgccgccactcccattcttctctttctcttagactatctgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcgacagttattatcaatggcttagtctcttctagctgttctattgttcttgtatcttgagcggacaactggtttctagggcaccttgaaatctgtctacgagatctctaagattatgagatgacatatgaccccctattgcttttgttcactttgctaaaactgaaagtccgagttcacatgagttgggcatcagttggtgtttatttcctgcttgttgggtcttgcgtctgaattgggaatcagtttgtgtttatttcctacttgttgcatttagttcttattccaatttgtctggctgtgggttaagtttggaatatgtttcatcgttactagaggtgtcagtgggattttctctattaggcctcctttggtagccatggatcctggaaggattctggcctgttccctagccttgaaatccacgggtccaatttccttggggcaaatacaaaatgtatttggtgtcacacgcctcccggcccaatccgtgggggaagagtgggcttttgcccccggcctcataacgtcgggtaggttttccccgactt

SEQ ID NO: 3390 - DNA, 1239 bp, Avena sativa
gctctttcccaacccttctgcccaagcctcctactaccggcggcggagacgacggcgacatggtgcagcgtctgacctaccggaagaggcacagctatgccaccaagtccaaccagacgcgggtcgtcaagaccccaggtggtaagctcgtgtaccagtacaccaagaagagggctagcggccccaagtgccctgtgaccgggaagaagatccaggggattccccacctgaggcctacggagtacaaaagatcaaggttgtctaggaaccgcaggactgtcaaccgtccctatggtggagtgctctctggacctgcagttagagaaaggatcattcgtgctttcctggtcgaggagcagaagattgtgaagaaagtcttgaaaatacagaaaaccaaggacaagaccacctcaaagtagagaacttgtttgaaactgaagtgagagactgttatgtaaacaaggaaatatttttgtggatggtgatcatgaatggttttagtcccttctagctaaatgctttagtatgtcgaggagatctgttgaattcagagattgtgagacatttgatacccatttgctattccatttctgaatctcatgttgaatttgcaaaaaaaaaaaaaaaagggcggccgcacctttcctggcctatttcatcgatgaaaggtggcacgggaaacttacccgggcaagggtggattggtcttcaggggcgatatcgctgcgctggtttattcaagagatatacatccctatgccacgaagctactcgccgctctaggtcttccttatttgctcgccgaggggttcttcccaagactaggctaccctgccgccgtgaactcagcagtctaccgtttcgcgtggttgggctgcgtcagctgctgcgtggtcttctatctcggcaaggtgttgtgcgtcaagatccacgactctatcagggatgaccactatatcatcggcgagagcttgcaagacgtcaccgaaacagtagctgaagattctcctgtctcttgaggactttttttgtagtatagctagtcacttcggacaaggattgggcgagtgatattaccagtttgttaggatgcaaacgcgaaggaatatataggtcgtgttactgacaggaaagatgtgaatgagttttttttttgaacattcagatgtgaatgagatgattacaaacagataaatttctggcgaaacttgtaaatatcagtctgtgattttctgtggc

SEQ ID NO: 3391 - DNA, 805 bp, Avena sativa
ctccttccccacccagcatctctagggtttatcgacgagaccatcggcggcggcggcaagatggtgcagcgtctgacttaccggaagcgtcacagctacgcgacaaagtcgaatcagacccgggttgtcaagaccccaggtggaaagcttgtttaccagtacaccaagaagagggctagcgggcccaagtgccccgttactgggaagaagatccagggaattcctcacctgaggcctactgagtacaagaggtcaaggttgtctaggaaccgcaggaccgtgaaccgtccttacggtggagtgctttctggacctgctgttagggagaggatcattcgtgctttcttggtcgaagagcagaagattgtcaagaaggtcctgaaaatccagaaaaccaaagacaagacagccacaaagtagagctcctctgaaaatggatgctcactgctgttttgtacacagtgaaaagtatttttgatggtggtgatgaaaggatctagttgcctcgtgtgaaatgtagcatgtgagtgtagggtgttccaaatccttttacctcttgttatcgggacatctgatcccctagttgatttgtcctcagactctgaatcatgtctttgaaccataagctagacaaatgtgccagagttgtttgttgcactatcttccttaatgacatactccctcatttatgtcctattcacatatcctgggaattttgttgtactgcttgacagtgatcagtgattgggctactgttatgttttgtttgtttgtgacctggttgacaaaaataaacctgattgcc

SEQ ID NO: 3392 - DNA, 778 bp, Avena sativa
tttatcgacgagaccatcggcggcggcggcaagatggtgcagcgtctgacttaccggaagcgtcacagctacgcgacaaagtcgaatcagacccgggttgtcaagaccccaggtggaaagcttgtttaccagtacaccaagaagagggctagcgggcccaagtgccccgttactgggaagaagatccagggaattcctcacctgaggcctactgagtacaagaggtcaaggttgtctaggaaccgcaggaccgtgaaccgtccttacggtggagtgctttctggacctgctgttagggagaggatcattcgtgctttcttggtcgaagagcagaagattgtcaagaaggtcctgaaaatccagaaaaccaaagacaagacagccacaaagtagagctcctctgaaaatggatgctcactgctgttttgtacacagtgaaaagtatttttgatggtggtgatgaaaggatctagttgcctcgtgtgaaatgtagcatgtgagtgtagggtgttccaaatccttttacctcttgttatcgggacatctgatcccctagttgatttgtcctcagactctgaatcatgtctttgaaccataagctagacaaatgtgccagagttgtttgttgcactatcttccttaatgacatactccctcatttatgtcctattcacatatcctgggaattttgttgtactgcttgacagtgatcagtgattgggctactgttatgttttgtttgtttgtgacctggttgacaaaaataaacctgattgcc

SEQ ID NO: 3393 - DNA, 676 bp, Pseudoroegneria spicata
ctcgttacagacagcgggagcgaaagagcgagcggtgagagaactccgggagagggcggcgagatggtgcagcggctgacataccggaagcgccacagctacgccaccaagtcgaaccagactcgcgtcgtcaagaccccaggtgggaggcttgtgtaccagtacaccaagaagcgggcgagtgggccaaaatgcccggttaccgggaagaagatccaaggaattccacacctgaggcctactgagtacaagaggtccagattgtcaaggaaccggaggactgtgaaccgtccttatggtggtgttctgtctggtcctgcagtcagggagaggatcatcagggcgtttttggtcgaggagcagaagattgtgaagaaggtactgaagatccagaagaccaaggagaagaccaccaagagctaaacaattgtgcgagataggctgtcgccgtgatgttttgtgtttctttgaatttgttttaagcaaccaagaattttctctcttcggatttgcagaatcctggttctagtatgcgaggttgatgtggttatctagattttgcgagctggttctctatggatgcttagcctgatgcaagagcttgtggactccaattcggcttagatgctcttgagctgcttgccccatttaatgcttttggatttaaaaaaaaaaa

SEQ ID NO: 3394 - DNA, 367 bp, Senecio madagascariensis
gagaagaggaagagaaaataatcgattccaaaaatggtgcaacgtttgacttaccggaaacgacatagctatgctactaaatccaaccaacacagggttgtcaaaacccctggtggtaagttggtttaccagactactaagaagagagctagtggacctaaatgccctgttactggcaaaagaatccaagggattcctcacttgaggccaactgaatacaaaaggtccaggctatcaaggaacaggaggacagttaaccgtgcctatggtggtgtgctatctgccggtgctgtgcgtgagaggatcatccgagctttcttggttgaagagcaaaagatcgtgaagaaggttctcaagatccaaaaga

SEQ ID NO: 3395 - DNA, 821 bp, Sorghum bicolor
atacccccttgccgccgccacgccctcgcttctcgttctcctagcctctctgctccagcctcccattagggtttatccaccggcggcgcgcgcgacggcggcaagatggtgcagcgtctgacctaccgcaagcggcacagctatgccacaaagtccaaccagacgcgggtcgtcaagacccctggtggtaagctcgtgtaccagtacaccaagaagagagccagcgggcccaagtgccccgtgaccgggaagaagatccaggggattccccatcttaggcctgctgagtacaaaaggtccaggttgtctaggaaccgcagaactgtgaaccgcccatatggtggagtgctctctggaactgcagttagagaaaggatcatccgtgctttcctggttgaagagcagaagattgtcaagaaggtgttgaaattacagaagaccaaagacaaaacttcctcaaagtaactctgaaacagaagtgaaccactcttctgtaaacaagggaagatatttttgtcgatggtgatgatcaatgaagtagtctcttctagctgtgttctagtatgtcttgagccgacaactgtttctagggtaccttgaaatctgtctaccattgtggtgtcaaagattatgagatgacatatgatccccatgttgcttttgttcacttcgctaaaactgcaagtctgagttcatatgagttgggcttcagttggtatttatttcctgcttgttgcaaatagctgttattccaatttgtctgtgggataagtttgcaatactatcgtccacctgtctcagacggtgattgctagtcctta

SEQ ID NO: 3396 - DNA, 899 bp, Sorghum bicolor
atttatacccccttgccgccgccacgccctcgcttctcgttctcctagcctctctgctccagcctcccattagggtttatccaccggcggcgcgcgcgacggcggcaagatggtgcagcgtctgacctaccgcaagcggcacagctatgccacaaagtccaaccagacgcgggtcgtcaagacccctggtggtaagctcgtgtaccagtacaccaagaagagagccagcgggcccaagtgccccgtgaccgggaagaagatccaggggattccccatcttaggcctgctgagtacaaaaggtccaggttgtctaggaaccgcagaactgtgaaccgcccatatggtggagtgctctctggaactgcagttagagaaaggatcatccgtgctttcctggttgaagagcagaagattgtcaagaaggtgttgaaattacagaagaccaaagacaaaacttcctcaaagtaactctgaaacagaagtgaaccactcttctgtaaacaagggaagatatttttgtcgatggtgatgatcaatgaagtagtctcttctagctgtgttctagtatgtcttgagccgacaactgtttctagggtaccttgaaatctgtctaccattgtggtgtcaaagattatgagatgacatatgatccccatgttgcttttgttcacttcgctaaaactgcaagtctgagttcatatgagttgggcttcagttggtatttatttcctgcttgttgcaaatagctgttattccaatttgtctgtgggataagtttgcaatactatcgtccacctgtctcagacggtgattgctagtccttattcctttgtcttggcagtctccagaatacgtttcatggtagggagtttgcggagtcaagtcaacacatgtaggc

SEQ ID NO: 3397 - DNA, 760 bp, Saccharum officinarum
aggggcttctctttctcctcctagcctctctgctccagcctcccactagggtttattcaccggcggcgcgcgcgacggcggcaagatggtgcagcgtctgacctaccgcaagcggcacagctatgccacaaagtccaaccagacgcgggtcgtcaagacccctggtggcaagctcgtgtaccagtacaccaagaagagagccagcggccccaagtgccctgtgaccgggaagaagatccaggggatcccccatctgaggcctgctgagtacaaaaggtccaggttgtctaggaaccgcagaactgtgaaccgtccctatggtggagtgctctctggacctgcagttagagaaaggatcatccgtgctttcctggttgaagagcagaagattgtcaagaaggtgttgaaactacagaagaccaaagacaagacttcctcaaagtaactctgaaacagaagtgatccactcttctgtaaacaagggaagatatttttgtcgatggtgatgatcaatggcttagtctcttccagctgtgttctagtatgtcttgagccgacaactgtttcttgggtaccttgaaatctgtctaccattgtgatgtcaaagattatgagatgacatgatccccctgttgcttttgttcactttgctaaaactgcaagtctgagttcacatgagttgggcttcagttgttgtttatctcctgcctgttgcaaatagctcttattctaatttggctgattgggggataagtttgcc

SEQ ID NO: 3398 - DNA, 864 bp, Panicum virgatum
gctctcctctcctcctcctcccgcccttccttccccaacccctcgcgccggcacccagcctctctagggttttgtcgggcggcggcggcggcggcggcgagatggtgcagcgcctcacctaccgaaagcgtcacagctacgcgaccaagtccaaccagacccgggtcgtcaagaccccaggtgggaggcttgtgtaccagtacaccaagaagagggcgagcgggcctaagtgccccgtcaccgggaagaagatccaggggatcccccacttgaggcctgctgagtacaagaggtccaggttgtctaggaatcgcaggactgtgaaccgtccttatggtggagtgctctctggaactgctgttagggagaggatcatccgtgctttcttggttgaggagcagaagatcgtcaagaaggtcctgaaaatacagaaaaccaaggacaagacagccacaaagtagagctcctggaatggaagcgtagctgttttgtacactgcgaaaagtatttttggtggatggaaaatctagttgccttttgtgtgaaatgtttagcatgtgagagacatacctgtcaagtttagagcatctgcagactggagccattttcacctttcattgtctgaatattgggacatctgtaccccttgttgctttgttttgaattcagatcatatctgggcaccatcagcttattgaatttgccttctggtttgtagctatcttttttgttcaggacctgttgctcccccgtttcatgtcatttcttgcatgaccattgtgcctctttttgctactgtaaacgagactattaaccctttgttaaaatcaactgtgcactcttgaaaccattttcttgctttcc

SEQ ID NO: 3399 - DNA, 788 bp, Panicum virgatum
gcccccccttccttccccaacccctcgcgccggcccccagcatcactagggttttgtcggcggcggcggcggcgagatggtgcagcgcctcacctaccggaagcgtcacagctacgcgaccaagtccaaccagacccgggtcgtcaagaccccaggtgggaggcttgtgtaccagtacaccaagaagagggcgagtgggcccaagtgccccgtcactgggaagaagatccaggggatcccccacttgaggcctgctgagtacaagaggtccaggttgtctaggaatcgcaggactgtgaaccgtccttatggtggagtgctctctggaactgctgttagggagaggatcatccgtgctttcttggttgaggagcagaagattgtcaagaaggtcctgaaaatacagaaaaccaaggacaagacagccacaaagtagagttggaatggaagcgccgctgttttgtacactgcgaaaagtatttttggtggatggaaaatctagttgcgttttgtgtgaaatgtttagcatgtgatgtgagagataccttgagtttagagccatctggagactggaatccttttcacctttcattgtctgaatatcgggacatctgcccccctagttgctttgttatgggtaatcagcttgtcgaatttaccttctggtttgtagcaatctttttcatccaggacctgttgctcacccgttccatgccatttcttgcacgacaattgtcctgtttttattgctactgtgaagtttgattgttgaaatcaactgtgcactc

SEQ ID NO: 3400 - DNA, 581 bp, Tamarix hispida
  misc_feature (16)..(16): n is a, c, g, or t
  misc_feature (33)..(34): n is a, c, g, or t
  misc_feature (50)..(50): n is a, c, g, or t
  misc_feature (372)..(372): n is a, c, g, or t
  misc_feature (396)..(396): n is a, c, g, or t
  misc_feature (400)..(400): n is a, c, g, or t
ggggggagagacaagngagggaacgcagagcgnngagagggagctcgtantcagccaaaatggtgcagcgtctcacctaccgtacacgccacagctattctaccaagtctaaccagcataggatcgtgaaaacccctggtggaaagcttgtataccagaccacgaagaagagagctagtggacctaaatgccctgttactggaaagagaattcagggaattcctcatttgagacctgcagagtacaagaggaccaggttacccgaggaacaggcgtactgttaatcgtgcctatggtggtgtactagctgccagtgctgtccgagaaaggattgtccgggccttccttgttgaagagcagaagattgtgaanaaggtcttgaagattcaaaaggcnaaanaaaagcttgctgcgaggagctagaatggcagtgaaacattagttattgttttgagatgaaattttgtttcctttgaaagacatggatttagggagattgttttttgtttgcaagcaatactagctgtattgtttaaattttaatgagcatttttgttcagctttgcttttcccgacaaaaa

SEQ ID NO: 3401 - DNA, 760 bp, Triticum aestivum
ggacccacgcgtcggcgactggagcacgaggaaactgacatggactgaaagagtagaaactctctctccccccactctttgcccaagcccccctactgccggcggcggagacgacggaaacatggtgcagcgtctgacgtaccggaagaggcacagctatgccaccaagtccaaccagacgcgggtcgtcaagaccccaggtggtaagctcgtgtaccagtacaccaagaagagggcgagcggccccaagtgccctgtgaccgggaagaagatccaggggattccccacctcaggcctactgaatacaaaagatcaaggttgtctaggaaccgcaggactgtgaaccgtccctatggtggagtgctctctggaactgcagtgagggaaaggatcatccgcgctttcttggttgaggagcagaagatcgtgaagaaggtgttgaaaatacagaagaccaaggacaagacgacctcaaagtaatctgtttgaaacggaagtgcgaagtgagatggtgttctgtaaacaaggaaaatatttttgttggtggttatgatcaatggtttagtcccttctagctaaatgttttagagtacttgaaatccttctgccgccgtgacatcagagattgtgaaacatttgatacccatttgcagtttcatttctgaatgcatgttgaatctacttatgttaatttggtttcacctggcattcgtggttattgatctataataatctttgagttcctcaaaaaaaaaaaaa

SEQ ID NO: 3402 - DNA, 489 bp, Zostera marina
cccccttttcttgttacagcgggagagatggtgcagagattgacgtacaggaagagacatagctatgcgactaggtctaatcagactcgagttgtgaaaactccgggtggaaagctggtttatcagaatacgaagaagcgagcaagtggacccaaatgcccagttaccggaaagagaatccaaggaattcctcatctgagacccactgaatacaagagatccagactcgctaggaaccgccgaactgtaaaccgtgcttatggtggtgttctgtctggaaatgctgtgagagaaagagtcattcgggcctttttgattgaagagcagaaaatcgtaaagaaggtcttgaagatccagaagacaaaggagaaacagaccaaggcataaaccctaatttatattctatgcattcccaatcaattgtgagttatgatatttttttgacattgaaaccttaatttcttatgttctgttttatcaagtaatgtt

SEQ ID NO: 3403 - DNA, 695 bp, Abies balsamea
ggaagctttaacggaggaagcttcgcaacctttaacagagcaagttttgggtaccaactgagaggaagagatggtgcagaggctgacttaccgcaagcgccatagctatgcgacgaaatctaaccagaccagggttctgaaaactccaggcgggaggttaatatatcagactgcgaagaagagggccagtggacctaaatgccccgttacaggcaagagaattcatgggatcccccatctgaggccagctgagtacaagaggtcaaggcttagcaggaacagaagaactgttaacagagcctatggaggtgttttatctggttcagctgtccgtgaccgaattattcgagcattcttggtagaagagcaaaagattgtcaagaaagttttgaagattcagaagtccaaggaaaaacagactactaggagttagggttaagtgtttacttttttttgtaaaatgcatgtttaccttattgttatagtgatcaaaggctgcaaacaaaggttttgttctttttatttataattaagttcctgttgtgtcaaatgttactgatacatatgaggatattactgttattttgttctttcaatcaagaactggaagctctatttctttgaggcatagtatgcttgttactatgataagtgcttgttttgaccatgcaccggtgagtaaatttgtaattgat

SEQ ID NO: 3404 - DNA, 443 bp, Abies balsamea
tgagagggagagatggtacagaggctgacgtaccgcaagcgccacagctatgcgacgaagtctaaccagacccgggttctgaagactcccggtgggagattgatctaccaaactgcgaagaagagggccagtggacctaaatgccccgttacaggaaagagaattcacgggatcccccatttgaggccagctgagtacaagaggtcaaggcttagcaggaacaggagaactgttaacagagcctatggaggtgttttatctggttcagcggtccgtgatcgaattattcgagcattcctggtagaagagcagaagattgtcaagaaggttttgaagattcaaaagtccaaggaaaaacagactgctaggagttagggttaagatgttcatattttcctcattgttatggtgatcaaaggttgcaaactaaggttttagttcta

SEQ ID NO: 3405 - DNA, 487 bp, Brassica napus
ggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttcaaaaggctaaggaaaaggttgctcccaggagctagatgattcatattagcttcttttaggaaaaaaaatgtttaatggatctgttctagcaatagtactggttgcagacgttgagagaaatactttttgttatccgttgagttttgattctgtcgacattt

SEQ ID NO: 3406 - DNA, 457 bp, Brassica napus
ggttcagcgtcttgtataccgctcgcgtcacagctacgccaccaaatctaaccagcacaggatcgtcaaaaccccaggtggtaagttgacttatcagaccactaagaagcgtgcaagtggacccaaatgtcccgttaccggcaagcgtattcagggtatccctcacttgaggcctgctgagtacaagagatctagattgtctagaaacaggaggaccgtgaaccgagcttatggtggtgttttgtctgctttggctgttagagaaagaatcgttcgtgctttccttgtggaggagcagaagattgtgaagaaggtgttgaagctccaaaaggctaaggaaaaggttgctcccaggagctagatgatcatattagcctactttacgggaaaaaaaatgtttaatggatctgttctagcaatggtactggttgcagaatttgagagaaatacttttgtt

SEQ ID NO: 3407 - DNA, 501 bp, Flaveria ramosissima
gcgtcacagttacgccactaagtccaatcaacatcgagttgttaaaacccctggcggaaagctagtttatcagactaccaagaagagggcaagtggaccaaaatgccctgtcactgggaagagaatccaagggattcctcacttgagacctgctgaatacaagagatcaagattgtctaggaaccgaagaactgttaatcgtgcttatggtggcgtgctttctgcaggtgccgtaagggaaaggatcattagggcctttttggttgaagaacaaaagattgttaaaaaggtgttgaagatccaaaaggcaaaagaaaagactgcatccaaagcttagatttttctgcaatttctcatgagagaatttttgagtgtcaagattttggatctgtaatcgggtcgggtctggttgggctgtttttatgttttatttcttctactttgttatttatgaaaccttgttaaatttgtaggatcatgtttgattcaaatggttttctg

SEQ ID NO: 3408 - DNA, 876 bp, Pinus pinaster
aggaaggttcaaaccggagcatgtttcgagtacgctttaacactgcacccgagatctagggttagggcatgggagtttcagggttagggtttaggatgagcaagtatgagtatcattcgtatctatataggcctcggcaatggcgttgattaacagaacgagctgcggggatgggaaggtattttcgtcgagtgatacttgcgcaggagtaataagttcggccattgaagtccctagtcagctgtgggttagatcacataacgagctttccaagctctgggtaccatttaagagggagagatggtgcagaggctaacgtaccgcaagcgccacagttatgcgacgaaatctaaccagactagagtcttaaaaactccaggtggtaagttaatctaccagactgcgaaaaagagggccagcggacctaaatgccctgttaccggcaagagaattcatgggattccccatctgagacctgctgagtacaagaggtcgaggcttagcaggaaccggagaacagttaacagagcctatggaggcgttttatctggttcagctgtacgtgaccgaattattagagcatttttggtcgaagaacagaagattgtcaagaaggttttgaagatgcaaaagtccaaggagaaacagagtgctaggagctagggttaagatgtgttcattttcctcattgtcatgatggtgatataaggttgcaaacaaatgtttttttcattgaattaaaaatcaagttcagtatgaaatgctactgatacatgtgggcagcctcgtggataatttaataaaaatctgccattttctttaacatggatttgccatattttagttgaagctcattcacggctttcatggtggcga

SEQ ID NO: 3409 - DNA, 611 bp, Brassica juncea
ggaggaagagtgtgagcagcaaaaaggaagcggaggaaaatggtgcagcgtcttgtataccgttcgcgtcacagctacgccaccaaatccaaccagcacaggatcctcaaaacccctggtggtaaattgacgtaccagaccactaagaagcgtgcgagtggaccaaaatgccccgttaccggcaagcgtattcagggtatccctcacttgaggcctgctgagtacaagagatcccgattatccagaaacaggaggacagtgaaccgtgcttatggtggtgttttgtctgctttggctgttagagaaagaatcgtccgtgctttccttgttgaggagcaaaagatagtgaagaaggtcttgaagcttcaaaaggccaaggaaaaggttgctcccaggagctagatccttttagcttttttcaaaaaacattgtctactctgccaaattctaaaactttttgtattcgtttgcttgactttgtcgacatttctcaaatgtttggttatggtttctcttttagatgctgcgtttagcaattcgcgttcctacttgggtgtttacaatgtgatttatattacttggttaataaattgtgcaattcaaagtaaaaa

SEQ ID NO: 3410 - DNA, 660 bp, Brassica juncea
agggaggggagaaagagcggcgaagaaaatggtgcagcgtcttgtataccggtcgcgacacagctacgccaccaaatcgaaccagcaccgcctcgtcaagactccaggaggtaaattggtgtatcaaaccacaaagaagagagccagtggccccaaatgccctgttaccggcaaacgtatccatggaatccctcacttgaggcctacggaatacaagaggtctagattatcaagaaacaggaggaccgtgaatcgtgcctacggtggagtcttgtctgctttggctgtcagggaaaggatcgtacgagcatttcttgttgaagagcagaagatcgtgaagaaagttttgaaactccagaaggctaaggagaaagtagctaccaaggcttgaggggttttatgtttttttccttctttgtatttttgatttttggtctcgaaaggatgcatctttttcaatatcttgtctgtgacattatgaacttcatacatttttacatgtccgagttttctttaaagagttcaaagcagagcttaatattccaacaacaaaagacgaaacatctatgagtgaaaccgaagtcttacagacaaaaaaatcgtgttctttgcagctttgaacacgatttttttatgagtgaaaccgaaagatcggcagag

SEQ ID NO: 3411 - DNA, 572 bp, Brassica juncea
gtggtctgataagtcaacttaccacctggggttgtgagcgaagcagcggagagaaaaaaatggttcagcgtctagtttaccgatcgcgccacagctacgccaccaaatctaaccagcacaggatcctcaaaaccccaggtggtaagttgacttatcagaccactaagaagcgtgcgagtggacccaaatgccccgtcaccggcaagcgtattcagggtatccctcacttgaggcctgctgagtacaagagatctagattatctagaaacaggaggacggttaaccgtgcttatggtggtgttttgtctgctttggctgttagagaaagaatcgttcgtgctttccttgtggaggagcagaagattgtgaagaaggtgttgaagctccaaaaggccaaggaaaaggttgctcccaggagctagatgatcatattagcttcttttgaaaaaaatgtttaatggatctgttctaccaatagtactggttgcagaagttgagagaatacttttttttttttgttatccgttgagttttgttttgattatgtcgacatttctcaaatattatgtttt

SEQ ID NO: 3412 - DNA, 549 bp, Brassica juncea
agtgagggattccatggatacaagagtagaaccctagggaggggagaaagagcggccaagaaaatggtgcagcgtcttgtataccggtcgcgacacagctacgccaccaaatcgaaccagcaccgtatcgtcaaaactccaggaggcaaattggtgtatcaaaccaccaagaagagagccagtggtcccaaatgccctgttacaggcaagcgtatccatggaattcctcacttgaggcccacggaatataagaggtctaggttatcaagaaacagaaggactgttaaccgtgcttacggtggagttttgtctgctttagctgtcagggaaaggatcgtgcgagcattccttgttgaagagcagaagatcgtgaagaaagttttgaaactccaaaaggctaaggagaaagtagctaacaaggcttgagggttttacgttttttttttattttggccttgaaaggatacatctttttcactatcttctctctgacttatgaattacacagatttttacttgtccggctgtcccgagtgtcttttacaattt

SEQ ID NO: 3413 - DNA, 644 bp, Brachypodium distachyon
ctcgcttccctttgccgccgcctcgccacagtaagagagagagagagatcgcacggggcgagaggactcccggagcacgacgtcggcgagatggtgcagcggctgacctaccggaagcggcacagctacgccaccaagtccaaccagacccgcgtcgtcaagaccccgggtgggaagcttgtgtaccagtacaccaagaagcgggcgagtgggccgaaatgcccggtcaccggcaagaagatccaaggaattccccacctgagacctactgagtacaagaggtccagattgtcaaggaaccggaggactgtgaaccgtccttatggtggcgttctgtctggtcctgcagtcagggagaggatcatccgggcgtttttggtggaggagcagaagatcgtgaagaaggtgcttaagatccaaaagaccaaggataagacaaccaaggcctaaacaataccttctgagtttcttccgaatttgtttaagcattcaagaaattttctctctggatttagggaatcctggttcagtatgtgatgttgatgcgattctctagattttgcgtgctagttctctatggatgcttgaccttgatgatcaaaagctattggaattcccatctgttgcggtgctttttcccttca

SEQ ID NO: 3414 - DNA, 573 bp, Brassica napus
ggtcgcaagagaaccccaagaggagaaagagcggcgaagaaaatggtgcagcgtcttgtataccggtcgcgacacagctacgccaccaaatcgaaccagcaccgtatcgtcaaaactcctggaggcaaattggtgtatcaaaccaccaagaagagagccagtggccccaaatgccctgttacaggcaagcgtatccatggaattcctcacttgaggcctacagaatacaagaggtctaggttatcaagaaacaggaggactgtgaaccgtgcttatggtggagtcttgtctgctttggcagtcagggaaaggatcgtacgagcatttcttgttgaagagcagaagatcgtgaagaaagttttgaaactccaaaaggctaaggagaaagtagctaccaaggcttgagggttttacgttttttattttattttggggatacatctttttcacttatctttgtctctgacattataaattacatacatttttacctgtcctagtgtcttttacattttagtttgattgacacttataagtacgtagtgccattgctgatatatagaatgaactcga

SEQ ID NO: 3415 - DNA, 538 bp, Brassica napus
gaagaaaatggtgcagcgtcttgtataccggtcgcgacacagctacgccaccaaatcgaaccagcaccgtatcgtcaaaactcctggaggcaaattggtgtatcaaaccaccaagaagagagccagtggccccaaatgccctgttacaggcaagcgtatccatggaattcctcacttgaggcctacagaatacaagaggtctaggttatcaagaaacaggaggactgtgaaccgtgcttatggtggagtcttgtctgctttggcagtcagggaaaggatcgtacgagcatttcttgttgaagagcagaagatcgtgaagaaagttttgaaactccaaaaggctaaggagaaagtagctaccaaggcttgagggttttacgttttttattttattttggggatacatctttttcacttatctttgtctctgacattataaattacatacatttttacctgtcctagtgtcttttacattttagtttgattgacacttataagtacgtagtgccattgctgatatatagaatgaactcga

SEQ ID NO: 3416 - DNA, 515 bp, Brassica napus
gagggagcggccaagaaaatggtgcagcgtcttgtataccggtcgcgtcacagctacgccaccaaatcgaaccagcaccgtatcgtcaaaactccaggaggtaaattggtgtatcaaaccaccaagaagagagccagtggtcccaaatgccctgttacaggcaagcgtatccatggaattcctcacttgaggcccacggaatataagaggtctaggttatcgagaaacagaaggactgtgaaccgtgcttatggtggagttttgtctgctttagctgtcagggaaaggatcgtgcgagcattccttgttgaagagcagaagatcgtgaagaaagttttgaaactccaaaaggctaaggagaaagtagctaccaaggcttgagggttttacgttttttttattttggccttgaaaggatacatctttttcactgtctcgtctctgacattatgaattacacatatttttacttgtccggatgtccggagtgtcttttacaatttagttttattacg

SEQ ID NO: 3417 - DNA, 486 bp, Brassica napus
ggcggccaagaaaatggtgcagcgtcttgtataccggtcgcgtcacagctacgccaccaaatcgaaccagcaccgtatcgtcaaaactccaggaggtaaattggtgtatcaaaccaccaagaagagagccagtggtcccaaatgccctgttacaggcaagcgtatccatggaattcctcacttgaggcccacggaatataagaggtctaggttatcgagaaacagaaggactgtgaaccgtgcttatggtggagttttgtctgctttagctgtcagggaaaggatcgtgcgagcattccttgttgaagagcagaagatcgtgaagaaagttttgaaactccaaaaggctaaggagaaagtagctaccaaggcttgagggttttacgttttttttatttggccttgaaaggatacatctttttcactgtctcgtctctgacattatgaattacacatatttttacttgtccggctgtccggagtgtc

SEQ ID NO: 3418 - DNA, 729 bp, Gnetum gnemon
cagggttacaggcagcgcaacggctttggttgaagaactatcaggcgaagccgaaggcgaaagcaatctgctagggcaagcaagcaggcaaaatggtgcagagattgacgtaccgcaagcggcacagctatgccaccaaatccaaccagaggcgggttgtcaagactccaggtggaaaattgacgtttcagactgcgaagaagagggcaagtggtccgaaatgccctgtcacaggaaagaggattcacgggattcctcacttgaggacagcggaatattctaggtcaaggcttagcagaagcaggagaactgttaacagggcatatggaggtgtcctatctggcgtagctgttcgcgaaagaattatccgggcatttttggttgaggaacagaagatagtgaagaaagtgcttaagatccagaagatgaaggaaaagcagagtgccaagagttagatgatactttcctcggctcttcttgttttagatgcatttgtggttcttatatatgatgagaaattatggaatggactgcaattggtgttcttttgctaatcctgaatgtaaaattcgttttgcttcttgtgatgcaccagtcaattcgattttatcatgaaaatttaccgttaatgttttcgatacaattgagcttgccattatatgttttcattacgaacagcttatcatttaaaagtttatcagttctcggatggtacattttaatggaaac

SEQ ID NO: 3419 - DNA, 938 bp, Pinus taeda
ggggaacgagctgcggggatgggaaagtattttcgtccagtgatatctgcgcaggagtaataagttcagccattgaagtcctgatcagctgcggggtagatctcagagggagagggagagatggtgcagaggctaacgtaccgcaagcgccacagttatgcgacgaaatctaaccagactagggttttaaaaactccaggcggtaggttaatctaccagactgcgaagaagagggccagcgggcctaaatgccccgttaccggcaagagaattcatgggattccccatctgagacctgctgagtacaagaggtcgagacttagcaggaacaggagaacagttaacagagcctatggaggtgttttatctggttcagctgtccgtgaccgaattattagagcattcttggtggaagaacagaagattgtcaagaaggttttgaagattcaaaagtctaaggagaaacagactactaggagctagggttaagatgtcttcattttccttattgtcatgatggtgatcgaaggcttcaaacaaaggttttgttcgttgaattagaaaccgagttcagtgtcaattgccactactgatacatgtgggcagcctcctgaatagttcaaaaaaaatttaccattttatccttaacatggatttgtcgtgttttagttgatgcttcattaacggctttaatggtgggttgaaggttgtaaccggggattttattcatttttattaaaatcttaagctatcttcttttgctacaaggtctgttcttcacagccaccagatttcgaagaaactgttcaatctgtgtttaatagaaatgatactcaatctgattttgaataaactgttcaatgtgtttaatagaaatgataatctgattttgaataaactgttcaatctgtgtttaatagaaatgataatctgatttg

SEQ ID NO: 3420 - DNA, 531 bp, Populus trichocarpa
attaaactctctgcttttggtcgctgcctctgtgtcactcgtctgcacactacacacgaacacagagactaaagagctgatacgaaaatggtgcagcgacttacgtaccggaagcgccacagctacgctacgaaatctaaccagcaccgcgttgtcaaaacccctggtgggaaattggtttatcaaaccactaagaagagggctagtggacccaaatgtccagttactggaaagaggattcaagggaggtctagattgtctaggaatcgcaggactgttaaccgtgcctatggcggagtcttgtctggaagtgctgttagggagaggattatccgggctttcttggtggaggagcaaaagattgtgaagaaagttctgaagattcagaaggcaaaggaaaaacaagcctcaaggagctagaagaagaagaggtggatgatgttttccgaggtagaggatgattcagcaaaattttgttatgattaacggcattgaaatgtggaattgattattagcttgtttgatacttat

SEQ ID NO: 3421 - DNA, 693 bp, Oryza sativa
agcttccccttcgccgacgccgccgcctcctcgagagagagagagagattgagagagagctccgcgggagagcgcgtcgaagatggtgcagcggctgacctaccggaagcggcacagctacgccacgaaatccaaccagacccgcgtcgtcaagacccccggtgggaggcttgtgtaccagtacaccaagaagcgggcgagcgggccgaaatgcccagtcaccgggaagaagatccaaggaattccacacctgagacctgctgagtacaagaggtccagattgtcaaggaatcgcaggaccgtgaaccgtccttacggtggtgtcctgtctggtactgcagtcagagagaggatcatccgggcttttttggtcgaggagcagaagattgtgaagaaggtgttgaagatccagaagaccaaggacaagtcagctaaatgattgcaagatagagacattgccgcgatgtttaagcttctccaaatttgtttttaagcaatcaagagaatttttcttctggatttgggggaaatcccgtttcctagtgctgctagtatgtgagatcaaatcgacatgattgtttaaattttgagcgctagttctctagagtactactacaaccttgtgtggatcctttgatgcaagttttgaaactcccaagtcccaagtttgcgcaaatgttgttttggcagaaa

SEQ ID NO: 3422 - DNA, 757 bp, Oryza sativa
ctcttcttccacctccacccacccacccacccagcctcgtttctagggtttatcgcggcggcggcggtggcgagatggtgcagcggctcacctaccggaagcgtcacagctacgcgactaagtcgaaccagaccagggtcgtcaagaccccaggtgggaggcttgtgtaccagtacacgaagaagagggcgagcgggccgaagtgccccgtcaccgggaagaagatccaggggattccccacttgaggcctgctgagtacaagaggtccaggttgtctaggaaccgcaggactgtgaaccgtccatatggtggagtgctctctggaactgcagttagggaaaggatcatccgtgctttcttggtcgaggagcagaagattgtcaagaaggtcctgaaaatacagaaaaccaaggacaagaccgcaaagtagagctcctttgtaagggttgcacaatgctgttttgtacacagtgaagagtatttttgatggtggtttatgttggatgatgtttagcatgtgagagacctaccttttgagtttagggttttcaaatcctctcatcttataattgtcggagtattgggacatctgatccccttgttccttaattatgaaatttctgtatgaactattgggtactagtcgaattcacctacatgttagccatctttttatttgacttaattcactcccttaaatgatttgtggttgttttactccctctgttatttggtaatactttttgttagctggtc

SEQ ID NO: 3423 - DNA, 591 bp, Secale cereale
  misc_feature (345)..(345): n is a, c, g, or t
  misc_feature (351)..(351): n is a, c, g, or t
  misc_feature (407)..(407): n is a, c, g, or t
  misc_feature (440)..(440): n is a, c, g, or t
ccacgcgtccgctctccccactctttgcccaagccccctactgccggcggcggagacgacggaaacatggtgcagcgtctgacctaccggaagaggcacagctatgccaccaagtccaaccagacgcgggtcgtcaagaccccaggtggtaagctcgtgtaccagtacaccaagaagagggcgagcggccccaagtgccctgtgaccgggaagaagatccaggggattccccacctcaggcctactgaatacaaaagatcaaggctgtctaggaaccgcaggactgtgaaccgtccctacggtggagtgctctctggaactgcagtgagggaaaggatcatccgngctttnttggttgaggagcagaagatcgtgaagaaggtgttgaaaatacagaagaccaaggncaagacgaccacaaagtaatctgtttgaaacgnatgtgcgaagtgagatggtgttctgtaaacaaggaaaatatttttgttggtggttatgatcaatggtttagtcccttctagctaaatgttttagagtacttgaaatccttctgcccccgtgagatcagagattgtgaaacatttgatacca

SEQ ID NO: 3424 - DNA, 877 bp, Picea glauca
  misc_feature (29)..(29): n is a, c, g, or t
ccccccccccccccgataacgcctgtagncaaggcaaggcaaggcaaggcagatttgtcgcctgctatctgccaagggtaataagttcagccattgaagttcctaattaacagggggatacaacagagcgagctttgcaagctttgggtgctaattgatagggagagatggtgcagaggctgacgtaccgtaaacgccacagttatgctactaaatctaaccagaccagggttttaaagactccaggtggtaggttaatctatcagactgcgaagaagagggccagtggacccaaatgccctgtcacgggcaagagaattcatgggattccccatctgagaccagctgagtacaagaggtcgaggctaagtaggaacaggagaaccgttaacagagcctatggaggtgttttatctggttcagctgtccgtgaccgaattattagagcattcttggtggaagaacagaagattgtcaagaaggttttgaagattcaaaagtcgaaggaaaaacagactcctaggagttagggttaagatgtttctatttttctattgttatggtggtgatcgaaggttgcaaacaaaggttttgttccttgtattaaaaatcaagttttagggttaaatgctacggatggtcacatatggccttacgatttttaggcctcgtgggcagtttaataaaatctgtcattttatcttaagtctgcatttgtgttttaattgatgctcattcatggctttcatgatggtgatcgaaggttgtaaaccaaggacacacgcgggtcccatatggcctacaggctctaatttgtcaatgaaaatctaattatctgtgttttatgtttttgttattaatttatgaatttgaccta

SEQ ID NO: 3425 - DNA, 460 bp, Brassica rapa
gagaaatggtgcagcgtcttgtataccggtcgcgtcacagctacgccaccaaatcgtaaccagcaccgtatcgtcaaaactccaggaggcaaattggtgtatcaaaccaccaagaagagagccagtggtcccaaatgccctgttacaggcaagcgtatccatggaattcctcacttgaggcccacggaatataagaggtctaggttatcgagaaacagaaggactgtgaaccgtgcttatggtggagttttgtctgctttagctgtcagggaaaggatcgtgcgagcattccttgttgaagagcagaagatcgtgaagaaagttttgaaactccaaaaggctaaggagaaagtagctaccaaggcttgagggttttacgttttttttattttggccttgaaaggatacatctttttcactgtctcgtctctgacattatgaattacacatatttttaaaa

SEQ ID NO: 3426 - DNA, 1731 bp, Zostera marina
attctgctctccaacttctctcactccacctgctttaacgaggacgttttctcgcatcaatgtcaagaagaaccgaggtctttccttgccgtttttgtgcaagaaatccgacgaaaatttcgattcccctcttcctgctccaaatgtttcgggggagttgttggccgtgcttcagcgatgggatgtgccttggccatggcaggctttcgttctcacaaatatagcttgtgcattgagttttattttggtcggattagttgaatcgtttgtctccacgtatatcggatttcaagggagtgatcttagtttggatacaaaatcagagttactctttgtgaaccaattcattgtatcggcaactatcttaggggttatatttggtatcaccaaaacctttcgaccctttcctgatgacgttttttgctacagtttcaaagagccattgaatctgagaaatgggtggcttttatgggctgggattgggttttttcggtgccttagttactattgctttggcaggttctgctttgacattttttaatggtgaaagtccacaaagagatgagactgattcattgatgcgcttactaccactgattggctcatcaaatattagcaccgcatgtcttctgggaatcactggtatcctggctccagttcttgaggagacagtcttccgagggtttctcatggtgacccttaccaagtggcttccaaccccaatttctgtacttttaagtgctgcactattttctcttgcccatctcagtcctgggggagtttcctcaactttttattctaggatgtgctttaggattttcatatgctcaaactcacaatcttatgacacccataactatacatgcattctggaactccggtgtgattcttctcctaacatttcttcagcttcaaggatacaatattaatgagcttttgggaagatgattgttgcagactagcagtgctcttccataatcaatattaattcgattacattgtgtacaaaatgatcatcaaattttttttttttgaaacaacattcttagtagtaaacttatgaaaatttggatcaaatgttaatttataacatagaataatttttaaactgtgcatttttaaaattgtcaacaagaagtaatatattagaaatcacaataagtaagatcccaaaaaaacttagcaggttcgtcaaacttgactaaaccaatccacatcgtttaccctttaccttgaaaaatgagtacagcataagatattttgaaaaaaaagacaatctaattatctattatggtagtttcgctattgatctcaagctttggtttgtttctcctttgtcttttgaatcttcaagacctttttcacaattttctgctcctcgatcaaaaaggctcttacgatcctttccttaacagcacagccagacaaaacaccaccataagctcggtttacagttcgacggttcctggacaatctggatctcttgtattcagtaggtctcagatggggaattccttggattctttttcctgtaaccggacacttgggtccactcgctcttttcttcgtgttctgataaatcaatttcccaccgggagttttgacgacacgagtttgattggacttggtggcatagctgtgcctcttcctgtaggtcagcctctgcaccatatttcttcagcttctagatcttcttcttcaaacgattgaaaagcgagagccgagagagac

SEQ ID NO: 3427 - DNA, 529 bp, Populus trichocarpa
agaggatcccaacttttggtccaccccaaacgtcacagctacgccacaaaatctaaccaacaccgtgtggtcataagcccttgtgggaaattggtttaccaaaccaccaagaagagggctagtggacccaagtgcccagttactggcaagaggattcaagggatccctcacttgagacctgctaaatacaagaggtctagactgtcaaggaatcgcaggactgtgaaccgtgcctatggtggagtcttgtctggaagtgctgttagggagagaattatccgggctttcttggtggaggagcaaaagattgtgaagaaggttttgaagattcagaaggcaaaggaaaaacaggcctcaaaatgatgaagtgaagtcttttaagttagaggatgtgtttgagcaaaattttgttatgattaatgacagtcaaatgtggagttgattgttagcgtgtttgattctctgatgacttggatgtgttcattgtcaatttgatttccttgcctatatttggatagattgccaattt

SEQ ID NO: 3428 - DNA, 495 bp, Flaveria ramosissima
acgacacagttatgccacaaaatcaaaccaacatagggttgtcaaaacccctggtggtaagctagtgtatcagactacaaagaagagggctagtggacctaaatgtcctgttacagggaagagaattcaagggattcctcatttgagacctgctgaatacaagaggtcaagattatcaaggaacagaagaactgttaaccgcgcttatggtggggtactttctgcaggtgccgtaagggaaaggatcattagggcctttttggttgaagaaacaaaagattgtgtaaaaaggttttgaagataccaaaaggcaaaggaaaagactgctgcaaaggcttagatttctagcatttctgcaattctcatgagagtaattataggttatctagattttgaatctttaatcgggtaaggcgggatgttttatgttatggtttttctacttcgtcgacaaacaaacatggttgactatgttaggcttttgtttggttgttt

SEQ ID NO: 3429 - DNA, 489 bp, Flaveria ramosissima
acgacacagttatgccacaaaatcaaaccaacatagggttgtcaaaaccccaggtggtaagcttgtgtatcagaccaccaagaagagggctagtggacctaaatgtcctgttacagggaagagaattcaagggattcctcatttgagacctgctgaatacaagaggtcaagattatcaaggaacagaagaactgttaaccgcgcttatggtggggtactttctgcaggtgccgtaagggaaagaatcattagggcctttttggttgaagaacaaaagattgtgaaaaaggtgttgaagatccaaaaggcaaaggaaaagactgctgcaaaggcttagatttctagcatttctgcaattctcatgagagtgactataggttatctagattttgaatctttaatcgggtaagcgggatgttttatgttatggtttttctacttcatcgacaaacaaacgtggttggctatgttaggttttgtttggtgttt

SEQ ID NO: 3430 - DNA, 540 bp, Flaveria ramosissima
acgacacagttatgccacaaaatcaaaccaacatagggttgtcaaaacccctggtggtaagctagtgtatcagactacaaagaagagggctagtggacctaaatgtcctgttacagggaagagaattcaagggattccccatttgagacctgctgaatacaagaggtcaagattatcaaggaacagaagaactgttaaccgcgcttatggtggggtactttctgcaggtgctgtaagggaaaggatcattagggcctttttggttgaagaacaaaagattgtgaaaaaggttttgaagatccaaaaggctaaggaaaagactgctgcaaaggcttagatttctagcatttctgcaattctcatgagggtaattataggttatctagattttgaatctttaatcgggtaagcgggatgttttatgttatggtttttctacttcgtcgacaaacaaacatggttgactatgtttaggtttttggtttggttgtttaatggtctttatgagacgcttgttttttattcgtttaacgagatgta

SEQ ID NO: 3431 - DNA, 667 bp, Eutrema halophilum
acatcccttggatctagggctcaatagatcttccccatatataatctggcatcaaaaactcgcgccgctcctccattgttttctctgagctcgcaaaaatggttcaacgtcttgttttccggtcgcgccactcttacgccaccaagtccaaccaacaccgcatcgtcaaaactcctggtgggaaattgacttaccagacgacgaagaagagagctagtggacccaagtgccccgtcactggcaagagaatccaagggattccgcatctgagacctaccgagtacaaaaggtcgaggttgtcaaggaaccggaggacagtgaaccgtgcatatggtggtgctctatctggagtagctgttagggagaggatcgtcagggccttcttggtggaagagcagaagattgtgaagaaggttttgaagcttcaaaaggccaaggagaagactgtgccaaagagttagaagaaatctttgtggagtcttacaatacaattataagagtgatggggaggaatatcttgttgggatcgatagacatgagtttgattcagattttcggcgctaaaaaaagaagtttagttatttatgatttttgagttaagttttgctctcagttcagattgattttactttctggagctgtctcagtttgttttcattggtttatt

SEQ ID NO: 3432 - DNA, 667 bp, Brachypodium distachyon
actcctctttcttcccctccctcatcatctctagggttcatcaattggcggcggcggcggcaagatggtgcagcgcctgacctaccggaagcgtcacagctatgcgaccaagtccaaccagacccgggtcgtcaagaccccaggtgggaagcttgtgtaccagtacaccaagaagagggcgggcggacccaagtgccccgtgactggaaagaagatccaggggattcctcacctgaggcctactgagtacaagagatccaggttatctaggaacagaaggactgtgaaccgtccttatggtggagtgctttctggacctgctgttagggagaggatcattcgtgctttcttggttgaagagcagaagattgtcaagaaggtcctgaaaatccagaaaaccaaagacaagacaggaacaaaatagagctcctctagcatggatgcgctgttttgtacacaacgaaaagtatttttgatggtggttatgaaagggaactagttgcctcgtactaaatgtttagcttgtgagagacaaacatcttgagattagtatttcgaattcctttgccttttcgttgtcgggacatctgatcccctagttcatttgtcatgaattctgatgtcttggaactataaattagtcaaatatgccagacttgtttgttga

SEQ ID NO: 3433 - DNA, 1193 bp, Cycas rumphii
  misc_feature (381)..(382): n is a, c, g, or t
  misc_feature (528)..(528): n is a, c, g, or t
  misc_feature (604)..(604): n is a, c, g, or t
gaaggtccagataaatcagagcttggattgagacccccaattgggatttctgtcactaggctcgtgctccttcctcttgtaggtattggggttacggccttggcagctaaattacatttccttgtgagtggggataagatgtttgcgtttgtgattcttttgcagtacacaacaccgagtgcaatcctgcttggagcaatgaccagcttgcggggctatggtgcaaaggaagcctcttcactcctgttttggcaacatgtttttgcagtggtttctctttcattctacgttacagtctacttcagattgttgaattatgtgtaaaggttggtgtgtcttggaagtcctgcttttcgtatattcttgaatgaggttgaaatnncatggaagacgtctgtatgattaactcttttgattttgctggccaaggcacaacttgccttctgggtatcagctgtattggctttgattagtattggttgtaattttttcatgtgcaaactaagttggtgctgactgtataagtanccttccctcttagactatttgacgtacgggctaataaagactcttatctggttggttttatacatgaaaaaaaaangagaatagaagagcaagatggtgcagaggctcacataccgtcggcggcacagctatgccaccaaatccaataagatgagggttctcaagaccccaggtgggaggttaatctaccagactgcggcaaagagagccagtggacccaaatgtgctgttactggcaagagaatccaggggattcctcatctaaggcctgctgaatacaagaggtccaggttgcccagaaataggagatctgttaacagagcttatggaggtgttttgtctggatcagctgtccgagaaaggattatccgagcctttttggttgaagaacagaagattgttaagaaggttctgaagattcagagggccaaagaaaagcagactgctaagagttagagttgatcagacgttttgatctgatctatttataagagaattttgttttgagtgtgatggcaattgatattcatccccaaatattttgttaaaattgagtgaacccttttatgaagccagtgttttgatgcatgtcatggtaattcccttgttatcttttcctaagtaagtgcaggagttgaattgaattatgattagttcgaagctct

SEQ ID NO: 3434 - DNA, 674 bp, Cynodon dactylon
ccggggtccccagcctctccctctagcctcctccttgccagggtttatccatcagcgcgtgcgtggcggcggcaagatggtgcagcgcctgacctaccggaagcggcacagctatgctaccaagtccaaccagacgcgggtcgtcaagaccccaggtggcaggcttgtgtaccagtacaccgacaagagggcgagcgggcctaagtgcccagtgaccgggaagaagatccaggggattcctcacctcaggcctgctcagtacaaaaggtccaggttgtcacggaaccacagaactgtgaaccgtccctacggtggagtgctatctggaactgcagttagagaaaggatcatccgagctttcctggttgaagagcagaagattgtgaagaaggtgttgaaaatacagaagaccaaagacaagggtgcttcaaagtaactgtttgacttgaacgaagactgttctgtaaacaagggaggattttttttgtcttttgatgatctatgccttaatctcttctagtatgttgaggtggcaagtgttgaattagagtaccccaatctgtctaccgttgtgatgtcaaaattgtaagacaatttaatctcatgttacgctggttgctggaactcaatgttgaattccacaagttggtttaaatagcatttcaatttcctcc

SEQ ID NO: 3435 - DNA, 535 bp, Actinidia deliciosa
aagcggcatagctatgccaccaaatctaaccagcacaggatcgtcaaaactcctggagggaagttagtgtatcagagcaccaagaagagggcaagtggacccaagtgccctgttaccggcaagagaatccaagggattcctcacttgagacctaccgaatacaagagatctagattatctagaaaccggaggactgtgaaccgtgcctatggtggggtattgtctggaggtgctgtgagggaaaggatcattagagccttcttagtggaagagcaaaagattgtgaagaaggttttgaagattcagaaggccaaggaaaagcaagctggcaagaactgagcttagtgaagtgtgtaccaaaccttaaaccgcgtgagaggataatggatacatccaatgactagtaatcatggcaatgtatccagaggtgttcacatttgcttttgtatcttttgggggctgtttgagacgatcatcgttagtacttttgtcaacaatttaactgaactaggttttgttttctcaaaaaaaaaaa

SEQ ID NO: 3436 - DNA, 580 bp, Allium cepa
  misc_feature (75)..(75): n is a, c, g, or t
cggacaaataagtaaaggggggaaatggttcagcgattagtttatcgcaggagacacagctacgccaccaaatcnaatcaaacccgcgttgtcaaaacacctggtggtaagcttacttatctaactgctaagaagagggcaaaaggaccaagatgcccagttacaggcaagagaatccaagggattcctcatctcagacctgctgagtacaagaggtcaagattagcaaggaacaggaggacagtaaatcgtgcctatggtggtgttctatctggtagtgctgtgaaagaaagaattattcgggcatttttggtagaagagcagaaaatagtgaaaaaagtattgaagatccaaaaggccaaagaaaagctttcttcaaaatgaacctctatgtaagaagctaaaggcttttgaacatgatgtaccatcaggaggaattttttgaaatttccaattacgtatgtctgcctgtttttaattccattacaaattgagacgtgttatcatgttatttctgtattgcacttgaaatttatttgtgccttttcgtgctattgaattatattatttttctaaaaaa

SEQ ID NO: 3437 - DNA, 457 bp, Arachis hypogaea
ctctgcggcgccttttctcctctcttctaaaaaccctaacgcagcagagggagcagatcaaagaagatggtgcagcgtcttacctatcggaagcgccacagctatgctacgaaatcgaatcaacacagagtggtgaagactcctggtggcaagctcgtttaccagaccaccaagaagagagccagcggccctaagtgccccgtcactggcaagaggattcagggtattccacacttgaggccggcggaatacaagagatcaaggttgcctagaaatcgcaggactgtgaaccgtgcatatggaggggttttgtctggaagcgctgttagggaaaggattattcgcgtcttttttggtgaagagcaaaagattgtgaagaaggtgttgaagataccaaaaagctaaaggaaagcaatccttgaagggttaagtttggaaaatagaatggaatcatatc

SEQ ID NO: 3438 - DNA, 751 bp, Pinus taeda
gaataaaccctaatcagcgggaggcgagggttctttttgcaagctttggttgccaattgaataaaccctaatcagcaggaggcgagagtcctttgcaagctgtggtgccaactgagaggaagagatggcacagaggctgacgtatcgcaagcgccacagctatgcgacgaaatctaaccagactagggttctaaagactccaggtgggaggctaatataccagaccgcaaagaagagggccagtggacctaaatgtcctgttacaggcaagagaatccatgggattccccatctgaggccagctgagtacaagaggtcaaggcttagcaggaacaggagaactgtaaacagagcctatggaggtgttctatcgggttcagctgtccgagaccgaattattcgagcattcttggtagaagaacagaagattgtcaagaaggttttgaagattcagaagtccaaggaaaaacagactgctaggagttagagttaagatgctctttttttgcgaaatgcatattttccttgttgtggttgaaggttgcgaacaaaggttttgttgagtttctattctgtcaaatgctactgatacatatgatgataccactcttattcttttcttttaattaagagctgtgagattatttctttgaggcatagtatgcttgttttgaccatgtaccggtgagtaaatttgtaattggattaagtgatatatacatggacaagtctcttgtctaagttaaatgtt

SEQ ID NO: 3439 - DNA, 744 bp, Pseudotsuga menziesii
gagaaaccctaaagggaaggcaataaaatccctgaaggaataaaccctaattcctgatcagacggtggcgtgataactctgtaagctttgggtgccaagtgagagggagagatggcgcagaggttgacataccgcaagcgccacagctatgcgacgaaatctaaccagacaagggttttgaagactccaggtgggaggttaatataccagactgcaaagaagagggccagtggacctaaatgccccgttacaggcaagagaattcatgggatcccccatttgaggccagctgagtacaagaggtcgaggcttagcagaaacagaagaactgttaacagagcctatggaggtgttctatctggttcagctgtccgtgaccgaattattcgtgccttcctggtagaagaacagaagattgtcaagaaggttttgaagattcagaagtccaaggaaaagcagactgctaggagttagggttaagatgctccttttttttccatgaaatgcattttgtccttgttgtcgtggttgaaagttgcaaacaaagattttgttcattttattaaaaattaagctcatattgtgtcagctgttactgatacatgtgatgatattactgttaatctcttgttttaattaagaggtgggagctctatatttttgaggcatagtatgttttgctttgacaatatgtactggtgagtgaattgaattaagtaattacacacattgacaagtctctct

SEQ ID NO: 3440 - DNA, 587 bp, Raphanus sativus
gggccgctctttcattttctctgtggcggcctgagctttgcgaaaatggttcaacggcttgtttaccgatcacgccactcttacgccaccaaatcaaaccaacaccgcatcgtcaaaactcctggtgggaagttgactttccagacgacgaagaagagagctagtggacctaagtgccctgtcactggcaagcgaatccaagggattcctcatctgagacctgctgagtacaagaggtcgaggttgtcgaggaacaggagaacagtgaaccgtgcatatggtggtgttctctctgggctagctgttaaagacaggatcgttagggcgttcttggttgaagagcagaagattgtgaagaaggttttgaagcttcagaagtttaaggagaagactgcaccaaagagttagataacttcttttgtggagagttttgcagtaaagtgatgtgtgagaggaatatgtctttgtaagggagatcgttagacatgagtgagtttgattcaccagattttgttattttgacttcagttgagatattacttttcatgactttggtttaccaattaccattataattcgtcccgcca

SEQ ID NO: 3441 - DNA, 689 bp, Raphanus sativus
cctctgctcccgtcaggataaaaccctagaaggaggataaagaaagagcgtgaaaaatggtgcagcgtcttgtataccgttctcgtcacagctacgccaccaaatccaaccagcacaggatcctcaaaacccctggtggtaaattgacattccagaccaccaagaagcgtgccagtggacctaaatgtcccgttaccggcaagcgtattcagggtatccctcacttgaggcctgctgagtacaagaggtctcgattatccagaaacaggagaaccgtgaaccgtgcgtacggtggtgttttgtctgctttggctgttagggagagaatcgtccgtgctttccttgtggaggagcaaaagattgtgaagaaggtcttgaaactccaaaaggccaaggaaaaggtcgctcccaagaactagaaatcctattttcactttttattttattaaaaaatgttgtggctttgttctagcaatagttactggttgcagaatatgagagaaacattatgtattcgtcgcagttctcaagctttttttcaattcgtttttggtcttgactctgtcgacatttcgcaaatcttgtgtgttatacttttctcctttcaattttcttttcacatttcattgtttctattcttgtgaagttcacttgtttgttacatagtgatcgacgtgattcctactaga

SEQ ID NO: 3442 - DNA, 640 bp, Raphanus sativus
ggacttctctcgctccgtcaagccaaaaaccctaaagaggaagaagagtgtgagcagccaaaatggtgcagcgtcttgtataccgttcgcgtcacagctacgccaccaaatctaaccagcacaggatcctcaaaacccctggtggtaaattgacattccagaccactaagaagcgtgctagtggaccaaaatgccccgttaccggcaagcgtattcagggtatccctcacttgaggcctgctgagtacaagagatctaggttgtcaaggaacaggaggaccgtgaaccgtgcttatggtggtgttttgtctgctttggctgttagagaaagaatcgttcgtgctttccttgtcgaggagcaaaagatagtgaagaaggtgttgaagctccaaaaggctaaggaaaagggtgctcccaagaactagatccctatataacatttgtgtactctctcgtcttccaaattcttaagctttttgtattcgtttgtcttgactttgtcgacgtttcagcaaatcttgggttttgttttctcgtttaaatgtctggtttaacaatatcacgtttctactctgcttctttggtgtttaacaatttgttttatattactactcggttaataaattttgcaattcaaaga

SEQ ID NO: 3443 - DNA, 669 bp, Raphanus sativus
ggattttcctctgctcccgtcaggataaaaccctagaaggaggataaagaaagagcgtgaaaaatggtgcagcgtcttgtataccgttcgcgtcacagctacgccaccaaatccaaccagcacaggatcctcaaaacccctggtggtaaattgacattccagaccaccaagaaacgtgccagtggacctaaatgtcccgttaccggcaagcgtattcagggtatccctcacttgaggcctgctgagtacaagaggtctcgattatccagaaacaggaggaccgtgaaccgtgcgtacggtggtgttttgtctgctttggctgttagggagagaatcgtccgtgctttccttgtggaagagcaaaagattgtgaagaaggtcttgaagctccaaaaggccaaggaaaagggcgctcccaagaactagaaatcctattttcactttttattttattaaaaaaaatgttgtggctttgttctagcaatagttactggttgcagaatatgagagaaacattatgtattcgtcgcagttctcaagcttttttttaattcgtttttggtcttgactctgtcgacatttcgcaaatcttgtgtgttatactttctcctttcaattttcttttcacatttcattgtttctattcttgtgaagtttacttgtttgtta

SEQ ID NO: 3444 - DNA, 638 bp, Raphanus sativus
aggggctctcgctccgtcaagccaaaaaccctaagaggaagaagagtgtgagcagccaaaaaaatggtgcagcgtcttgtataccgttcgcgtcacagctacgccaccaaatcgaaccagcacaggatcctcaaaacccctggtggtaaattgacattccagaccactaagaagcgtgctagtggaccaaaatgccccgttaccggcaagcgtattcagggtatccctcacttgaggcctgctgagtacaagagatctaggttgtcaaggaacaggaggaccgttaaccgtgcttatggtggtgttttgtctgctttggctgttagagaaagaatcgttcgtgctttccttgtcgaggagcaaaagatagtgaagaaggtgttgaagctccaaaaggctaaggaaaagggtgctcccaagaactagatcctatataacatttgtgtactctctcgtcttccaaattcttaagctttttgtattcgtttgtcttgactttgtcgacagttctcaaatgttttggtatggtttctcgtttaaatgctgcgtttaacaatttcacgtttctactctgcttctttggtgtttacaatgtgatctatattaataaattgttcgattcgaagtaaaaaaaaaaa

SEQ ID NO: 3445 - DNA, 646 bp, Raphanus sativus
ggatatacatatatattaggttaaaacaagccagcctcctcagcgtgtgagcgaagaagcagcggagaaaaaaatggttcagcgtcttgtataccgttcgcgtcacagctacgccaccaaatctaaccagcacaggatcctcaaaaccccaggtggtaaattgacattccagaccactaagaagcgtgcaagtggacccaaatgtcctgtcaccggcaagcgtattcagggtatccctcacttgaggcctgctgagtacaagaggtctagattgtctagaaacaggaggaccgtgaaccgtgcttatggtggtgttttatctgctttggctgttagagaaagaatcgttcgtgctttccttgtggaggagcagaagattgtgaagaaggttttgaagctccaaaaggccaaggaaaaggttgctcccaggagctagattatcatataagcttcttttggaaaaaaaatgtttaatggatctgttctagcaatagtactctggttgcagaagtttgagagaaatacttttttttttgttatccattgagttttgattctgtcgacatttctcaaatattgcgttttgttttctcgtccacatttcacgtttctactttttaccaacgaagctgcattgtgaatttta

SEQ ID NO: 3446 - DNA, 934 bp, Picea glauca
aaatattgttagaaatataagaaagaaaaaaaaaacttccatatatgcaaatgaaagagtttattataagggagaaatatgagtaaatgggaaaccctaaagggaaggcaataaaaccccccaaaggattaaacccaaaccctaatcagcgggaggcgagataacgttgcaagcgttggttgccaattgagagggagagatggcgcagaggctgacgtaccgcaagcgccacagctatgcgacgaaatctaaccagaccagggttttgaagactccaggtgggaggctaatataccagactgcaaagaagagggctagtggacctaaatgccctgttacaggaaagagaattcatgggatccctcatctgaggccagctgagtacaagaggtcaaggcttagcaggaacaggagaactgttaacagagcctatggaggtgttttgtctggttcagctgtccgtgaccgaattattcgagcattcctggtagaagaacaaaagattgtcaagaaggttttgaagatccagaagaacaaggaaaaacagactactaggagttagggttaagatgctcctttttttttgtcttcgtgaaatgcatattttcttcattgttataacggttgaaagttgcaaagggttttgttctttctattaaaaattaagttttcgttgtgttaaatgctactgatacatgtgaaaacactactgttattcttttcttttaagtaagagctgggagcgctatttctttgaggcataatatgcttgtttgaccatgtactggcgagtaaatttgtaattgaattaagtggattatatatattgacaagtctcttgtccaagttaaaagtggtggtgattgttactagagataaagtgatgtcattccaatcatttacattttaatatgttgaagtgattgttactgtt

SEQ ID NO: 3447 - DNA, 714 bp, Zostera marina
ggttattaaaataggttgtatctatctctatctcatcgccgctctcacataaccctgcgacgttgcgaacgaaacagccagagcagagaagatggtgcaaaggcttacctacaggaagcggcatagctatgccaccagatccaatcagacgcgtgttgttaagaccccaggcgggaaacttgtttaccagaatacaagaaagagagcaagcggacctaaatgtcctgtcactggaaagagaatccaagggattcctcatctgagacctacccagtacaagaggtcgagattgtctaggaacagaagaacagttaatcgtgcttatggtggtgttctttcaggcactgctgtaagagaaaggattattagagcattcttgatcgaagaacagaaaattgtcaaaaaggtattgaagatccaaaagactaaggacaagcaggccaaggcataaaacaaacgagattttaaattttgttgtgagtttaaatgaattttgatgttttgttttcccgaaaattgggttgtcgtctgtttatgtttttaatacttattactcttagaatggatgtttctatataaccaacctatgtgtttgttttgctgacttctatatattattttatttatcattattgttcgtgtttaaattttcacatgtaattagaattatttattatcttcacatataaagagtctattatggatagatgagac

SEQ ID NO: 3448 - DNA, 570 bp, Cedrus atlantica
ttgagggggagagatggcacagaggctgacgtatcgcaagcgccacagctatgcgacgaagtctaaccagaccagggttctgaagactccaggtgggaggctaatatatcagactgcgaagaagagggccagtggacctaaatgccctgttacgggcaagagaattcacgggatcccccatctgagaccagctgagtacaagaggtcaagacttagcaggaacaggagaactgttcaaagagcctatggaggtgttttatctggttcagctgtccgcgatcgaattattcgagcattcctggtagaagagcagaagattgtcaagaaggttttgaagattcagaagtccaaggaaaaacagactgttaggagttagggttaagatattcatttgttcctcattttattttaaaattaagtccttttctgttaaatatgatgatattaccattgttctgttctttcaatctagagctgggagctctatttctttgaggcatagtatgcttgttttgaccatgtactggtgagtaattttgtaattgaattaagtgattatatacatggacc

SEQ ID NO: 3449 - DNA, 614 bp, Distylium racemosum
aagagcggcaggggctgcaacacaggagggcaaagatggtgcagaggctcacgtaccgcaggcgccacagctaccacaccaaatctaatcagactagaatcgtcaaaaccccgggagggaggctggtctaccagaccgccaagaagagagccagcggccctaaatgtcccgtcactggcaagagaattcagggaatcccccatctaaggcctgccgagtacaggtggacaaggctccgtaggaacaggagatctgtgaacagggcctatggaggcgtgctgtccggtaaagccgtgcgtgaaagaattatccgggctttccttgttgaagaacagaagattgtgaagaaagtattgaagattcagaagtccaaagagaagtctgctaagagttagacttggaggcaattttgttcttgtttgacaattaccagattgttttagttttgcccaatgtattggtacttgagattatgtttattccctttgctcatagagtggctggggatttatttgttttgaggcctgagatgtttttgccaattatctactctggaaatttttaaattgcatttaaggagttttatatattctgacatgcgtattctcaaaatt

SEQ ID NO: 3450 - DNA, 481 bp, Flaveria ramosissima
cgtcacagttacgccaccaagtcgaatcaacatcgagttgttaaaacccctggtggtaagctagtttatcagactaccgagaagagggcaagtggaccaaaatgccctgtcactgggaagagaatccaagggattcctcacttgagacctgctgaatacaagaggtcaagattgtctaggaaccgaagaactgttaaccgtgcttatggtggcgtgctttctgctggtgctgtaagggaaaggatcattagggcctttttggttgaagaacaaaagattgttaaaaaggtgttgaagatccaaagggcaaaagaaaagactgcatctaaagcttagatttttctgcaacttctcatgagagaatttttgagtgtcaagattttggatctgtaatcgggtcgggtctggttaggctgttctgtttttatgttttaaatacttctactttgttacccatgaaaccttgttaaatttgtaggat

SEQ ID NO: 3451 - DNA, 966 bp, Pinus pinaster
attggggagaaacataaataaggaagaaaccctagagggaaggcaataaaaaccctaatggaataaaccctaatcagcgggagacgagggttctttttgcaagctttggttgccaattgaataaaccctaatcagcgggagacgagggttctttttgcaagctttggttgccaattgaataaaccctaatcagcaggaggcgagagtcctttgcaagctgtggtgccaactgagaggaagagatggcacagaggctgacgtatcgcaagcgccacagctatgcgacgaaatctaaccagaccagggttttaaagactccaggtgggaggctaatataccagaccgcaaagaagagggccagtggacctaaatgtcccgttacaggcaagagaatccatgggattccccatctgaggccagctgagtacaagaggtcaaggcttagcaggaacaggagaactgttaacagagcctatggaggtgttttatcgggttcagctgtccgagaccgaattattcgagcattcttggtagaagaacagaagattgtcaagaaagttttgaagattcagaagtccaaggaaaacagactgctaggagttagggttaagatgctctttttttgcgaaatgcatattttccttgttgtggttgaaggttgcgaacaaaggttttgataagtttctattctgtcaaatgctactgatacatatgatgataccactcttattcttttcttttaattaagagctgtgagattatttctttgaggcatagtatgcttgttttgaccatgtaccggtgagtaaatttgtaattggattaagtgatatatacatggacaagtctcttgtctatgttaaatgtttgtgattgttgctagagatatagtgttggtcattccagtaatttatatttgaatatgttgaagcgactgctactgttgctgtatatacaatttactcg

SEQ ID NO: 3452 - DNA, 666 bp, Eutrema parvulum
acatcccttggatctagggctcaatagatctccgccatatataaactcacatcaaagctcgcgccgctcctccgttgttactcactcactctctcagagctcgcaaaaatggttcaacggcttgtttaccggtcgcgccactcttacgccaccaagtccaaccaacaccgcatcgtcaagactcctggtgggaagctgacttaccagaccacgaagaagagagctaatggacccatgtgccctgtcactggcaagagaatccaagggattccacatctgagacccactgagtacaaaaggtcgaggttgtcaaggaacaggaggacagtgaaccgtgcatatggtggtgctctgtctggagtagctgtaagggagaggatcgtcagggccttcttggtggaagagcaaaagattgtgaagaaggttttgaagcttcagaaggccaaggagaaaactgcgccaaagaattagaagaacgctgtgtggagttttacaatacgttacatgagtgatggggaagagtatcttgtaggatcgatagacatgagtttgatcgaggttttgggtactgaaaaaggccaagtttggttttttctgacttctgacttcagttttgcgctctcaattcagattttactttcttgagttttctttgtttgtgtttat

SEQ ID NO: 3453 - DNA, 551 bp, Antirrhinum majus
  misc_feature (534)..(534): n is a, c, g, or t
acatacagatcgcgtacagttacgccaccaaatccaatcaacacagagtcgtcaaaacacccggaggcaaacttgtgtatcaaaccacaaaaaaacgagcaagtggaccaaaatgccccgtaacaggcaagagaatccaaggtattcctcatttgagacctactgagtacaagagatcgagattatcgaggaatcgaaggactgttaatcgtccttacggtggtgttttatcgggcggtgctgttagagagaggattattagggcttttttggttgaagagcagaagattgtgaagaaggttttgaagatacagaaggcgaaagagaaggttgcttctaagagctaagctagtttttgaatacgttataagggaatggagtggagatatctggaatgtgtactgtgaggttttacgagctttttttgacgtgtatggaattcgttataaattgttacgttttgttttgttcagtaagttcgtcgaaaattctgttatcgtagggttttggggttttaatgaaaagttgaactcnttttgagcaaaaaaaaa

SEQ ID NO: 3454 - DNA, 545 bp, Brassica juncea
gcgtcttgtataccgttcgcgtcacagctacgccaccaaatcgaaccagcacaggatcgtcaaaacccctggtggtaaattgacataccagaccactaagaagcgtgcaagtggacccaagtgccccgtcaccggcaagcgtattcagggtatccctcacttgaggccggctgagtacaagagatcccgattgtctagaaacaggaggaccgtgaaccgtgcctatggtggtgtgttgtccgctcttgctgttagagaaagaatcgttcgtgctttccttgttgaggagcaaaagatagtgaagaaggtgttgaagcttcaaaaggccaaggaaaaggttgctcccaggagctagatcctctttagcttttttttaaaaaaacattgtctacttgccaaattctaaaactttttgtattcgtttgcttgactttgtcgacatttctcaaaatgtttggttatggtttctctttcaaatgctgcgtttaacaattcacgttttctacttatttggtgtttacaatgtgatttacattactcggtta

SEQ ID NO: 3455 - DNA, 2295 bp, Zingiber officinale
ttttttttagaaaaaatattacatttctatttcgtggtaatgcaaatatttagaccaaatgggcttgccaacaaacaaaagaataaataaataaataaataaataaacaacacgatttatcccaccgccaatttacacacagcccccaaccactcccaacaagataattaataaaataataatccaatactatctcttcgctgaccatctatttcgatcggtgaacgccgtcaatcaaaatatgtctcacttcgatggacggatcagatcattttcagctgacggtgagttggaaatcccaaagaacggagaggagataacggcggcaggttaaagatgcccgtcgtctccctcgtgccgaattcggcacgaggaggagcggcgcgtgttcttcgtcgaccgcctcgtcctcgagcgggaccacttcaagatcttgatggaggctgccggagatcgtatccggaggcggaaaggtaccgtcttggtggacctcgacgctatcctcttcgagcacttgctgtggttggtctaccatgaatcctcctcctcctcctctgtctcctttttgcagctcaatctaaaggagattatagatttctattctcaagattattgagatgattaaacaaaaaaaattatgtttgaatactcttttgcttaaggtgttcgatttatattcagaatcaattgacaagtgtatactatattcttgtgttgaatcctcgtgccgaattcggcacgagggctagctagctagtaagtaactagtaaacagagtccttagggttgaactcccacagatccagaatcatggcggcttcccacaacggcattttatcaaacagatggtctctcgccggatccacggctctcgtcaccggcggcaccaaaggaatcggattctccatcgtcgaagagctggccgcactgggagccgcagtccacacctgctccagaaacgaagccgagctcaacaagtgcctgcaggactgggagaagaagggcttcaagatcaccggcaccgtctgcgacgtgtcctcgccggctgaccgggagcgcctgctacaggatgtcaaggccgtcttcgacggaaagctaaacatcctcgtgaacaatgcgggaacagggtacccgaagccggcgacgctgtgcacggcggacgacttcaaattcatcatgacgaccaacgtcgaagcggctttccacgtctgccagttggctcaccctctgctcaaggcttccgggagaggcagcatcgtcttcaactcctccatctccggcatcgtcgctctcgagtacctctccatctacggcatcaccaaaggtgcgctgaatcagcttgcgaggagctttgcttgcgagtgggccaaggacaacattcgcgtgaacagcgtcgcccccggcgccgtggagacaccgctgatgaagccggcgttcgacaacaaggagttcgtggagagggaggcagcgcacgtgccgctggggaggctgggagtgccggaggacgtggctccggtggtggcgttcctttgcttgccggcggcgtcctacgtcaccggacaagtcattgtgatcgacggaggacgcgttgtgaatggctactactgagcacggctgccgttcaagagtttgtttgttatgatgcaatgggcgtttggcaatttccttatattttcagtcctaagagttgtgtttttattgaccaatttaaacatctcttagttaaataatattattccggaagaggcatagctatgccaccaaatcgaatcagacccgtgtcgtcaaaacccctggtgggaagttggtgtaccagtatacacacaaaagagccagtggacccaaatgccccgtgactggaaagagaatccaagggattcctcacttgagacccacacagtacagaagatctagattgtctagaaaccggaggactgtgaaccgagcttatggtggggtcttatctggaggtgctgtcagagagaggattatccgagctttcttggtcgaagagcaaaagatcgtgaagaaagttttgaagatccagaaggctaaagagaagcaaagcaccaagagctaaggcatcaaactaaacaaaagttatgtccggagccttttaatctagaaatttttgtttgactcggtgaactttgtcgggcggtgtttatacattgcttcaatatgctttactagaaagtctagaatcatgaggacagccagttccgtcgttacttaatatggcggcaatgttcgttgtgcttcgattaattttctcctattgcattgtgttctttc

SEQ ID NO: 3456 - DNA, 454 bp, Allium cepa
acaaaagacgataagaaacagaagaaacaatggttcagcgattagtttatcgcaagaggcacagctatgctaccaaatccaatcaaacccgtgttgtcaaaacacctggtgggaagcttacttacttaactgcaaagaagagggcgaaaggaccaagatgtcctgtaactgggaagaggatccaaggaattccccaccttagacctgcggagtacaagaggtctagactggcaaggaacaggaggacggttaaccgtgctttatggcggtgttttatctggtagtgccgtgaaagaaagaatcatccgtgcctttttggtagaagagcagaagattgtgaaaaaagttttgaagatccaaaaggcaaaagagaggctttctgccaaatgagctgcatcctaagaagcaacaactttttttgaatttttcgtttcctccagggaaagtttaggtt

SEQ ID NO: 3457 - DNA, 868 bp, Pinus taeda
gagtacacgcttaacactgcacccgagatctagggttagggcatggagttagggtttaggatgagcaagtatgagtatcattcgtatctatataggcttcggcaatggctttgattaacagaacgagctgcggggatgggaaggtattttcgtcgagtgatatctgcgcaggagtaataagttcagccattgaagtccctagtcagctgtggggtagatcacataacgagctttccaagctctgggtaccatttaagagggagagatggtgcagaggctaacgtaccgtaagcgccacagttatgcgacgaaatctaaccagactagagtcttaaaaactccaggtggtaggttaatctaccagactgcgaagaagagggccagcggacctaaatgccctgttaccggcaagagaattcatgggattccccatctgagacctgctgagtacaagaggtcgaggcttagcaggaaccggagaacagttaacagagcctatggaggcgttttatctggttcagctgtacgtgaccgaattattagagcatttttggtcgaagaacagaagattgtcaagaaggttttgaagatgcaaaagtccagggagaaacagactgctaggagctagggttaagatttgttcattttcctcattgtcatgatggtcatagaaggttgcaaacaaatgttttttcattgaattaaaaatcaagttcagtatcaaatgctactgatacatgtgggcagctttgtggataatttaataaaaatctgccattttctttaacatgaatttgccatattttagttgatgctcattcacagctttcatggtggcgattgaaggttgtaaccggaggtcttattc

SEQ ID NO: 3458 - DNA, 789 bp, Pseudotsuga menziesii
agttatattgtttggttgtttgattgttattgtttatttattgttaaatcaagttgtatctttttatttggttctgaaatatcccttttttggaataaacgttttgatgtacataacaaactttaggtgccaattgagagagagatggcgcagaggctcacttatcgcaagcgtcacagctatgcaacgaagtctaatcagaccagggttctaaagactccaggtgggaggttaatataccagacagcgaagaagagggcgagtgggcctaaatgccccgttacaggcaagagaattcatggaatcccacatttgaggccagctgagtacaagaggtcgaggcttagcaggaatagaagaactgtcaacagggcatatggaggtgttttgtctggttcagctgtccgtgaccgaattattagagcattcttggtagaagaacagaagattgtgaagagggttttgaagcttcagaagaccaaggaaaaacagactgctaagagttaaaggctgattctgtgttttttgatatgcatattttcctcattgtcacgctgatgatcgaaggctaccaataaaggttttgttcattttagtaaacatttaagttcggtgacaaatacttctgatacaaatggttttgtggacgtgtggtaataaattgttttgtcttaaatctgcaattgattgatataagcagttttcgttattaaatttttgattatttctaatcgcttcctattcttgacagatctagacttgtgataatgttttgaaatttataatgca

SEQ ID NO: 3459 - DNA, 693 bp, Sequoia sempervirens
cagctgcagaggtagttgtcgaaggaagaagaggcaaagatggtgcagaggctaacataccgcaggcgccacagctatcacaccaaatcaaaccagacaagaattgtcaaaacccctggcgggaagttaatctaccagaccgccaagaagagggccagcggacccaaatgcccggttactggcaagagaattcaaggaatcccccatctgagacctgctgaatacagggtgagcaggctgaaaaggagcaggagaactgttaacagggcctatggcggggttctgtctggttcagctgtgcgagaaaggattatccgggcattccttgttgaagaacagaagattgttaagaaggtgttgaagattcagaagtctaaggaaaagactactaagagttagaattggggataagatagtatcccgtgcatttttcccttaggcaatcgagatcaattgtggtaaccaaatattttggtcaatgttgagaaaagcagtttgttttttgtttcgcccaacgtatgggtagttgtgatcatacttattcccttaactcacagagagctttgggttttattagtttgaagaccatgttttcgacaatcatctaccttaaactattttttaactacatcctagtgaattatatgtattgtatgtttgttcaattacactgactgctacatgtttaaaatt

SEQ ID NO: 3460 - DNA, 598 bp, Lippia dulcis
cagcaacactctcactctccccctctcgcgctcccatcaaaacccctgtcggaaaaatggtgcagcgcctgacatacagtaagcgtcatagttatgccaccaaatccaatcaacaccgcgtcgtcaaaactcccgggggaaagctagtgtatcagaccaccaagaagagagcgagtggaccaaaatgccctgtcaccggaaagagaatccaagggattcctcacctgagacctgcggaatataagaggtctagattgtccaggaaccgtagaactgtgaatcgtgcctatggcggagttttatctggttctgctgtgagggaaaggatcattagagctttcttggtggaagaacaaaagattgtgaagaaggttttgaagcttcagaaggccaaggaaaggttacttccaagaactagatccaaagcttggggctaagataattttgaaaagcaatttatcagagggattaagaaattgtattgtgagaagacttgttaccttctgtttgctgcattaggttttgggaatcttatgctttttgatgaaactcatatatgagctactggtttcctctaattatacttctcttattcaca

SEQ ID NO: 3461 - DNA, 668 bp, Tropaeolum majus
tcaacgcagagtggcatacggccggggcttctggttgcagtctctcttcttccgccactgcaaaaccttaaggctcgagaggtcaaaacctagacggagcgaaaatggttcagagactcacttaccgcaccaggcacagctatgccaccaaatccaatcagcatcgcattgtgaaaacccctggtgggaaattggtgtatcaaactaccaagaagagagcaagtggacccaagtgccctgttaccggcaagaggatccaagggattcctcacttgagaccaactgaatacaagaggtcaaggttgcccaggaaccgcaggactgttaaccgtgcatacggtggtgttttgtccgcaggtgccgtaagggaaaggattatccgagcttttcttgtggaggagcaaaagattgtgaagaaagttttgaagcttcagaaaactaaggaaaacaagctggaaagaactagagaaagagggtagtttgatatcctgtgaacatgaaatatgattttggtcttttttttgaacttcttatcttattaattttaggtttttggtactgggtttactctgagtaattgtttgtttactttgttgaagaatcatatttcaagatattactttgttgtttatgaattttctcaaatgttataataattattacaccta

SEQ ID NO: 3462 - DNA, 789 bp, Cedrus atlantica
tgctaccgtcgataacccctagagccttccaaccgtcgatactacaccactccaggaggcgagataacagaaaaaaaccctaaataaacagagcgatacttggccaacctctggaagtaaaccctaagagagcaagctcttgggtgccaattgagaggaaaatatggcgcagaggctaacgtatcgcaagcgtcacagctatgcaacgaagtctaaccagaccagggttctgaagactccaggtgggaggctaatataccaaactgcaaagaagagggccagaggacctaaatgccctgttacgggaaagagaattcacgggatcccccatctaaggccagctgagtacaagaggtcaaggcttagcaggaacaggagaactgttcagagagcctatggaggtgttttgtccggttcagctgtccgcgatcgaattattcgagcattcctggtagaagagcagaagattgtcaaaaaggttttgaagattcaaaagtccaaggaaaaacagactgttaggagttaggtttaaaatgtttgcatttttattctgaaatgcatattttcctcgttgatggaaggttgcaaacaaaggttttgtcatttttatttaaaattaaattcctattgtgtcaaatgatactgagacatatgatgatattactgttattccgttctttcaatcaagagctgggagctctatttctttgaggcatagtgcttgctttgaccatggactggtgagtaaatttgtaattggattaagtgattatatacgttgacaaatcc

SEQ ID NO: 3463 - DNA, 762 bp, Sciadopitys verticillata
gtggaggataactgtagttgttttcgctgtttaaaggagaaagaggggaaagaggcaaaagagaggagcaaaaggagtgaggcagaaggagaaaggcaagatggtgcagaggctgacataccgcaggcgccacagctatcacaccaaatccaaccagaccagaatcgtaaaaaccccaggtgggaagctaatctaccagactgccaagaagagggccagtggccccaaatgtcccgtcactgggaagagaatccagggtatcccccacctaaggcctgctgaatacagggttactaggcttaaaaggaacaggagatctgttaatagagcatatggaggagttttgtccggtcaagctgtacgcgataggattattcgggcttttcttgtcgaagaacagaagattgttaagaaggtgttgaagattcagaagtccaaggaaaaggctgttaagagctagagttggagttaatttaatctgttctcttgaagtgctagttttcattttaggccgcggttctttttggtggtaaccaaatattttgttcaatgttgaggaaagcaaatttgtttttattcagcccaatttgtggttactcaatattatacttactcccttctcacagaggggttgggcttaactaggttcgaggcataacatgtttttgtcaattatactgggaacaatttttttttgcatttaagtgattatatattgattatattgttaaatcacactagatgtgtcctgattaaattgcc

SEQ ID NO: 3464 - DNA, 593 bp, Taxus baccata
aaaaaccctaatttttcaaagaggagaaaccaggagcggcagagggctaaggcaaagatggtgcagaggctcacataccgcaggcgtcacagttatcacaccaagtcgaaccagaccagaatcgtcaaaacccctggcgggaagctaatttatcagactgccaagaagagggccagcggacccaaatgtcccgttactggcaaaagaattcagggaattccccatttgaggcccgcggaatatagggttagcaggctgaaaaggagcaggagaactgtgaacaggccctatggaggagttctgtctggttcagccgttagagaaaggattatccgggcttttcttgttgaagaacagaagattgttaagaaggtgttgaagattcagaagtctaaggaaaagactactaagagttagactcaaggatccggtgttttgcaatgtagtttttcctttgaggcaactgtcatttatgttggtaaccaaatacgttgttcaatgttgagaaaagcagtttgtttttgtttttcacagtgtgggatatttgcgataacacttgttccctttcctctcagagcagatggggatttatt

SEQ ID NO: 3465 - DNA, 889 bp, Gnetum gnemon
ggcctgtaagtgtagtcgtgcggcaccagggttttgggttttggttgctgcgtggccaccgataacgagtgatagcagagcagagcagagcagacgtgaaaatggtgcagagactgacttatcgcaaacgtcacagttatgctaccaagtctaaccaaaggaggatcgtcaagacgccagggggaagttagtatttcagacagcaaagaaaagggcaagcggtcccaaatgtcctgtcacgggaaaaaggatccacgggattcctcatttaaggacggcagagtattccagatccaggcttaaaaggagccgcagaactgtaaacagaccctatggaggagtcctttctggcactgctgttcgtgagcgaattattcgggcatttttggtagaggaacagaaaattgtcaagaaggtgctgaagattcaacgtcagaaggaaaagctggctgctaagagctagaattatgctaattgacattgcatgggagactttaagaaaattcacacgttgtaacaaggaggaaaaggactttatcatgtcgttatttatttttggtgattttagtattaaacatgatacattaagcttcggaaaacatccattagttaaaatagaacaaaagatgaatttttgtttaaatgtcaccatggtaactattttaattgtagtgaagcttttgttttcatcttgtcaggttgtccgcaacgtgacaacgatattcttggagccttggtaataatggtgaattgaatatcattagtaacagaggagtgcgtattggatcattttttaacaaaataatgaatattgtttgccctttacacggaaacatcttggtttgattttcttcatagaggggtactgcatttgtgatctcttgtttag

SEQ ID NO: 3466 - DNA, 568 bp, Thalictrum flavum
tcgaaagcggcatagctatgcaaccaagtctaaccagaacaggttgtaaaaccctggtggaaagcttgtttaccagacaactaagaagagagctagtggacctaagtgccctgccactggaaagaggatccaagggattccacacttaagacctgctgaatacaagaggtctagattatcaaggaacaggaggactgtgaaccgtgcttatgggggtgttttgtcgggaggagctgtcagggaaaggatcatccgagctttcttggtggaagagcaaaaaatcgttaagaaggtattgaagattcaaaaggccaaggaaaagactgccccaaagagctaaatgagaatcaaattaaagttgtacctgtctaaagaaattttggctagacagataatgatttatgggaaaagtatgatgaggtattttagtgcagtgttttgagtatttctttccttgaggttttgtagactccatgtgccagtaacattactttgccgacatttctattaccatgttttgtttttaaattacttctagcaagttaaattgtacctagtatttaaattc

SEQ ID NO: 3467 - DNA, 543 bp, Arabidopsis lyrata
atctcctttggccgtcacttactgacctcagagctcaacgaaaatggttcaacgtcttgtttaccgatcacgtcactcttacgctaccaagtccaaccaacaccgcatcgtcaaaactcctggtgggaaattgacttaccagaagacgaacaagagagctagtggacctaagtgccctgttactggcaaaagaatccaagggattccgcatttgagacccgctgaatacaaaaggccgaggttggcaaggaacgagaggacagtgaatcgtgcatatggtggtgttctatctggagtagctgttagggagaggcaagtgattgttagggccttcttggttgaagaacagaagattgtgaagaaggttttgaagcttcaaaaggcgaaagagaagactgggccaaagagttagaagaagacgttttggattttatgttctagggatcgatagacatgagtctttttgttcacgaaaagagcaaatgtttgtttttgataatatcttatgttcagttttgttctccattcagattttactttctc

SEQ ID NO: 3468 - DNA, 430 bp, Flaveria ramosissima
gcagatagccgccgatcgaaccctggtcaacgtctcacgtatcgcaaacgccatagctatgccaccaaatccaaccagcatcgtgttgtcaaaacccctggtgggaagcttgtttatcagaccactaagaagagggctagcggacctaaatgtcccgttactggcaaaagaatccaagggattccacatttgaggcctgctgaatacaagaggtcaaggttatctaggaacagaagaaccgttaaccgtgcttatggtggagtgttgtctgcgggtgctgtaagagagaggatcatccgggcgtttttggttgaagaacaaaagattgtgaagaaggttttgaagattcagaaagccaaagaaaaactgcttcaaagagctagattttgaatatgtatcaaaccacttctgtcttcttttcatcgttatt

SEQ ID NO: 3469 - DNA, 619 bp, Triticum aestivum
  misc_feature (353)..(353): n is a, c, g, or t
  misc_feature (396)..(396): n is a, c, g, or t
  misc_feature (406)..(406): n is a, c, g, or t
  misc_feature (448)..(448): n is a, c, g, or t
  misc_feature (458)..(458): n is a, c, g, or t
  misc_feature (462)..(462): n is a, c, g, or t
  misc_feature (464)..(464): n is a, c, g, or t
  misc_feature (472)..(472): n is a, c, g, or t
  misc_feature (515)..(515): n is a, c, g, or t
  misc_feature (518)..(518): n is a, c, g, or t
  misc_feature (527)..(527): n is a, c, g, or t
  misc_feature (580)..(580): n is a, c, g, or t
  misc_feature (584)..(584): n is a, c, g, or t
ctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctgggaattgctgttagggagaagaatcatccgtgcttccttggnccgaaggacagaagatggtcaaagaaagtcctgaaaatacaanaaaccaaggncaaagacagctgcaaagtaatctcaaggaatggggaagctancccggtttgncacngnaaaattantttggggatggaaatctaggggcttgttgacatttacagtagntanaatttgggnatgaaccttcacttgaatggtggaaacggaaccgtcccaagtgctttatagantagntcaaccatcaagtaactcggttgaaaaaaaaaaaa

SEQ ID NO: 3470 - DNA, 740 bp, Cephalotaxus harringtonia
atcaggtcatcaagagcggaaagcggtagcagcagcagtagttgttgaaggcaaagatggtgcagaggctaacataccgcaggcgtcacagctaccacaccaaatcaaaccagaccagaatcgtcaaaacccctggtgggaagttgatttaccagaatgccaagaagagggccagcggacctaaatgccctgttactggaaaacgaattcagggaattccccatctgaggcctgctgaatacagggtaagcaggctgaaaaggagcaggagaactgttaacagaccctatggaggggttctatctggtgcagctgtgcgagaaaggattatccgagcttttcttgttgaagagcagaagattgttaagaaggtgttgaagattcagaagtctaaggaaaagacaactaagagttaggcttatagatctggtcttttgctggcggttaccaaatattttgttcaatgttgagaaaagcaatttatttttgttttgcccaatgtgtgggtagtcgtgatcatactttttctctttccttgcagtggggttggggttttattagtttgagccttaaaggcttaacatgattgtctatcatctaccatgaacattttctttaattgcattcaggtgattatatatatccatgtcctttattattcaattggactgaacattacatgattaaaatagcttattagataataatgaaatttgtctgttaacacttttttgcatgct

SEQ ID NO: 3471 - DNA, 575 bp, Cucurbita pepo
cttacaattcttcggcaacagctttagagggttccgacgagcggagaagatggtccagcggctcacttaccgtaagcggcacagctatgccaccaaatccaaccagcaccgcgtcgtcaagacccccggtgggaagcttgtgtatcagaccacgaagaagagagccagtggtcctaaatgtcctgtaactggaaagagaattcaagggattcctcacttgaggcctgctgaatacaagaggtctaggctggctaggaaccgtaggactgtaaaccgtgcctatggtggtgtactgtctggcggtgctgttagagagaggattataagagcttttttggttgaagagcaaaagattgtgaaaaggtattgaagatccagaaggcaaaggaaaactagcttccaagagctagaatgtctggttttaacgcatgaactcttttccattttatatatgctggatgaaaattttgacttggatcaatgacttgttaatttaaatgattttggaattagcttcgttcttgtagttgcatcagtattttgaagtttcttctgctataatattcagtctatca

SEQ ID NO: 3472 - DNA, 726 bp, Cucurbita pepo
ttttgtttcagtcttacaattctccagcaacaggtttagaggattccgacgagcggagaagatggtccagcgtctcacttaccgtaagcggcacagctatgccacaaagtccaaccagcaccgcgtcgtcaaaactcccggtggaaagcttgtgtaccagaccacgaagaagagggctagtggtcctaaatgccctgtcactggaaaaagaattcaaggaattcctcacttaaggcctgctgaatacaagaggtctaggctggctaggaaccgtaggactgtcaaccgcgcctatggtggtgtactgtctggaggtgctgttagggaaaggattataagggcttttttggttgaagagcaaaagattgtgaaaaggttttgaagatccagaaggcaaaggaaaagcttgcctccaagagttagaatgctgggttaaaagcacaaacccttttccattttatatatgctgaatgcaaattttgacttggatcaatgactttttaatttaaatgatttggaattagcgttgtattctttcagttgcattagtcgttccaagtttcttctgcaagaattaatcagtttatcactcttgtttatgctgattatgcttcatttacctgcacgcatcaagaatatggtacgagtttgtgttgctttattctcctcatcctttagcacgctcttctgcatttttcatgtaagcttggtttcgtcatgtgaact

SEQ ID NO: 3473 - DNA, 564 bp, Distylium racemosum
ggtttagatgaatataaagcattggaagcttgcctccgacaactacagcaacagctctggaatctggagtagagggaagagagtaaaggagaggaggagaaactcaggtaaaagaggaagatggtgcagagactcacctaccgtaggcgtcacagctatgccactaagtctaaccagaccaggattgtcaaaacccctggtgggaagctaatttaccacactgcaaagaagagagcgagtggccccaaatgtcccatcacgggcaagagaattcacgggatccctcatttgaggccggcggaatacaggacgacgcggctcgccaggaacaggagaaccgttaacagggcctatggaggcgttttgtccggttcagctgttcgccaaaggattatacgcgcatttcttgttgaagaacagaagattgttaagaaggtgctgaagatccaaaagtccaaggaaaaggtggcaactaagagttagagcaggtggtttttaaggttgttcttcaaaatgcaccactctacttagggtgactttatggtgccaacaacccttttcttt

SEQ ID NO: 3474 - DNA, 396 bp, Humulus lupulus
gcagtccagaatcgcagagctcgttccagaagcaatcgaaaatggtgcagcgcctcacttaccgcacgcgacacagctacgccaccaaatcgaaccaacaccgtgtcgtcaaaaccccaggtgggaagttggtctaccagaccaccaagaagagagctagcggcccaaaatgccctattactggcaagagaattcaggggattcctcacttgagaccaactgaatacaagcgctctaggttgtcgaggaaccgtaggactgtgaaccgtgcctatggtggtgtactttctggaggtgctgttagggagaggatcattcgtgctttcttggtggaagagcaaaagatcgtagtaaaggtaagggtttttagtaaaactttacgaaaaacgggtaccg

SEQ ID NO: 3475 - DNA, 521 bp, Eutrema parvulum
ataatctccgtcccaagaggaaaaccctaaggagaaagagaggcgaaaatggtgcagcgtcttatttaccggtcgcgacacagctacgccaccaaatcgaaccagcaccggatcgtcaaaactccaggaggtaaattggtgtatcaaaccacaaagaagagagccaatggtcccaaatgccctgttacaggaaagcggattcacggaatccctcacttgaggcctactgaatacaataggtctagattatcaagaaacaggaggaccgtaaaccgtgcatacggtggagtcttgtctgctttagcagtcagggaaaggatcatacgagcattccttgttgaagaacagaagatcgtgaagaaagttttgaaactccaaaagaccaaggagatagtacccaaggcttaagcgttttatgtttttcttctttgttttgggattttggcctcgaatggatacatctttttcatcgtctattatctgttacttattatgaattatatacatttttacaagactga

SEQ ID NO: 3476 - DNA, 718 bp, Cryptomeria japonica
gctaatttctgtgtggggtgaaggatagattagggctcaaagcagccgcagaggttgttgtcgaagacaggagaggcaaagatggtgcagagactaacataccgcaggcgccacagctaccatactaaatcaaatcaaacacggattgtgaaaacccctggcgggaagttaatctaccagaccgccaagaagagggccagcggacccaaatgcccggttactggcaagaggattcaagggattccgcatctcaggcctgctgaatacagggtgagcaggttgaaaaggagcaggaggactgttagcagagcctatggcggggttttgactggttcagccgtacgagaaaggatcatccgagccttccttgttgaggaacagaaaattgttaagaaggttttgaagatccagaagtctaaggaaaagactactaagagttagaattggggatgttatagaatagcaagtataacatgcaattttccctaatcgagatcaattgtggaaaccaagtattttggtaaatgttgagaaaagcagtttgtttttgttttgcctaatgaatgtatgggtagttgtgatcatacttattattccctttactcatggagggcttgagccttcctgttagtttgaagaccaacatgtttttgttaatcatttacataactatttttttaatttcaagtgggtttgatgtgttccatgcttcatgttc

SEQ ID NO: 3477 - DNA, 635 bp, Podocarpus macrophillus
ttaaggcgaggcaagaaagcctagggcacaaggaagaaacgagaggacgcggcggccaagatggtgcagaggctcacttaccgcaggcgccacagctaccacacgaaatccaaccagaacagagtcgtcaaaacccctggagggaagttagtgtatcagaatgtgaagaagagagctagcggccccaaatgccctgtcactggcaagaggattcaaggaataccccatttgaggccagcagagtacaggtggacaaggttacgcaggagcaaaagatctgtaaacagggcttatggaggtgttttatcaggaaaagctgtccgtgaaaggattattagggcatttcttgttgaagaacagaagattgttaagaaggtgttgaagattcagaagtctaaagaaaaagctgccaaaacctaagagatgaaagcgattttgtttgatgttgaaaatagtttagttatggccaatatgttggcatttgagattgctttaattccttctgcatgcagggggatcagcattttgttgaggcctagcatgtttttgtcaatcgttgactgtgacatgtttttcttaattacattcaagtgattatatattcatatttttgtgtgaatggaacagtgtattgc

SEQ ID NO: 3478 - DNA, 436 bp, Vinca minor
gccatagttatgcaaccaaatccaaccagcacaggatcgtcaaaacccctggtgggaatttggtatatcaaagtaccaagaagagggcaagtggtcctaagtgtcctgtaactggaaagaggattcaagggatcccacacttgaggccggctgagtataaaaggtctcgtttacccagaaacagaaggactgtcaatcgtccatatggtggtgtattatctggtggcgctgtccgtgagaggattgtccgagcattcttggttgaagagcaaaagattgtcaagaaggttttgaagatccaaaaggcaaaagaaaagcttgctgcaaagaactaatttaattttttctgggaatctcattccctttttatttggaacaagattttgacatttagtgctactacatatgtcttatacagtctctgagctgatttcct

SEQ ID NO: 3479 - DNA, 567 bp, Festuca arundinacea
ggcacgaggcgcaagcgtcacagctacgcgacaaagtcgaaccagacccgggtcgtcaagaccccaggtgggaagcttgtgtaccagtataccaagaagagggctagcggacccaagtgccccgtcactgggaagaagatccagggaattccacacctgaggccaacggagtacaagaggtcaaggttgtctaggaaccgcaggactgtgaaccgtccttatggtggagtgctttctggacctgctgttagggagaggatcatccgtgctttcttggtcgaagagcagaagattgtcaagaaggtcctgaaaatccagaaaaccaaagacaagacagccacaaagtagagatcctctgagaaggatggcacactgctgttttgtgcaagagaaaagtatttttgatggtgatgaaagggtctagttgcctcgtgaaatgtagcatgtgagtttagggtgtttcaaatccttttacctcttgttattggggcatctgatcccctagttgatttgtcatggattctgatcttgtctgtgaccataagttagtcaaatctgccgacttgt

SEQ ID NO: 3480 - DNA, 526 bp, Brassica napus
tcagcgtcttgtataccgctcgcgtcacagctacgccacccaatactaaccagcacaggatcgtacaaacccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttcaaaaggctaaggaaaaggttgctcccaggagctagataattcatattagcttcttttggaaaaaaaaaatgtttaatggatctgttctagcaaatggtactggttgcagaagttgagggaaatacttattgttatccgttgagttttgattctgaagtctattctacgaaacttgagtactgacctaggcacgaacgtacggg

SEQ ID NO: 3481 - DNA, 493 bp, Valeriana officinalis
gagagagagagagaaggagaaggagatcgttgactgctacgatggtgcaacgtctgacttaccgcaagcgccatagctatgccaccaaatccaaccagcacaggatcgtcaaaacgcctggaggaaagttagtgtaccagggaacgaagaagagagcaagtggaccaaagtgtcctgttactggcaagaggatacaagggattcctcacttgagacctacggagtacaaaagatcaagattgtctagaaacaggagaactgtgaatcgtgcttatggcggtgttctatctggtggtgcagttagagagagaatcattcgtgtcgtttttgggtgaggagacaaaagatcgttaaagtaagggtttttgaaagtatttcaaagtaaaaacaaaaaagaaaaaacaatacatacaaagggtctttaaagtttggttagtagtttttagttttctataattagtaaattttagtacttttagaaagacgtagtggc

SEQ ID NO: 3482 - DNA, 350 bp, Brassica napus
aaaaaatggttcagcgtcttgtataccgctcgcgtcacagctacgccaccaaatctaaccagcacaggatcgtcaaaaccccaggtggtaagttgacttatcagaccactaagaagcgtgcaagtggacccaaatgccccgttaccggcaagcgtattcagggtatccctcacttgaggcctgctgaatacaagagatctagattgtctagaaacaggaggaccgtgaaccgtgcctatggtggtgttttgtctgctttggctgttagagaaagaatcgttcgtgctttccttgtggaggagcagaagattgtgaagaaggtgttgaagcttacaaaaggctaaaggaaa

SEQ ID NO: 3483 - DNA, 612 bp, Adiantum capillus-veneris
ggcgcgatggtgcagaggctcacgtatcgtcgccgccatagctatgcaaccaagtccaatcagacccgcgtcgtaaagacgccaggtgggaagcttgtcttgcagtacgccaagaagagagcaaatgggccaaagtgtgccatcacagggaagcgcatacaagggattcctcatctgcgccccgctgaatatagaaacacgcgtcttagcaagaggcaaaagactgtaaaccgagcgtatggcggcgctttgtcaggaggggcagttcgagagagaattatcagagcttttcttgtggaggagcagaagattgtgaagaaagtgctgaagattcaaaagtcgaaggagaagcaggcatcaaaggtttagtaatatggccaagaatgctactccctttaccattatcactggcgtatacctgccttcctttatttgtaacattggcgatcaacaagatggctctactttaaagtaggctgagctataaatctgttaggaaattttggaaactgtatttggtcatgaaacgaaggcaatattatcttaagctccgctacttgtgtttgatgtcatctagtgacattgaggtttcttatatcctttgaacttttt

SEQ ID NO: 3484 - DNA, 485 bp, Raphanus sativus
  misc_feature (12)..(13): n is a, c, g, or t
  misc_feature (18)..(18): n is a, c, g, or t
  misc_feature (54)..(54): n is a, c, g, or t
  misc_feature (61)..(61): n is a, c, g, or t
  misc_feature (105)..(105): n is a, c, g, or t
  misc_feature (109)..(109): n is a, c, g, or t
  misc_feature (134)..(134): n is a, c, g, or t
  misc_feature (239)..(239): n is a, c, g, or t
  misc_feature (409)..(409): n is a, c, g, or t
ggagggagaaanngcggngcggcgaaaatggtgcagcgtcttgtatacaggtcncgacacngctacgccaccaaatcgaaccagcaccgtatcgtcaagactccnggangtaaattggtgtttcagaccacaangaagagagccaatggccccaaatgccctgttactggcaagcgtatccatggaatccctcacttgaggcctacggaatacaagaggtctagattatcgagaaacangaggactgtgaaccgtgcttatggtggagtcttgtctgctttggctgtcagggaaaggatcgtacgagcattccttgttgaagagcagaagatcgtgaagaaagttttgaaactccaaaaggccaaggagaaagtagctaccaaggcttgagcgttttatgttttttgantttagccttgaaaggatacacatctttttttactttgtctttgacaatatgaattacatatatttttacctgtcca

SEQ ID NO: 3485 - DNA, 644 bp, Sciadopitys verticillata
ggagagggagagggagagggagggtgaaaatggtgcagagactaacgtaccgcaggcgtcacagctaccacaccaagtctaaccagactaggattctcaaaactcccggtgggagattgatttaccagactgcgaagaagagagcaagcggccccaaatgtccagtcacaggcaagagaattcatgggatcccccatttaaggccggcggaatacaggaggccaagactccaaagaaataggagaactgttaacagagcttatggaggcgtattagcagcttcagcagttcgcgaaaggatcattcgagcctttttggttgaagaacagaagattgttaagaaggtgttaaagatccaaaagtccaaggaaaagatgactgcgaagagttagaggcggtaacttttacttgtctttcaaaatgcaccaattatattagtgtgaacgcaggtggtgccagcaacagtttttgaaaatttggaacagtaaatactgctaattgtgttggtgtgagtgctgataatattctgtgtttgtttgaggcttggaacaattgtttttaccatttaccattgaagcattttaatttttaattaagcattttcaggcttatgtgaattacagtgatggttaatgtgccgagat

SEQ ID NO: 3486 - DNA, 442 bp, Brassica oleracea
ggaggagaaagagcggcgaagaaaatggtgcagcgtcttgtataccggtcgcgacacagctacgccaccaaatcgaaccagcaccgtatcgtcaaaactcctggaggcaaattggtgtatcaaaccaccaagaagagagccagtggtcttaaatgccctgttacaggcaagcgtatccatggaattcttcacttgaggcctacagaatacaagaggtctaggttatcaagaaacaggaggactgtcaaccgtgcttatggtggagtcttgtctgctttgggagtcagggaaaggatcgtacgagcatttcttgttgaagagcagaagatcgtgaagaaagttttgaaactccaaaaggttaaggagaaagtaggctaccaaggtttgagggttttacgttttttattttattttggggatacatctttttcacttatctttg

SEQ ID NO: 3487 - DNA, 929 bp, Eragrostis curvula
  misc_feature (34)..(34): n is a, c, g, or t
  misc_feature (929)..(929): n is a, c, g, or t
aaacaagcagaaagaaccaaaaaaaaaaacaccncccagtgttttttgcgacggctcctacggaagcggacagctacgccacaagtccaaccagaccgcgtcgtcaagaccccggtgggaggcttgtgtaccagtacaccaacaagcgtgcgagtgggccgaaatgcccagtcaccgggaagaagatccaaggaattcctcacctgagacctactgagtacaagaggtctagattgccaaggaacaggaggaccgtgaaccgtccatatggtggtgttctgtctggtactgctgtcagagaaaggattattcgggcgtttttggtcgaggagcagaagattgtgaagaaggtgttgaagatccaaaagactaaggacaaggcctccaagagctagacacttgagtcaggcatttctgccacaatgtttaaagcttttcaaatttgtttcagtaagaagtttctcatggttttgggaaattgtggatgtaatgctagcatgtgagattgatgccattgctttaaattttgtgcgctaattgtggatgcttctgcgcgaatttttaaccccccaggtcgctgggacttgcttcactcctcctatgcacgatattctgttaccctggttgctctgggctcctttcgagttcccgaatggtggtgacctgggttttaaattgggccaaaggacacagaaaaagactaacacacacaagtaaccctgggatggataccactggctttaatccgtagagggaattccggaggacgcgcttaaagtttggacaacatgtggaagaaagttcccaagagcgcgttgggatgcgaaatagcgtgagagttttgaaatagaggggcacacattagaatgagcttgggggagagagattggggcccatacgatgggagacctgggtggagaaatgggagn

SEQ ID NO: 3488 - DNA, 451 bp, Triticum aestivum
  misc_feature (263)..(263): n is a, c, g, or t
  misc_feature (340)..(340): n is a, c, g, or t
  misc_feature (351)..(351): n is a, c, g, or t
  misc_feature (360)..(360): n is a, c, g, or t
  misc_feature (424)..(424): n is a, c, g, or t
  misc_feature (440)..(440): n is a, c, g, or t
gagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcangactgtgaaccgtccatatggtggtgttctgtctggtaccgcagtgagagagaggatcatccgtgcctttttggtcnaggagcagaanatcgtgaanaagttttgaagatcaaaaaaaccaaggataaggctccaagaactaggcatatagcatcttccanaatgttaagtccttanaattgttcaac

SEQ ID NO: 3489 - DNA, 724 bp, Ceratodon purpureus
gacggcgaggctctcttttcgcgctctgcttgctgggttgcgccatcgccaccgatcccccggagcctcgcagctttcgcagcgcactcccaagcctgccaccatggttcagcggttgacatacaggcggcgtcactgctatgccaccaagtctaaccagacccgcgtggtcaagacccctggaggcaagcttgtgttccagactgccaagaagagggcgaatggccccaagtgcccagtcaccgggaagcgcattgctgggatccctcatttgaggcccaccgagtacaagacttctcgccttcacaggcacaggaagactgtgaaccgcgcttacggaggcaacttggctggctctgctgtgcgtgaacgcatcatccgggctttccttgttgaggagcagaaaatcgtgaagaaggtcctcaagatccagaagtccaaggagaaattggcttccaagactcaggcttaagtgtaatcgttttatgaaattttatgagaaccatttaacgacggttatttagtttccggattttgtattctccgatcttcactatctggaagattatttctgttttgaattttaatgtggttttgagtgaagtttcactgaagttccttctccagccaattctcgtcaatccttcagacgtggtgcttttcactgtgatcgatgcaatggtgctctgttgcccatcgatgtcatgttacaatgatggtgctt

SEQ ID NO: 3490 - DNA, 740 bp, Ceratodon purpureus
ctgggttgcgccatcgccaccgatcccccggagcctcgcagctttcgcagcgcactcccaagcctgccaccatggttcagcggttgacatacaggcggcgccactgctacgccaccaagtccaaccagacccgcgtggtcaagacccctggaggaaagcttgtcttccagaccgcgaagaagagggcgaatggccccaaatgcccagtcaccgggaagcgcattgctgggatccctcatttgaggcctacggagtacaagacctctcgcctgcacaggcacaggaagactgtgaaccgcgcttatggaggcaatttggctggctctgcagtgcgtgaacgcatcatccgggctttccttgtcgaggagcagaagatcgtgaagaaggtcctcaagattcagaagtctaaggagaaaatggctgccaagactcaataagtgtaaccattttatgattcctaccggggccattcaactacagatctttagatgttggagatttgtagtctccaaatttactctgtggaagattattatgatcttgaatctcaatgtcgttgtttgagtaaggtttgatctgttttctcttgcgaatctctttctatcacgaagttcaagacgttacttgctctaaaaattatgtactcatcatgtatactaggaagccagcggtcatttgttcctctttgttgcagtacttggtcattctattcatgtgcttcaaagtaatgttaatgtgag

SEQ ID NO: 3491 - DNA, 562 bp, Triticum aestivum
cgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggccaggttgtctaggaaccgcagaactgtgaaccgtccctatgggggagtactatctggaactgcagttagagaaaggtcatccgtgctttcctggttgaagagcaagaagattgtcaagaagtgttgaaattacagaagaccaaagacaagactcctcaaaaaataactctgaaacagaagtgagcaccctctgcagcaagggaagacattttgtccacattatatcaatggcttatctctccacctgttccatgtccttgtatcttgaccggcaacggttctagggacctcaaatcctctacaaatcctaagattacagatgacatatacccccatgctttgttacttgc

SEQ ID NO: 3492 - DNA, 622 bp, Flaveria ramosissima
cctccagcctccactcagaaccaccgtcaagcagtaaacagccgccggccggaaaatggtgcaacgactaacctaccggagacgacacagttatgctaccaaatcgaatcagcatcgggttgtcaaaacccctggtggtaagctggtgtatcagactactaaaaagagggctagtggacctaaatgtcctgttacagggaagagaattcaagggattcctcatttgagacccgctgaatacaagcggtcaagattatctaggaacagaagaactgttaaccgcgcttatggtggagtactttctgcaggtgccgtaagggaaaggatcattagggtctttttggttgaagaacaaaaaattgtgaaaaggtgttgaagatccaaaaggcaaaggaaaagactgcttcaaaggcttagatttctagcatttctgcaattctcatgagagtaattataggttatctagattttgaatctttaatcgggtaagcgggatggtttatgtttcgatttttctacttcgtcgacaaacaaacatggttgactatgttaggtttttgtttggtgttctaatggctttatgagacgctgttttttatttcgtttaacgagatgtatttac

SEQ ID NO: 3493 - DNA, 529 bp, Linum usitatissimum
caagcgccacagctatgccaccaagtcgaaccagcacaggatcgtcaagactcctggtggtaagttggtgtatcagcccactaagaagagggccagtggacctaagtgccctgttactgggaagaggattcaagggattccccatttgagccctgctgagtccaagaggtcgagattgccgaggaccaggaggaccgttacccgtgcttatggtggtgttctctctggtggtgctgttcgtgaaaggatcatccgagctttcctagtcgaagagcagaagatcgtaaagaaggtgttgaagatccagaagtccaaggagaaggtcactaagtaaatgtgatgtgtaactcttgagaaaagatgtgtcgaaacacccagtaatagaaggaatccgtttgattccattagagttggtttctgatttttggattttgtttgtgcttctgtttttatctccgaatgaatgttgaattgttattactcttttgagctttcgtttaaaaagttttgtgccctaagcccaagttcc

SEQ ID NO: 3494 - DNA, 633 bp, Actinidia deliciosa
ccaaatccaaccagaacagggttgtcaaaacccctggagggaggttggtgtatcagaccacaaagaagagagccagtgggcctaagtgccctgttactggaaagagaatccaagggattcctcacttgagacctgctgaatacaagaggtctagattgtcaaggaaccgtaggacagtaaaccgagcctacggtggtgtgttgtctgggggtgctgtgagggagaggatcatccgagccttcttggttgaagagcaaaagattgtgaaaaaagttctgaaaatccagaaggcaaaggagaagcaatcctcgaagaactaaaatggagtgataaaacaagagccccctttcagatcatattatgctcgaaatggagtcttgactttgatgatgacgatcatgaagacctgcaacaatttcatgtttcggtgcctcggaaattatcttacctaacttgttacttgggaacaccttgttcagtttgtcgacaaatcaatctctagagacttcttgttttccttttggcatcgttgtgctttgaccaagtatttgatgtttgattttgcacttaaaaagtagttgactttgtgtttatgttttaagaaatatcgatcggatggttctgtatgtgttg

SEQ ID NO: 3495 - DNA, 780 bp, Ceratodon purpureus
gtcactatgtagataccccctcttttcgcgctctgcttgctgggttgcgccatcgccaccgatcccccggagcctcgcagctttcgcagcgcactcccaagcctgccaccatggttcagcggttgacatacaggcggcgccactgctatgccaccaagtctaaccagacccgcgtggtcaagacccctggaggaaagcttgtcttccagaccgcgaagaagagggcgaatggccccaaatgcccagtcaccgggaagcgcattgctgggatccctcatttgaggcccacggagtacaagacctctcgcctgcacaggcacaggaagactgtgaaccgcgcctatggaggcaatttggctggctctgcagtgcgtgagcgcatcatccgggctttccttgtcgaggagcagaagatcgtgaagaaggtcctcaagattcagaagtctaaggagaaaatggctgcgaagactcaatcttaagtggtaccgttttatgattcttaccggggccattcaactacagatctttagatgttggagatttgtagtctccaaattttactctgtggaagattattatgatcttgaatctcaatgtggttgtttgagtaagatttgatctttttttctctggatctctttttatcttgaagtttaagacgttacttgctctaaagttatgtactcttcatgtatactagtaaggcagcggtcatttgttcctctttgttgcagtaaatggttattctattcatctacattaaagtcatgttcatgtgag

SEQ ID NO: 3496 - DNA, 547 bp, Gossypium hirsutum
aggcgaagaaacatggttcaacggctgacataccggaccctccatagctatgccaccaagtccaaccagcaccgggtcgtcaaaactcctggtggaaaacttgtctaccacacaactagcaagagagctagcggacccaaatgtccagttcctggcaaacgaatccattggattcctaactggagacctgctgaatacaagaggtctaggttacctaggaacaggaggactgtgaaccgcgcctatggtggtgtgtgatctggcagtgcattcagggagaggatcattctagccttttaggttgaagaacagaagatagtgaagaaagtattgaatattcacaaaactaaggaaaatgtttcttcgtcgaactaaaggatgagatctcggaagctttacttggaatgttacttttgtttcgattaaatcttttgacatgaagacactataaatcgtgagcattgtattatggtgacgtgtttggtcctgcaataatagagcttaaaaaggactttagagtcctttataaccggccgaggacccatgg

SEQ ID NO: 3497 - DNA, 876 bp, Citrus sinensis
ggaaccgcagtacgggtcggaattccgggtcgaccacgcgtccgacgagatcctctgggtgtcctttttgaggactcctcgaaagcgagcgaaaatgggtcaacccctctcataccgcacgcgccacagctatgccaccaggtccaaccagcaccgcgtcgtcaaaacccccggggggactctggtttaccagagcaccgagaagagagcaagtgggcctaagtgtcctgtcactggaaaaaggatccgaggaattcctcacttgagacctgctgagtacaagaggtctaaactatctcaaaataggaggactgtcagccgtgcctatgggggtgtattatctggaggtgctgccagggagaggattatccgggcctttttggtggacgatcataagatggtccagatggtgctgaagattcagaaaggcaaataaaagctggcatctaagagctaaatttgagacagcagctttttgttttgcccttctaatttgcccacgccactttccgaattgcttccatgtctttaagggggcatcttagccctgtgctcatcaaaactgaaagaggaatttgactacacccttcaagggcacccacgaccccacccctcgccaaacactcacctcctattcgctaaacaaacggtacggtgtaccataagcaattagcaaaagcaaacttctcggcgcccccgcgacgcacaccacctcgcactccctaggtcccgtcccgaccacaacccccttacccctccgcgctttttgcctcccacgacggcggccataactcctgaccacgaccggtgcgtgagatccccgcatagtcagcatggctcgacctcgaataccgtagcgtacgcccgccgaacgcc

SEQ ID NO: 3498 - DNA, 662 bp, Physcomitrella patens
aaccctctttgcgcttttgctcagctggtgcgccattgctcagcctgtgacggagcttcgcatcggttattttgtgtggggtggggtgacaccatggtgcagcgtttgacctacaggcggcgccactgctatgccaccaaatccaaccagactcgtgtggtcaagacccctggtggtaagaatgtatttcaaaccgccacaaagagggctcgaggacctaagtgtccagtaactgggaagcgcattgctgggattcctcacttgagacccacggagtataagacttctcgtcttcaccggcacaagaaaactgtgaaccgcgcgtatggtggcaccatggcagggtctgcagtgcgtgagcgcatcattcgagcattccttgtcgaggagcagaaaatcgtaaagaaggttctgaagattcagaagtccaaggagaaattggctgccaaggctcaatcttaagtgaaactgttttttgaaagaaatgagaaatgctgagggaaagagtttcatgttttggaatttgaagtcttcaaattgtactgtcattatgtaatcattttctgatagtgaacctcaacatgatggtctgattggaatcattcctctttctttcttttgcaaatcttcgtcaatttctaagagacatctgagttggtgtt

SEQ ID NO: 3499 - DNA, 592 bp, Physcomitrella patens
ctctttttgcgctcattctgtctgcgctccaccgccatcacctctcttttacttgaactcagttcaagttcaagttcaaccgaagcttcgtcaccatggttcagcgattgacttaccgccgccgccactgctacgccactaagtctaatcagactcgcgttgtcaaaactccaggtggcaagaatgtattccagaccgctactaagagggctagggggcccaagtgcccagtcactggaaagcgcatcgctgggattcctcatttgagacctacggaatataggacatcccgtcttcacaggcacaagaagactgtgaaccgggcctatggtggcaacctggctggttctgcagtgcgggagcgcatcattcgcgctttccttgtcgaggagcagaagattgtgaagaaagtactgaagatccagaagtcaaaggagaaattggctgctaaaactcagtcttaagtggtgagattagagttttgtactattcaatgagcacttggcgaatgacattttgtcggatagaggactttccatcccttttcttatgatcaattgaaagctacctggcattttaatcctctttagta

SEQ ID NO: 3500 - DNA, 366 bp, Rhizophora mangle
gctctcacactctcagaaaccctagagagagaaaaaggagttgggtcggggatagagagagaacaaatggttcagagactcacgtatcgcaagcggcatagctatgccaccaaatcgaaccagcaccgcgtagttaaaacccctggggggaagttggtttaccagtccaccaagaagagagcaagtggtccaaagtgtcctgttactggaaagaggattcaagggattccccacttgagacctgctgaatataagaggtcaagattgccaagaaaccggaggacagttaatcgtgcttatggtggagtattgtctggagctgctgtcagggagaggattattcgagccttttggtggaagagcaaa

SEQ ID NO: 3501 - DNA, 716 bp, Orobanche aegyptiaca
cttccgtccgccttttatccaagcaagcagtggagatagatttgaggtaagcacgaacgaaaatggtgcagaggctcacttatcgtaagcgtcacagctatgccaccaaatccaatcaacacagaattgtcaaaacccctggaggaaagttggtgtaccagagcactaagaagcgggctagcggacccaaatgccccgtcaccggcaagagaattcaagggattcctcatttgaggcctgctgagtacaagaggtctagattgccaagaaaccgcaggactgtgaaccgtccttatggtggtgtattatctggaagcgctgtaagggagagaattattcgggctttcttggtggaagaacaaaaattgtgaagaaggtattgaagattcagaaggcaaaggaaaagcaagcttccaagagctaaattcaaggcattgattcagaatgttttgcctatcatgatgatgatgtaacagatgttgtggtttttgttacttgttgaatccaaccttcaagttttattgaaatgactctagttttgaaaatttgttcgtttctttaatcagtttacaagtatgttcatcagtcgacaatatatttttctgaagtttctcttagtgctaatgctaccttctgatcgactttgttttgtgtactctggttatgttaaatacatcttctatatttttcataaacaattttatttgtatatattt

SEQ ID NO: 3502 - DNA, 673 bp, Pteridium aquilinum
ctacaaaatggaaccgttcgatgaggaagcagcacgaccgtcagatctagggctttgataaacacccataactgtccggtccattttccattacgagtcttctgtagttgctgaaggtctgcgagttccatcgcagcagcagccatggtgcagcgtctcacctaccgtcgtcgacatagctatgctaccaagtccaatcaaacccgggttgtgaagacaccaggtggcaagcttgtctttcagtatgccaagaagcgggctcaggggcctaaatgctcagtcacaggaaagcgaattcagggggttccgcatttgcgacctgctgaatatagaaacactcgcatgagcaagagaaagaaaactgtaaacagagcctatggtggtaccttgtcaggaggagcaattcgagaaaggatcatacgggcttttcttgttgaggagcagaagatcgtgaagaaggttttaaagatccagaagtcgaaggagaagcaagctgccaaggctcaagcatagctaatcaaactatgattaaagttttgcggctgagactctgtagctaggtgaatgagggatgaatcttacttaatacatgttttggatgcaatgaaatctctggtttataaaagtgttgtggcagagcttctcttattgatgttgaaaaatccatccttgg

SEQ ID NO: 3503 - DNA, 616 bp, Adiantum capillus-veneris
cctcctcgtcaattctcctgatttgcagcggcagaggcagcagcagtagccatggtgcagcgcctcacgtaccgccgccgtcacagctatgcgaccaagtccaaccagacccgggtggtgaagactccaggcggtaagcttgtatttcaatatgcaaagaagcgcgcacaggggccgaaatgtgcaatcactggaaagcgtattcaggggattccacatctgcgacctgccgaatatcggaacactcgtttgagtaaaaggaagaagacggtcaatcgtgcatacggtggtgctttgtcaggaagtgctgtccgtgagagaattatccgggcttttttggtggaagagcagaagattgtgaagaaggttctgaagatccagaagtccaaggagaagcaatctgcaaaggcccaagcataaatcattagatttcttgcctagtgttgcagctaagggtgctgaaactagattttgagagatttttgtaatgtttgccctctcctttttcaaaggaagtgttcacagctgagataattttaaaattgtgaaagagggcccatgatccatacctgtgcaatagagaaggggtattttaatcattgagttttcttggttt

SEQ ID NO: 3504 - DNA, 837 bp, Physcomitrella patens
attctcttcgccccttgcagctctgcgaggtcctcctccgccatcgccacgccctgcctgaggtgaaaagccaaggtccgtcactatggtgcagcgattgacgtatcggcgtcgccactgctacgccactaagtccaaccagacccgtgttgtcaagacccctggtggcaagaatgtcttccaaaccgccacgaagagggcgagaggacccaagtgtcccgtcactggaaagcgcattgctgggattcctcacttgaggcctacggagtacaagacatctcgccttcacaggcacaggaagactgtgaaccgggcttacggaggcaccatggctggttctgcagtgcgcgagcgcattatccgggcttttctggtcgaggagcagaaaattgtaaagaaggtcctcaagatccagaagagtaaggagaaattggctgccaaggctcaatcttaatctgtaattgtttgatgatattaatgaggattattcaatgaccgtacctcaaatttcggaatttgctgagcccatgtttcgtctgtggttgtcaccttaaatcttcatgtggatgtctgacttcaatatgtttccttcgttaacccttctgaggttcagggctttaaatagcagtggacacgtattgtatttcgaggtgcagtgtttactaagcggtagcccatcgacgtagtggtgaggtggaatttccagtcacctgtgcttttcattaattttggttgaaaaggctggagatagtgcaaaacctgtagctctcacttcctggtgctccttaaaagcttatcacaatgagcttgaatagaactatcttcttttaatgaatc

SEQ ID NO: 3505 - DNA, 860 bp, Physcomitrella patens
actcttcccttccgccttgcagctcgacgagctccccgttcgccatcgccatcgccacgacctgcctgaggtgaaaagcgaaggtccgtcactatggtgcagcgactgacgtatcggcgtcgccactgctacgccactaagtccaaccagacccgtgttgtcaagacccctggtggcaagaatgtcttccaaaccgccacgaagagggcgagaggacccaagtgtcccgtcactgggaagcgaattgccgggattcctcacttgaggcctacggagtacaagacatctcgccttcacaggcataggaagactgtgaaccgggcttacggaggcaccatggctggttctgcagtgcgcgagcgcattattcgggcttttctggtcgaggagcagaaaattgtaaagaaggtcctcaagatccagaagagtaaggagaaattggctgccaaggctcaaacttaatctgtaactgttttatgatattaatgaggatcattcaatgaccgtgccacaaatttccgaatttacagatcccatatttcgtctgtggttgtcgccttaaatcttcatgtaaatgtccaactctaatatattcccctcgttaaccctgctgaggtccagggctttaaacagccgtggacacgtattgtatttcgaagtgcagtgtttactatgtggtagcccatcgacgtagtggtgaggtggaatgtccagtcacctgtgcttttcattaattctgattgaaaaggctgtagatagtgcaaagcccgtagctctcacttcctggtgctccctaaaggcatatcacaatgagctcgaatagaactatgttctttaatgaatccaaaatgtgctttaaa

SEQ ID NO: 3506 - DNA, 773 bp, Physcomitrella patens
gccatcgccatctctgcagaagcagccttcgccgaggtcttccatcatggttcagcgattgacctaccgtcgtcgtcactgctacgcctccaagtccaatcagacccgcgtggtcaaaacccctggtggtaagaatgtcttccagacagccataaagagggcgaggggcccgaaatgtccagttaccggaaagcgcattgctgggattcctcacttgaggcccacggagtataagacatctcgccttcacaggcacagaaaaactgttaaccgggcttacggaggcaacatgtctggttctgcagttcgtgagcgcattatccgggcttttctggtggaggagcagaaaattgttaagaaggttctcaagatccagaagtccaaggagaaagtggctgccaagactcaatcttaggctgtaattgtgttatacattaatgagaattattcaattccttagacttctgagtttgtggagtccaattctgcacacgattgttgtcttaaatctgaatgtagattccccttctgtgtattttcttggatggtagatttgcagcagcataaatttgtaatagtggtgcagcattcattagtatgccttaaaactttgagatatcactttttgttctccccgaccttcttctcactttcattggttttataatattgcatgagatagtgtttcaccatttcacagtccaatagtcctatgggtctgtgtcccttttctcagtggtgatgagaaaaatggagcattcttcacggtacga

SEQ ID NO: 3507 - DNA, 418 bp, Flaveria ramosissima
caacatagggttgtcaaaaccccaggtggtaagctcgtgtatcagactacaaagaagagggctagcggacctaaatgtcctgttacagggaagagaattcaagggattcctcatttgagacctgctgaatacaagaggtcaagattatctaggaacagaagaactgttaaccgcgcttatggtggggtactttctgcaggtgccgtaagggaaaggatcattagggccttttggttgaagaacaaaagattgtgaaaaaggtgttgaagatccaaaaggcaaaggaaaagactgctgcaaaggcttagatttctagcatttctgcaattctcatgagagtaattataggttatctagattttgaatctttaatcgggtaagcgggatgttttatgttatcgtttttctacttcgtcga

SEQ ID NO: 3508 - DNA, 912 bp, Cryptomeria japonica
  misc_feature (380)..(380): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (392)..(394): n is a, c, g, or t
  misc_feature (398)..(399): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (658)..(658): n is a, c, g, or t
  misc_feature (793)..(793): n is a, c, g, or t
ggggccatccctgccacacgactgagcaaattttaactcgcaacgaatattttagggtgtcgcattgggaaaaaaaatctgctttgttagggtttcgtaatagttttcctgcaaaccctgtcaatttttctcattgatagcacgacacaatttttgcagaatcttgagtgtgaaggatagattagggcttagaggtggttgtcaaaggaaggagaggcaaagatggtgcagaggctaacataccgcaggcgccacagctatcacactaaatccaatcagactcgaattgtcaaaacccctggtgggaagctaatctaccagactgccaagaagagggccagtggacccaaatgcccagttactggcaagagaattcaagnaantncncattnnnggcnngngantncagggtgagcaggctgaaaaggagcaggagaactgttaacagggcctatggcggggttctgactggttcagctgtgcgagaaaggattatccgggcgttccttgttgaagagcagaagattgttaagaaggtgttgaagattcagaagtctaaggagaagactactaagagttagaaatgaggatatgatagtataacaggcatttttacctataggttatcaagatgaactgtggtaaccaaatattttgnttaatgttgagaaaagtagattgtttttttggcccaattatgggtagctatgagcatacttagtccctttcatcacacagagggcttgaggttttattcatcttaaaacggacagtatttgtcaatcatctaccnggaactattttttttaagtcattcaagtggactatatgtattgtatgctagttgttcatttacattgactttttttacatgtttaaaattgctaattgatgataaaaaaatttattctc

SEQ ID NO: 3509 - DNA, 793 bp, Physcomitrella patens
agggcgccgctgactctcttcgtgctcttctgtgttgcgagatcgcagtaccggaacatagcaggctatctcctggtctgtcaccatggttcagcgattaacgtaccgtcgccgccactgctatgccaccaagtcgaaccagacccgcgtggtcaagaccccaggtggtaggaatgtcttccagaccgccacaaagagggcagctgggccgaagtgtccagtgtctggaaaacgtattgctgggattcctcatctgagacccacggagtacaaaacctctcgtcttcacaggcacaagaagacagtcaaccgggcctatggcggcaacttggctggttccgcagttcgggaacgcattatccgagcttttctagttgaggaacagaagatcgtgaagaaggttttgaagatccagaagtcaaaggagaaattggctgctaagacccaatcctaagttatttgagattagtttcactgagcacttcatgagcaacagtatgtctgctatgagaacttagtcttttctattgattgatctatagaaggccctctgagatttcaattctcttgcgtattgttgatttgtgagtattgattgcctcgagtatcggttcatcgattatgtcatgtttccatgtgagaatattttggaagggtgaggatttcaaggatgggcaacacacaaagtttcgtgattattttctacgattcagcagctcattagaatgagcggtaatgccctaaaatgaaacattcgctcgtaaaattgattattaacattttgaagggaaat

SEQ ID NO: 3510 - DNA, 2489 bp, Glycine max
taatggtggtgaagatgatgaggtggcggccatggccgcctctcctctcgaagaagttccaagtgaggctgctcgtgcggaggctccagggctgcgatctgctgcggaacgctgcacgtgaaggttccaaattggttcttgagattcgctggaagggtcctaagttgacccttggctctctgcgacggagctccgtcgcgagaaactttactaaagaggcggaatttgacgtcgacggcggtggcgccgccgtggttcactgggacgaggagtttccgacgttgtgcaatttgaacggttacaaagacaatgtttttcacccttgggagatcgctttcactctctttaatggattgaatcagaggccgaaaaacaaggttcctgcaattggaaccgcattattgaatattgctgaatttgcatcttcaactgatcaaaatgattttgatttaaacattccactcacactaactggaggttctggggagctttctcctttactctgtatatcaataagcttgacggaggtaagcgtagctcaagaaagcgtggagccaattcagagatctatagtgcctgggccatcgccctccgccaagtcgggagaaacagccttggtagaaaaagatgagctttctgctattaaagctggtattaggaaagtaatgattttgacggagtttgtatcttccaagaaatcaaaaaagggatgtcgtgaggaagaaggaagtgaaggtaggtgctctagaagtgaggatggtgaatacaattatcctttggattctgagtcaattgatgattctgaggaaggtgaaacagatgaggggaaggaggattccagcattaggaagtcattcagttatggaacactggcctctgcaaatgctgggggattttttcattccaatatgagagtaaattgtaatgatgaagactgggtttattacagccatcgaaagtctgatgttgggtgttcacggatggaggattctacaacttcttcttctgatccatatttacaaagttctaagcgcagcatacttccatggaggaagaggaagttgagtttcagatctcctaaagcttataagggagagccgttgctaaagaagtcatatgcagaagaaggtggtgatgacatagattttgatcgccgtcaacttagctccgatgaatccctttctttgacttggtacaagactgaggatgacttgtctgcacatcgatcgtcaatctctgaatttggggatggcagttttgctgtagggagttgggagcagaaagaagtcatgagtcgtgatggtcatatgaagcttcaaacacaggtcttctttgcttcaattgatcaacgcagtgaacgtgcagcaggtgagagtgcatgtacagctcttgttgctgtgattgctgactggtttcaaaataatcgtgatcttatgcccataaagtcgcagtttgatagtctaattagagaaggctcctcagaatggaggaacctatgtgaaaatgatgcctatagagagcggttccctgacaagcattttgacctggaaacagtcattcaagcaaaaatacgtccgcttactgtggctcctgggaagtccttcattggtttttttcatcctgaagggatggatgaaggcagatttgactttctgtatggtgccatgtcttttgataatatttgggatgagattagtcgtgctggacaagagtgccctagcaatgttgaatatgattgttattacatcattgacactttgggagagagactttatgaagggtgcaaccaggcatatatcttgaaatttgacagcaacacaatgatgtacaaaatgccaaatgttgctcattcatcagataacaagacatccaatgaccagcaaactgtagcagaaatattagatcctaataatagtcaaacccaacaagtaaatagcaaggaggtggattctgttgcaggggaggaagaacagttgaggagtgagacagaagaagttatatgcagagggaaggaagcatgcaaagagtacattaaaagcttcctagctgcaatccctatcagagaattggaagcagatgccaagaaaggcctcatttcttcagcatccctttaccatagactactacaaattgagtttcattacacccaattgttaggtgaaacatcaatggctgaaccagagaccttagctcttgcaataactgaggcttctaccataaccaagctgtaaattgaagaaaatgcgtctatgctaacttattttactactttaaccattgatgttcttctgattttgaactgaatttaattataacatatggaggctcgtataagcttttggtgcgagcaaatgagtgagctgagcttttatttgcgcagttctgtttggcacttgccttgttttatatttacctgtaatctttcttgggaaggttattctgtaaatggctatgtagtttccttttcaagtcagtgcatacgtttggca

SEQ ID NO: 3511 - DNA, 2108 bp, Glycine max
ggcttgatcaatcgactttcgacgagggcaagctctcacctttgaagccccaattttgaagagatataactggcctgacagaaactgagaggatgaaacgtaataatagtgtttatcccgctgcacttaactgtgatgacatcctgcatgagatcctacttcgaataccaccaccaactatctccaaattaattatcgtatcaaaaatatggctgcgtgtgatatgcagtccttcatttcgtcaatgctacgtgaggcaatggggacaaagttttcgacttttgggtttttttgtatgcaattttttatatcttggaagacctcgtgatggctatcgtcgccctcgttgggagcctgccctcccaatcttgtccacttgcaaagacggtgatgatttgaaactttctggaatcctcaaacatcttgggtacttcgttgatagttccaaaggcattattctttctggtttccatccaaaggcatattatgtgtacaatactgtgaccaagcaaaagtatgactcccagaacctcagcaattctataaagttctgtgatccgtgcagatgtgaatgcaaactaaaggaacgcaacactgtctcaattgagacttactcatcaaaaagtagacaatggaagcaatccactctgatgtgctccacaaccttagcattgtgcccgaggacggcagctatggtggttggaggggttgtacactggtttgcaatgtggggaaaacttgccatttatgatcctcgtcttggagacaggtatatagccttgataaaactaccaacaggtgtgttaacacacgagcatgaggaatctgttcttggggagtcatctgatgggcttttgcagtatggccagagcaataacttgggtctggagatatggatacttgagaaggaagcaggagccaactcatctatttactgcaactgcactcatctgaagtacaagtggattctgaggtggagattaaactttaaagtattatggaagcagatgccgtctttaagcacacattctaaagaaactcagatattgtcattccttcctcagaattctacatctatcttcattaggtcggggtggaacattttgctgtgtgatttggagaccaaaacggtggaaattgttaattatcagggtcgtggaggtaccatttcatgggaatctagcaaagtagttccttactttctaccagcttggccacacacttcctcggtgtcggtgtcatgacatcatggaacaagggaaaacttgtcgtttttcaatctatatgcacttggtcttttcaatctaaaagttaagggtttgtttttattttctgatttcacttttaattagaaaactatcatcttgttttcaatctaaaagttgttttcactagtttctatacaaatctttgaaaactggaaataaattgaaaacaaggtaacaattttataattaaaagtaaaaaccaaaaaacattttgtcaaagtaaacggaccctacgctttaaacttgtttgttctgttttgaagtctagccatagtattagtaggtccttcatttctcttgtacatgcctagaggttgctgttttatcaaaacgctgaaaaatattactcttttgattgtgttctatttagtcttctcgtagaagaattcagaattgcagcctgatacagtcgcaacaagctgcatataatggtttccaaagatgaagatgcaagactcttgtttttaaccgtttttgtttggttttgttaaagtagaatttgaatatagttttgtttgattatggtaactatgtatatgaatttcatacattgaaaactgatgtcctttagcaaaacacattcggtgtgctcaagggtggtagttttgtttctactagagaacagcaccagtggaagctattctacgctagttttcatacattgtgtattttctagagaaatatagcattgtgtatatattagaaagtacaatatgttggtacggctacgaatgtaaattcgtatgaatcctgtaggttcgggatcttttggaacttttactaatgcgaagtatgggtgtaattttcaccttaactcagctgttaaaagattaatagcgt

SEQ ID NO: 3512 - DNA, 1658 bp, Cajanus cajan
acaagcaccggacgcactcaccgttgaatccccaaatttgaagagttcttgtgaggatgtagttaagtagcttatgcttagcaggatataactggcctgacaaaagttgataggatgaaacgcaatagtgggtatcctggcgcacttaacagtgatgacatcctgcatgagatcctaattcggctaccaccatcaacaatctccaaattaattattgtatcaaaaagatggctgcgggtaatatgcagtccttcatttcgtcgatgttacttgagtaaatgggggcaaagttttcgacttttgggttttttcgtatgcaactttttatatcttggaagacctcgggatggataccgccgccctcgttgggaacctgccctcccgatcttgtccacttgtaaagagggtgatgatttgaaactttctggaatcctcaaacatcttgggtacttcattgatagttccaaggggataattctttctggtttccaccctaagacatattatgtgtacaatactgtgaccaagcaaaagtatcaactcccagagcctcagcagttttataaaattctgtgcatggcattgattgttgaggaatatcttgatggtgacttgtgctacaaggtgatccgggcaagatgtgaatgcaaacttaaggaacgaaaaactgtttcaattgagactttctcatcaaaaactggacaatggaagcaatccactctaatgtgctccacatcttttgcattgcgcccaaggacggccgctatggtggtcggaggggttgtacactggtttgcaatctggggaaaacttgccatttatgatcctcgtcttggagacaggtatatagctttaattagattaccaagaggtgtgttatcacatgagcatgaggaatcggttcttggagagtcatctgatgggcttttacagtatggtcagagcaataacttgggtctagagatatggatacttcagaaggaaccaggaaccaactcatccatttactgcaactgtactcatatgaagtacaagtggatactgaggtggagattatattttaaagtattatggaagcagatgccatctttaagttcgcatgctaaagaaacccagatactgtcattccttcctcaaaattctacatctatcttcattaggtcagggtggaacattttgctgtatgatttggagaccaaaacggtggaaactgttaattatcagggtcgtggaggcaccatttcatgggaatctagcaaagtagttccttactttctaccagcttggccacatgcgtcctcaggtgtcatgacaacatgaaacaagggaaaacatgtcgtttttcaatccagatgcatttggttttttcgattttgttcctcatctggatataatgaaatttaagcgtttagcttctttgttctgttttaatgtctagccataggaggatcttcatttctcttgtagatacagtggtgtcatacatgcttagagggtgttgttttatcaaaacactgaaaatttagcttcttaagtcattttgtagaagaaatgaattgcagcctgatacagtcgcgacaggttagctgcatattctagcgtgtttggatacgcgattggagatctagactctcgtatttttgtgcaaaacgtgattc

SEQ ID NO: 3513 - DNA, 1843 bp, Glycine max
actaattgagagtagaaacaaaaagaaaaaaaacattgtaagcgctgtaacagcaggtttcggaggcttttggggtagccgacgagacacagtggattccttaattctccatggatatggagatgaaagaaggtgaagcccccgtgttgtggttcgaaacctctgactctgtctgtcgtcgacaccagtttgaacccgatggtcaactctccgtagtgattgtcgatgattccaggcccttataccaaagggtggctggatctttcatgaataaatttttcccctcgggatatccgtacagtgtgaatgaaggctatcttagatacacgcagtttcgagctgtgcaacacgttaccagtgcagcattatcagttctatcaactcagtccttgctatttgctgcagggttgaggcccactcctgcgcaagcaactgctgttagttggattttaaaggatggaatgcaacatgtagggaagctaatatgtagcaattggggagctagaatggattctgaacctaaacgttggagactattagctgatgcgctctatgatataggcactggcttggaagtgctttctccattatgcccacatctttttcttgaaatggcaggcttaggaaattttgcaaaggggatggcagttgttgcagcaagagcaacaaggttgcctatatattcttcatttgccaaagaaggaaatctcagtgacctatttgctaaaggagaggctttttcaactctctttaatgttattggaattggagttggaattcaattagcatctaccatctgtgcatcaatgcagggaaagttagttgcgggtcctctcctttcaataatacatttatacagtgtgtctgaagaaatgagagcaactcctatcaatacgttgaatccacgaagaactgcaatggttgtggctgattttctcaaggcaggaattgtatcaagccctgctgatctaagatatagagaaaatctgctgttcaatgtgcatgtcaaagaagatgctggaaatgtaagagtggggaaggatgtgcacaaggtcattaagccttccaggcttcttgaattaaaacaagtgttccctgaggagaagtttctcttaaattttggaaataaatgcattgacatggtattggaacaagatgctagtggtgaagatgcattgagggggtggctagttgctgcatatgctgcacaaacacatagtttctctcatgagctcagtgctactagtgtcctgcatgaggcttatgagaaaatgaatggtgtctttcctgtattcttaagggaattgcagaacaaagggtggcacactgataggtttttggatggaactgggagccgttttgcattctagataaatttcatgttgatttaagtaggtttttatccattctttgagagaaattttgatgtgctatgggtggagtaaactgtatattttatctattattttttaaaaagtaatgttaggacatacctttcttcaaaaaacatgaagatggaggaaggtatgataaggactttgtggcttgtttgagggatgcggattgaagcttcttgatggccaaatctggtcttattttcagcacgaggagaggtcaatactattttgcagacaataatttggctttcacagcaccacagagttaatgttgtttttgaatcagattgttgatcatatatacaataaaggggaagatattacagattgtgggatatttcttaaccataatttagagagatcctgagattaaatccttcttattcaattaaatttgttagaagacagggtatgactgaaagtatctgattcgtctttgtgagaat

SEQ ID NO: 3514 - DNA, 1507 bp, Lotus japonicus
ggaaaaacagcgagcccaagaactcatccaaacatgtagaaaacagcactgggcagtgagcagacaagctggggcttttggggttgtcggcgttgactccaacggattttcagaacatttccgaaatggagaaggaagaaggtcccgtgttctggttcgagacctctggctctgtttgtcaccgacaccactttcaatccaatggtcaactttccgtaatgctcgttgatgattccaggccattataccaaaaggtggctgggtctttcatgaataaattttttccatcaggatatccatacagtgtaaatgaaggctatctcagatacactcagtttcgatctgttcaacatgttaccagtgcagcactatcagttctatcaactcagtcattgctatttgctgcagggttgcggcccactcctgcacaagcaactgctgttagctggattttaaaggatggaatgcaacatgtagggaagctaatatgtagcaattggggtgcaagaatggattctgaacctaaacgttggagactaatagctgatgtgctctatgatttaggcacgggcttggaagtgctttctccattatgtccacatctttttcttcaaatggcaggcctaggaaattttgcaaaggggatggcagttgttgcagcaagggcaacaagattgcctatatattcttcatttgctaaagaaggaaatctcagtgacctgtttgcgaagggggaggctttttcaacactctgtaacgttattgggattggagttggaattcagctagcatctactatctgtgcatcagtgcagggaaagatggttgtaggtcctctcctttcaattttacatatatacagtgtgtctgaagaaatgagagcaacacctatcaataccttgaatccacgaagaactgcaatgatcgtgacagattttctcaaggcaggagttgtctcaagccctgctgatctaagatatagagaggatctgctgtttcgtgtccgactcacagaagatgctggaaatgtaagagtggggagggctttgcatgaggttattaagccttccaggcttcttgaattagaacaggtacttccaggggagaagtttctcttaaatcgtgggggtaaatgcgtcgacatggtgttggaacaagatgctagtggtgaagatgcattgagagggtggctagttgctgcatatgctgcacaaattgagaattcctctcatgagctcagtgctagtgtcctgcatgaggcttacaagaaaatgaccggtgtgtttcctgtatttttaaaagaattacagagcaaagggtggcacactgatcgttttctggatggaactgggagccgctttgcattctagggttcatagaaatcctgtattggtttgaaatattttttctcccactatatgagagaagttttgatgtagtgtgggtgtagtgaattcaattgttcatatttcttgaacttaactgtatatcttaactattttttagg

SEQ ID NO: 3515 - DNA, 1161 bp, Glycine max
ccgtgaatgaagttgttttattatttttccaatatgcacgcgcctgtcactatctggcattacgaattaaagtagacaaaccctatcccactttttcttaccattatatatatccttccccctttctctttcctcccatccaaacacttatctttttctctctcttccctcttcaatcttcacattttctctatggagaatcatggcaacaagcgagtctgggaccagtcctctgactccaacactcagcgggtcgactcgcccgagtctaagattcgtcgagttgactcgtccgattcgggtattaactcgtccgagtctcaactcgaatcggtcctcgactcgtcggaggtgcagctacaagacgacatttttaacatgcttgacgacacggacaatgtgcccgagcgtgactcggtgcagggtcttgactcagtgatcaaaagcttcgaggatgagataaatgctccaggttcggattctggttccggtgacccggcccaggaacccgactccggggagctacaatctaacttgggctatcttctagaagcctccgacgacgagctcgggttgccgccgacggtgggtgacggcgaggaaatgggtcgggctgccccggaaatggcggagcttgccaggttcgtgggatttgaagacgacatacccagttatgatgcattcgggtttgggtcggggtttacggcggagaatgacggaggtgccggaggttttgtgacggtggatgggttgtttgactattcggacccgtcggcggatgttttgtggcggtcggagtcattacaagctatgtaggtggtggcggtggttttagtgaaacggtgcgtaggggtggaaaatgtaaatctgggaaaatattggcgttaaaaataggaggaggggtagcacagaaaggtaggaggtagatgtgaaaaagttgtagggttaggatttgtttgttgttttggttttttcgttgaattcaattgaaacaaactcaactccctcatgagccgtttcagttttgttttgttgcttcagttgcatcttgaacgttctttatttatcctacataatctatttgattaattttaaagagtgtcgttaactgtttaagacttttggttaaagaacatttaaagtactctattaaatactctt

SEQ ID NO: 3516 - DNA, 770 bp, Taraxacum officinale
  misc_feature (706)..(706): n is a, c, g, or t
cgcggggatgcagcatgtctggcccagagtgctgccaaaacccaccggcgccctcctccggcggagaatccggtcaacttttacaaatcgcatctctcaattcctatgtttccggcaaccctgattccaaagtcgccgttcttcttatttctgatgtttttggttatggagctccgaaactgaggcaacttgcagacaaagttgcagctgctggatattatgtagttgttcctgatttcttctatggcgacccgttgactcccggagccaacatagaagactggctaaaaaaccatgcacccgagcaagcggttgattttgctaaacgagttatacaggctttgaaagagaagggtgtaacgaaaattggggctgcaggtttttgttggggcgctaaggtggttgtggagctagcaaaggatggtgaaatacaatttgcggcactcttgcatccttcgtttgtcacgttagatgatatcaagggggttaaggtccctatagggatactaggtgccgagatcgacaaacgatctccaccagaactcgtgaaagaattcgaggctgcactagtcgcaaacgaggttaataactttgtaaaaatatatcctggtgtggcacatggttggaccgttagatataaagacgaggatgcagcagaagtgaaatgtgcagaagaggctcatcaggatcttgtggattggtttgngaagagtcattagacatatgattaagtctgttaaaccctaatcaatcatgtaataaaggaggag

SEQ ID NO: 3517 - DNA, 916 bp, Ambrosia trifida
ctttcaactcctcatgtccctaaaatctttgttgggttgacccgaacacttgctccagaacccgttaacagtatgtctggcccagaatgctgcgaaacccaccggcgatctcctccggcgaagaatccggcgaacttctgcaaatcgcatccctcaattcctatgtttccggtcaagcctgattctaaagttcgccgttattcttgtttcttgatgtttacggttatggagctcctaaactcaggcaacttgcagacaaagttgcagctgcaggatattatgcagtggttcctgatttcttctatggtgatccgttgactcccgagactaagttagaagattggctaagcaaccatgcacctgagcaagcggttgattttgctaaaccagttatacaagctctcaaagagaagggtataactaaaattggggctgcgggtttttgttggggcgccaaggtggtcgtagagctagcaaaggaaggtgaaatacaatttgcgtcactcttgcatccttcttttgtcactgtagatgatataaagggggttaagatccctatagggatactaggtgccgagatagacaaacgatctccaccagaacttgtcaaagaattcgaggctgcactagtcgcaaatgaggttaataactttgtaaaaatatatcctggtgtcgcacatggttggaccgttagatataaagatgaggatgcagcagaggtgaaatgtgcaaaagaggctcatcaggatcttgttgattggtttgggaagtgtctttagataaataactaaatctgttaaactctaatcatgtaataaaggagggatgcagatgtttgagaagatccttataaaacgaaataaagtgtgtttgagaaggtctaaatgttagaaaaaagaaaaagtaccgaactgcg

SEQ ID NO: 3518 - DNA, 724 bp, Parthenium argentatum
gaacctctagtaaacccatataatgtctggaccggagtgcttcgaaaacccaccggcgatctcgtccggcggagaatccggtgaagttttgcagatagcatctctcaattcctatgtttccggcaagcctgattcaaaagtcgccgttattcttgtttctcatgtttttggttatggagctccaaaactgaggcaactagcagacaaagttgcagctgctggatattatgtagttgttcctgatttcttttatggtgacccgtatacacccgaaactaagatagaagattggctaagcaaccatgcacctgagcaagcggttgattttgctaaaccagttatacaggctctcagagagaagggtataactaaagttggggctgcaggtttttgttggggtgctaaggtggttgtagagctagcaaaggaaggtgaaatacagtttgctgcactcttgcatccttcttttgtcactttagatgatatcaagggggttaagatccctatagggatactaggtgccgaaatcgacaaacgatccccaccagaactcgtcaaagaatttgaggctgcgctagtcgcaaatgaggttaataactttgtaaaaatatatcctggtgttgcacatggttggaccgttagatataaagatgaggacgcagcagaagtgaaatgtgcaaaagaggctcatcaagatcttgtcgattggtttgggaagtgtctt

SEQ ID NO: 3519 - DNA, 823 bp, Parthenium argentatum
acaaaatgtctggaccagagtgctgccaaaaccctccggtgatctcctccggcggagaatccggtgaacttctgcaaatcgcatctctcaattcttatgtttccggcaagcctgattccaaagttgccgttgttcttgtttctgatgtttatggttatgaagctcctaaactgaggcgacttgcagacaaagttgcagctgctggattttatgtggttgttcctgatttcttctttggcgacccgctgactcctggagccaacatacaagattggttaaaaaaccatgcacctgagcaagcagttgatgttgctaaacaagttatacaggctctcaaagagaagggtataactaaaattggggctgcaggtttttgttggggtgctaaggtggttgtaaagctagcaaaggatgctgaaatacaagttgctgcactcttacatccttcatttgtcactgtagatgatatcaagggggtgaaggtccctacagggatactgggcgctgagatagacaaaatgtctccgccagaactcgtcaaagaatttgaggctgcactagtcgcaaatgaggttaataactttgtaaaaatataccctggtgtcgcacatggttggaccgttagatataaagacgaggatgcagcagaagttaaatgtgcagaagaggctcaccaggatcttgtgcagtggtttgggaagtgtctttagacaaatcattaaatctgtaaaatcctaaacatgttataaaggagagattcatatgtttgagaatatccttcataactatctaaataaaggtgtgtgtgaagatataaaaatct

SEQ ID NO: 3520 - DNA, 785 bp, Ambrosia trifida
cgggggttccagaatctgttagagtacttacaatgtctggaccagagtgctgccaaaacccaccggcgatctcctccggcggagaatccggtgaacttctgcaaattgcatctctcagttcctatgtttccggcaaacctgattccaaagttgcagttattcttgtttctgatgtttttggttatgaagctcctaaactgaggcaacttgcagacaaagttgcagctgcgggatattatgtagttgttcctgatttcttctttggcgacccgctgattcctggaaccaatatacaagattggttaaaaaaccatgcacctgagccagcagttgattttgctaaacaagttgtacaagctctaaaagagaagggtataactaaagttggggctgccggtttttgttggggtgctaaggtggttgtaaagctagcaaaggatgccgaaatacaagttgctgcactcttacatccttcgtttgtcactgtagatgatatcaaaggggtgaagatccctacagggatactgggcgctgagatcgacaaaatgtctccgccagaacttgtcaaagaatttgaggttgcactagtcgcaaatgaggttaataactttgtaaaaatataccctggtgtcgcacatggttggaccgttagatataaagatgaggatgcagcagaagttaaatgtgcagaagaggctcatctggatcttgtgcagtggtttgggaagtgtctttaggcaattcattaaatctataaaatcctaaacatgttataaagaatagat

SEQ ID NO: 3521 - DNA, 847 bp, Ambrosia trifida
cggacggtcccgacgttaacgtactaacgaccgtagaggtacgtacggggggttccgacgaacgtctgttagagtacttacaatgtctggaccagagtgctgccaaacccaccggcgatctcctccggcggagaatccggtgaagttctgcaaattgcatctctcagttcctatgtttccggcaagtctgattccaaagttgcagttattcttgtttcttgatgtttttggttatgaagctcctaaactgaggcaacttgcagacaaagttgcagctgctggatattatgtagttgttcctgatttcttctttggcgacccgctgattcctggaaccaatatacaagattggttaaaaaaccatgcacctgagccagcagttgattttgctaaacaagttgtacaagctctaaaagagaagggtataactaaagttggggctgccggtttttgttggggtgctaaggtggttgtaaagctagcaaaggatgctgaaatacaagttgctgcactcttacatccttcgtttgtcaccgtagatgatatcaaaggggtgaagatccctacagggatactgggcgctgagatcgacaaaatgtctccgccagaacttgtcaaagaatttgaggctgcactagttgcaaatgaggttaataactttgtaaaaatataccccggtgtcgcacatggttggaccgttagatataaagatgaggatgcagcagaagttaaatgtgcagaagaggctcatcaggaccttgtggagtggtttgggaagtgtctttaggcaattcaattaaatctaataaaatcctaaacatgttatacaggagctatgcatatgttt

SEQ ID NO: 3522 - DNA, 875 bp, Helianthus annuus
cttggcggggcccacatatctgttgggttgaccaaaacacttgatccattccagaacctgttagaattatgtctggccctgagtgctgccaaaacccaccggtgatatcctccggcggagaatccggtgaacttttgcaaattggatctctcaattcttatgtttccggcaaccctgattccaaagtcgccgttcttcttgtttctgatgtttttggttatgaagctccgaaactgaggcaacttgcagacaaagttgcagctgcgggatattacgtagttgttcctgatttcttccatggcgacccgttgacttctataaccaagataggagattggctaaaaaaccatgcacccgagcaagcagttgaatttgctaaaccagttatacaggctttaaaagagaagggtataactaaaattggggctgcaggtttttgttggggcgctaaggtggttgtagagctagcaaaagatggtgaaatacaatttgctgcactcttgcatccttcgtttgtcacattagatgacatcaaaggggtgaaggtccctacggggatattgggcgctgaaatcgacaaaatgtctccaccagaactcgtcaaagaattcgaggccgcactagtcgcaaatgaggttaataactttgcaaaaatatatcctggtgtatcgcatggttggaccattcggtataaagatgaggatgcaacagaagtgaaatgtgcacaagaggcacatcaggatcttgtggaatggtttgggaagtgtctttagacaaatcattcagtctgtaaaatcctaaacatgttataaaagagagatacatatgtttgtgaagatccgtaataactatataaagtgtgtttgaagatatta

SEQ ID NO: 3523 - DNA, 837 bp, Ambrosia trifida
ctggaccagagtgctgccaaaacccaccggcgatctcctccggcggagaatccggtgagcttctgcaaattgcatctctcagttcctatgtttccggcaagtctgattccaaagttgcagttattcttgtttctgatgtttttggttatgaagctcctaaactgaggcaacttgcagacaaagttgcagctgctggatattatgtagttgttcctgatttcttctttggcgacccgctgactcctggagccaatatacaagattggttaaaaaaccatgcacctgagccagcagttgattatgctaaacaagttgtacaagctctaaaagagaagggtataactaaagttggggctgccggtttttgttggggtgctaaggtggtggtaaagctagcaaaggatgctgaaatacaagttgctgcactcttacatccttcgtttgtcactgtagatgatatcaaaggggtgaagatccctacagggatactgggggctgagatcgacaaaatgtctccgccagaacttgtcaaagaatttgaggctgcgctagtcgcaaacgaggttaataactttgtaaaaatataccctggtgtcgcacatggttggaccgttagatataaagatgaggatgcagcagaagttaaatgtgcagaagaggctcatctggaccttgtgcagtggtttgggaagtgtctttaggcaattcattaaatctaataaaatcctaaaacatgttaataaagtagcgatgcatatgtttgagaatatgcttaataactaaataaagtgtgtttgaagatgtaaagatctaatgttgaactctttgcatggttac

SEQ ID NO: 3524 - DNA, 802 bp, Helianthus annuus
tgtctggcccagagtgctgccaaaacccgccggtgatatcctcaggcggagaatccggtgaacttttgcaaattggatctctcaattcttatgtttccggcaaccctgattccaaagtggccgttcttcttgtttctgatgtttttggttatgaagctccgaaactgaggcaacttgcagacaaagttgcagctgctggatattatgtacttgttcctgatttcttccatggtgacccgttgacttctatagacaagttaggagattggctaaaaaaccatgcacccgagcaagcagttgaatttgctaaaccagttatacaggctttaaaagagaagggtataactaaaattggggctgcgggtttttgttggggcgctaaggtggttgtagagctagcaaaggatgctgaaatacaatttgctgcactcttgcatccttcgtttgtcacgttagatgatatcaaaggggtgaaggtcccgactgggatactgggcgctgagatcgacaaaatgtctccgccagaactcgtcaaagaattcgaggctgcactagtcgcaaaagaggttagtagctttgtaaaaatatatcctggtgtatcgcatggttggaccattcggtataaagatgaggatgcaacagaagtgaaatgtgcacaagaggcacatcaggatcttgtggaatggtttgggaagtgtctttagacaaatcattcagtctgtgaaatcctaaacatgttataaaagagagacacatatgtttgtgaagatccataataactatataacgtgtgtttgaagat

SEQ ID NO: 3525 - DNA, 735 bp, Ambrosia trifida
aacttctacaaatcgcatccctcaattcctatgtttccggcaagcctgattcaaaagtcgccgttattcttgtttctgatgtttatggttatggagctcctaaactcaggcaacttgcagacaaagttgcagctgcaggatattatgtagttgttcctgatttcttctatggtgacccgttgactcccgagactaagttagaagattggctaagcaaccatgcacctgagcaagcggttgattttgctaaaccagttatacaggctctcaaagagaagggtataactaaaattggggctgcgggtttttgttggggcgccaaggtggtcgtagagctagcgaaggaaggtgaaatacaatttgctgcactcttgcatccttcttttgtcactgtagatgatataaagggggttaagatccctatagggatactaggtgccgagatagacaaacgatctccaccagaacttgtcaaagaattcgaggctgcactagtcgcaaatgaggttaataactttgtaaaaatatatcctggtgtcgcacatggttggaccgttagatataaagatgaggatgcagcacaggtgaaatgtgcaaaagaggctcatcaggatcttgttgattggtttgggaagtgtctttagataaataactaaatctgttaaactctaatcatcatgtaataaaggagggatgcagatgtttgagaagatccttataaatgaaataaagtgt

SEQ ID NO: 3526 - DNA, 1039 bp, Flaveria ramosissima
cataaatcctccatcgggtcgacccgaaaacatactccagaacccatatcactaccaccaatgtcgggcccagagtgctgcagtaatcctccggcgatctcctccggcgacggcgccggcgaagtcctgcaaatcgcctccctcaattcatacgtctccggcgaccctcagtcgaaaaccgccgtgcttcttgtttctgatgttttcggttatggagctccgaaactgaggcaacttgcagacaaagttgcatctgctggatattatgtagttgttcctgatttcttctatggagaccccttgactcccgaaacaaagatagatgattggctaaagaatcatgcacctgagcaaggagttgaacttgctaaacctgtgctacaagctcttaaggagaagggtgtgactaaaattggggctgcgggattttgttggggcgccaaggtggttgtagatctagcaaaggatgctgaaatacatgttgctgcaatcttgcatccttcttttgtcactgtagaggatatcaagggggttaagatccctattggaatactaggtgctgagatcgacaaacgttctccaccagaactcgttaaagaatttgaggctgcagtagtggcaaatgaggttaatcactttgtaaaaatatatcctggtgtggcacacggttggacgattagatacaaagatgaagatgcagcagaagtgaaatgtgcacaagaggctcatcaggatcttatggattggtttgggaagtgtctgtagacaaatcatttagagtctttaaaacccaaatcatgtaataaatgggatatgtttgagaagatatttgattactaaataaagtgtgtttgaagatattgaggtcaaatgttgaactctttgcatctgcatgggtggacctaccctataggcaccagggtcaagtgacccttgagtttgtgttatacaacatactatactttaagtcgattgacgcttgtgttttcggacgataacccctataactactttgcatagaattaaaaaaaaaaaaaaa

SEQ ID NO: 3527 - DNA, 807 bp, Arnica chamissonis
atgtctggccctgagtgctgcgagaatcctccggcaatctcctccggcgctggatccggtgaagtcttgcaaatcgcatccctcaattcctatgtttccggcaagcctgattcgaaaaccgccgtgcttctcgtttctgatgtttatggttatggagctcagaaactgaggcaacttgcagacaaagttgcatctgctggatattatgtggttgttcctgatttcttccatggagaccccatgactcctgaaacaaagatagatgattggctgaaaaaccatgcacctgagcaatgtgttcaatttgctaaaccagttatacaggctctctctgagaagggtataactaaaattggggcagcaggtttttgttggggcgctaaggtagttgtagagctagcaaaggatgctgaaatgcaagttgctgcaatcttgcatccctcatttgtcactttggatgatatcaagggggttaaggtccctatagcgatgctaggtgctgaaatcgacaaaagatctccaccagaactcatcaaagaattcgaggctgcactagtcgcaaacaaggttgatcactttgcgaaaatttatcctggtgttgcacatggttggaccgttagatacaaagatgatgatgcagcagaagtgaaatgtgcagaagaggctcatcaagatcttgtggattggtttgggaagtgtctttagacaaatcaattagaatctgtaaaaccttaatcatgtaatgactaaataaagtgtgtttgaagatgtaaaggtctactgttgaactctttgcatgagttccta

SEQ ID NO: 3528 - DNA, 884 bp, Flaveria ramosissima
taacattcaacccctcacttccataaatcctccatcgggttgacccgaacacatactccagaacccatatcactaccaccaatgtcaggccccgagtgctgcagtaatcctccggcgatctcctccggcgccggcgccggcgaagtcttgcaaatcgcatccctcaattcatacgtctccggcaaccctcagtcgaaaaccgccgtgcttcttgtttctgatgtctttggttatggagctccgaaactgaggcaacttgcagacaaagttgcatcttctggatattatgtagttgttcctgatttcttctatggagaccccttgactcctgaaacaaagatagatgattggctaaagaaccatgcacctgagcaaggagttgaacttgctaaaccagtgctacaagctcttaaggagaagggtgtgactaaaattggggctgcaggattttgttggggtgccaaggtggttgtagatctagcaaaggatgctgaaatacatgttgctgcaatcttgcatccttcatttgtcactgtagaggatatcaagggggttaagatccctattggaatactaggtgctgagatcgacaaacgttctccaccagaactcattaaagaatttgaggctgcagtagtggcaaatgaggttaatcactttgtaaaaatatatcctggtgtggcacacggttggacgattagatacaaagatgaagatgcagcagaagtgaaatgtgcacaagaggctcatcaggatcttatggattggtttgggaagtgtctgtagacaaatcatttagagtctttaaaaccctaatcatgtaataaatgggagatacatatgtttgagaagatctttgattactaaataaagtgtgtttgaag

SEQ ID NO: 3529 - DNA, 1030 bp, Flaveria ramosissima
aaaacccatagagttactcccaatgtcaggccccgagtgctgcagtaatcctccggcgatctcctccggcgccggcgccggcgaagtcttgcaaatcgcctccctcaattcatacgtctccggcaaccctcagtcgaaaaccgccgtgcttcttgtttctgatgttttcggttatggagctccgaaactcaggcaacttgcagacaaagttgcatctgctggatattatgtagttgttccggatttcttccatggagaccccttaactcctgaaacaaagatagaagattggctaaagaaccatgcacctgagcaaggagttgaacttgctaaaccagttctacaagctcttaaggagaagggtgtaactaaaattggggctgcgggattttgttggggcgccaaggtggttgtagatctagctaaggatgctgaaatacatgttgctgcaatcttgcatccttcttttgttactgtagaggatatcaagggggttaagatccctatcggaatactaggtgccgagattgacaaacgttcaccaccggaactcattaaagaattcgaggctgtagtagtggcaaatgaggttaatcactttgtaaaaatatatcctcgcgtggcacacggttggacggttagatacaaagatgaagatgctgcagaagtgaaatgtgcacaagaggctcatcaggatcttatggattggtttgggaagtatctttagacaaatcattcagtctgtgaaaccctaagcatgtaataaaggggagatgtcatgcatatgtttgagtagatctttaatttactaaataactgtgttttaagatattgaagcctgatgttaaactctttgcctgagcatgggcaggggcggctcaacctttatgggtcccaaagcgacttcaaaatttggagctctttacgaaaaaaaaaaaaaaaaaaaataacgtctcgtcgtagactaccacgtcgtacttacgtggacgtacgtcgaaccgaaggaccaacgaacgggaaggggtaagta

SEQ ID NO: 3530 - DNA, 854 bp, Guizotia abyssinica
gtcgacggtccggactctgcccggcaattctgccacccggacgggggtggctgttacaatgtctggccccgagtgctgcgaaaatcctccggcgatctcctccggcggcgattccggcgaactattgcaaatcgcatcgctcaattcctatgtttccggcaagcctgagtcgaaaatcgccgtgctccttgtttccgatgtattcggttatggagctcagaaactaaggaaacttgcagataaagttgcatctgctggatattatgtagttgttcctgatttcttctatggagaccccatgactcctgaaacaaagatagaggattggctaactaaccatgcacctgagcaagcagttgaattcgctaaaccggttatacaggctctcaaggagaagggtataactaaaattggggctgcaggtttttgttggggcgccaaggtagttgtagaactagcaaaggatgctgaaatacaagttgctgcaatcttacacccttcatttgtcactttagatgatatcaagggagttaaggtccctatagggatactaggtgccgagattgacaaacgatctccaccagaactcatcaaagaatttgaggctgcacttgtcgcaaatgaggtaaatcattttgcaaaaatatatcctggtgttgcacatggttggaccgttagatacaaagacgacaatgcagcagaagtgaaatgtgcagaagaggctcatcaggatctggtggattggtttgggaagggtcttagactactcattcaatctgtaaaactttaatcatgtaataatgaaagatgcagatgtttgaatatattcctaatagctaaataaagtgtgttcg

SEQ ID NO: 3531 - DNA, 939 bp, Ambrosia trifida
tccagaacctgttagagagtactcacaatgtctggaccagagtgctgcaaaacccaccggcgatctcctccggcggagaatccggtgaagttctgcaaattgcttctctcagttcctatgtttccggcaagcctgattcaaaagtcgccgttattcttatttctgatgtttttggttatgaagctcctaaactgaggcaacttgcagacaaagttgcagctgcgggatattatgtagttgttcctgatttcttctttggcgacccgctgactcctggaaccaatatacaagattggttaaaaaaccatgcacctgagccagcagttgattttgctaaacaagttgtacaagctctaaaagagaagggtataactaaagttggggctgcaggtttttgttggggtgctaaggtggttgtaacgctagcaaaggatgctgaaatacaagttgctgcactcgtacatccttctttggtcactgtagatgatatcaaaggggtgaagatccctacagggatactgggcgctgagatcgacaaaatgtctccgccagaactagtcaaagaattcgagactgcactagtcacaaatgaggttaataactttgtaaaaatataccctggtgtgtcgcatggttggaccgttagatataaagacgaggatgcagcagaagttaaatgtgcagaagaggctcatcaggatcttgtgcagtggtttgggaagtgtctttaggcaattcattaaatctataaaatcctaaacatattataaaggagagatgcatatgtttgagaatgtgcttaataactaaataaagtgtgtttgaagatataaatatctgatgttgaactctttgcatggttactgttaaaaataatgtgtcaatattcattcaaatattaaatattgtttgttataaattcttttattaaaagtttta

SEQ ID NO: 3532 - DNA, 857 bp, Carthamus tinctorius
gcggggctccattttataccaaaacacttcatactccacaggctacaatgtcaggaccccagtgctgcgaaaacccccctgcaccttcctccggcggtgaatccggcgacctccaccagattgcttccctcaattcctatgtctctgggaatcctgattccaaaatcgctgttctccttgtttctgatgtttggggttatggagctccaaaattgaggaaacttgcagacaaagttgcatctgctggatattatgtggttgttcctgatttcttccatggcgaccccttgactcctgaagctaagatagaagattggctacaaaatcatgcaccgggtccagcagttgattttgccaaaccagttattcaggctctcaaagagaagggtattactaaaattggggctgcaggattctgttggggtgccaaggttgttgtagagctagcaaaagatactgatctacaagttgctgcactcttgcatccttcttttgtcactttagatgacatcaagggggtgaaggtacctattgcaatactaggagctgagattgaccaacgatcaccgcccgaggttatcaaacaattcgaggaggctttggaagccaaaccagaggttgatcagtttgtgaagatttatcctggggtttcgcatggttggactgtccgatataaagatgaagatgaagtggctgtgaaatgtgcattagaggctcatcaggatcttttggattggtttggtaagtgtcttaagcattaaacattccatcctgtaaaactaaaacctgaacctgtggagattggacatatttcagaaacctccattacctcctgtgtgttttataactaaataaag

SEQ ID NO: 3533 - DNA, 723 bp, Ambrosia trifida
ctccagagcctgttaacagtatgtctggcccagagtgctgcgaaaacccaccggcgatctcctccggcgaagaatccggcgaacttctacaaatcgcatctctcaattcctatgtttccggcaagcctgattcaaaagtcgccgttattcttgtttctgatgtttatggttatggagctcctaaactcaggcaacttgcagacaaagttgcagctgctggatattatgtagttgttcctgatttcttctatggtgacccgttgactccgggtactaagattgaagattggctaagcaaccatgcacctgagcaagcggttgattttgctaaaccagttatacaggctctcaaagagaagggcgtaactaaaattggtgctgcaggtttttgttggggcgctaaggtggtcgtagagctagcaaaggaaggtgaaatacaatttgctgcactcttacatccttcttttgtcagtgtagatgatatcaagggagttaagatccctatagggatactaggtgccgagatagacaaacgatctccaccagaacttgtcaaagaattcgaggctgcactagtcgcaaatgaggttaataactttgtaaaatatatcctgtgtgcacatggttggaccgttagatataaagaatgaggatgcagcagaagtgaaatgtgctaaagaggctcatcaggatcttgttgattggtttgggaagtgtctttag

SEQ ID NO: 3534 - DNA, 748 bp, Centaurea maculosa
agctacaatgtcaggatcgcagtgctgcgaaaaccctcctgcaccttcctccggcggtgaatccggcgacctccaacagatcgcttccctcaattcctatgtctccgggaatcctgattccaaaatcgctgttctccttgtttctgatgtttttggttatggagctccaaaattgaggaaactcgcagacaaagtggcatctgctggatattatgtggttgttcctgacttcttccacggcgacccgttgactcctgaagctaagtttgaagattggctcaacaatcatgcaccgggtccagcagttgattttgccaaaccagttattcaggctctcaaagagaagggtattactaaaattggggctgcaggattctgttggggtgccaaggttgttgtcgatctagcaaaagatactgatctacaagttgctgcactcttgcatccttcttttgtcactttagatgacatcaagggggtgaaggtacctattgcaatactaggagctgagattgaccaacgatcaccgcccgaagttgttaaacaattcgaggaggctttggaagccaaaccagaggttgatcagtttgtgaagatttatcctggggttacgcatggttggactgtccgatataaagatgaagatgaagtggctgtgaaatgtgcattagaggctcatcaggatcttttggattggtttggtaagtgtcttaagcattagacattccaccctgtaaaactgaaacct

SEQ ID NO: 3535 - DNA, 967 bp, Cirsium arvense
accaaaacacttgttgtgttcagccgccatacgctacaatgtcaggatcgcagtgctgcgaaaaccctcctgcaccttcctccggcggtgaatccggcgaactccaccagatcgcttccctcaattcctatgtctccgggaatcctgattccaaaatcgctgttctccttgtttctgatgtttttggttatggagctccaaaattgaggaaactcgcagacaaagttgcatctgctggatattatgtggttgttcctgacttcttccacggcgacccgttgactcctgaagctaagtttgaagattggctcaacaatcatgcaccgggtccagcagttgattttgccaaaccagttattcaggctctcaaagagaagggtattactaaaattggggctgcaggattctgttggggtgccaaggttgttgtcgatctagcaaaagatactgatctacaagttgctgcactcttgcatccttcttttgtcactttagatgacatcaagggggtgaaggtacctattgcaatactaggagctgagattgaccaacgatcaccacccgaagttgttaaacaattcgaggaggctttggaagccaaaccagaggttgatcagtttgtgaagatttatcctggggttacgcatggttggactgtccgatataaagatgaagatgaagtggctgtgaaatgtgcattagaggctcatcaggatcttttggattggtttggcaagtgtcttaagcattaggcattccaccctgtaaaactgagacctaaacctgtaggcattggagatatttcagaaacctcatgtgtgttttataactaaataaagcgatattagatcgcaccttctactctatgtataagtgccttgcttaccttcatagtctactctaaaaacagatagctataattttactacgggactatttaccaaaaagaaaaagtaaccgactagcg

SEQ ID NO: 3536 - DNA, 996 bp, Cirsium arvense
ttcaagcgatctttcccttaccaaaaactcttgttgggttgacctgaaaacgtactccagcgcaatgtcaggcccccagtgctgtgaaaaccctcctgcaccctcctccggcggtgaatccggcgacgtccaccagattgcttccctcaattcctatgtttccgggaaccctgattccaaaattgccgtgcttcttatatctgatgtttatggttatggagctccaaaattgaggaaacttgcagacaaagttgcatctactggatattatgtggttgttcctgacttctttcatggcgaccccatgacccctgaaactcggatagaagattggctcaaaagtcatgcaccggatcatgcagttgaatttgccaaaccagttattcaggctctcaaagagaagggcattactaaaattggggctgcagggttctgttggggtgccaaagttgttgtggagctagcaaaagatactgatatacaagttgctgctctcttgcatccttcttttgtcaagttagatgatatcaagggggtcaaggtaccaattgcaatactaggtgctgaaattgaccaacgatcaccccccgaagttatcaaacaattcgaggaggctttggaagccaaaccggaggttgatcagtttgtgaagatatatcctggggttccgcatggttggaccgtccgatataaagatgaagaccaagtggctgtgaaatgtgcacaagaggctcatcaagatcttttggaatggtttggtaagtatcttcagatttaaccattccaccttgtaaaaacctgtacctgtatagcaactatattaagattgctttacaaattgcaactaaataaagccatgttaggtggcatcttcaactctatgagtctcttaaactgtttcaaaatctcaattatatattgtaaattggttcacttacaagttgcaactaaataatatttatatatgaatctatgttaaggcttcacatgtgaatc

SEQ ID NO: 3537 - DNA, 842 bp, Cynara scolymus
  misc_feature (8)..(8): n is a, c, g, or t
  misc_feature (23)..(23): n is a, c, g, or t
  misc_feature (322)..(322): n is a, c, g, or t
  misc_feature (669)..(669): n is a, c, g, or t
  misc_feature (766)..(766): n is a, c, g, or t
ggggaggnctggagtgcacaggnttcctatcccttcctttccaaagctcttgttgggttgacccgaaaacgtaccccagaagctactacactaaccgcaatgtcaggcccggagtgctgcgaaaaccctcctgcacccgcttcaggcgttgaatccggcgacatccagcagattgcttccctcaattcctatgtttccgggaaccctgattccaaaatcgctgttcttcttatttctgatatttatggttatggagctccaaaattgaggaaagttgcagacaaagctgcatctgctggatattatgtggttgttcctgacntctttcatggggatcccatgactcctgaaactcggatagaagattggctcacaagtcatgcaccggatcaagcagttgactttgccaaaccagttattcaggctctcaaagagaagggttttaccaaaattggggctgcagggttctgttggggtgccaaggttgttgtggagctagcaaaagatactgatatacaagttgctgtgctcttgcatccttcttttgtcactttagatgatatcaagggggtcaaggtacctattgcaatactaggtgctgagattgaccgacgatcaccccctgaagttatcaaacaattcgaggaggctttggaagccaaaccggangttgatcagtttgtgaagatatatcctggggtttcacatggttggaccgtccgatataaagatgaagacgaagcagctgtgaaatgtgcagaagagnctcatcaggatcttttggaatggtttggtaagtatcttcagattaaccattccaccctgtaaaaccggaagctgta

SEQ ID NO: 3538 - DNA, 2361 bp, Solanum phureja
tttcctaatctggtccagttagaaaaggaggctcttacaaagggggtcccaataagtcaagcacttgacattgaaattcctcctccacgacctaaaaggaaaccaagtaatccttatcctcgtaagatgagtgtagcagttccctcattacaggtgggagcaaaagatgggaaattttcgacacctttttcttccatctgtgaggaaaggaacttatttgacctggagaaagaaccgattactgagaaagctggcggaaacgagaagctgggcaatgtacaagaaacccagaacaagaaaaattgctcccaagggttcactcttttcaaagaaggtgcttctgcagcctctatgtcttcaggaaagtccttgcaaacacatgtggcaccagcaaatgcatgtgcttttagtgagtctgtgcctgtcaccaaaggagaggttaaccatgatatagcaaataaatcttttctcactgttgaatccaacgaacatcaacaggcagaaatacttgatatcagacagtcctttcaaggtaacagctcctgtaacaccttcgacggggggaaatcttgccagtcgagtgaaaagttggcacaaggtgagaaaaaacatccaccgagtcagccagatcatttgggggaattctcaagaaatgatatgcaagtgctacacaactatccaagacatgtgccagtgcatattcttgatggaacaaatggttctcaaatatccccagatatgtttaatcatgaatctacgagtcagcagataggtggggtcccggggctcccaaatttgtattctaaccctgcttcatccgccacatctgagcaccatagtaattctccacagtcatccattcatcagtcattttcttgtttccaccccatcttcacccctattcgtgatccagatgattaccgatcgtttcttcaattatcctccagtttctccagccttattgtttctgctttattgcaaaacccagcagcacatgttgcagcaagttttgctgctagcttttggccttatgcaaatatggaacgtccaacggattctccaacagataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaatgaaggaagagagggaactcataattctccccatgctcaggaacccgtcccagaatgctctgaagctttgcaagaacaacaatcaggttctaaattgccaccttctccatcatcagaatcggaggagagtgaaggtaggaagctacaaattgggttaacggccactggtactgagcaaggagctgcagttactaaaattaatgagccaaacacagaaaagggcgggaagcaggtagatcgctcttcctgtggatccaacacaccttcaagtagtgaaattgagacagatgctttggagaaggacgataagggtaaagaagagcctcaagaatctaatattaaccttcttgttggagaggctgcgattcggcgttgtagaaatttcatcagtccaactgaatcttggaaagaagtctctgaagagggacggatagctttccaggctcttttcaccagagaagtgttgcctcaaagtttttctccttcacttgatctgaaaaacaagggaaagatcattcttgaaaagtttaagcaaaggccagacgagaaagttcaatgtggaccgcagttagaccttaatgatctggcatccagtatctgttccagtcaccaaacaatggaagacaatgtgttattaattggcaacaaagatgtagaaaaatgcctaccaatgatagaacttggacaagtaaggttgaaagctcgccgtactggatttaaaccttacaagaggtgctcattggaggcaaatgatagcagggtgacaagttcaaactgtcaggatgaagaaaaaagctcgaaaagacttcgattggaaggagaagcttctacttagtgttgtgtcaatgtgcaattctacaagggaacctatcttgttgcacggagagctctattctaccctgtcattatcttttcccagttacgttgtctagttctaatgtacacgaaacttatcgtgtaggtgtgtaccatattattttttatgttctgttataattcgacttgtatgcaaagggactttgaagaatgaacttaaatgtggatctcttcaacaatcatagcaaatttaatggaccttgattggaccagttcctcggaa

SEQ ID NO: 3539 - DNA, 2099 bp, Solanum phureja
atggaagaagcttctgttgatagtgagcaagatgttactgggcaaggcagtgggagatttcaagaaatagagtcagatgatcagaacagtgagaaaattgagtcggatgaattatttgttcaaaatggtaggcaaatagaggcaaatggtttagatgatcaaaattgcgttactgatgatgggcagaaggaatttgttgccccagcagtaggaatggagtttgaatcgtatgatgatgcttacaactactataattgttatgccagggaggttggttttcgtgttagagtaaaaaattcttggttcaaaagaaatagcagggagaagtatggtgcagtgctatgctgtagtagccagggcttcaagaggattaaagatgtcaaccggctgcgcaaggaaactagaactggttgtcctgcaatgatgaggatgagaatggtggactccaaaagatggagagtacttgaagttactcttgaacacaatcattcgttaggtacaaaagcatacaagtctatcaagaaaacaggtgctggaaacaagaagaagttggattcaaactgtaatgctgaagtgcaaacaatcaagttataccgggcactagtgatcgatgcaggtgcaaataggaatgccaattttagtgcaaggaggtgccaaacttcatccgatttccacgataagcttaacttaagaaaaggagacacacaagccatgtataattatttctgccgcatgcaattgacaaatccaaacttcttttacttgatggatctgaacgatgaagggcagttgaggaacgtgttctggattgatgccaggtcaagggcggcatatgcttactttgttgatgtcatctatattgataattcatatttgtccaacaaatatgagatccctcttgtggcatttgtgggaacaaatcaccatggtcagtcaatgttgctgggctgtggcctgcttgctggtgagactaaggcctcttatgtttgggtgtttaaagcttggctcaccagctctcttggacgtttccctcaaacaattattacagaaagatgcaaggttttggagactgcaataaatgaggtgttcccgaggtctcttcatcgttttgctttatcacacatcatgaggaaagttccagaaaagttgggaggattgcgtaactatgatgttattcggaaggcattgtttaaaacagtatatgagggtctaaagccatttgattttgaagcagcatggagagttatgatccaaagatttggagtgggtgatcatgagtggctttgttcattgtacaatgaccgagctaaatgggctccagtttatctgaaagatactttctttgctggaatggccactgccagattgaatgaaacattggctgcttttttcgataaatatgtgcacaagcaaactcctctaaaagagtttcttgacaaatatgaattagctttacagaaaaagttcaaggaagaagctcttgcagatatggagtcgagaagctcaaaccctgaactcaaaacaaggtgttcatttgagttgcagctttcaaaagtgtacactagagagatctttaaaagatttcagttagaagtcgaggagatgtattcttgttttagtacaacacagttacatgttgatgggcaggtggtaatatttttggtgaaagagcgtgttttggaagagggaaataggagagagatacgggactatgaagttctgtacaacagaacagcagcagaagttcgttgcatttgtagctgcttcaacttctatggatatttgtgcaggcacgcattgtgtgtgctgaacttcaatggtgtggaagagatcccctcaaagtacattttatcacggtggaaaaaggattacaagaggttatgtgcaccagatgttgaatccagttctaccgagtctactgaacaggttcaatggtatagccagttgtatagaagtgcattacaagttgtggaagaaggggtgatttccctagatcattataaagtagctctaaatgcatttgaagagtctctgtccagagtttaccacattgaagaaaaaccaaataaaaatttgttgtaattagcatatctactatc

SEQ ID NO: 3540 - DNA, 1694 bp, Solanum phureja
gaaggtagatctacaactgtgcctttgtatccccttttgaaggaagagatctactttattccctccatatcatcttcttccttcatattttccatttccctactgctgataaactcaacagagacgaaacccattgggtgcattattattctatagaatgatcgcttcaactgtgcgaaagcccctttttggcgttactctattgacgctctctctttttctccttctcttcttcttcacaccgttttctttcttctccgacccttctgttaccttcaattcttcatggcgtgaaagacctgagatatggagcatgcgaagattagctgagtggcgaccttgcaattggtggctccaacctcgaactaatgctcttcctgctcaggctaatgggtatattcgagtggattgctatggtgggctcaatcagatgaggagagatttgtgtgatggtgttggaatagctcgtttgctgaatgctactcttgttttgccaaagtttgaagtagctgcatactggaatgagtcgagtggttttgaagatgtatttgatgtagacttcttcatccaacaaatgaagggctttgttaatgtggtgaaagagcttccaattgagattgcatcaaaagatcctgttagagttgattgcagcaaacgcaaaggccaatttgactatgttgagagtgttcttccttccctactgaagcatggatatatctcaatcacccctgcaatgagtcaaagaagggataggtaccctctttatgcaaaagctgcactttgccaggcttgttatagtgcgttgcgccttacaaacacattggagaagaaagcgcttgagcttctacaagctataccaaagcccttcttatcgcttcaccttcggtttgaacctgacatggtagcttatagtcaatgcgagtactctggtatttctcttgcttctgcaaaagccatagaagctgcacgggttgacaggaaaccttggactggggaaacagctcgtatttggagaaaccgtggaaagtgtccacttacccccaatgaaactgcattcatacttaaagctttagccatacccaccaatacgacaatttatttggcagctggtgatggcctgatggaacttgagggacttacatctgtgtataccaatgttgttaccaaatctagtcttcttagcggagaggacttcacaaccatgcatgggaatacaaaagctgcactggattattacgtgtctattaacagcgattcttacatggctacttattttgggaacatggataagatggttgcagcaatgcgagttttcacggggttgtataagacaattttcttgaacaggaaagcctttgcattgtttacctctcaggggtttaaagggaaggaactaacagaagccctgtggaaggttcatagagatgattttataatgggtagaggatctgccttacctgactgtttttgtgaattcaatctatgaacttatgttttcctcatcaatttatttgttacttgatgttttggttatatacccggagcaatttattcgaaaagatgtcgtgtttgatgtaggcgtcattcacaaatttatgtgggagagagacatttgattcatgtatttaaagtgtatgtagcttatggaacaccacatttagcatttgataatttgcattcatttcttctttcaa

SEQ ID NO: 3541 - DNA, 802 bp, Solanum phureja
acacatttcacactccaacttggaagaaaattcaaaacagagacgattcaatttgcagagatgaacggcgctatgaatatgcacggagatatggcgccgccggcaccagatgctgccgtgaacaaccaccacatgatgatgcacatgacgtttttctggggaaaaaacgccgaaatcctcttctccggttggcctggatacaacaacatcggtatgtacgtcttcgcacttttcgtcgtttttctacttgctttcttcgtcgagtggctatctcactcaaattacatcaaagagagtgcaaatcatgtgacggccgggttgattcagacggcgttgtacggaatcagaattggattggcttatttggttatgctttctgtgatgtccttcaatggcggtatctttctggcggcgattgccggtcatacgttagggtttttggtcttcgggagtagggtttttaagaaatcgccgttgatggcttatgctaaagcctccgatcttccttctatgccttgtaattgttgatgaaaattgaaataaacagaatctttgtgttcaaaattgaaaattcaaatctaaaaaaatgttattgaattatagatatcgaaaacatctgttacgattcatccttaatggaggaatagttttacaaaaaaggagacgaattgaaataatgttggattttgttcattctctgtgatggatcaatttccagaaaaaaggacaactttcgtgtagtttgtgtcaccgcctgctaactgtattctccgttgacagcaccaatagcattcaatgtgat

SEQ ID NO: 3542 - DNA, 675 bp, Solanum melongena
tagaacctaaaaggaacatttattactgagctgttactattcaattttggcttatctaaaacatgtactcaacacacctctgtcacacatttcagtcccaaatttggaaaatcaatttgccgagatgaacgacgctactcatatgcacggagccggcgcgatggacatgacgccgccgccgacctccagcggcgcctccgccgcgaacagccaccacatgatgatgatgcacatgacgtttttttgggggaaaaacgcggagattctcttctccggttggcctggatacaacaacatcggtatgtacgttttcgcactcttcgtcgtttttgtacttgctttcttcgtcgagtttctatctcacactaattacatcaaagagagtgcaaatcatgtggcggccgggctgattcagacggctttgtacggaattagaattggattggcttatttggttatgctctctgtgatgtccttcaatggcggaatttttctggcggcgattgccggccataccttagggtttatggtgtttggaagtagggtttttaagaaatcgccgttgacggcttatgctaaggcgtcggatcttccttctctgccttgcaattgttgatgaaaaattaaatttagtaccactagtgttttttttttcaaaatcataatttgttagag

SEQ ID NO: 3543 - DNA, 1271 bp, Solanum phureja
aaatttgtacccttttaagaattaaatcactgaaatcccatttagatttgtccaaaaaaaaaaaaaaaacttcaaatcattgtctgatttttgtattagggtacaacccagaagagttgttgattagataaaaaaaatggtggaattaaagtttcttggaatggactttggttgtgcacttggatctctcagtaatggtcaattcccagaaaaagattgtttgcttcccttaatttccaagcttcttggttatgcaattgttgctgcctccaccactgttaaacttcctcagatacttaaaattttgcaacacaaaagtgttagagggcttagtgttgtggcctttgaactcgaactacttggttataccattgctttggcatattgtcttcacaaagggctcccgttttcagcttttggcgagtacctttttcttttgatccaagctataattttggttgcaattatctactatttttctcaacctttgggaatgaagacatggatgaaaggcttattatattgtgctgtagccccaactattttggcaggtcaaattgatcccgttcttttcgaggccttatatgcttcccaacatgcaatctttctttgtgcaaggattccgcagatatggaagaactttaagagcaaaagtactggtgaactgagctttttgaccttctttatgaacttcgccggttctatggttagagtttttaccagcctccaggaaaaagctcccatgagtgttgccttgggatctgtgatcggtgtactgatgaatggtaccatcttgagtcaaattatcatataccaaaagccaacacctcagaaagggaagaagaaagattagaagtttcagcacgtcgtgctgcacctggagctcattgtcatgatcgtcgagcacataattcatccatatactatataccctgagaatctgtcatagttttcgctgatttcaaaatttggattgatccatcagttccagaatttttcattttaacatatagtctcagtatggtatttttatttattttttacctaaagtatgctaacacaggtgtaacaatttcttttggtaaaaatatgctcattaggggacttcttgtgttgaagtcaccaatattatttttctagtcatcatctgttgttatagttgtgcaatagttgaggtatgtgttgtctccttatataattttttctttaatgacggtggagtttgggctggcttgcgcctgctttaactattctactaggtattttgctac

SEQ ID NO: 3544 - DNA, 868 bp, Nicotiana tabacum
ggccgcgggggcaccctttaggatcattcccgaaataccatttagttttgtccaaaacaatctcaaatcattatctgaacaaatttctctgcgttagggcttattcaataaccagttatcgatccatcaattgacagataaaaaatggtagaactaaagtttcttggaatggactttggttgtgcacttggatcccttagcaaaggtgaattcccagaaaaagattgtttgcttcctttaatatccaagctattgggatatgccattgttgctgcctccactactgttaaacttcctcagatacttaaaattttgcaacacaaaagtgttagagggcttagcgttgtggcctttgaacttgaactaattggttataccattgctttggcatattgtcttcacaaagggcttccattttcagcttttggcgagtatgcttttcttttgatccaagctataattttggttgcaattatctactatttttctcaacctttgggaatgaagacatgggtgaaaccattactatattgtgctgttgcaccgactgttttggcaggtcaaattgatcccgttcttttcgaggctctatatgcttcccaacatgcaatctttctttttgcaaggattccacagatatggaagaactttaagaacaaaagtactggcgagctgagctttttgaccttttttatgaactttgccggttccatggttagagtttttaccagtctccaggaaaaagctcccatgagtgttgccttggggtctgcgcttggtgtactgatgaatggtaccatcttaagtcaaattatcatatatcaaaagccgacgccctcagaaagagaaaaagaggagatagaagttt

SEQ ID NO: 3545 - DNA, 976 bp, Tabernaemontana elegans
aaaagtaaattctacggaggcgtataaatctggtttgtttctccggggctaaattgaatagagtagttgtgccctcattgaaaatcgaatagagtaagctgaggtttctctgattcaattcttaaaatgacggaactgaaatttcttggaatagacttcagttgtgcgctgggttccctcagcaaaggtgaaatcccagaaaaggattgtttgcttccattaatatcgaagcttctgggctattgcatcgttgcagcctcaactactgtcaaagttcctcagatactaaaaatattgaatcacaagagtgtcagagggcttagcatggtagcctttgagcttgaagtaattgggtataccattgccttggcttattgtcttcacggggggcttcctttttcagcttatggagagttgttatttcttttgattcaagctataatattagttgcaatcatctactacttttctcagcccatggaaacgaagacttggattagggcattgttatactgtgctgtagcaccaactgttttagctggtaaaattgatccccttctttttgaggctctatatgcatcccagcatgcaatttttttctttgcgagggttccacagatatgggagaattttaagaacaggagcaccggagagcttagctttttaacatctttgatgaactttgcaggttcaatggtgagagtttttacaagcctccaggaaaaggctccaatgagtgttgttatgggctctgcaattggcgttctgactaatggaaccatcctgagccaaattatcatatatcagaggccacatccaaagaaagagaagaaaacagactagaagagttgcagcttggcatccaatgttgatacactttattcagctgcaggaatttattgtcagccttataaatgcatacaggacgcattatccatcttcataattatattctgattttagaattcttgcttag

SEQ ID NO: 3546 - DNA, 1029 bp, Ipomoea nil
gacaatcccaccccgctgactccaaaaacagttgagtgtttcctcaaaaaactcgatcaataaaaaatggtggagttgaagtttcttggaatggactttagttgcgcgctgggatctcttagcaagggtgaattcccagcgaaggactgtttgcttccgttaatatcgaagctcttgggctacgccatcgtggctgcctccaccaccgtcaagcttccgcagatattaaagattttgcgacacagaagtgttagtgggctcagtgtggtagcctttgaacttgaagtagttggttataccattgctttggcatattgtcttcacaaagggctaccgttttcagcttatggcgagtatgcatttctcttggtccaagcaataatcttagtttcaaccatctactatttttctcaacctttgggcacaaagacatgaatgatagcattactatactgtggtattgcgccaactattttagcaggcaaagttgatcccatccttttcgaggctctatatgcttcccagcatgcaatttttctttttgcaagaattccacagatatgggcgaactttaagaacaagagtactggacagttgagcttcttaacgttttttatgaactttggaggttcaatggttagagtatttacaagcatccaagaaaaggctccaacaagcgttgccatgggttctgtgctcggtgtactgatgaacggaaccctcttgagccaaattatcctgtatcagaagccaaacccaaagaaggagaagaaaaccgattagggaaatttcgttgggacaggtgtcacttgacttcacagccggcagtcaagattacaaagcgtcgcaacaccacatgatgacttctgttggggagtttctgtgttaaagatggcaagaattatttttctggctatgccaaccatagaactcatgtttttagaagaagtgatctgacatgtacttcacagttgaaagatgtaaacacaacagctcaagaaagagatgatgttccatagacacatgatt

SEQ ID NO: 3547 - DNA, 1213 bp, Amsonia hubrichtii
atcaggcagcagattcccgcacatcgaagcctatcaggccacgcttcatttattttatcgcaaacaccagaacgcacatgaagacttcaagaagggtttgtttctccgggttaaattgaatagagtggtacccttattgaaaatcaaagagagtaaggtgaggtttctctgattcaactcttaaaatgacggagttgaaatttcttggcatagactttagttgtgcactgggttccctcagaaaaggtgaaatcccagagaaggattgtttgcttcccttaatatcaaagcttctgggctactgcatcgttgccgcctccactactgtcaaagttcctcagatactaaaaatattgaaacacaagagtatcagagggcttagcgtggtagcctttgaactcgaagtaattgggtatacaattgcgttggcatattgtcttcacaaggggcttcctttttcagcttatggagagttagcatttcttttgattcaagctataatattagtttcaatcatctactacttttctcagcctgtgggaacgaagacatggattagggcattgttatactgtgctatagcaccaactattttagctggtcaaattgacccccttctttttgaggctctatatgcatcccagcatgcaatttttttctgtgcaaggcttccacagatatggaagaactataagaacaagagtaccggggagcttagctttttaacttctttgatgaactttggaggttccgtggtgagagtctttaccagcctccaggagaaggctccaatgagtgtcgttatgggctctgcaattggtgttctgacaaatggaaccatcctgagtcaaattatcatatatcagaggccacatccgaagaaagagaagaaaacagattaggagagttgatccgtttgaagttgaggcttggcatcaatcttgatgcagtttattcagcagtaggaatttacaatcaaccttatgaatgcgtgcagaagacattatccatctctataatcatattctgattttacaatgcacaattaggacttcatattttaatttttcttttctggataagcaaatatacgaccttaagttgatttctctttgaacttcattgttctgtcattgcaagaaagagattaaacaaatgatcaaaaccttttaaaggaagaattgcatctctgcattatgtagtagtccttttt

SEQ ID NO: 3548 - DNA, 998 bp, Lippia dulcis
tccacacacaaataacacataaacgtgcttgaagatggtggagatgaagtttctcggcatggattttagctgtgcactgggttcgctgagtaatggcgaattcccagaaaaggactgtttgctcccgttaatttcgaagctgttggggtactgcatcgtggccgcctccaccaccgtcaaactccctcagatactaaaaatattgaaacatagtagtgtgagagggcttagtcttgtatcgttcgaacttgaggttgttggttataccattgctttggcctattgtcttcacaaagggcttcctttttctgcatatggagagttggcattccttttgattcaagccatagttcttgtagcaatcatttactatttttcccaaccgctcggtaccaagacatggataagagctttattatactgtgcgctagcgccaacaatattggctggtcaaatcgatccccttctttttgaagctctctatgcttcgcagcatgcaatatttttctttgccaggattccacagattttggcaaacttcaagaataaaagcacaggggagcttagctttttaacctcctttatgaatttcggaggttccatggtgagggtcttcaccagcatccaagaaaaggcaccgatgagtgtggttttgggctcggtgatcgggattgtcacgaatggtacgatcttgagtcaaataattatataccaaaaaccagctacgaagaaagaaaagaaagctgattagagaagagtgggattggtcattactgcagattttcgagtacctctctcctggcagttaaattaaagagcttgaaactcatacttcctagtaggattcgaattagacattaatgctagtaggatccgagtttcgaaattgtacttctttgatttagatgatcacaatgcatagatgtcaaattcagtacaagttgttcattgcaatatgttacattgtgattttatgtgataatgtgaaaattttagta

SEQ ID NO: 3549 - DNA, 1091 bp, Triphysaria pusilla
gaagaagtggtagcgattcagtttgtatcatcgtcttttgtttttgttttggtgtggagagaaaatgaaatagcaatgaaaggagaaaaaaacaagtcgagccgagcgagaaataggagttcaattttgtagatcccatcccgcaatttgcataaaaatggctgagttgaagtttcttggtatggattttagctgtgcgttgggttctctacgcaacggacaaatcccagaaaaggattgcttgcttccattaatatcaaagctcttgggttactgcatcgtcgctgcctctaccacagtcaaactaccacagatactaaaaattgtgaaacacagtagcatcagagggcttagtgttgtagcctttgagcttgagcttgtcggctataccattgctttggcctactgtctgcacaaaggcctccccttttcagcgtatggagagttggttttccttttgattcaggccataattcttgtagcaatcatctactattattctcagcccctcggatctaagacatggatcaaagcattaatttactgtgcacttgcacctacggtgttggctggtcaaattgatccgtatcttttcgaagccttatacgcttcccaacacgcaattttcttttgtgctagaattccacaaatttgggcaaattccaagaacaaaagtacaggggaactcagctttttaacctctttaatgaattttgctggttccatggtgagagtcttcaccagcatccaggaaaaggcaccaacgagcgtgattatggggtctgtgattggtatcatcacaaatggtaccatcttaagtcagataatcatatatgaaaagccaaagccggctgcaaagaaagaaaagaaagcgcattagagaagcgaggctgagtcaaatttactggttgtaaggtcttctggtttacatctgttgaatacatttaactggttgttatatgaaacgtaaagtcaaaaaaccgtactatgcttctatggatgatgaattccatatgttatcgtccgattccgagataattgtttttagcttgtttgttcacccagaaaatgaatgatagtgattgcttgag

SEQ ID NO: 3550 - DNA, 1228 bp, Antirrhinum majus
  misc_feature (704)..(704): n is a, c, g, or t
tagatcgaattttgtgtgtggaagtggaattacataaaaatggtagagatgaaatttctggggatggactttaggtgtgcggtgggatcggtaagcaacggtgaattcccccaaaaggattgtttgctccctttaatctcaaagcttctaggttactgcatcgtcgcagcttccaccactgtcaaattaccccagatactaaaaatcttgaagcacagtagcgttagaggcctaagtctcatatcttttgaacttgaagtagttggttacaccattgctttggcatactgtctgcacaaagggcttccattttcagcatatggggagttggctttccttttggtccaagccataattctagtagcaatcatgtactatttttctcaacctttgggaaccatgacatggatcaaaggattgatatactgtgcagtagcaccaacaattttagctggtcaaattgatccctttctatttgaagctctatatgcgtcccaacatgcaatttttttctgtgcaaggattccacagatttgggcaaactttaagaacaaaagcaccggagaacttagctttttgacctctctaatgaattttgcaggttccatggtgagagtcttcaccagcctgcaggaaaaggcaccaatgagtgttgttatgggatcagtgattggaattatgaccaatggtacaatcttaagccnaatatcatataccagaaaccaactgctaagaaagaaaagaaagccaattagcaaactgagatggcctaccaagctttcaactgctacagaatcgggagaatatcgtcacctacatttcgcaagttcatcaacacccaattaggaaatagcagccttggtacatcctgtgatgatatttatctggtcgaagattcttcatttgataaaactactgtttatgtatcaagtaaaagtttcatactagacttctagtacatcaatgatttatagaggatctttagaaatgaaatagtggagtgtagtacaatgtggtaccagtggaattgtcattgcaggtttccttttctttttttttgttctgaatgatacatatgtctttgattgttgaaacatgtttatttttcaattgatttgtggatgatagttagctgtatatctggatgaacataattgtggacttacctcggaaacagcttcttattgggagtaaaagtatttcactatctatggaaatgaatctcctc

SEQ ID NO: 3551 - DNA, 1066 bp, Lippia dulcis
atacagccaaccaacgtgcagtgtagatccagcaatccgaagacaattcaactctgcaattccacactcaaaagattttcacgcacaaaggtaatagacaataatcagaaaccagtgaagaattaggaggaatgatagagatgaagtttctcggaatggatttcacctgcgctttgagttcgttgcaaagcggcgaaattccagaaaaagattgcttgcttccgttaatatcaaagctattgggttacttgatcgtggccgcctccaccaccgttaaacttccgcagattctaaaaattgtacaaaacagtagtgtcagagggcttagtgttgtggcttttgaacttgaagttgttggctacacaattgccctggcttactgtcttcacaaagggcttccgttttcagcttatggggagctagcattcttattgattcaggctataattcttgtagcaatcatctattacttttctcaacctctgggaacaaagacgtggatcagaggcttattatactgtgcaatagctccaacagtgttggctggcaaaattggccctatgcttttcgaagctctatatgcttctcaacatgcaatcttcttctgtgctcgaattccacaaatttgggcaaatttcaagaataagagcaccggggagcttagctttttgacctcgcttatgaattttgctggatctatggtgagagtctttaccagcatgcaggaaaaggcaccaatgagcgtggttatgggctcggtgatcggcattgtcacaaatggcacgatcttatcgcagatagttgtgtaccagaaaccacctgcaaggaaagagaagaaatccgactagggaatgagcaacttctccgctagtctgaactcagaggcctcctctttttcaggcaagttttttgcgtctgtgccgcgatatctttagatgatcatagactctatttgcagaagaactacagttgtgtgtttttagatgatcagacttcagttttcatagaatttcattttacaatatctggattttgtgaactcattgccttcaaatattgttgtgag

SEQ ID NO: 3552 - DNA, 912 bp, Linum usitatissimum
ccacgcgtccggaatagatcaagggcaaaacgatggagtatctaggcatagattttggttgtgcaattggatctctacgccatggcaacttccctgaaaaggattgtttgcttcctcttatctccaagctcctcggctacgccatcgtcgctgcttccactaccgtcaaactccctcagatattgaaaattgtgaagaacagaagtgtgagagggcttagtgtcgttgccttcgagttagaagtgattggatacacaattgcactcgcatattgtcttcataaagggttaccattttcagcttatggagaatatgcgtttctcctcatccaagctataatcttagttgctgttatctactacttttcacaacctatcggcaccaagacatggatcaaggcattattattttctgcgatagcaccaactattctagctggtcaaattgctcccatgctttttgaagctctatatgcatcacaacatgcgatattcctctgtgccagaatcccacaaatatgggcgaacttttcgaacaaaagcactggggagctaagcttcttaacctttttcatgaactttggtggttccatggtgcgagtattcaccagcctacaggaaaaagcacctacaagcgttgttcttggttcggcacttggcgtggtcatgaatggaaccatcttaagccaaatactaatgtatcaaaagaagccacaacccaaaagaggcaagaaagaagaatagaatagagattgccaaaggagttgcttagcctccacttgatgtaatatttacttaacatttcatctgggattggaaaatcagatatttgatatgaactatgagaccttttttgcccaaatgtctaatcttgtttcgataaaaaaattatgatggaatattgtcatttgtc

SEQ ID NO: 3553 - DNA, 1097 bp, Mimulus guttatus
aagctcgaacatctcaggtcaataggtcatcagtttgataaatttaaaaaaaaaaaaaaaaaacagttaaaatagatagaaatggtggagatgaaatttctggggatggattttagctgtgcagtgggatctctaagccatggtcaattcccggaaaaggattgtctacttcccttaatatcaaagctgttgggttactgcatcgtcgccgcctccaccaccgtcaaactcccgcagatactaaagattttgaaaaacaatagtgtcagagggctaagcgtcctatctttcgaacttgaggtagttggttataccattgctttggcatactgtcttcacaagggacttccgttttcagcttacggagagttggcattccttttgattcaaggcataattctagtagcaatcatctactattattctcagcctctaggaaccaagacatggatcagagcattactatattgcgcaatagcaccaaccatcatggctggccagattgatccgtttcttttcgaagctctatatgcttcccagcatgcaatttttttctgtgcaaggattccacaaatctgggcaaacttcaagaataaaagtactggagagcttagcttcttgacctctttgatgaactttgcaggttccatggtgagggtctttaccagcatgcaggaaaaggcaccgatgagcgtggttatgggttctgtgattggcattatgacgaacgggacaatcttgagtcaaataatcatgtaccaaaaaccatcaacgaagaaagagaagaagtccgattagagaatcgacatttggtcccccaaggattgtactgctacagatgaactctttaaatttcactcgagaattgttatcaacacaagtagggaatagatactacaatgcttgtagttccttttttttaaaaccctagttctttaatttcgatgcaccatttgcaattttgtttggtgcagtaacatcaaatataagcgtggattcacgtcaatataaaccctttgttacaagataacttaatgttgtgcatcataaaccatgctaatataacatacattataagaagtaaagcttgagcagat

SEQ ID NO: 3554 - DNA, 1058 bp, Plantago ovata
ccactgcaaaatcccaacaacaatcaacaatgatggagatgaaattccttggaatggactttacctgcgcattcggagctttatccaatggccaattcccagagaaagactgtttgcttccccttatttctaagcttttgggttacgcaatcgtagctgcttcaaccactgtcaaactcccccagataatgaaaattttgaagcatagtagcgtaaggggactaagtgtcctagcgtttgaacttgaagtagtcggttatacaattgcgttggcgttctgtcttcacaaaggacttccattttcagcttacggggagttggcattccttttgattcaagctttaattctggtatcaatcatctactatttttctcaacctatgggaatgaagacatggatcaaaggattaatatactgtggaatagcaccaacaatattagctggtcagattgatccctttctttttgaagctctatatgcatcccaacatgcaatctttttctcggcaagggttccacaaatctggacaaactacaagaacaaaagtactggagagcttagctttttgacctcgctaatgaattgtgctggttccatggtgagggtcttcactagccttcaggagaatgcaccaatgagcgttgttcttggatcagtaattggaatcatgaccaatggtgcaatcttaagtcaaataatcatataccagaattcaactgcaaagaaagaaaagaaatccgattgaaaaatagagatcagatttgcaggctttcatttactcaaggttggagacccttgtttgctggagttgaatgattttatagcgaagcaagatatgttgcttacatatagtcttccagcaatctgtatcaaattataatttcatcacttcaattctcatatagaagctagcgagttctttgatttagattctctaatacatacatggaaactttagtagtctgtgatatggaatcttgttcatttgcctcttgttctgttatgatgaaacttgtgcctgtgacattggtatgacatgttatggaatttgaataat

SEQ ID NO: 3555 - DNA, 1861 bp, Solanum phureja
gagtaaacaagtctttaaaattctgataattcacacaaggtgtttggtttccatatatctatatatatccttgttacatgccaaaaactgaaaaagggtgtttttttttttatagtatttttagtactttttgcctatttctgatctgaaatttcacattttccggcgagaaaatggcgacggatatggaggtgctgcagaacgggaaggcggcggcggttaatgggtgttgcaaaaaaggacctggttatgcttctccacttgcagccatggatggtcctaaagaatctttaatttatgtcacctgcatatatactggaatgggaagggggaaacctgactacctggctacagtagatgtagatcctaagtcaccatcttattcaaaagtgatccacaggctgcctatgccttatgagggtgatgaactacatcattctggatggaattcctgcagttcttgttatggagatccatcagctgctcgacgatatctcgtcctgccttcactagtatcaggacgcatttatgcaattgacacacaaaaggatccaaaggctcccagtttgtataaagttgttcagccagatgatgtcatcaaaaagacaggattagcattcccgcacactgctcactgccttgcttctggtgagataatgttgtcatgtctcggagataaagatggaaatgctgaggggaatggatttcttcttctcgactcagactttaacgtgaaaggaagatgggagaaaccaggacatagtcccctctttggctatgacttctggtaccagcctcgacataacaccatgatcagttccacctggggagctccatctgctttcaccaaaggtttcaacctgcaggatgttgctgatgggcattatggtcgacatttgcatgtctacacatggcctggtggtgaacttaaacagacattggatcttgggaacactgggctccttcctctagaggtaaggttcttgcataatccatctgaagcaattgggtatgtgggctgtgctttgaccagtaacatggtgcgatttttcaagaatccagatggctcgtggggacatgaggtagctatctcagtaaaaccagtgaaagtgcagaactggattcttcctgaaatgcctggtcttattactgattttctgatctctctcgatgatcgttttctctacctggcaaactggctacatggtgacattcgacagtacaatatcgaggaccctgccaatcctaagttaactggccaagtatttgttggaggagtatttcaaaaagggaacgctgtactcgctgaggctgaagatggttcaacataccaagttgatgtccctgaagtccagggacatcggttgagaggagggcctcagatgatacaattgagtctagatggaaaacgtttgtatgctacaaactcattgttcagtacatgggaccgtcaattctaccccgaaatggtagagaaaggaggtcacatgttacaaatcgacgttgacagtgagaaaggtggccttgctattaacccgaggtttttcgttgatttcggagctgaacctgatggtccatctttggctcatgaaatgaggtatcctggtggtgactgcacttctgatatttggatatgagtgcctaaaatctcataaagaataaagtctggtgactctggtcccatgatattgcatttgtttattgaacgtcttcttcaaactccatgtaccttaaaacttcacgtttcagtttttctatatcttgatggagctttgtcttgatttcagaatttttactctggttatcccttatttatatgagctctttggtaaataactgtctttttttttatttctcgtgc

SEQ ID NO: 3556 - DNA, 1835 bp, Solanum tuberosum
ctttaaaattctgataattcactcaaggtgtttggtttccatatatctatatatatccttgttgttacaagccaaaaactgaaaaagggtgttttttttatagtatttttagtactttttgcctatttctgatctgaaatttcacattttccggcgagaaaatggcgacggatatggaggtgctgcagaacgggaaggcggcggcggcggtggttaatgggtgttgcaaaaaaggacctggttatgcttctccacttgcagccatggatggtcctaaagaatctttaatttatgtcacctgcatatatactggaacgggaagggggaaacccgactacctggctacaatagatgtagatcctacgtcaccatcttattcaaaagttatccacaggctgcctatgccttatgaaggtgatgaactacatcattctggatggaattcctgcagttcttgttatggagatccatcagctgctcgacgatatctcgtcctgccttcgctaatatcaggacgcatttatgcaattgacacacaaaaggatccaaaggctcccagtttgtataaagttgttcagccagatgatgtcataaaaaagacaggactagcattcccacacactgctcactgccttgcttctggtgagataatgttgtcatgtcttggagataaaagtggaaatgctgaggggaatggatttcttcttctcgattcagactttaacgtgaaaggaagatgggagaaaccaggacatagtcccctctttggctatgacttctggtaccagcctcgacacaacaccatgatcagttccacctggggagctccatctgctttcaccaaaggtttcaacctgcaggatgttgctgatgggcattatggtcgacatttgcatgtctacacatggcctggtggtgaacttaaacagacattggatcttgggaacactgggctccttcctctagaggtaaggttcttgcataatccatctgaagcaattgggtatgtgggctgtgctttgaccagtaacatggtgcgatttttcaagaatccagatggctcgtggggacatgaggtagctatctcagtaaaaccagtgaaagtgcagaactggattcttcctgaaatgcctggtcttattactgattttcttatctctctcgatgatcgttttctatacctggcaaactggctacatggtgacattcgacagtacaatatcgaggaccctgtcagtcctaagttaactggccaagtatttgttggaggagtatttcaaaaagggaacgctgtactcgctgaggctgaagatggttcgacataccaagttgatgtcccagaagtccagggacatcggttgagaggagggcctcagatgatacaattgagtctagatggaaaacgtttgtatgttacaaactcattgttcagtacatgggaccgtcaattctaccccgaaatggtagagaaaggaggtcacatgttacaaatcgacgttgacagtgagaaaggtggccttgctataaacccaagatttttcgttgatttcggagctgaacctgatggtccatctttggctcatgaaatgaggtatcctggtggtgactgcacttctgatatatggatatgagtgcctaaaatctcataaagaataaagtctggtgactctggtcccatgatattgcatttgtttattgaacatcttcctcaaactccatgtaccttataacttcacatttcagtttttctttatcttgatggagctttgttttgatttcagaatttttactcaggttattccttttttatatgagctctttggtaaataacgtcg

SEQ ID NO: 3557 - DNA, 1589 bp, Capsicum annuum
cctatttctggtctgaatttttctgttttttggtgagaaaatggcaacagatatggaggtgggagttaatgggtgttgcaaaaaaggacctggttatgctgctgcacttgctggtatgtctggtcctaaagaatctttaatttatgtgacctgcatgtatactggaacaggaaggggaaaacttgactacttggctactgttgatgttgatcctaattcaccatattattggaaagtaatccataagctgccaatgccttatgagggggatgaactacatcactctggatggaattcttgcagttcttgttatggagatccatcagctgctcgacgatatctcgtcctgccttcactaatatcaggacgcatttatgcagttgatacacaaaaggatccgagagctcccagtttgtataaagttgttcagccagatgatgtcattcagaagacgggattagcattccctcacactgctcactgccttgcttctggggagataatggtgtcatgtctcggagataaagatggaaatgccgaggggaatggatttcttcttcttgattcagactttaacgtgaaaggaaggtgggagaagccagggcatagtccattctttggttacgacttttggtaccagcctcgacataacaccatgatcagttccacctggggagctccatctgctttcaccaaaggtttcaacctcgagcatgttactaatgggctttatggtcagcatttgcatgtctacacatggcctggtggtgaaataaaacagacgctggatcttgggaacactgggctccttcctctagaggtaaggttcttgcataatccagctgaagcaattgggtatgtgggatgtgctttgaccagtaacatggtgcgttttttcaagaatccagatggctcttggggacatgaggtagccatctcagttaaaccagtgaaagtgcagaactggattcttcctgaaatgcctggtcttattaccgattttctgatctctcttgacgatcgttttctatacctggcaaactggctacacggtgacatcagacagtacaacatcgaggaccctgccaatcctaagctgactggccaagtttttgttggaggcgtgtttcaaaaagagaacgctgtactcgctgaggctgaagatggttcaacataccaagtcgatgtcccagaaatccagggacatcaattgagaggaggacctcagatgatacaactgagtctagatgggaaacgtttgtacgctacaaactcacttttcagtacatgggaccgtcaattctaccccgagttaatagagaaaggaggtcacatgttacaaattgacgtcgacacagagaaaggtggccttgctgtcaacccgaactttttcgttgatttcggagcagaacctgatggtccatccttggctcatgaaatgaggtatcctggtggtgactgcacttctgatatttggatatgaatggctaaaaatctcatacaagaataaagtatggtgcctttggtcccatgatgttgcattgcctattatataaagttttaaaactctacatttcagtgactcctta

SEQ ID NO: 3558 - DNA, 1859 bp, Olea europaea
gacaaacgcgcaatataataactcacctgtcacctgacatgaccgctcatttcggactgttgcaaacgtggcttctgtaagcactgagtggcgtttagcttcccgaattgcatccgtagaagcacaaacagatattcacaaaaagcgtaaaattcaagggcgattagtctgagcagtttttctatctgggttgtgcttaaatttgtttgtgaaggaagaaaaagagcagaaaaatggctacggatatggtggtggttcaacaagcagcggtgaacggtggttgctgcaaaaaggggccaggatatgctactccgcttgaagccatggctggcccaagggaatctcttatttatgtcacctgtgtttataaaggaactggaacggagaagcctgattatcttgctacggtagacgtggatccagattcgccgacttactctaaagtcattcacaggctacctatgccttacattggcgatgaactacatcattcgggatggaattcctgcagctcttgccatagtgatccatcagcttcccggcgattccttgtcctaccttcacttgtgtctggtcgcatatatgccgttgatactcaaaaggatccgaaggctccgactttgcataaagttgttgatccaaaggatataatcgcaaagactggattagcgtacccgcacacagctcattgccttgcttctggtgatatcatggtatcatgccttggagataaagatggaaatgctgaaggaaatggatttcttcttctggattctgattttaatgtgaaaggaaggtgggagaaacctggacatagtcccctttttggctatgatttctggtatcaacctcgacacaagaccatgatcagcacttcgtggggagcacctgctgctttcaccaaaggtttcgaccttcagcatgtttctgatgggctttatggaagacatttgcacgtgtacagctggcctgatggtgaactgaaacagactttggatcttggaaatactgggctcctaccattggagataagatttctgcacgatccatccagggatacaggatttgtgggatgtgccttaacaagcaacatgataaggtttttcaagaacccggatgggtcatggagccacgagctatcaatatcagtgaagccactcaaggtgcaaaattggattcttcccgagatgcctggtcttataacagatttcctgatatctcttgatgatcgtttcctctacttggccaactggcttcatggtgatattagacaatataatattgaagatcccgcaaatcctcagctgactggccaagtatgggttggaggattagttcggaaaggaagcaccgtggttgttgaggcagatgatggttcgacgtaccaggttgatgtcccggatgttaagggaaataaattgagaggaggacctcagatgatacaactgagcttagatgggaagcgactctatgttacaaattctctcttcagtacatgggaccgtcaattttatcccgagcttgtgcagaaaggcggccatatcttacagatcgatgttaacaatgagaaaggtggtcttgcaataaaccagaatttttttgtcgattttggagctgaaccagacggtccatccttggcgcatgaaatgagatatcccggtggcgattgcacatctgatatatggatataagtactcaataatagtagttcggatcgatgctgcctccagcacaggagtcaaaaagtactgttatatgtaataagggcagcaaaattcactagttgaactgatatttaattgaaaataacttgataaagaatcagttttcttcccacactgcgcaatatgctccttatt

SEQ ID NO: 3559 - DNA, 1947 bp, Mimulus guttatus
cgcaaacgtgggcgcttctgtaataaaaaaataaaaaagttagcatctttcaccagattcctaaaatcgaaactcgtgaacactctgaaagttaaataagtgctaaaggtggcaacttttcagtgatttacgatctgggcttcttttaaattcgcttcaagaaaatcactgaaaatagagagagaggagagagagagagatctagagagagagaatggcaacagatatggtggttttgcagcacgctgacgtggaaaatggaaatggaaatgggtgctgtaagaaagggcctggttatgctactcctcttgcagccatgtctggtccaagggaaacccttatctatgtcacttgtgtttatacaggaacgggaaaagaaaatcccgattatcttgcgacagtcgacatagatccgaattcaccgacgtattcgaaagttatacacaggctgccaatgccttacattggagatgaactccatcattctggttggaattcttgcagctcttgtcatggagattcctctgcttctagaagattccttgtcctcccttcactcgtgtcgggtcggatatatgcaatcgatactttgaaagatccaaaagcgccgagtttatataaaatagtcgatccaaaggaagtaatccaaaagacgggattagcgtaccctcatacagctcactgccttgcctcgggcgaaatcatgctatcgtgtcttggagataaagacggaaatgccgaaggaaatggatttcttttgctcgactccgatttcaatgtcaaaggaaggtgggaaaaaccgggacacagcccgactttcgggtacgatttttggtaccaaccaaggcacaaaaccatgataagcacttcttggggagctccattggcttttactaaaggctttaaccctcagcatgtttccgacggtttatacggccgtcatttgcacgtgtacagctggcccgatggtgagttgaaacagactttggatctcggaaataccggtctcattcctttggagatacgattcttgcatgatccggataaggatacggggtttgtggggtgtgcgctaacgagcaacatggtgcgatttttcaagaaaccagatgagtcgtggggtcacgaggtatcgatatcggtgaagacgctgaaggtgcagaactggatacttccggagatgcctggtcttataaccgattttctgatatcactcgacgaccgttttctttacctggctaactggcttcacggtgatattagacaatataatatcgaagatccgaccaatcctaggttgacaggtcagctttgggttggcggtttgattcgtaaaggtggtcccgtttttgccgaggcggaagacggtactacgttccaggtcgacattccggaagttcaggggcatgaattacgaggcgggcctcagatgatacagctgagtttagacggaaaaagactgtacgcaacaaactctctcttcagcgcgtgggacaagcagttttatcccgatctaatcgagaaaggttctcacatgctgcagatcgatgtcgacactgagaaaggcggtctcgctatcaacactgacttctttgtggatttcgggtctgagccaggtggcgcctcgctggcgcatgagatgaggtatccgggtggcgactgcacttctgatatttggatttgagttattttgtaataagagatcaagaatgtttggctgaaaaacgtacgttttaatacaaagatgtaatgaatcgaattatcgaattgtggtcttgcaataaatagtgggattgttgatatgaaatctcgtttgcaattcgattttttgaaactgggctcatgcccgatagcggacccgggatttgagtcctgggcgccgaatgcattaaaaaaattatgaggggctgataatcaggggcgagtctagcccaccctcaattgaaa

SEQ ID NO: 3560 - DNA, 1773 bp, Fraxinus spp
cgattaatctgagcagttattctatctgggttgtgcttaaaattgttcgtgaaggaagaaaaaagagcaggaaacatggctacggatgtggtggtggtgcaacacgcggcggtgaacgatggctgctgcaaaaaggggccgggatatgctactccgcttgaagccatggctggcccaagggaatctcttatttatgtcacctgtgtttattcaggaactggaacggagaagccagattatcttgctacagtagatgtggatccaaattcaccgacttactctcaagtcattcacaggctacctatgcctcacattggcgatgaactacatcattcgggatggaattcctgcagctcttgccatagcgatccatcagcttcccgtcgattccttgtccttccttcacttgtgtctggtcgcatatatgctattgatactcaaaaggatctgaaggctccgactttgcataaagttgtcgatccaaaagatataatcgcaaagactggattagcatacccgcacacggctcattgccttgcttctggtgatatcatggtatcatgccttggagataaagatggaaatgctgaaggaaatggatttcttctgctggactctgattttaatgtgaaaggaaggtgggagaaacctggacacagtcccctttttggctatgatttctggtatcaacctcgacacaagaccatgatcagcacttcatgggggcacctgctgctttcaccaaaggtttcaaccttcagcatgtttctgatgggctttatgggagacatttgcacgtgtacagctggcccgatggtgaactgaaacagactttggatcttggaaatactgggctcttaccattggagataagatttctgcacgatccatccagggatacaggatttgtgggatgtgccttaacaagcaacatgataaggtttttcaagaaccctgatgggtcatggagccacgagctatcaacatcagtgaagccactcaaggtgcagaattggattcttcccgagatgcctggtcttataacagattttctgatatctcttgatgatcattttctctacttggccaactggcttcatggtgatattagacaatataatattaaagatcctgcaaatcctcggctgaccggccaagtatgggttggaggattagtccgaaaaggaagcaatgtggttgttgaggcagatgatggttcaacataccaggttgatgtcccagatgttcagggaaatcaattgagaggaggacctcagatgatacaactgagcttagatgggaagcgactctatgttacgaattctctcttcagtacatgggaccgtcaattttatcccgagcttgtgcagaaaggcagtcatatcttacagatcgacgttaacaatgagaaaggtggtcttgcaataaacgagaagttttttgtcgattttggagctgaaccagatggtccatccttggcgcatgaaatgagatatcccggtggcgattgcacatctgacatatggatataagtactcaagaatagtagttgaatcgatgctgcctccagtacacgtgagtcacaaattactgttatatgtaataagggcagcaaaattcactagttgaactgatgtttaactgaaaatagctcgataacaatcagtttttcttgcattgcagcgataatggggccttttaatttagatttttatgttattaccttggttagatgattgtgttttatatatatctactttctgatgaagcacc

SEQ ID NO: 3561 - DNA, 1572 bp, Vinca minor
aaacagagatggtgactgcaacagatatggtggtggtggagcatgcgacggtggcggagggcggtggttgctgcaagcataaggggccaggttatgctagcccgcttgaagccatggctggtcctacagaaaagctcatttatgttacctgcatttatacagggacagggaaggagaagccagactacctggccacagtggatatagatccaaattcaccaacttactctaaggttattcacaggctgcctatgccttatattggtgatgaacttcatcattctggatggaatgcctgcagctcctgctttgacgattcgtcagcttccaggagatttcttgtcctacctgcattagtgtctggtcgcatttatgcgattgacacactgaaggatccaaaggctccgtcttttcataaggttgttgagcctgaagatatcgtccagaagactggtttagcatatccacatactgctcactgcctagcttctggtgatatcctggtttcatgccttggagataaagaaggaaatgctcaaggaaatggatttcttttgctcgactcggaatttaatgtcaagggaaggtgggagaagcctggacatagtcctctttatggatatgatttctggtaccagcctcggcacaagacaatgatcagcacttcatggggagctccatctgcgttcactaaaggttttaaccttcaggatgtttcagatggtctttatggacggcatttgcatgtgtatagttggcctggtggtgaattacagcagacgttggatcttggtcccacaggtctcctaccgttggagattaggttcctgcatgatccatcgaaagatactggttttgtcgggtgtgcgctaacaagtaacatggttcggtttttcaagaccgcagatgggacatggagccatgagatagcagcatcagtaaagccactgaaggtgcaaaattggattcttccggaaatgcctggtctaataacagattttctcatatctcttgatgaccggttcctatacttggcaaactggcttcatggtgatatcagacagtataacattgaggacccccaaaatcccaagcttacaggccaagtatgggtggggggactaatccgtaaaggtagctctgtattagcagaagctgaagacggtacaaagtaccaggttgatgtcccagaggttcagggaaagcagctgagaggaggacctcaaatgattcagttgagtttggacggaaaaaggctctacgttacaaactctctgttcagcgcgtgggaccgccagttctatcccgatctagtcgagaaaggagcacacatgttgcagattgatgttgagacagagaaaggtggtcttgctataaaccccaacttctttgtggactttggagctgaacctgatggtccatctttggctcatgaaatgagatatcctggtggagactgcacttctgatatttggatctaaactatgtgaatcttgagaggaataaaacaatgtactattaagcaattctacttgtactctataaacatttaccaactaaataaataaatga

SEQ ID NO: 3562 - DNA, 1669 bp, Populus trichocarpa
atcatctcatcgtcattcagacagggagaaagaaagagatggctacaggcacagaagtggtgagtgataatggacatggatgctgcaagaaaggaccaggttatgcgacaccacttgaagcaatgtctggtccgagggagtcacttctctatgtcacttgtgtttactctggaacgggaatagagaagcctgattatctagccacagtggatgttgatcccaactcacctacttattcaaaagttatccacaggctacctatgccaaacgtaggagatgaactgcatcatacaggatggaattcttgcagctcttgccatggagatccatctgcagcaaggcgttatctggtccttccttccttgatatctggtcgcatttatgcaattgacaccctaaaagatccaagggctccctcattgcataaagttgttgagcctgcagatattgtaaataagacaggattagcatatccacacacatcccattgccttgcttctggagatgtcatggtatcatgccttggagataaagatggaaatgcagagggaaatggatttcttctactcgattcagaattcaatgtaaaggggaggtgggagaaaccagggcacagtccaacgtttggttatgatttctggtaccaacctcgacacaacataatgattagctcatcatggggagctcctgcagccttcactaaaggcttcaatctgcaacatgtggcagatggtctttacgggaggcatttgaatgtctacagttggcccaatggtgaactgaagcagacattggatcttggcgatacaggactcttgccattggagataaggtttctgcacgatccttctaaagattcagggtttgttgggtgtgccttaacaagtaacatggttaggtttttcaagacccctgatggatcatggagccatgaggtggcaatatcagtgaaaccattgaaggtgcaaaactggattctcccagaaatgccagggcttgtaactgattttctcatctctcttgacgatcggtttctgtactttgtcaactggctgcatggagatgtccgacagtacagcattgaggaccctgaaaaacctgtcctgaaaggacaagtttgggttggggggctgatccaaaaaggaagctctgtggtggctgagggtgaagatggaaaaacctggcagtatgatgttcctgaaatccagggacatcgattgaggggcgggcctcaaatgattcagctgagtttagacgggaagcgactttatgtcaccaactcacttttcagtacctgggatcgtcagttttatccggaacttatggagaaaggatctcacatgttacagatagatgttgacactgagaagggtggtcttgcaataaatccaaactattttgtggactttgcagctgaacctgatggtccttccctagctcacgagatgagatatccaggtggtgactgcacatcagatatatggatctaagcatcctaaatggttcggcagtgaggggttacgtgagaacagacattagaagttgtagttatgtgactgtaaattgcaatggcatgttgtggcttactgttgatggatgagtaactatgtctcttctaatgctttaatccatccttttaataataataataattgccgttttcataacc

SEQ ID NO: 3563 - DNA, 1861 bp, Populus trichocarpa
gcaaaaataaatagaaacagcaacacgttagatgggagttctgttcttctaatgtaagattgcatgacttaacaattctgtgtaatattaccaaaaaaaacactattttgtgttagaaacttgaaacttcttggttcttgctgctcaccatcatcatccagagagagagagagagagagagagagatggctacagggacagaagtggtgagtgctcatggacatggatgctgcaagaaaggaccaggttatgctagcccacttgaagccatgtctggtccaagagagtcacttatttatgtcacttgtgtttacgctggaacgggaatagagaagcctgattatctagccacagtggatgtagatcccaactcacctaattattcgaaagttatccacaggctacctatgccaaacttaggagatgaactacatcattcagggtggaattcttgtagctcttgtcatggagatccatcagcagccaggcgttatctgatccttccttcattgatatctggtcgcatatatgcaattgacacactaaaagatccaagggctccctcattgcataaagttgttgagcctgcggatattgtaaataagacaggattagcatatccacacacatcccattgccttgcttctggagatgtcatggtatcatgcctaggagataaagatggaaaggcagagggaaatggatttcttctacttgattcagaattcaacgtaaaggggaggtgggagaaaccagggcacagtccgaaatttggttatgatttctggtaccaacctcgacacaacaccatgattagctcctcatggggagctcctgcagccttcactaaaggcttcaatccgcaacatgtttcagatggtctttatgggaggcatttgcatgtctacagttggcctaatggtgaactgaaacagacattggatcttggcagtactggactcttgcccttggagataaggttccttcacaatccttctaaagatacagggtttgttggatgtgccttaacaagtaacatggtacgatttttcaagacccctgatgaatcatggagccatgagttggcaatatcagtgaaaccattgaaggtgcaaaactggattcttccagaaatgccagggcttataactgattttctcttatctcttgacgatcggtttctatattttgtcaactggctgcatggagatgtcagacagtacaacattgaggaccccaaaaatcctgtcctgaaaggacaagtctgggttggggggctgatccaaaaaggtagcccagtagttgctgagggtgaagatggaaaaacctggcagtatgatgttccagaaatccagggacatcgattgagaggagggcctcaaatgattcagctgagtctagacgggaagcggctttatgtcaccaactcacttttcagtacttgggatcgtcagttttatccagaagtcgtggagaaaggatctcatatgttacagatagatgttgacactgagaaaggtggtcttgcaataaatccaaactattttgtagactttgcatctgaacctgatggaccttccctagcccatgagatgagatacccaggaggtgactgcacatcagatatatggatctaagcatcctggatggtttggcaatgaggggttacctgagaacagaccttaggaagcaataatatcaatgtgtaaattgcaatggcatgttgtggcacttactctttgatggatgagtaacttcgttccttttaatgctttaatccatcgtttaatatcaaatgataattgcagtttcataatcaacatgaacttatgcctgatctggccatcatggcgcttttttg

SEQ ID NO: 3564 - DNA, 1811 bp, Triphysaria pusilla
atcatcatcatcatcccataccccgtccgtgagttcaatcatttcacacttttatacccatctcaaacaacaaaatctaaactcaaactcctcggttgatcttggatttggtctttaattcacttgaacacaaacaagaagtgcagagagggaaaaaaatggcaaccgatatggtggtgttgcagcatgcaagtgtcggaaatggttgctgcaacaagggaccaggatacgctacacccctcgatgccatggctggtcccagagagactcttatttatgttacctgtgtttataatggaacaggaaaggagaagagccagattaccttgcaacagtagatgtggacccaagttcgccgacatacactaaaatcatacacaggctgccgatgccttacgttggcgatgaactacatcactctggatggaatgcatgcagctcttgccatggagatactttggtttcacgccgatatcttgtcctgccttcgctgctgtctggtcgcatatatgcaattgatacccaaaaagacccaaaggctccaagtttgtataaatttgttgatcccaaagatataattgaaaagacgggattggcatacccacatactgctcactgccttgctactggtgaaatcatggtatcgtgccttggggacaaagatggaaacgctcaaggaaatgggtttcttcttctggattccgattttaacgtcaaaggaaggtgggagaagccagggcacaccccacttttcgggtatgatttctggtatcaacctcggcataagaccatgatcagcagctcatggggggctccagctgctttcaccaaaggtttcgaccttcagcatgtttcagatggtctttatgggcgacatttgcatgtatacagctggcctgagggtgagttgaaacagacgttggatcttggaaacactggtctcctaccgttggagataagattcttgcatgatccggacaaggatactggatttgtgggatgtgctctaacgagcaacatggttagattcttcaggaagcccgatggatcatgggaccacgagctatcagcgtcggtgaaaccagtcaaggtgcagaactggatccttccggagatgcctggtcttataactgatttcttgatatctcttgatgatcgtttcttttatgtgtccaactggcttcatggtgatattagacaatataacattgaggatcctgcaaatcctcgactgacgggtcagttatttgttggaggtttgattcgaaaaggaagcagcgtgcttgctgtggctgatgatgctacaacttaccaggttgacgtaccagatgttcagggacatgaattacgaggagggcctcagatgatacagctgagcttggatggaaagcggctctacgtgacaaattcactcttcagcacgtgggaccgtcagttttaccccgatctcatcgagaaaggtagccatatattacagattgacgttgacaatgagaaaggcggtttggccatcaatcccaatttctttgtggatttcggaaacgaaccggatggcccatctttggctcatgagatgagatatcctggtggtgactgcacttccgacatctggatttagtaacctctctcaatgacactgagtgtattatctatctatctcagcgcttctttaatttgtggaatattaattcaagatttctacttacaaataaaaataaagaaataaagttgatcttggagattttatttgcactcttacatatagcaagtgcattacaatgctctgaaatataatataacaccagtaaaac

SEQ ID NO: 3565 - DNA, 1622 bp, Vinca minor
aaaaaaaaaaaaaaaaaaaaacagagatggcgaccgcaaccgatacgacggtggtggtggaacaggcgacggtggcggaggatggcggttgctgcaagcacaaaggacccggttatgctagccctcttgaggccatggctggtcctagagaaaaacttatctatgttacctgcatttatacaggaacagggaaggagaagccagactacttgggcacagtagatgtggatccaaattcaccaaattactcaaaggttattcacaggctgcctatgccttatgttggtgatgaacttcatcattctggttggaatgcctgcagctcctgctatgacgactcctccacttccaggagatttcttgtcctaccttcattagtgtctggtcgtatttatgcgattgatacgctgaaggatccaaaggctccgtctttgcataaggttgttgagcccgcagatatcattcagaagactggtttggcatttccacacactgctcactgcctagcttctggtgatatactggtctcatgccttggagataaagaaggaaatgctcagggaaatggctttcttttgcttgattcggagtttaatgttaaaggaaggtgggagaagccaggacatagtcctctttatggatatgatttctggtaccaacctcggcacaagacgatgatcagtacttcatggggagcgccatcggctttcaccaaaggttttaaccttcaggatgtttcagatggtctttatggacggcatttgcacgtgtatagttggcctggtggtgaactgcagcagacggttgatcttggtccctcaggtctcctaccgttggagattcgattccttcacgatccatctaaagatactgggtttgtggggtgtgcactaacgagtaacatggttcggtttttcaagacagcagatgggtcatggagccacgagattgcaatatcagtaaagccgctcaaggtgcagaattggattcttccagaaatgcctggtctaataacagattttcttatatctcttgatgatcggttcctatatttggcaaactggcttcacggtgatatcagacaatataacattgaggaccctaaaaaacccaagcttacaggccaagtatgggttgggggacaacttcctaaaggtagctctgttttagctgaagctgaagatggtacaacataccaggtcgatgtccccgaggttcagggaaagcagctgagaggaggtccacaaatgattcagttgagtttagacggtaaaaggctttatgctacaaactcactgttcagcgtgtgggaccgccagttctatcccgatctagtggagaaaggagcacatatgttgcagattgatgttgacacagagaaaggtggtcttgccataaaccccaacttctttgtggactttggagctgaacctgatggtccatccttggcccatccttggctcatgagatgagatatcctggtggtgactgcacttctgatatttggatttaaactatatatgttaggtttaaataaaaattgtattacacaattctctttgtactccataaatgtttaccaaactgaaacttatatggttgtaaataagtgaagcatttta

SEQ ID NO: 3566 - DNA, 1927 bp, Euonymus alatus
gaactgaggcaaaaaacaaatcacgatacacaattctttcttcgaccttaacaatcccaaatccaaaaagtaacctcagaataccagatttgagtgcataaatataaacgaaggtgttgtcttcctcaaatttgtgattgtttgattattctgaagtgtgagctcgagatggcgacggacatggtggttttagagcatgggtctgagcaaagcaacagccatggatgctgcaacaagggaccaggttatgccaccccacttgaggccatgactggccccagagaatctcttatctatgtcacttgtatctattcaggaacaggaatagagaagcctgattacctaggcacagtggatgtagatccaaactcacctacttattctaaagttatccacaggctacctatgccaaacgtaggagatgaactgcatcattcaggatggaattcttgcagctcttgctatggagatccatcggctaacagacgttttctcgtcctaccttctctgatatctggacgcatatatgctgttgacactcagaaggatccaagagctccctctgtgcataaagttgtggagcctgaagttattgtacagaagacaggattagcatatccacacacagcccattgtcttgcttctggagagataatggtgtcatgcttgggagataaagatggaaatgctgaaggaaatggatttcttctcctcgactcagaattcaatgttaaaggaaggtgggagaaaccaggtcacagtcctttgtttggctatgatttctggtatcaacctcaacacaagaccatgataagcacatcatggggcgcccctgcagctttcaggggtggtttcaacctgcaacatgtatcagatggtttgtatgggaggcatctgtttgtttatagctggcctgatggtgaactgaaacaaacactggatcttggctctgaagggctattacccctggagataaggttcctgcataatccttctaaagacacagggtttgttggatgtgcgttatcaagtaacatggtgcgttttttcaaaaacgaagatggatcatggagccatgaggtggcaatatcagttaagccattgaaggttcaaaactggatacttccggaaatgccagggcttataactgattttttgatctctcttgacgatcgttttctatattttgtgaactggcttcatggagatgttagacagtataacattgaagaccctgcaaagcccatattgactggtcaagtttgggttggtggactgattcggaagggaagtccaatagtggctgagcaagaagatggtacgacctggcagtctgaagttccagtggttcagggaagtcatttgaaagggggacctcagatgatccaactgagtttagatgggaagcgactgtacgtcaccaactccctcttcagtgcatgggatcgccagttctatcctgaaatcttggaaaagggatcacacatgttgcagattgatgtggatactgaaaagggtggtcttaagataaaccccaacttctttgtggactttggagctgaacctgatggtccgtccttagctcatgagatgagatatcccggaggtgactgcacttctgacatttggatttaagcattcttagctggttacaaataataaataaaaaagaagtcatatgataaatgttttatgaataaatccttcctgttgggttatacgtatcaaaaattgctcggtttggttgaggagattaaagctctttgcatgttttttttccaagtagttaggatttggcgacagccccaagtgattagggtttggatgcctattgactacctaattgcgtggagcaaataacatttgtattttgatctgtactcagctgtccttaaggaatgtgcaggaccccgcagaattatgttgc

SEQ ID NO: 3567 - DNA, 1596 bp, Catharanthus roseus
gcgacggtggcggagaataatgcttgctgtaagaataagggtccaggttatggtagccctcttcaggccatggctggtcctagagaaaaactcctttatgtaacctgcatttatacaggaacaggaaaggagaaccctgactacctggccacagtggatgtagacccaaattcaccaacttactctaaggtgatacacaggctgcctatgcctcatattggcgatgaacttcatcattctggatggaatgcctgcagttcctgctatggagatccatcagctgccaggagatatcttgtcctgccttctttagtgtctggtcgcatatatgcagttgatacactgaaggatccaagagctccagctctgtataaggttgttgagcctgcagatatcatccagaaaactggtttagcatatccacatactgctcactgcctagcttcgggtgacatcctggtgtcatgccttggagacaaaaaaggaaaagctgagggaaatggctttcttttgcttgactcagaatttaatgtgaaaggaaggtgggagaaacctggacatagtcctctatttggatatgatttctggtaccaacctcggcacaaaacaatgattagcagttcatggggagctccatctgcgttcaccaaaggttttaaccttcaggatgtttcagacggactttatggacggcatttgcatgtgtacagttggcctgatggtgaactacagcagacattggatcttggtagcacaggactcctaccattggagattagattcctgcacgatccatctaaagatactggctttgtcgggtgtgccctaacaagtaacatggttcgatttttcaagactgcagaagggacatggaaccatgaggttgcaatatcagtaaaaccactgaaggtgcagaattggattcttccagaaatgcctggtctaataacagattttcttatatcacttaatgatcggttcctttatttcgccaactggcttcatggtgatattagacaatataacattgaggaccctcaaaatcccaagcttacagggcaagtgtgggttgggggacaaattcgtcaaggtagctctgttttagcagaagctgaagatggtaaaacctaccagatcaatgtcccagagattcaggggaagcagctcagaggaggaccccaaatgattcagttgagtttagatggaaaaagactatacgctacaaactcgctgttcagcacttgggatcggcagttttatcctgaacttgttgagaaaggagcacacatgttgcagattgatgttgatacagagaaagggggtcttgctataaacccaaacttcttggtggactttggagctgaaccagaaggtccatcattggcacatgagatgagatatcctggtggagactgcacttctgatatttggatctaaacattgtgaatcttaattagaaattaaatgtaatgcacagcgaaaaaatgaaaaactaacagtttttaaataagtgaagcattttatccagcaatgtataaagttccatttgctatttatgattcagtgacttgtcctgttttaagatttctactactg

SEQ ID NO: 3568 - DNA, 1777 bp, Amsonia hubrichtii
gagaaggatcaatgatacatcccacctggacacttctcagacatgcactgataatcttctcacgtgtctgtaccgtattagcttatccatcgtgttcataacgccgaagacagaaaaaccaccacgacagcaaggactgcttatatagataacagttttttgcatttgggatcatcacttcttttgaagattctgcagtgtctttgagaaagagagatagagatggctgcaaccgatgtggtggtggtggagcatgcggctgtgtcggagaatggctgctgcaaacataagggaccaggctatgctagcccacttgaggccattgctggtcctagagaaaaactcatctatgtgacctgcatttatagagggacaggaaaggagaaacctgactacctggccacagtggatgtagatccaagttcaccaacttactccaaggtcatccacaggctgcctatgccttacattggtgatgaactgcatcattctggatggaatgcatgcagctcctgccatggagatccatcaacttcaaggagatttctcgtcctaccttcattagtatctggtcgcatatatgcagttgatacactgaaggaccctagggctccagcattgcataagattgtacagcctgaagatattatccagaagactggtttagcatacccacatactgctcactgccttgcttctggtgatatcatggtgtcatgtcttggagataaagaagggaaggctgagggaaatggctttcttttgcttgactcagaatttaatgtaaaaggaaggtgggagaaacctggacatagccctctttttggatatgatttctggtaccaaccccgacacaagacaatgatcagcacttcatggggagctccagctgcgttctgtaaaggttttaaccttcaggatgtttcagatggcctttacggaaggcatttgcatgtgtatagctggcctggtggtgaaatacagcagacattggatcttggtaacacaggactcctacccttggagataaggttcctgcacgatccatctaaagatactgggtttgtcgggtgtgccttgacaagtaacatggttcgatttttcaagaccgcagatgggacatggagccatgaggtatcaatatcagtaaaaccactgaaggtgcagaattggattctgccagagatgcctggtctgattacagattttcttatatctcttgatgatcggttcctttatttagcgaactggcttcatggtgatatcagacagtataacattgaggaccctcaaaatcccaggcttacaggccaagtatgggttgggggacaaattaaaaaaggtagctctgtattagcagaggctgaagatggtatgacataccaggttgatgtctcagaaattcaggggaagcagctgagaggaggaccgcagatgattcagttgagtttagatggaaagaggctctacgctacaaactcactcttcagctcatgggacagccagttttaccccgatttagtggagaaaggatcacacatgttgcagattgatgttgacactgagaaaggtggtcttgccataaacccgaacttcttcgtggactttggagctgaacctgatggtccatccttggcacatgagatgagatatcctggaggcgactgcacatctgatatatggatttaaacaatgtgaatctttagaaacataattcgcccagtatttgggaagtgtcttctaaaccataactttcagctcttacataaatgaagta

SEQ ID NO: 3569 - DNA, 1733 bp, Fraxinus spp
aaaagaccgattaatctgagcggtatttctatctgggccgtagcttaaaattgttacgtgaaaggagaaaaaagagcaggaaacatggctacggatgtggtggcggtgcaacacgcggcggtgaacgatggctgctgcaaaaaggggccgggatatgctactccgcttgaagccatggctggcccaagggaatctcttatttatgtcacctgtgtttatacaggaactggaacggagaagccagattatctcgctacagtagacgtggatccagattcaccgacttactctcaagtcattcacaggctacctatgcctcacattggcgatgaactacatcattcaggatggaattcctgcagctcttgccatagtgatccatcagcttcccggcaattccttgtcctaccctcacttgtgtctgggcgcatatatgctattgatactcaaaaggatcttaaggctccgactttgcataaagttgtcaatccaaaagatataatcgcaaagactggattagcatacccgcacacggctcattgccttgcttctggtgatatcatggtatcatgccttggagataaagatggaaatgctgaaggaaatggatttcttctgctggactctgattttaatgtgaaaggaaggtgggagaaacctggacacagtcccctttttggctatgatttctggtatcaacctcgacacaagaccatgatcaacacttcatggggggcacctgctgctttcaccaaaggtttcaaccttcagcatgtttctgatgggctttatgggagacatttgcacgtgtacagctggcccgatggtgaactgaaacagactttggatcttggaaatactgggctcttaccattggagataagatttctgcacgatccatccagggatacaggatttgtgggatgtgccttaacaagcaacatgataaggtttttcaagaaccctgatgggtcatggagccatgagctatcaacatcagtgaagccactcaaggtgcagaattggattcttcccgagatgcctggtcttataacagattttctgatatctcttgatgatcattttctctacttggccaactggcttcatggtgatattagacaatataatattaaagatcctagtaaaacctcggctgaccggccaagtatgggttggaggattagtccgaaaaggaagcaatgtggttgttgaggcagatgatggttcaacataccaggttgatgtcccagatgttcagggaaatcaattgagaggaggacctcagatgatacaactgagcttagatgggaagcgactctatgttacgaattctctcttcagtacatgggaccgtcaattttatctcgagcttgtgcagaaaggcagtcatatcttacagatcgatgttaacaatgagaaaggtggtcttgcaataaacgacaagttttttgtcgattttggagctgaaccagatggtccatccttggcgcatgaaatgagatatccaggtggcgattgcacatctgacatatggatataagtactcaagaatggtagttgaatcgatgctgcctccagtacacgtgagtcacaaagtactgttatatgtaataagggcagcaaaattcactagttgaactgatttttaactgaaaatagcttgataactatcagtttttcttgcattactgcgataatggggccttttaatttagattttcatgttatta

SEQ ID NO: 3570 - DNA, 1827 bp, Actinidia deliciosa
  misc_feature (12)..(16): n is a, c, g, or t
  misc_feature (19)..(20): n is a, c, g, or t
  misc_feature (25)..(26): n is a, c, g, or t
  misc_feature (28)..(29): n is a, c, g, or t
  misc_feature (690)..(690): n is a, c, g, or t
  misc_feature (1789)..(1789): n is a, c, g, or t
  misc_feature (1804)..(1804): n is a, c, g, or t
cttttcagagannnnnagnnagagnnanngagagagagagagagagagatggctatggaggtggtggtgaatcctaatgggtgctgcaaggggggacctgggtacgcaacaccactggaggccatgtctggtcccagggagtctctcatctatgtcacttgcgtctacgccggaacggggaaggagaagcctgactaccttgctacagtggatatagatccaaactctccgacttattcaaaagtcatccacaggctgcctatgccttacgttggtgatgaattacatcattctggatggaacgcatgcagctcttgctatggagatcaatcggcatctcgtcgttaccttgtcttgccctcaataatatctgggagaatatatgcaattgacacccagaaggctccaaaggcccccactttgcacaaagttgttgagccagcagatattttgcataagactggattagcgtatccacacacggcccattgtcttgcttccggtgagataatggtctcatgccttggagataaagatggaaaagctgagggaaatggatttctgcttcttgactcggactttaatgtgaaaggaaggtgggagaaaccagggcatagtccactttttggatacgatttctggtatcaaccccggcacaagaccatgatcagcacatcatggggagccccngcagctttcaccactggtttcaaccttcagcatgtctccgatggcctttacggccgccatttgcatgtttatagctggcctggtggtgaactaaagcagacattggatcttggaaatacaggactccttcccttagagataagattcctgcatgacccatctaaagatacggggtttgtcggctgtgccttgaccagcaacatggtgcgatttttcaaaaccccagatggatcatggagtcacgaggttgtaatctccgtgaaaccgttgaaggtgcaaaattggattcttccggaaatgcctggacttataactgattttcttatgtctctggatgatcgctatctctacttggtaaattggcttcacggagatgtcagacagtacaacatcgaggaccctaagaaccctgtactaactggccaagtatgggttggggggctgattcagaaaggaagctctgtattggtcgaggctgatgatgggacgacgtaccaggtcgacatcccagagatcaagggaaatcggttgagaggaggaccacagatgatccagttgagcttagacgggaagcggctttacattaccaactcactcttcagtacgtgggaccgtcagttttatcctgatctccttgtgaaaggttcacacatgctccagattgatgtcgacactgagaaaggtggtcttgtagtaaaccctaatttctttgtggactttggatccgagcccgatggcccttcccttgcccatgagatgagatatcctggtggtgactgcacctcagacatatggatttgagcagcttgaatgtcaataagggtcacattttagcagatcttgggggaccgacatgggctgttggatcatatccgatcagggaaatcttccgttgtgaaacatttcgtctatcaaaaaacttggaactataaattttactaagacttgatcctctggactgcttggttcggaatttctatcaagtgggaagaacaatttggttagaaattttctttttgaatgtgccatgtaataacgcaaatgggtctggatgataattgcagtcttggatttcttttcgaaccattgaattctcttnattttaatatcttanaatctttgtattaaaaaaaaaaa

SEQ ID NO: 3571 - DNA, 1736 bp, Orobanche aegyptiaca
ttccggcgagggaagctcatatcctgattgttcttggatctggtaactcagacagaagcgaggggagagagagagaaaggaaagctatggcaactgatatgatggtggtgcagcatgcaaatgtggaaaatgattgctgtaagaagggaccaggatacgctactcccatggatgccatgtccggccccagagaaacacttatttatgttacttgtgtttacgcaggaacaggaagggagaagccagattaccttgcaacagtggatgtagatccaagttcaccaacatattctagagtcgtacacagactgcccatgccttatgttggtgatgaactacaccattctggatggaatgcctgtagctcctgccatggaaatgcttcggcttcacgccgatatctcgtcctgccttccttaatatctggtcgcatatatgcaattgatacccaaaaagatccaagggctccaaacttgcataaaattgttgagcccaaagatataatacagaagacgggattggcatacccacacactgctcactgccttgcttctggtgatattatggtgtcatgccttggagacaaagatggaaatgctgaaggaaatggatttcttctgcttgactctgattttaatataaaaggaaggtgggaaaaaccagggcacagcccactttttgggtatgatttctggtaccaacctcggcataagactatgatcagcagctcctggggggccccagctgctttcaccaaaggttttgaccttcagcatgtttcagatggtctttatgggaggcatttgcatatatatagctggcctgagggtgagttgaaacagactttggatcttggcagtagtggtctcttacctttggaggtaagattcttgcatgacccagacaaggatactggatttgtggggtgtgctttaacgagcaacatggttagattcttcaagaagccagatgggtcatggggtcacgaagtatcagcatcagtgaagccagtcaaggtgcagaactggattcttcctgagatgcctggtcttattactgattttttattatctcttgatgatcggttcctatatttgtccaactggcttcatggtgatattagacaatataacattgaagatcctgcaaatcctcggctgacaggccaggtatttgttggaggtttgatttcaaaagggagcaatgtgtttgctgtggctggtgatggtacaacataccaggttgacgtaccacaagttcagggacatcaaatccgagggggacctcagatgatacagctcagcttggatggaaagcgactgtatgtgacaaattctctcttcagtacatgggatcgtcagttttaccctgagcttgtggagaaaggtagccatattttgcagattgatgttgatacgcaaaaaggtggtctagccatcaatccgaatttgttcgtggattttggatccgaaccaaatggtgcctctttggcccatgagatgagatatcctggtggtgactgcacttctgacatctggatttaataaacatctgcatctaataatatctccatgaatgacacggctatgttgttaaacacttcttgtgtccctttagtaaaaatgtaagtcgtaaataaagtaacaaaatgacttggtcaaggggatttgacgataaattgcttgattgagatcgtgttcctcgtgtttgttaaaaaatgcagtttgtgtttgttg

SEQ ID NO: 3572 - DNA, 1865 bp, Citrus sinensis
agatataaaatctcgtacagctcttgcatcagcgtgtgattgcgttcttatcatccattcgcttcctatcttgatctttcttcaaagtctttgtgttgttctgtctgtgttttttttcttgtaagaaatggcaactgatactgtggtggctgaacaccggtcgagcaataatgggcatggttgctgcgcgaaagggcctgggtatgcaactccactcgatgccatgtctggtcctagagagaaacttctctatgtcacttgtctttacactggtactggaagagagaagcctgattacctagcgacagtggatgcggatcctagctcttcttcttattcaaaagttattcatcggctccctgtgccatacattggcgatgaactacatcattcgggatggaattcatgtagctcatgctatggagattcatctgctcaacggcgttttcttgtcttgccttctttggtatctggtcgtatatacgtagttgacacacaaaaaaatccaagggctccctctttgcataaagttgttgagcctgcagatattgtacagaagacaggattatcttatcctcacacggctcattgccttgcttctggtgatatcctggtgtcatgccttggagataaggatggaaatgctgagggaaatggatttcttctccttgactcagaattcaatgtgaaaggaagatgggaaaaaccaggtcacagtcctgctttcggttatgatttctggtaccaacctcgacacaaaacaatgatcagctcatcatggggagcacccctggctttcaccaaaggcttcaaccttcagcatgtctctgatggtctttatgggaggcatctgtttgtgtacagctggccggatggtgaattgaaacagacattagatcttggtaatacaggcctcataccactggagataaggttcttgcatgatccctctaaagatatagggtttgtaggttgtgccttagcaagtaccatggttcggttttccaaaacccaagatggatcatggaatcatgaggttgcaatatcagtgaaatctctgaaggtgcaaaattggatacttcctgagatgccagggcttattactgactttctgatttctcttgatgatcggtttctttacttctccaactggcttcatggagatattcgacagtataacattgaggatcccaaaaatcctgtattgacaggccaagtctgggtcggggggctgtttcagaaaggaagtcctgtagtggctgtaacagatgatggtcagccatatcagtctgatgttccagaggtccaggggcatcgtttgagagggggacctcagatgattcagttaagcttagatgggaagcggctctatgttaccaactcgctctttagtgcatgggattgtcaattttatcctgaactcaaggagaaaggatcccacatgttacagattgatgtcaactccgagaagggtggtatggctatcaatccaaacttttttgtggactttgaagctgaacctgatggtcctgccctagctcatgagatgaggtatcctggtggtgattgcacttcagatatatggatttaaccatcttaatctattctggcaataaacggtgtccatcatgtccagataggataccgctttgattgatggggtgattacgtttgtatgtggaagtcagtgtccgttctggttctggaatagccagtttaagataatggtttgatttatgcagtaaataaactttttactttgtataactgctcctgatgaatgttttactgttaatattgttgattctcaactgtaaaacacttgcttcagaaatgaattacctacaagcaatacgactaatttg

SEQ ID NO: 3573 - DNA, 1876 bp, Citrus clementina
ggaagctgaccacatccaaacgacgttaacaatggaaatgccaactctggacgtaacttcttcactgtccgttaaaaaaaaaaaaaaaaaaaaatcccatgtgtcagttataagatataaaatctcgtgcagctcttgcatcagcgtgtgattgcgttcttatcagccattcgcttcctatcttgatctttcttcaaagtctttgtgttgttctgtctgtgttttttttcttgtaagaaatggcaactgatactgtggtggctgaacaccggtcgagcaataatgggcatggttgctgcgcgaaagggcctgggtatgcaactccactcgatgccatgtctggtcctagagagaaacttctctatgtcacttgtctttacactggtactggaagagagaagcctgattacctagcgacagtggatgcggatcctagctcttcttcttattcaaaagttattcatcggctccctgtgccatacattggtgatgaactacatcattcgggatggaattcatgtagctcatgctatggagattcatctgctcaacggcgttttcttgtcttgccttctttggtatctggtcgtatatacgtagttgacacacaaaaaaatccaagggctccctctttgcataaagttgttgagcctgcagatattgtacagaagacaggattatcttatcctcacacggctcattgccttgcttctggtgatatcctggtgtcatgccttggagataaggatggaaatgctgagggaaatggatttcttctccttgactcagaattcaatgtgaaaggaagatgggaaaaaccaggtcacagtcctgctttcggttatgatttctggtaccaacctcgacacaaaacaatgatcagctcatcatggggagcacccctggctttcaccaaaggcttcaaccttcagcatgtctctgatggtctttatgggaggcatctgtttgtgtacagctggccggatggtgaattgaaacagacattagatcttggtaatacaggcctcataccactggagataaggttcttgcatgatccctctaaagatatagggtttgtaggttgtgccttagcaagtaccatggttcggttttccaaaacccaagatggatcatggaatcatgaggttgcaatatcagtgaaatctctgaaggtgcaaaattggatacttcctgagatgccagggcttattactgactttctgatttctcttgatgatcggtttctttacttctccaactggcttcatggagatattcgacagtataacattgaggatcccaaaaatcctgtattgacaggccaagtctgggtcggggggctgtttcggaaaggaagtcctgtagtggctgtaacagatgatggtcagccatatcagtctgatgttccagaggtccaggggcatcgtttgagagggggacctcagatgattcagttaagcttagatgggaagcggctctatgttaccaactcgctctttagtgcatgggattgtcaattttatcctgaactcaaggagaaaggatcccacatgttacagattgatgtcaactccgagaagggtggtatggctatcaatccaaaattttttgtggactttgaagctgaacctgatggtcctgccctagctcatgagatgaggtatcctggtggtgattgcacttcagatatatggatttaaccatcttaatctattctggcaataaacggtgtccattatgtccagataggataccgctttgattgatggggtgattacgtttgtatgtggaagtcagtgtccgttctggttctggaatagccagtttaagataatggtttgatttatgcagtaaataaactttttaccttgta

SEQ ID NO: 3574 - DNA, 1882 bp, Theobroma cacao
ggtatgtttttgactgtgttcaagtgaatttttcttgcattcactgttagttatcctctacatcttcactgcctgatgcgcatgctcagttccttccttcaatatgatcaagtgctacttgaaaattggtgatatatttttgaaggagatttagtcactgtcggttggactctataaaagagcgtcttttctaataaagttggtctttcaagaaaagaagggagagatagaaaagaaggaagagttttaagacagagggaagatggccggaaacgggacagggtgttgcaagacaggaccgggatatgctactccactggcagccatgtctggtcctagagaggctcttatttatgtcacctgtgtttatactggaactggaagagagaagccagatttcttggctacagttgatgtagatccaaactctcctacttattctaaagttatacacaggctacctgtgccatatttaggtgatgaactacatcactcaggctggaactcatgcagctcttgccatggagatccttcagcagaacggcgttttctgatcctgccttcattggtatctggccatatctacgtgattgacacacagacaaatccaaaggctccctcattgcataaagttgttgatcctgaggatattgttcagaagacaggcctagcatatccacacacatcccactgccttgcctctggtgatataatggtttcatgtcttggagacaaagatggaaatgccaagggaaatggatttcttcttcttgattcagaattcaatgtgaaagggaggtgggagaagccagggcatagtcctttgtttggctatgatttctggtaccaacctcgacataaaacaatgatcagctcatcttggggagctcctgcagctttcacgaaaggtttcaaccttcagcatgtcgcagatggtctatatggaaggcatctgtatgtgtacagctggcctgatggtgaattgaaacaaacattggatcttggtgacagtggactcctacccttggagataaggttcctgcatgatccttctaaagatacaggttttgttgggtgtgccttgacaagtaacatggtgcggttcttcaaaaccaaagatggatcatggagccatgaggtggcaatctccgtgaaaccactgaaggtgcaaaactggattcttcctgaaatgcctgggcttataactgactttctgatctctcttgatgatcgttttctctattttgccaactggcttcatggagatgttcgacaatataatattgaggaccctaaaaatccagtcttggcaggacaagtatgggttggaggactgattcaaaatggaagccctgtagtggctgtgatagaagatggcaaaacgtggcaatgcaatgttcctgagatccaggggcatcgtctgagagggggaccccagatgatccagttgagcttagatgggaagcggctatatgtcaccaactcgctattcagcacatgggatcgccaattctatcctgagctgattgagaagggttcccacatgctacagattgatgttgacactgagaaaggaggtctcaaagtaaacccatacttttttgttgactttggagctgaacctgatggcccttccctggcccacgagatgagatatccaggtggtgactgcacctcagatatttggatttaggcatcctgaaccaatcttgctgtgaagaatcaccctttaccgaagaacgagaaaataataataataataatcaatgcaatctgtagattcctgtgacaacatgatgcatgtaattataaactctacatcagcacgtcaatgtgaaataatatacagctcaaattagtcaataaagagtttgaattgtat

SEQ ID NO: 3575 - DNA, 1699 bp, Solanum phureja
tcacatcttgaaggcttgattatcttactaaattcccaattggggtagttaaaaaaattgaatcttgaaattttttgtattgatttggtgttttttgggtttttcatattatgcccaacagtgtgattcccaattggggtaattaaaaaaattgaatcttgaaatttttttgtattgatttggtgttttttgggttttttcatattatgcccaacaagtgtttgttgtaagttctagctgaagaaatttgtaaaaatggaagaaggtgaaacagggttgttgttgcagagtaacaaagaattgctttcttcaggttattcaatacatgaatattctgaagaaatcaagaagattaaatcagctctgacatgggtttttcttgatcaatcaaatctatggagggctggtctttcttggtcactttttttcattcttacaattggggttccattagtatctcactttatgtttgcttgtttaacctgtgatactatgcatcagaggccttttgatgctcttgttcaagtttctttatcactttttgcaactttatcatttgttagtctttctagctttgctcgaaaatacgggattcggaagtttctgtttcttgataaattgtatgaagatagtgaaaaggttcaacaaggatacactgaacagctacataggtcgatgaagatcctctcatcttttgtcctcccttcttttattgctgagagtatttacaagatatggtggttttcctccgggggaacccaaattccttacctgtataatgctgctttgagcaatatcttcgtatgcatactgttaataagctcctggctctaccggatatcaatttccttccttgtatgtgtcctattccggttaatatgctccctgcagatccttagactggaagagtttgctcaagttttcgagaaacaatctgatgtctcatcgatcatgatagaacatctccgaatcagaagaaatcttcgcgtcattagccataggttcagagttttcattttgtcaactctcatactagttaccataagccagtttcttgccctgcttcttattactgagcctagctccactgtgaacatctttacagcaggtgaacttgcgttgagctcaattactctggtaactggacttttcatgtgcttacgtagtgcagcaaagatcacacacaaagcacaagctgttacatcacttgctgccaaatggcatgcttgtgcaacaatcagcaccttagatgacatgactgaggagactcccatggctcggaccgtgacatctcaggtggtataccctatcaattccagttgggacacagacgaggaaggagatggagacgacgtgttggacaacacaaatatggtaccaattcatgccagtacaatatcctaccaaaagagacaagcactagtgacatacttcgagcacaacaaagctggaatcacagtgtatggtttcatgttagatcggacatggcttcatacaattttcgcgattcaactgtctcttacactctggatactcaataaaactattggtatttcgtaaatcccagtcaacgacaaggtttttactgtgtgtgtgttcgtaaatatacaaaaatctgtgcgatcgatacgtagagaaactagtatatatatatagtatatatctatttccttgatgtcaaaatttttgctgatcttct

SEQ ID NO: 3576 - DNA, 2271 bp, Solanum phureja
taactaccacatgctttgaaaaagttccatttatctacccacaaagtttaatgattagtgattttgacacagcaccaatatcttcttcatcatacaaaagaacaaaaaaaaaatcatagtgtactatgaacattcactatattttccttaaaaattcagtacctttctgcaattctcagaggactaaaatccattactcttacacttttgagacccctttaagtacaaatggatgtagtaacttttggcataataataggaataataatactattcttctgtgctgtttgtgtaatcaccatagaaggcacttgcaagaaccgctcttcttgatttctaataccctttatccaaacacgcccttatcatcttacccttccataaatttagggtttttccctgattttgttcttgcccaaattgacaaaatgtcgaaaattgatgctttggtgaaacagatctgcttcttcttgattgtttctacttctttatgggtagtggtttttgggtcttctgtagaagcgaaggttctagaaaattccaagcaggaatttcatcagtgtaatcatggtcatggtcatcatggccatgaggggcatcatccatgatcatgatcatgggtcgagtggagttgaccagaggaagcttttagaggaattggctgaagaggaggatctgaaactgtatggatttgggtctcatggtaatatggatgaacatcatcatcatcatgatggacgtggagtcaaggatcttactggtcttggtctatgggtcaatgcaatgggttgctcactattggtgagcttggcttcccttatctgcctgattcttttgcctttaatatttatacacgggaagccgtcaaaagcagttgtagattctttagcgttatttggggcaggagccatgctgggggatgctttccttcaccaattgccacatgcttttggtggtggacactcccactcgcatgatgaccatcttcatgatcactctggtcattcacatgcccattcattggaggatctttctgttggattgtccattttggctggaatagtgctctttcttattgttgagaagcttgtgaggtatgttgaagatttttctggaggagtcaatgaacggagtcatggtcaccaccatcatcatcatatgcactacacaaaattgaaggatgataatgatgctgatgagaatctccaggaactgtctcaggagaaggatggaattttatcagaaaaggcagctggagggagtggagtggatggagtgtctgctgactctcccaatggggataaaccaaatggaggagctattctacggaagaggaatactggctccagtgctgctgaagacaatactgctttagatgctgcaaatttctctaccaattctacatcaactggagaggaacaggctaaaccacgttcaagccttgtctttggttatctcaacctcttctccgatggtgttcacaattttactgatgggatggctttgggaagtgcattcctccttcatggatcagttggtgggtggtcaagaactttgtttcttctcgcacatgagctccctcaagagataggtgattttggaatcttggtaaggtctgggttcagcgtctccaaagctctcttctttaacttcttatctgcactagtggcactagccggaactgcactggcattgacattgggacaagattctggtcattcatcattgattgagggattcactgctggaggcttcatctacatttcggttgctggagtgttggctgaaatgaataatagtggcaggacgacgttagtgaatacagtaatccaactcatctcgctggtatcagggatggctgttgctctttgcatctctcttattgaatgacggtatacgctacttcttgtgttcgtagagaggatagacggttgccatctcccccggcagggatgagaacagccttcgggtgtttaccatttacgacacatccagccagacaaaacacatgtatcaagactagtgttagacatcttgaatatttatataaatctacaggcaggggaaaaaaaattactccttccgtttcaatttatgtgacatgttttctttttggtccatctaatatgaggggaatttcataaatatgagtgaaagcataaaatattttataatctacaatataaacaaggcaaatgagtaaatgagaattcctttggtggcagttctcctgtagtgaggaaactatgaaataatgaagcacactataat

SEQ ID NO: 3577 - DNA, 3301 bp, Solanum phureja
accgacttgcctgatccaaaaaaaaaggtgaaattgttctgttttttcagctgtcaacgattttgctcaacaacgaacagtcatggtgttcatcaatcttccgaatcacaaaaccctaaccctagaaattaacccttttgtaacttctcttcaaaccctaaccctagaaatccatctaaagttccatatcccaatcactcaacaacgactttattcatcctgccggcgtctcctcgatgcggaagcactgttatccgatctagggatttcccctaattccactctaaccctgcatgttcctcttctcggaggtatgcaagctcccgtggcaccgaaagcccggcttgaatttcttaacacgagacctcctccgaattatgttgctgggttgggtcgtggtgctacgggtttcacgacccgttctgatattggtccggctcgtgctgctcctgacctccctgatcgttcagctgttggtggtgcaccggcaactggagttggacgtggacgtggcaagggtgctggtgaggaagatgaagaggatgatgcggaggaaaaggggtatgatgagaatcagaaatttgatgaatttgaaggtaatgatgtggggttgtttgcgtctgctgagtatgatgaagatgataaagaagctgatgcgatttgggaatctattgatcagaggatggattctaggaggaaagataggagagaagctaggttaaagcaagaaattgagaagtatcgagcttcgaatccgaaaattactgaacagtttgctgatttgaagaggaaattgtatacattgtcaagtgatgagtgggacagtatacctgaaataggggattattcgttacgaaacaagaagaagaggtttgagagttttgtgcctgtacctgatactcttttggagagggctaggcaggaaaaagagcatgtatctgcattggatccgaggagcaggatggttggtggcatggagacgccctcttcacagacgccagttgcagatttgactgcggtgggtgaagggagaggaactgtgttgtcagtgaggttggataggattttggattctgttactgggcaaaccgttgtggatcctaagggatacttgactgatttgaagagtatgaagattactagtgatgctgagatttccgatataaagaaggctagattgttgcttaagtcggttactcagacgaatccaaagcatcctcctggttggatagcagctgctagactggaggaggttgcagggaagatgcaggtagcaagacagttgataaagaaagggtgtgaagagtgtcctaagaatgaggatgtttggttggaggcgtgccgtttggcgagcccccttgaggctaaggcagtgattgctcaaggtgttaaggcaaatcctaattcagtcaagctgtggatgcaggcttcaaagttggaggatgatacagcaaacaagagccgtgtgttgaggaaaggtctagagcatatccctgattcagtgaggttgtggaaagctgttgtggagttggccaatgaagaagatgctagacttttgcttcagagggctgtggaatgctgtccattgcatgtggagctgtggcttgctcttgctaagttggaaacttatgataatgctaagaaggtacttaacaaggctagagaaaagctgcctaaagagcctgccatctggatcactgcagctaggcttgaagaagctgatgggaatactgcttcagttgggaaaattattgaaagggcaataagggctttgcagagagaaggtttggagattgacagggaggcttggatgaaggaggctgaaggatgtgaaagagccggttctcttgggacttgccaagctataataaacaacactgttggggttggtgttgaggaagaagataggaagaggacctgggttgctgatgctgaggagtgcaagagaaggggttctattgaaacagcgaaatacatttatgcacatgctcttactgtatttagaactaagaaaagtatctggcttaaagctgcacagctcgagaaaagtcatggtaccagggaatcgcttgatgcactgcttcgaaaagcagttacctacattccaaaggctgaggttttatggttgatgggtgccaaagagaagtggcttgctggtgatgttcctgctgctcgagcaattctggaggaagcatttgctgcaattcctgattctgaggagatatggcttgctgctttcaagcttgagtttgagaactgtgagacagagagggcaaggaagcttcttgctaaggcacgtgaaaggggaggcttggaacgggtttggatgaagtcggtcattgtggagagagaacttggaaatgtggatgaggagaggagattactggatgaagcattgaggcgcttcccctcatttttcaaactttggttgatgctgggacagttggaagaaagacttggtaattctaacaaggcgaaggatgcatttgaatctggcattaagaattgccccaattgtatacccctttggctatcccttgcgtctctagaggagaaaatgaatgggctaagcaaagctcgagcagttcttactatggccaggaagaggaatcctcaaaaccctgagctatggcttgcagctgtgcgggctgaagctaggcatggctacaaaagggaagctgatgttctgatggctaaagcattgcaggagtgccccaacagtggcattctatgggctgcttcaattgagatggcgcctcggcctcaaagaaaaaccaagagctctgacgctttaaagaagtgtgatcatgatcctcatgttattgctgctgtggctaagctgttttggcaggagaggaaagtagacaaagcaagaaattggttcaacagggcagtgacgcttgcaccagatattggtgatttctgggcattgtatttcaaatttgaacagcagcatggagcagaagagcagaggagcgatgtgctgaagagatgtgttgctgcagagccaaagcatggtgaaaaatggcaagctacatcaaaggccgtagagaactctcatgaaccaactgaaagcatattgaagaaggtggtagccacactaaagaaggaggaaaatttggctgaaaataaccacaactaatctgctgtagtgtatgagtctatgtacttgataatctagagagatttttaggttaggagagtagttaaaacatccttgtttgaattttacctcaaatggttggatcgtggttgtatttgtcaccttatgtgagcttataatattgcaattttccagttc

SEQ ID NO: 3578 - DNA, 3096 bp, Cucumis sativus
cttaatctctccgatcactcatggtgttcctttcgatcccaaaccagaaaaccctatttctcaatctaaacccttccacaacttccatcctcaacctaaagcgagccatcgaagatgtttcccacatacccatctcgtttcagcgtttgttcttatcccaaagctttcaattatcccatttcaatgattccacacttctttcccatctccgaatcctacccaattcaaccctaacccttcacgttcccttatttggaggtatgcaagctccgactatccccaaacccagattggatttcttgaactctaagccacctcccaattatgttgctgggttgggacgtggtgccactgggttcactactcgttctgatattggtcctgctcgggctgctccagaccttcctgataggtcggccacgactattggcggtgctgccgccgctccacctggtagaggccgtgggaaaggtggggaggaagaggaagaagatgaaggtgaggacaaaggatatgatgagaatcagaagtttgatgaatttgaaggcaacgatgttgggttgttcgcatcggctgaatacgacgaggacgataaggaggctgatgctgtatgggaggcgattgataagcggatggattcgagaagaaaggataggagggaggctagattgaaggaggagatcgagaagtacagagcctcgaatccgaaaatcaccgagcaatttgcagacctaaagcgtaaattgtatactctgtcggcgcaagagtgggaaagcattccggaaattggggattattcattgaggaataagaagaagaggtttgaaagctttgtacctgttcctgataccttacttgagaaggccaggcaagaacaagaacatgtgacagcgttggatccaaagagtagagcagctggcgggacggagacgccatgggcacaaacaccagttacagatttgactgccgtcggtgaaggtagaggtacagttttgtcgttgaagttggataggttatctgattctgtatcaggattaactgttgtagacccaaaaggttatctcactgatttgaagagtatgaagataaccagtgatgcagagatttctgatatcaaaaaggccagattattgctaaagagtgttactcaaacaaatccaaagcatccccctggttggattgcagctgctaggttagaggaagtggcagggaagattcaagcagcgaggcaattgattcaaaaaggatgtgaagagtgtcccaagaatgaagatgtgtggttggaagcttgtaggctggctagcccagatgaggcaaaggcagtgatcgccaagggagcaaagtcaataccaaattcagtgaaattatggttgcaggctgcaaaactggagcatgatactgcaaacaagagtcgggttcttaggaaaggtctggaacatattccagattctgttaggttgtggaaggcagttgtggagttggcaaatgaagaggatgccagacttttgcttcatagggctgttgaatgttgtcctttacatgttgaattgtggcttgcattggcaagactggaaacttatgatcgtgcaaagaaggttcttaatagcgcaagggagaagctgccgaaggagccggctatatggataacagccgccaagttggaagaagccaatgggaatactgccatggtaggaaaaattatagagaagggtataagagctttacagagagtgggtgtggtgattgatagggaagcttggatgaaggaggctgaggctgcagaacgtgcagggtctgttgctacttgccaagccatcattcataatactataggggttggggttgaggaagaagataggaagagaacctgggttgctgatgctgaagagtgtaagaagaggggctcgattgaaacagcaagagcaatttatgcacatgctcttactgtcttcttgactaagaaaagtatatggcttaaagcagcacagcttgaaaagagccatggttccagggaatctctcgatgcattacttcgtaaggctgtcacttatcggccacaggctgaggtgttgtggcttatgggtgccaaagagaagtggcttgctggggatgtcccagctgctaggtcaattcttcaagaagcctatgcagccatacccaattctgaggagatttggcttgcagcattcaagcttgaatttgagaatcatgaacctgaaagagctagaatgcttctagctaaagctcgggaaagaggaggtacagaacgagtttggatgaaatctgctattgttgagagagaactaggcaacgctgaggaagagagcaagttactgattgaagggcttaaacgttttccatctttctttaaactatggttaatgcttgggcagttagaggaacgtcttaagcacttggagaaggctaaggaagcttatgagtctggtttgaagcactgtcccagctgcatacccctatggctttctcttgctcacctagaagagaaaatgaatgggttgagcaaggctcgagcagttttgaccatggccagaaagaagaatcctcaaaaccccgaactttggctttctgcagtgcgagctgaattgaggcatggccataagaaggaagctgatattttgatggccaaggcactgcaagagtgtccaaatagtggcattttgtgggcagcttcaatagagatggtaccacgtccacaacgtaaaaccaagagcatggatgcaataaaaaaatgtgatcatgatcctcatgttattgctgctgtggcaaagttgttttggtacgacaggaaggttgacaaagctagaaattggctgaacagggcagtaactcttgctccagatgttggtgatttttgggctttatattacaaattcgaacttcagcatggtggtgatgagaatcagaaggacgtactgaagagatgtattgctgctgaacccaaacatggtgagaaatggcaaacaatttcaaaggctgtggagaactcccatcagccaactgagtcaatcttgaaaaaagtagttgttgcattaggcaaggaggagggcgctgttgagagtagcaaaaattagtttc

SEQ ID NO: 3579 - DNA, 3208 bp, Vitis vinifera
atggttttcgtcaaatcatttgacaacaaaaccctaatcctcaatctaaaccccaaggccaccacttttgaaaccctaaaacaccaaatcgagcgcgagttggggatacctctatcactacaacggatattcctaaacccccgtcgattgatcggagatgagtcggcgttgatcgccgagcttggtgtccgatctgactcggccctaaccctacacttgcctctcttcggaggcatgcaagccccggttgtcccgaagcctaggctcgaattcttgaacaccaaaccgccgccgaattatgttgccggtctcggtcgtggtgccacagggttcaccactcggtccgatattggaccggctcgagcggccccagaccttccggaccgatctgccacaacaattggtggggccgctgcgcctggaggtatcggccgcggcaggggaaagggaggtgccgaggaggaggaggaagatgaaggggatgaaaaggggtatgatgaaaatcagaagtttgatgaatttgaagggaatgatgtcgggttgtttgcatcggctgaatatgatgaggatgataaggaggctgatgctgtttgggaggccatcgataagaggatggattcgaggaggaaggataggagggaggcaaggttgaaacaggagattgagaagtatagagcatctaacccgaaaattactgagcagtttgcggatttgaagaggaagttgtgtacactatctgcacaagaatgggatagtattccagaaattggggattattccctgaggaataagaagaggaggtttgaaagttttgtgcctgtgcctgatacgcttcttgagaaggcccggcaagagcaggagcatgttacagcattggatcctaggagtagggcagcaggtgggactgaaacaccatgggcacaaaccccagtaacagatttgacagcagtgggagaggggagaggaacagttttgtcactgaagttggataggctttcagattccgtgtcagggttgacggttgtggacccaaaaggatatttgactgatcttaagagtatgaagattacaagtgatgcagagatttcagatattaagaaggctagattattgcttaagtcagtcacacagacaaatccaaaacacccacctgggtggattgctgcagcaagactggaagaggttgctggtaagatacaggctgcgagacagttaatacacaaaggatgtgaggagtgtcccaagaatgaggatgtgtggttggaggcatgtaggcttgcaagtcctgatgaagccaaggctgttatagctaagggagtgaaggctatatccaattcggtcaagttgtggatgcaagctgcaaagcttgagcacgatgatgtgaataaaagcagggtcttgaggaaagggcttgaacatatacccgactctgtgaggctgtggaaagcagttgtggagcttgctaatgaggaggatgcaaggcttttgcttcagagggctgtggaatgttgtcctttgcatgtagaattgtggcttgctcttgcaaggctggaaacttatgataatgcaaagaaggttcttaataaggcaagggagaagctctcgaaggagccagctatttggataacagctgcaaagttggaagaagccaatggaaatactgctatggttgggaagataatcgaaaggggtattagggctttgcaaagagaagggttggcaattgatagagaggcttggatgaaagaggctgaggctgctgaacgggcagggtctgttgcaagttgccaggctatagtccataacacaattggcattggggtggaagaagaggatcggaagagaacctgggttgctgatgcggaggagtgcaagaaaaggggctccattgagacagcaagagctatttatgctcatgctcttaccgtgtttttaacaaagaagagcatatggctaaaagctgcacagcttgaaaagagccacggcactcgtgagtctcttgatgcccttcttcgtaaagcagtaacttacagaccacaggctgaagttctgtggctgatgggtgccaaggagaagtggcttgctggtgatgtgcctgctgctcgagcaattcttcaagaagcttatgctgctattcccaactctgaagaaatttggcttgcagcattcaagcttgaatttgagaatcatgagcccgagagggcgagaatgcttcttgctaaagcccgtgaaagaggaggcactgaaagagtgtggatgaaatcagctattgttgagagagaactagggaacactggggaagagaggaggttgcttggcgaggggctgaaactcttcccttcattcttcaaattgtggctgatgcttggacagctagaggagcggtttggtaactttgagaaggccaaggaagcctatgattcaggtctaaagcactgccccagttgtattcctctttggctttcactgtctcaccttgaagagaagatgaatggcctgagtaaggctcgagcagttcttaccatggctagaaaaaagaatcctcagaaccctgaactctggcttgctgcagtgcgagctgaatcacgacatggcaacaagaaggaagcggacattttgatggccaaagcactgcaggagtgccccactagtggtattctgtgggcagcatcaattgagatggttcctcgtccccagcggaaaactaagagtctggatgcactcaagaaatgtgatcatgatccccatgtcattgctgctgtggccaagttattctggcatgacaggaaggtggacaaagctaggacctggctgaacagggctgtaactcttgccccagatattggggacttctgggcattatactataaatttgaagttcagcatggaagtgaggaaaatcagaaggatgtactgaggagatgtgtagctgcagaacctaagcatggtgagaaatggcaagtcatttcaaaggctgtggagaactcccacctcccaactgaagccatcttgaagaaagcagtggttgcacttggcaaggaagagagtgttgctgagagcagtaaagactaattagttcaggaaacttttgtcactttgatttagtagtcaagatttgtattggaacatagaaagatctgtactcttgcaagtcttcttcactggcctattttatcttcctcatatcttccatttctaacataaacaa

SEQ ID NO: 3580 - DNA, 3651 bp, Vitis vinifera
gttttatcttccaaacactctccctgcttctcgaactactggctttggaggtgagccgacggtctcagctcttccgttcaggtacgttgaaaccctaattttaatatctgtatcttttgctctgtcttctcataaaccctaatcaatggttttcgtcaaatcatttgacaacaaaaccctaatcctcaatctaaaccccaaggccaccacttttgaaaccctaaaacaccaaatcgagcgcgagttggggatacctctatcactacaacggatattcctaaacccccgtcgattgatcggagatgagtcggcgttgatcgccgagcttggtgtccgatctgactcggccctaaccctacacttgcctctcttcggaggcatgcaagccccggttgtcccgaagcctaggctcgaattcttgaacaccaaaccgccgccgaattatgttgccggtctcggtcgtggtgccacagggttcaccactcggtccgatattggaccggctcgagcggccccagaccttccggaccgatctgccacaacaattggtggggccgctgcgcctggaggtatcggccgcggcaggggaaagggaggtgccgaggaggaggaggaagatgaaggggatgaaaaggggtatgatgaaaatcagaagtttgatgaatttgaagggaatgatgtcgggttgtttgcatcggctgaatatgatgaggatgataaggaggctgatgctgtttgggaggccatcgataagaggatggattcgaggaggaaggataggagggaggcaaggttgaaacaggagattgagaagtatagagcatctaacccgaaaattactgagcagtttgcggatttgaagaggaagttgtgtacactatctgcacaagaatgggatagtattccagaaattggggattattccctgaggaataagaagaggaggtttgaaagttttgtgcctgtgcctgatacgcttcttgagaaggcccggcaagagcaggagcatgttacagcattggatcctaggagtagggcagcaggtgggactgaaacaccatgggcacaaaccccagtaacagatttgacagcagtgggagaggggagaggaacagttttgtcactgaagttggataggctttcagattccgtgtcagggttgacggttgtggacccaaaaggatatttgactgatcttaagagtatgaagattacaagtgatgcagagatttcagatattaagaaggctagattattgcttaagtcagtcacacagacaaatccaaaacacccacctgggtggattgctgcagcaagactggaagaggttgctggtaagatacaggctgcgagacagttaatacacaaaggatgtgaggagtgtcccaagaatgaggatgtgtggttggaggcatgtaggcttgcaagtcctgatgaagccaaggctgttatagctaagggagtgaaggctatatccaattcggtcaagttgtggatgcaagctgcaaagcttgagcacgatgatgtgaataaaagcagggtcttgaggaaagggcttgaacatatacccgactctgtgaggctgtggaaagcagttgtggagcttgctaatgaggaggatgcaaggcttttgcttcagagggctgtggaatgttgtcctttgcatgtagaattgtggcttgctcttgcaaggctggaaacttatgataatgcaaagaaggttcttaataaggcaagggagaagctctcgaaggagccagctatttggataacagctgcaaagttggaagaagccaatggaaatactgctatggttgggaagataatcgaaaggggtattagggctttgcaaagagaagggttggcaattgatagagaggcttggatgaaagaggctgaggctgctgaacgggcagggtctgttgcaagttgccaggctatagtccataacacaattggcattggggtggaagaagaggatcggaagagaacctgggttgctgatgcggaggagtgcaagaaaaggggctccattgagacagcaagagctatttatgctcatgctcttaccgtgtttttaacaaagaagagcatatggctaaaagctgcacagcttgaaaagagccacggcactcgtgagtctcttgatgcccttcttcgtaaagcagtaacttacagaccacaggctgaagttctgtggctgatgggtgccaaggagaagtggcttgctggtgatgtgcctgctgctcgagcaattcttcaagaagcttatgctgctattcccaactctgaagaaatttggcttgcagcattcaagcttgaatttgagaatcatgagcccgagagggcgagaatgcttcttgctaaagcccgtgaaagaggaggcactgaaagagtgtggatgaaatcagctattgttgagagagaactagggaacactggggaagagaggaggttgcttggcgaggggctgaaactcttcccttcattcttcaaattgtggctgatgcttggacagctagaggagcggtttggtaactttgagaaggccaaggaagcctatgattcaggtctaaagcactgccccagttgtattcctctttggctttcactgtctcaccttgaagagaagatgaatggcctgagtaaggctcgagcagttcttaccatggctagaaaaaagaatcctcagaaccctgaactctggcttgctgcagtgcgagctgaatcacgacatggcaacaagaaggaagcggacattttgatggccaaagcactgcaggagtgccccactagtggtattctgtgggcagcatcaattgagatggttcctcgtccccagcggaaaactaagagtctggatgcactcaagaaatgtgatcatgatccccatgtcattgctgctgtggccaagttattctggcatgacaggaaggtggacaaagctaggacctggctgaacagggctgtaactcttgccccagatattggggacttctgggcattatactataaatttgaagttcagcatggaagtgaggaaaatcagaaggatgtactgaggagatgtgtagctgcagaacctaagcatggtgagaaatggcaagtcatttcaaaggctgtggagaactcccacctcccaactgaagccatcttgaagaaagcagtggttgcacttggcaaggaagagagtgttgctgagagcagtaaagactaattagttcaggaaacttttgtcactttgatttagtagtcaagatttgtattggaacatagaaagatctgtactcttgcaagtcttcttcactggcctattttatcttcctcatatcttccatttctaacataaacaatgcgggagaagtatttttatgttgatttttagaattccatgttggaactcctcttgttatccctctgttttttctcagggagatcactcaccctacatgcttatgcatgtttgtttgccgttgtaaccttgttttcatgcttcattttttttttttaccttacatctcaaccactgtcatattcttcctacttcatactacacgtttgcatgggaatattgtctataaatctttttgctccaattagtttgggttttaagttttaaatggtaaagatgtgcatagcaaggttgcaaga

SEQ ID NO: 3581 - DNA, 3325 bp, Citrullus lanatus
ctcaatctctctgatcactcatggtattcctttcgatccctaaccagaaaaccctattccttaacctaaaccctgccactacttccatctttaacctgaagcgcgcaatcgaagaggtttcccacatacccgtctcgcttcagcgtttgttcttatcccaaagctttcaattatcccatttaaatgattctacgctgctttcccatgcccgagtcctacccaattcaaccctgacccttcacgttcccttatacggaggtatgcaagctccgactatccccaaacccagattggatttcttgaactctaagcctcctcccaattacgttgctgggttgggacgtggtgcgactggattcactactcggtctgatatcggtcctgctcgggctgctccggacctccctgataggtcggcgacgactattggcggtgccgccgcggctccacctggcagagggcgtggaaaaggtggggaggaagaggaagaagatgaaggcgaggacaaaggatatgatgagaatcagaagtttgatgaatttgaaggcaacgatgtggggttgttcgcatcggctgaatatgatgaggacgataaggaggctgatgccgtatgggaggcaatcgataagcggatggattcgagaagaaaggataggagggaggctagattgaaggaagagatcgagaagtaccgagcttcaaacccgaaaatcacagagcaatttgcagacctaaagcgtaaattgtatactctgtcggcgcaagagtgggaaagcattccggaaattggggattattcattgaggaacaagaagaagagatttgagagctttgtacctgttccagatactttacttgagaaggccaggcaagagcaagaacatgtgacagcgttggatccaaagagtagagcagccggcgggacggagacgccatgggcacaaaccccagttacagacttgactgctgtcggggagggtagaggtacagtgttgtcattgaagttggataggttatccgattccgtttcaggattgactgttgtagacccaaaagggtatctcactgatttgaagagtatgaagataaccagtgatgcagagatttctgatatcaaaaaggcaagattgttactgaagagtgttactcaaacaaatccaaagcatccccctggttggattgcagctgctaggttagaggaggtggcagggaagattcaggctgcgaggcaattgattcagaaaggatgtgaagagtgtcccaaaaatgaagatgtgtggttggaggcttgtagactggctagcccagatgaggcaaaggcagtgatcgccagaggggcaaagtcaataccaaattcagtgaagttatggttgcaggctgcaaaactggagcatgatactgcaaataagagtagggttttgaggaaaggcttggaacatattccagattctgttaggttgtggaaggcagttgtggagttggcaaatgaagaggatgccagacttttgcttcatagggctgttgaatgttgtcctttacacgtagaattgtggcttgcattggcaagactggaaacttatgatcgtgcaaaaaaggttcttaatagtgcaagggagaagctgccgaaggagccggctatatggataacagctgccaagttagaagaagccaatgggaatactgccatggtaggaaaaatcatagagaagggtataagagctttacagagagtaggcgtggtaattgatagagaagcttggatgaaggaggctgaggctgcagaacgtgcaggatctgttgctacttgccaagccatcactcataatactataggggttggtgttgaagaagaagataggaagagaacctgggttgccgatgctgaagagtgtaagaagaggggttcgattgaaacagcaagagcaatttatgcacatgcacttactgtcttcttgactaagaagagtatatggcttaaagcagcacaacttgaaaagagccatggtactagggaatctcttgatgctttacttcgtaaggctgtcacttaccgtccgcaggctgaagtgttgtggcttatgggtgccaaagagaagtggcttgctggggatgtcccagctgctagatcaattcttcaagaagcatatgcagccattcccaattctgaggagatttggcttgcagcattcaagcttgaatttgagaatcatgaacctgaaagagctagaatgcttctggctaaagctcgggaaagaggaggtacagaacgagtgtggatgaaatccgctattgtcgagagagaactaggcaactcagaggaagagagcaagttactgatagaagggcttaaacgttttccgtctttctttaaactatggttaatgcttgggcagctagaggaacgtcttaggcatatggagaaggccaaggaagcttatgaatctggtttgaagcactgtcctagctgcataccgctatggctttctcttgctcacctagaagaaaaaatgaatggattgagcaaggctcgagcagttttgaccatggccagaaagaagaatcctcaaaaccctgaactttggctttctgcagtgcgagctgaattgaggcatggcaataagaaagaagctgatattttgatggccaaggcactgcaagaatgtccaaatagtggcatattgtgggcagcctcaatcgagatggtacctcgtccacaacgtaaaaccaagagcatggatgcacttaaaaaatgtgatcatgatcctcacgttattgctgctgtggccaaattgttttggcatgaccggaaggttgacaaagctagaacttggctgaacagggcagtaactcttgctccagatgttggtgatttttgggctttatactacaaattcgaacttcagcatggtgttgatgagaatcagaaggacgtactgaagagatgtattgctgcagaacccaaacatggtgagaaatggcaaacaatttcaaaggctgtggagaactctcatcagccaactgaagcaatcttgaaaaaagtggtagttgcactaggtaaggaggagggcgttgttgaaaatagcaaaaattagtttctacatagttcagatttttgagcctcttgccgctgaaggtatgtatgatttgtaagaagaagctgagttcagttgtcaaactatatgattaatgactgaaatttctggcttatggaagattgttatttggttatctgattccttatacatgtggttaacccttcacagtgatctgttgtcagaacttcttttaattatttcactaatcaatttccacaattcttctgcaa

SEQ ID NO: 3582 - DNA, 3169 bp, Prunus persica
acgccatggtgttcatcacatcccccaaccacaaaaccctaaccctaaatctaaacccgaagaccaccaccctccaaaccctaaagctccaaatcgaacaaaaatcccaaatacccatctcagagcagcgcctattcatctcccaaagcctccaattactgacccaaaccggctccaccctcctttccgacctcggcatcagacccctctcaaccctaaccctccacatccccttgttcggcggcacccaaccgcccaacgtccccaagccccgcctcgagttcctcaactccaagcctcccccaaattatgtcgctgggctcggccgtggtgccactgggttcaccacacgatccgatatcgggcccgcccgggccgcccccgacctgcccgataggtcggccacgacaatcggtggcgctgcttctgctgctgccccgcctggggttggccgcggtcgtgggaagcctgaggaagaggaagaagatgaaggagaggataaagggtatgatgagaatcagaagtttgatgaattcgaagggaatgatgttgggttgtttgcatcggctgagtacgatgatgaggataaggaggctgatgcggtttgggaagctattgatacgagaatggactcgaggagaaaagaccggagagaagctcggttgaaagaagagattgagaaatacagagcttcgaacccaaagatcacggagcagtttgcaaatttgaagagaaagttgtacaccgtgtctgctcaggaatgggagagcatacccgaaattggagactattcattgaggaacaagaagaagaggttcgagagctttgtgccggtgcccgatacgcttttagagaaggcgagacaggagaaggagcatgttacggctttggaccccaagagtagggcagctagtggtacggaaacgccatggtctcaaactccggttacagatttgaccgctgtaggtgagggtagaggtactgtgttgtcattgaaattagataggctttctgattctgtttctgggctgacggttgtggacccaaaagggtaccttactgatcttaagagtatgaagattactagtgatgctgagatttctgatattaaaaaggccagattgttgctcaagagtgtaacacagacgaatccgaagcacccacctggttggattgcggctgcaaggctagaggaggtggctgggaagattcaagcagccaggcagttgattcagaaagggtgtgaggagtgtcccaagagtgaggatgtgtggttagaggcgtgtaggcttgctaacccggatgaagctaaggctgtgattgccaagggagtcaagacgatacccaattcggtgaagttgtggatgcaggctgcaaaactagagcatgacgatttgaataggagcagagtgttgaggaaagggttggaacacattcctgattctgttaggctgtggaaggcggttgtggagctggcaaatgaggaagatgcaagacttctgcttcacagggccgtggagtgttgtcccttgcacattgaattgtggcttgcacttgcaagattggaaacttatgataatgctaagaaggtcctcaataaggcaagagaaaagctatcaaaggagccagccatttggatcactgcggccaagttagaagaagctaacgggaatacgtccatggttgggaagattattgaaagaggtataagggccttgcaaagggaaggattagcaattgatagagaagcgtggatgagggaggctgaagctgctgagcgtgcagggtctgttgcaacttgccaagcaatcattcggaacacaattgggattggtgtggaggaggaggatagaaagcgcacatgggttgctgatgcagaggaatgcaagaaaaggggttcgattgagacagccagagctatttatgctcacgcacttactgtgttcttaaccaagaagagcatatggctcaaagcagcacaacttgaaaagagccatgggactcgggaatctcttgatgctttgcttcgtaaagcagtgacatatcgaccacaagctgaagtcttgtggcttatgggagctaaggagaagtggcttgctggggatgtgcctgctgcccgtgccatcctccaagaagcttatgctgctatacccaattctgaagaaatttggcttgctgcatttaaacttgaatttgagaaccatgaacctgagagagctagaatgcttcttgccaaagcccgagaaaggggaggcacagaaaaagtttggatgaaatcagcaattgttgagagagagttagggaaccttgatgaggagaggaagttacttgacgagggattgaagcggtatgctagcttctttaaattgtggttgatgcttggacaactagaggaacggcttggtcatttggaaaaagccaaggaggcttatgactcaggtctgaagcactgctccaattctattccactctggctttctcgtgctaatctggaagagaagatggttgggctgagtaaagctcgtgcagttctcacgatgggcaggaagaagaatcctcagaatcctgaattgtggcttgctgctgttcgagctgaattgaggcatggcaataagaaggaagctgatatcttgatggcaaaggctttgcaggagtgtcccaatagtggtatcttgtgggctgcatctattgagatggtaccccgtccccaacggaagaccaagagtatggatgccctcaagaaatgtgatcatgatccccatgtcattgctgctgtggcaaagttattttggcatgataggaaggttgacaaagctaggaattggctaaacagggcagtgacacttgctccagatattggggatttctgggctttatactacaaatttgaacttcaacatgggactgaggagaaccaaaaggatgtactgaaaaggtgcgaagctgcagaaccaaagcatggtgaaaaatggcaacctatttcaaaggctgtggagaactctcaccaatcgtttgaagctatcttgaagaaagtggtggttgctcttgggaaggaagagagtgcagccgaaaataataaacactagttctggcttgttttttccaggttatgttggaaaacgttgtagtacagaaagaaaatcgatgtctagtgtcacttgtcatccgg

SEQ ID NO: 3583 - DNA, 3158 bp, Malus domestica
cacatcgatctcgccatggtgttcatcacatccccaaatcacaaaaccctaaccctaaatctaaaccctaagaccaccaccctcaaaaccttaaagctccaaatcgagcaaaattctcacatacccatttctcagcagcgcctattcatctcccaaagcctccagttactcacccaatccgactcctccctcctctccgacctcggaatccgacccctgtcaaccctaactcttcacattcccttattcggcggcacccaacctcccgccgtccctaaaccccgcctcgagttcctcaattccaagcctcccccgaattatgtcgctgggctcggccgtggtgccactggcttcaccaccaggtccgatatcgggcccgcacgtgctgcgccagacctgccggataggtcggccaccacaatcggcggcgctgctgctcctgctgccccgcctggggttggccgcggacgcgggaagcccgaggaagaggaggaggacgaaggggaggataaggggtacgatgagaatcagaagtttgatgaattcgaaggaaatgatgtcgggttgtttgcatcggcggaatacgatgatgaggacaaggaggctgatgcggtgtgggaagccattgagcaaagaatggactcgaggaggaaggacaggagagaagctcggttgaaagaagagattgaaaagtacagagcttcgaacccgaagatcacggagcaattcgcgactctgaagaggaagttgtacaccgtgtctgctcaggaatgggagagcatacctgaaatcggagactattcgtcgaggaacaagaagaagagattcgagagctttgtgccggtgcccgatacacttttagagaaggcaagacaggaaaaggagcatgttacggcattggaccccaagagtaggggagctggtggtatggagactccatggtctcaaactccggttacggatttgactgctgtaggtgagggtagaggtactgttttgtcattaaaattagataggctttctgattctgtttctggattgacggttgtcgacccgaaagggtaccttactgatcttaagagtatgaagattactagtgatgctgagatttcggatattaaaaaggctaggttgttgcttaagagtgttacacagacgaatccaaagcacccacctggatggattgcggctgccaggctggaggaggtggctgggaagattcaggcagctagacaattgattcagaaagggtgtgaggaatgtcctaagagtgaggatgtgtggttagaggcatgtaggctttcaagccctgatgaagctaaggccgtgatttctaagggagtgaagtcgattcccaattcggtgaagttgtggatgcaggctgcgaaattggagcgtgacgatttgaataggagcagggtattgaggaaaggtttggaacacattcccgattctgttaggttatggaaggcggtggtggagcttgccaatgaggaggatgcgagacttttgcttcatagggctgtggagtgttgtcccttgcacattgagttatggcttgcacttgcaagattggaaacttatgagaatgcaaggaaggtccttaatagggcaagagagaagctatcaaaagagcctgccatttggatcacagcagcgaagttggaggaagctaatgggaacacagccatggttgggaagattattgaaaggggtataagggctttgcaaagagaagggttggcgattgatagagaggcatggatgaaggaggctgaagctgctgaacgtgcagggtctgttgcaacttgccaagcaatcattcggaacacgattgggattggtgtggaggaagaggataggaagaggacatgggttgctgatgctgaggaatgcaagaaaaggggttccattgaaacagccagagccatttatgcacacgcacttactgtctttttaaccaagaagagcatatggctcaaagccgcacagcttgaaaagagccatggtactagggaatctcttgatgctttacttcgtaaagcggtgacttaccgaccacaggctgaagtcttgtggcttatgggagctaaggagaagtggcttgctggggatgtgcctgctgctcgtgccatccttcaagaagcttatgctgccattcctaattctgaggaaatttggcttgctgcgtttaaacttgaatttgagaaccatgaaccagagagagccagaatgcttcttgccaaagcccgagaaaagggaggtactgaaagagtgtggatgaaatcagcaattgttgagagagaattagggaacattaatgaggagaggaagttgcttgatgatgggttgaagcgcttcccttccttctataaattatggttgatgcttggacagctagaggaacgccttggtcatttggaaaaggccaaggaggcctatgattcaggtcagaagcactgctccagttctattccactgtggctttctcttgctaatcttgaagagaagatgagtgggctgagtaaagctcgtgcaattctgacgatggccaggaagaagaatcctcagaaccctgaattgtggcttgctgctgttcgagctgaattaaggcatggaaataagaaggaagctgatatcttgatggcaaaggctttgcaggagtgtcccaatagtggtatcttgtgggctgcgtctattgagatggtaccccgtccgcaacggaagacaaagagtatggatgccctcaagaaatgtgatcatgatccccatgtcattgctgctgtgtctaagttattttggcatgacaggaaggttgacaaagctaggacttggcttaacagggcagtgacactagcgccagatattggggatttctgggccttgtactacaaatttgaacttcaacatgggaccgaggagaaccagaaagatgtacttaaaagatgcatagctgcagacccaaagcatggtgaaaaatggcaacctatttcaaaggccgtggagaactcccaccaaccaaccgaagctatcttgaagaaagtggtggttgctcttgggaaggaagagagtgcagctgaaaataataaacagtagttcaagctgttctgttccaggttctgcttttaaaaacttgtaatacagaaaaaaattcgctg

SEQ ID NO: 3584 - DNA, 3294 bp, Malus domestica
ccatggtgttcatcacatcccccaatcacaaaaccctaaccctaaatctaaaccctaagaccaccaccctccaagccctaaagctccaaatcgagcaaaattcccacatacccattcctctgcagcgcctattcatctcgcaaagcctccaattactcacccaatccgactccgccctcctctccgacctcggaatcctacccctctcaaccctaactcttcacatccccttattcggcggcacccaacctcccgccgtccctaaaccccgcctcgagttcctcaactccaagcctcccccgaattatgtcgcagggctcggccgtggtgccactggcttcaccaccaggtctgatatcgggcccgcacgtgccgcgcccgacctgcctgataggtcggccaccacaatcggaggcgctactgctcctgctgcgccgcctggggtcggccgagggcgcgggaagcccgacgaagaggaggaggatgaaggggaggataaagggtacgatgagaatcagaagtttgatgaattcgaagggaatgattgttgggtttgtttgcatcggcggaatacgatgatgaggacaaggaggctgatgcggtgtgggaagccattgagcaaagaatggactctcggaggaaggacaggagagaagcacggttgaaagaagagattgaaaagtacagagcttcgaacccaaagatcacggagcagtttgccactctgaagaggaagttgtacactgtgtctgctcaggaatgggagagcataccggaaattggagactattcgtcgaggaacaagaagaagagattcgagagctttgtaccggtgcccgatacacttttagagaaagcaagacaggaaaaggagcatgttacggcattggaccccaagagtaggggagctggtggtacggagactccgtggtctcaaactccggttacggatttgactgctgtaggtgagggtagaggtactgttttgtcattgaaattagataggctttctgattctgtttctggattgacggttgtggacccgaaagggtaccttactgatcttaagagcatgaagattactagtgatgcagagatttcagatattaaaaaggctaggttgttgcttaagagtgttatacagacgaatccaaagcacccacctggttggattgcggctgcaaggctggaggaggtggctgggaagattcaggcagctagacaattgattcagaaagggtgtgaagaatgtcctaagagtgaggatgtgtggttagaggcgtgtaggctttcaagccctgatgaagctaagtctgtgatttctaagggagtgaagtcgattcccaattcggtgaagttgtggatgcaggctgcgaaattggagcgtgatgatttgaataggagcagggtattgaggaaaggtttggaacacattcccgattctgttaggctatggaaggcagtggtggagcttgccaatgaggaggatgcaagacttttgcttcatagggctgtggagtgttgtcccttgcacattgagttatggcttgcacttgcaagattagaaacttatgataatgcgaggaaggtccttaatagggcgagagagaagttatcaaaagagcctgccatttggatcacagcagcgaagttggaggaagctaatgggaacacggccatggttgggaagattattgaaaggggtataagggctttgcaaagagaagggttggcgattgatagagaggcatggatgaaggaggctgaagctgctgaacgtgcaggatctgttgcaacttgccaagcaatcattcggaacacaattgggattggtgtggaggaagaggataggaagaggacatgggttgctgatgctgaggaatgcaagaaaaggggttccattgaaacagccagagctatttatgcacacgcacttactgtctttttaaccaagaagagcatatggctcaaagccgcacagcttgaaaagagccatgggactagggaatctcttgatgctttacttcgtaaagcggtgacataccgaccacaggctgaagtcttgtggcttatgggtgctaaggagaagtggcttgctggggatgtgcccgctgctcgtgccatccttcaagaagcttatgctgccattcccaattctgaagaaatttggcttgctgcatttaaacttgaatttgagaaccatgaaccagagagagctagaatgcttcttgccaaagcccgagaaaagggaggcactgaaagagtgtggatgaaatcagcaattgttgagagagaattagggaacattaatgcagagaggaagttgcttgatgatgggttgaagcgcttcccttccttttataaattatggttgatgcttggacagctagaggaacgccttggtcatttggagaaagccaaggaggcctatgattcgggtctgaagtactgctccagttctattccactgtggctttctcttgctaatcttgaagagaagatgactggtctgagtaaagctcgtgcaattctgacgatggccaggaagaagaatcctcagaaccctgaattgtggcttgctgctgttcgagctgaattaaggcatggaaataagaaggaagctgatatcttgatggcaaaggccttgcaggagtgtcccaatagtggtatattgtgggctgcgtccattgagatggtaccccgtccacaacggaagacgaagagtatggatgccctcaagaaatgtgatcatgatccccatgtcattgctgctgtgtccaagttattttggcatgacaggaaggttgacaaagctaggacttggcttaacagggcagtgacactagcgccagatattggggatttctgggctttatactacaaatttgaacttcaacatgggaccgatgagaaccagaaagatgtacttaaaaggtgcatagctgcagaaccaaagcatggtgagaaatggcaacctatttcaaaggccgtggagaactcccaccaaccaactgaagccatcttgaagaaagtggtggttgctcttgggaaggaagagagtgcagctgaaaataataaacagtagttcaagctcttctgttccaggtctgctgtaaaactttgtaatacagaaataattttgatgttgaagcatgcatcgctgtaattctagttttgctccttttattgatagtccattgcataaattctcagtatcaacaatggtgtagcatgtctatatttattgttcgatttacgatggtatgcggcaacatatttttatttattgtttga

SEQ ID NO: 3585 - DNA, 3366 bp, Fragaria vesca
tagtattctcccgatctgaggatcacagacgaaaatggtgttcatcacatccccgaaccacaaaaccctaaacctgaatctcaacccgaaaaccaccaccctcgaaaccctaaagctccaaatcgaacaaacctcccacatccccatctcccagcagcgcctcttcatctcccaaagcctccaactcctcacccaatccgactccaccctcctctccgacctcaacatctcccccctctcaaccctaaccctccacatccccctcttcggcggcacccaacccccgccgtccccaaaccccgcctcgatttcctcaactccaagccccccgccaactatgtcgccggtctcggccgtggcgccaccggcttcaccacccgttccgatatcggacctgcccgcgccgctcctgacttgcccgatcgctccgccacgactatcggcggggctgccggggctgctccgcctggggcggggcgtggccgcgggaagccggaggaggaggaggaagacgacggcgaggagaaaggctacgatgagaatcagaagtttgatgagttcgaaggaaacgacgtcggtttgttcgcgtcggcggagtacgacgacgaggacaaggaggccgacgctgtgtgggaggcgattgagcagaggatggactcgaggaggaaggacaggagggaagcgaggttgaagcaagagattgagaagtacagagcttcaaatcccaaaatcacggagcagtttgcgaatttgaagaggcagctgtatactgtttcggctgaggaatgggataagataccggacattggggattattcggccaggaacaagaagaggaagtttgagagctttgtgccggtgccggatactcttttcgagaaggctaggcaggaacaggagcatgttactgcattggaccccaagagtagggcggccactggtacagagacgccgtggtcgcaaacgccggttacagatttgaccgcagttggtgatggcaggagtactgtgttgtctttgaaattagataggctttcggattctgtttcagggctgacagtcgtggaccctaaggggtatcttactgatcttaagagtatgaagattactagtgatgcggagatttcggatataaagaaggctaggttgttgctcaagagtgtgacacagactaatccgaagcatccacctggttggattgcggctgcgaggttggaggaagtggcggggaagatacaggcagcaaggcaattgatccagaaagggtgtgaggaatgtcccaagagtgaggatgtttggttggaggcatgtcggcttgccagtcctgacggagccaaggctgtgattgctgctggagtaaagtcaatacccaattcagtcaagctgtggatgcaggcggcgaaattggagcatgatgactcgaataagagtagggtgttgaggaaagggttggaacacattcctgattctgttaggctatggaaggcggtggtggagctggcgaatgaggaggatgccagacttttgcttcatagggctgtggagtgttgtcccttgcacatagagttgtggcttgctctagcgagattggagacttatgacaatgccaagaaggtccttaacaaggcccgggagaagctttcaaaagagcctgccatttggattactgcagcaaagttggaagaagctaatgggaatacatcagttgggaagattattgaaaggggtataagggctctgcaaagagagggattggtgattgatagagaagcatggatgaaggaggctgaagctgccgagcgtgcagggtctgtggcaacttgccaagccattattcggaacactattgggattggcgtggaggaagaagataggaagaggacatgggttgctgatgcagaggagtgcaagaaacgtggttccattgaaacagccagagctatctatgctcatgcacttactgtcttcttaagtaagaagagcatatggcttaaagcagcacagctcgaaaagagtcatggaactagggaatctcttgatgccctgcttcgtaaagcagttacctaccgaccacaggcggaagtcttatggcttatgggtgcgaaggagaagtggcttgctggggacgtatttaatgcccgtaaaatcctcgaagaagcttatgctgccattccgaattctgaagagatttggcttgctgcatttaagcttgaatttgagaatcatgaacctgagagagctaggttgcttcttgctaaagcccgagaaaagggaggaacagagagagtatggatgaaatcagcaatcgtcgaaagagaattagggaacctcgatgaggagaggaagttgcttgctgaaggattgaaacgcttcccttcgttctttaaattgtggttgatgcttggacagctagaggaacggcttaaccatttggacaaagccaaggagacttatgactcgggtcttaagcactgctccaattctataccactctggctttctcttgcaaatcttgaagagaagatgaatgggctgagtaaagctcgtgcagttcttacgatggccaggaagaagaatcctcagaaccctgaactgtggcttgctgctgttcgagctgaattgaggcatggtaataagaaggaagctgatattttgatggcaaaggccttgcaggagtgtcccaatagtggtatcttgtgggcagcttctattgagatggtaccgcgtccccaaaggaagaccaaaagtatggatgccctcaagaaatgtgatcacgatccccatgtcattgctgctgtggccaagttattctggctcgacaggaaggttgacaaagctaggacttggctcaacagggcagtgacacttgccccagatattggagatttctgggctttatactacaaatttgaacttcagaatgggactgacgagaaccagaaggatgtactaaaacgatgcattgctgcagaaccaaagcatggtgaaaaatggcaacctatttcaaaggcagtggagaactctcaccaaccaacagaggctatcttgaagaaggtagttgttgcccttggcaaggaagagagtgcagctgaaaataatagacagtaggtctggcagtctggcttgtcaattccaggttaggttttagttatttaatgagtttttagcaatgacaaatcgatgtggagttttacatcatatcctgcgagaaaaagttactctactattactcattttctctgtattactcatttaatctttacttctttctatgaatattatatcggttaatagttggatgatgaagcttttctttaattattgtttgaaatacgatgcacttgtgcatgttcttttgtatctgca

SEQ ID NO: 3586 - DNA, 3139 bp, Ricinus communis
aatggtttttgtaaaatcaccaaacaacaaaactctatctctcaatcttaaccccaatactaccactctctctctcctcaaacaacacattcagtcccaaacccagatcccaatttctgaccaattctttttaaatccatcctttaatgtttattctagctccaaatatgcaaatatatttgaatcttgtccactttctcatctgggtatcaccaatttctctactttaaccctttatatcccctttcacggcggtacccaaactccagcgccgccaaaaccccgtcttgatttccttaattctaagcccccacctaactatgttgcgggtttgggtcgtggagcaactgggttcactacccggtctgacatcggtcctgctagagctgctcctgaccttcctgaccgttctgcggttgctattggagctgctggtggtgccgccggggcggggatgggtcgtggtagggggaaaggtggtgaggaggatgatgaggatgacggggatgaaaagggttatgatgagaatcaaaaatttgatgaatttgaagggaacgatgtgggtttgtttgcttctgctgagtatgatgaggatgacaaagaagctgatgctgtttgggaagcaattgacaagagaatggattctagaagaaaggatagaagagaggctagattgaaggaagagattgaaaagtatagggcttcaaatccgaaaattacagagcaatttgctgatttgaagaggaagttgcatacattatcagctgaagagtgggagagcatacctgatattggtgattattctttgagaaataaaaagaaaagattcgagagctttgtgcctgtacctgatacgcttcttgaaaaagctaggcaagaacaggaacatgttactgcactggaccctaaaagtagagctgctggtggggctgagacgccttggtcgcagactcctgttactgaccttactgctgttggtgaaggaagggggactgtgttgtctttgaaattggataggttatcggattcggtttctgggttgactgtggttgatcctaaaggttatttgactgatttgaagagtatgaagattactagtgatgctgagatttcagatattaagaaggcaaggttgttgttgaagagtgttactcagactaatccaaaacaccctcctggttggattgctgctgcaaggttggaagaggttgctggcaagattcaggcagctaggcaattgatacaaagggggtgcgaggagtgtcctaaaaatgaggatgtttggatagaggcatgtaggctggctagtcctgatgaagccaaagcagttattgctaagggagtgaagtgtataccaaattctgttaagttgtggttacaggctgcgaaattggaacatgatgatgtgaataaaagtagggttttgaggaagggcttagagcatattcctgattcagttaggttatggaaagctgttgtggagttggccaacgaggaggatgctagaacattacttcatagagcagtagaatgctgtcctttgcatgttgaattgtggttggcattggcaagattagagacatatgatagtgcaaagaaggtgttgaacagggccagggaaaagttgcctaaggagccagccatatggattactgctgccaagttggaagaggcaaatggtaacacatcaacggtgggaaagattatcgagagaggtatcagggctttgcagagagaagggttggtgattgatagagaggcatggatgaaagaggctgaggcagcagaaagggcaggttctgtggtgacttgtcaagcaattattaagaatacaattgggattggagtggaggaagaggataggaagagaacatgggtggcagatgcagaggagtgtaagaagaggggttctattgagactgctagagctatttatgctcatgctctgactgtgtttttgactaagaaaagtatttggcttaaggcggcacagcttgagaagagtcatgggactagggagtctcttgatgctttgctgcgaaaagcagttacatacaggccccaagctgaggttttatggcttatgggtgctaaagagaagtggcttgcaggtgatgtgcctgctgcaagggctattcttcaagaagcctatgctgctataccaaattcggaggagatttggcttgcagcatttaagcttgaatttgagaatcatgagcctgaaagagctagaatgctgcttgctaaggcaagagaaagaggtggtacagaaagagtctggatgaagtctgccattgtcgagagagaattgggcaatacagaggaggagaggaggttgctggatgaaggactgaagcgcttcccttcgttcttcaagttgtggttgatgcttgggcagcttgaggaacggatttttcacttggataaagctaaggaagtttatgagtcaggtttgaagcactgcccaagctgtatacccctttggctttctcttgccaatcttgaagagaaaatgaatgggctgagtaaagctcgtgcggtgctcaccatggcaaggaagaagaatcctcaaaaccctgaactctggcttgctgccgtccgtgctgaatcaaggcatggtaataagaaggaatctgatatactgatggcaaaggccttgcaggagtgtccgaacagcggcatattgtgggcagcatcaattgagatggttcctcgtcctcagcgcaaaaccaagagtatggatgcccttaagaaatgtgatcatgatcctcatgttattgctgctgtggccaagctgttctggcatgacaggaaggttgataaagctagaacctggctgaacagggcagtcactcttgctccagatattggagatttctgggcgttgtattacaaatttgaacttcagcatgggactgaggaaaaccagagggatgttttgaagaggtgtattgctgcagaaccgaagcatggtgaaaaatggcaagcgatttcaaaggctgtggagaatgctcaccagcaaactgaagccatcctaaagaaagtggtaattgttctcggaaaggaagagaatgctgctgaaaataataaacactagttacttgtaagcttgtagtttaaggctttttgtctttgtttt

SEQ ID NO: 3587 - DNA, 3301 bp, Ricinus communis
ccaattccaataacaatggtttttgtaaaatcaccaaacaacaaaactctatctctcaatcttaaccccaatactaccactctctctctcctcaaacaacacattcagtcccaaacccagatcccaatttctgaccaattctttttaaatccatcctttaatgtttattctagctccaaatatgcaaatatatttgaatcttgtccactttctcatctgggtatcaccaatttctctactttaaccctttatatcccctttcacggcggtacccaaactccagcgccgccaaaaccccgtcttgatttccttaattctaagcccccacctaactatgttgcgggtttgggtcgtggagcaactgggttcactacccggtctgacatcggtcctgctagagctgctcctgaccttcctgaccgttctgcggttgctattggagctgctggtggtgccgccggggcggggatgggtcgtggtagggggaaaggtggtgaggaggatgatgaggatgacggggatgaaaagggttatgatgagaatcaaaaatttgatgaatttgaagggaacgatgtgggtttgtttgcttctgctgagtatgatgaggatgacaaagaagctgatgctgtttgggaagcaattgacaagagaatggattctagaagaaaggatagaagagaggctagattgaaggaagagattgaaaagtatagggcttcaaatccgaaaattacagagcaatttgctgatttgaagaggaagttgcatacattatcagctgaagagtgggagagcatacctgatattggtgattattctttgagaaataaaaagaaaagattcgagagctttgtgcctgtacctgatacgcttcttgaaaaagctaggcaagaacaggaacatgttactgcactggaccctaaaagtagagctgctggtggggctgagacgccttggtcgcagactcctgttactgaccttactgctgttggtgaaggaagggggactgtgttgtctttgaaattggataggttatcggattcggtttctgggttgactgtggttgatcctaaaggttatttgactgatttgaagagtatgaagattactagtgatgctgagatttcagatattaagaaggcaaggttgttgttgaagagtgttactcagactaatccaaaacaccctcctggttggattgctgctgcaaggttggaagaggttgctggcaagattcaggcagctaggcaattgatacaaagggggtgcgaggagtgtcctaaaaatgaggatgtttggatagaggcatgtaggctggctagtcctgatgaagccaaagcagttattgctaagggagtgaagtgtataccaaattctgttaagttgtggttacaggctgcgaaattggaacatgatgatgtgaataaaagtagggttttgaggaagggcttagagcatattcctgattcagttaggttatggaaagctgttgtggagttggccaacgaggaggatgctagaacattacttcatagagcagtagaatgctgtcctttgcatgttgaattgtggttggcattggcaagattagagacatatgatagtgcaaagaaggtgttgaacagggccagggaaaagttgcctaaggagccagccatatggattactgctgccaagttggaagaggcaaatggtaacacatcaacggtgggaaagattatcgagagaggtatcagggctttgcagagagaagggttggtgattgatagagaggcatggatgaaagaggctgaggcagcagaaagggcaggttctgtggtgacttgtcaagcaattattaagaatacaattgggattggagtggaggaagaggataggaagagaacatgggtggcagatgcagaggagtgtaagaagaggggttctattgagactgctagagctatttatgctcatgctctgactgtgtttttgactaagaaaagtatttggcttaaggcggcacagcttgagaagagtcatgggactagggagtctcttgatgctttgctgcgaaaagcagttacatacaggccccaagctgaggttttatggcttatgggtgctaaagagaagtggcttgcaggtgatgtgcctgctgcaagggctattcttcaagaagcctatgctgctataccaaattcggaggagatttggcttgcagcatttaagcttgaatttgagaatcatgagcctgaaagagctagaatgctgcttgctaaggcaagagaaagaggtggtacagaaagagtctggatgaagtctgccattgtcgagagagaattgggcaatacagaggaggagaggaggttgctggatgaaggactgaagcgcttcccttcgttcttcaagttgtggttgatgcttgggcagcttgaggaacggatttttcacttggataaagctaaggaagtttatgagtcaggtttgaagcactgcccaagctgtatacccctttggctttctcttgccaatcttgaagagaaaatgaatgggctgagtaaagctcgtgcggtgctcaccatggcaaggaagaagaatcctcaaaaccctgaactctggcttgctgccgtccgtgctgaatcaaggcatggtaataagaaggaatctgatatactgatggcaaaggccttgcaggagtgtccgaacagcggcatattgtgggcagcatcaattgagatggttcctcgtcctcagcgcaaaaccaagagtatggatgcccttaagaaatgtgatcatgatcctcatgttattgctgctgtggccaagctgttctggcatgacaggaaggttgataaagctagaacctggctgaacagggcagtcactcttgctccagatattggagatttctgggcgttgtattacaaatttgaacttcagcatgggactgaggaaaaccagagggatgttttgaagaggtgtattgctgcagaaccgaagcatggtgaaaaatggcaagcgatttcaaaggctgtggagaatgctcaccagcaaactgaagccatcctaaagaaagtggtaattgttctcggaaaggaagagaatgctgctgaaaataataaacactagttacttgtaagcttgtagtttaaggctttttgtctttgttttcctgccttgtagattattaatgttttagcattggaaatgccactagagatttttgttggcacatatacttcattacgagcttttctaaatcggatgtagtattggcttgattgactaattttagagtcgtggtgatgagactatttgg

SEQ ID NO: 3588 - DNA, 3856 bp, Ricinus communis
taatggaatgaataaataaaaatggttttaacaattagactaacatctcagtggtctaaaactaattcctctctataatagacacctcttcattcacatgaacatgatcacatcaaagattcttgcttttcttttttctaaaagctgatttatatatatgcttttgctcttattgaagacaaacgatttaaacaaaaaaattatatattatttaaggtattcttctgtagaaacaagcccagcccagcccagagcatacacagccaaaatcaccgccacagtgaagccgccgccattctctctgccaaatttaatcagaaaacggagtgacctccgttcgacattactaaacccagaaaaaagaaagcccttttctcttcgcagccaattccaataacaatggtttttgtaaaatcaccaaacaacaaaactctatctctcaatcttaaccccaatactaccactctctctctcctcaaacaacacattcagtcccaaacccagatcccaatttctgaccaattctttttaaatccatcctttaatgtttattctagctccaaatatgcaaatatatttgaatcttgtccactttctcatctgggtatcaccaatttctctactttaaccctttatatcccctttcacggcggtacccaaactccagcgccgccaaaaccccgtcttgatttccttaattctaagcccccacctaactatgttgcgggtttgggtcgtggagcaactgggttcactacccggtctgacatcggtcctgctagagctgctcctgaccttcctgaccgttctgcggttgctattggagctgctggtggtgccgccggggcggggatgggtcgtggtagggggaaaggtggtgaggaggatgatgaggatgacggggatgaaaagggttatgatgagaatcaaaaatttgatgaatttgaagggaacgatgtgggtttgtttgcttctgctgagtatgatgaggatgacaaagaagctgatgctgtttgggaagcaattgacaagagaatggattctagaagaaaggatagaagagaggctagattgaaggaagagattgaaaagtatagggcttcaaatccgaaaattacagagcaatttgctgatttgaagaggaagttgcatacattatcagctgaagagtgggagagcatacctgatattggtgattattctttgagaaataaaaagaaaagattcgagagctttgtgcctgtacctgatacgcttcttgaaaaagctaggcaagaacaggaacatgttactgcactggaccctaaaagtagagctgctggtggggctgagacgccttggtcgcagactcctgttactgaccttactgctgttggtgaaggaagggggactgtgttgtctttgaaattggataggttatcggattcggtttctgggttgactgtggttgatcctaaaggttatttgactgatttgaagagtatgaagattactagtgatgctgagatttcagatattaagaaggcaaggttgttgttgaagagtgttactcagactaatccaaaacaccctcctggttggattgctgctgcaaggttggaagaggttgctggcaagattcaggcagctaggcaattgatacaaagggggtgcgaggagtgtcctaaaaatgaggatgtttggatagaggcatgtaggctggctagtcctgatgaagccaaagcagttattgctaagggagtgaagtgtataccaaattctgttaagttgtggttacaggctgcgaaattggaacatgatgatgtgaataaaagtagggttttgaggaagggcttagagcatattcctgattcagttaggttatggaaagctgttgtggagttggccaacgaggaggatgctagaacattacttcatagagcagtagaatgctgtcctttgcatgttgaattgtggttggcattggcaagattagagacatatgatagtgcaaagaaggtgttgaacagggccagggaaaagttgcctaaggagccagccatatggattactgctgccaagttggaagaggcaaatggtaacacatcaacggtgggaaagattatcgagagaggtatcagggctttgcagagagaagggttggtgattgatagagaggcatggatgaaagaggctgaggcagcagaaagggcaggttctgtggtgacttgtcaagcaattattaagaatacaattgggattggagtggaggaagaggataggaagagaacatgggtggcagatgcagaggagtgtaagaagaggggttctattgagactgctagagctatttatgctcatgctctgactgtgtttttgactaagaaaagtatttggcttaaggcggcacagcttgagaagagtcatgggactagggagtctcttgatgctttgctgcgaaaagcagttacatacaggccccaagctgaggttttatggcttatgggtgctaaagagaagtggcttgcaggtgatgtgcctgctgcaagggctattcttcaagaagcctatgctgctataccaaattcggaggagatttggcttgcagcatttaagcttgaatttgagaatcatgagcctgaaagagctagaatgctgcttgctaaggcaagagaaagaggtggtacagaaagagtctggatgaagtctgccattgtcgagagagaattgggcaatacagaggaggagaggaggttgctggatgaaggactgaagcgcttcccttcgttcttcaagttgtggttgatgcttgggcagcttgaggaacggatttttcacttggataaagctaaggaagtttatgagtcaggtttgaagcactgcccaagctgtatacccctttggctttctcttgccaatcttgaagagaaaatgaatgggctgagtaaagctcgtgcggtgctcaccatggcaaggaagaagaatcctcaaaaccctgaactctggcttgctgccgtccgtgctgaatcaaggcatggtaataagaaggaatctgatatactgatggcaaaggccttgcaggagtgtccgaacagcggcatattgtgggcagcatcaattgagatggttcctcgtcctcagcgcaaaaccaagagtatggatgcccttaagaaatgtgatcatgatcctcatgttattgctgctgtggccaagctgttctggcatgacaggaaggttgataaagctagaacctggctgaacagggcagtcactcttgctccagatattggagatttctgggcgttgtattacaaatttgaacttcagcatgggactgaggaaaaccagagggatgttttgaagaggtgtattgctgcagaaccgaagcatggtgaaaaatggcaagcgatttcaaaggctgtggagaatgctcaccagcaaactgaagccatcctaaagaaagtggtaattgttctcggaaaggaagagaatgctgctgaaaataataaacactagttacttgtaagcttgtagtttaaggctttttgtctttgttttcctgccttgtagattattaatgttttagcattggaaatgccactagagatttttgttggcacatatacttcattacgagcttttctaaatcggatgtagtattggcttgattgactaattttagagtcgtggtgatgagactatttggtatttgtgctagaattgattttatttaatgcatcaaccatcctcttcataagatcattcaactacatgctgtattgggttatggttaattattgtattggtctctcctgttcattgcaagcaatgtcctggatacggatgctggatttttatttcgagtgtcaaatctttc

SEQ ID NO: 3589 - DNA, 3409 bp, Manihot esculenta
gatctcatttcattggaaaaatggttttcgtcaagtcttcagacaacaagacactctctttccacctcaaccccaacactaccactctctccgccctcaaataccatattcacacccaattccaaattccaatctctcaccagcgctttttgttgccgtcgtttaatcccctttataatccgagcgacacccaaaattccgacgaagttctcctctcccagctgggtatcaccccctactccaccttgactctgtatataccttttcttggtggcacccaaactccagcgccgccaaagccccgtcttgatttcctaaattccaagcctcctcccaactatgtcgccggtcttgggcgtggtgccactggcttcaccacccggtccgatattggtccagctcgtgctgctcccgatcttcctgatcgatctgctaccaccattggaggagcatctgctgccggctctggagtcggccgtggccgcggaaaaggaggcgacgaagaagacgaggatgatggggatgataagggttacgacgagaaccagaagttcgatgaatttgaaggcaacgatgtcgggttgtttgcttcggctgaatatgatgaggacgataaggaagcggatgctgtgtgggaggcaattgataagaggatggattcacggaggaaggacaggagggaggcaagattgaagcaggagatcgagaagtaccgagcttctaatccgaagatcactgagcaatttgcggatttgaagaggaaattgtacacgttatctgctcaagagtgggagagtataccagacatcggtgattactcgttgagaaacaagaagaggagatttgagagcttcgtgccagtacccgatacccttcttgagaaggcgaggcaagagcaggagcatgttactgctttggatccaaagaccagagctgctggtggaacagaaacgccatggtcacagactccagtcactgaccttactgctgtcggtgaagggagaggcactgtgttgtcattgaagttagatagattatcagattctgtttcagggcttactgtggtggatccaaaaggatatttgactgatttgaagagtatgaagattactagtgatgcagagatttcggatattaagaaggcgaggttgttgttgaagagtgttactcagactaatccaaaacacccgcctggttggattgctgctgcaaggttggaagaggtggctgggaagattcaggcagcaaggcagttgatacaaagggggtgtgaggaatgtcctaaaaatgaggatgtttggctagaggcttgtaggctggctagccctgatgaagccaaagcagttatagcaaagggagtgaagagtatacccaattctgttaagttgtggttgcaggctgcaaaactggaacacgatgatgtgaataaaagtagggttttaaggaagggtttagagcacattcctgattcagttaggttgtggaaatccgttgtggagttgtctaatgaggagaatgctagaattttacttcacagagcagtggaatgctgtccattgcacgtggagttgtggttggcattggccagattggagacttatgataatgcaaagaaggtgttgaacagggccagggagaagttgcctaaggagcctgctatatggataactgcagccaagttggaggaggcaaatgctaatacgtcaatggtgggaaagattattgagagaggtatcagagctttgcaaagagaagcagtggtgatagatagggaggcatggatgaaggaggctgaggcagcagaaagggcaggttctgtggtgacttgtcaagcaattattaagaacaccattggaattggagtggaggaagaggataggaagagaacatgggtggcagatgcagaggagtgtaagaagaggggatctattgagactgctagagctatttatgctcatgcgctaactgtgttcttgactaagaagagtatttggcttaaagcagcgcagcttgagaagagtcatgggacaagggagtcacttgatgctttattgcggaaggcagttacttataggcctcaagctgaagttctatggcttatgggtgctaaagagaagtggcttgctggcgatgtgcctgctgcaagggctattcttcaagaagcttatgctgctataccgaactctgaggaaatttggcttgcagcttttaagcttgaatttgagaatcatgaacctgaaagagctagaatgctgcttgctaaggctagagaaagaggtggcacagaaagagtgtggatgaagtctgccattgttgaaagagagttgggcaatactgaggaggagagaaggttgcttgatgaaggattgaaacgcttcccttcattcttcaaactgtggttgatgcttgggcagcttgaggcacggcttggtcaactggagaaggcaaaggaagcttacgagtcaggtttgaagcactgcccaagttgtatacccctttggctttctcttgctaaccttgaagagaaaatgaatgggctgagtaaagcacgtgctgtacttaccatggcaaggaagaagaatcctcaaaaccctgaactctggcttgctgctgtccgtgctgaatcaaggcatgcgaataagaaggaagctgatatattgatggcgaaggctttacaggagtgtcctaacagtggcatattgtgggcagcatcaattgagatggttccccgtccacaacgcaaaagcaagagtatggatgccctcaagaaatgtgatcatgatcctcatgttatttctgctgtggccaagttgttctggcatgataggaaggttgataaagctagaacctggctgaacagggcagttactcttgctccagatattggggatttctgggctctatattacaaatttgaacttcagcatgggactgaggaaaatcagaaggatgttttaaagaggtgcatcgctgccgaaccaaagcatggcgagaaatggcaggcaatttcaaaggctgtggagaatgctcaccagcaaacagaagctattctgaagaaagttgtggttgcacttgggaaggaagagaatgctgaaaataatagacataattgattgtaagcttgtagttggctgagcctgtccttgtttggtcgcaggtagatgattagtggcttagcctcttactgctacttattgtatttgcaatgtgcctcattgtgagttttccttgtgtaacaatttacccaactattatacgttcgaggaggctgaaaaggatgtagaagtgcgtgcattggattttagaattgtgatgataatactattctgtgctttttctatgacgaaggatgtatattttttttccactaattcggatttgtacttgcgtgcttattgactctggttcg

SEQ ID NO: 3590 - DNA, 3630 bp, Theobroma cacao
caattggtctttcttcacttacattttaacgaggttttgattttttttgtaatgctctggtggagaggtagtttcccttcccctgtttttgtgaaagaagacgaggcccaaaactacctgatctcggatctccttgctggtaagacctaatccactcaaaacgcacgccagggctcatgctggcccatgagtactcctaaacccaaacgactttcgtgctcaacaccgacgtttccatgtcttacgatctaaccaattttccacaacactggctcagaaacccagtcgaaaaagatggttttcgttgcaaccccaaattccaaaactgtttctctgaatctaaatcctaaaaccaccactctactttcccttcaacaatccattcaactccacacccaaatccctatttcccaccaaaaccttctcctctctcccaatccccgctctctccttctcagttcccagaaccccgactctgtccttctctcccaactccacatcaccccttactctaccttattccttcatgtccccctcctcggaggcacccaacctggccccggcggtgccgccccacccaaaccacgcttagattttctcaactccaagcctcctcctaattatgttgctgggcttggccgcggtgccacgggcttcaccacccgatccgatatcggtccggctcgtgctgctcctgacttacctgaccgctcagctaccacaatcggtggtgctgcggcgtcgtctgggcttggccgtggccgtggaaagcctggtgaagatgaagatgaagatgaaggggatgataagggatacgatgagaaccagaaattcgatgaatttgaagggaatgacgtgggtcttttcgcctccgcggagtacgatgaagatgacaaagaagctgatgctgtttgggaagccatcgataagaggatggattcaaggagaaaagatcgaagagaggccagattaaagcaagaaattgagaagtatcgtgcttcgaacccgaaaattacggagcaattcgctgatttgaaaagaaaattgcatactatgtcagctcaagagtgggagagtattccggaaattggagactattcattgaggaataagaaaagaaggttcgagagttttgtgccggttcctgacactcttttggagaaggcaagacaggaacaagagcatgttacggctttggacccgaagagcagggctgcgggtgggacagagaccccatgggcgcaaacccctgtaacggatttaactgctgttggtgaagggagaggtaccgtgttgtcattgaagttggataggttatcggattccgtttcaggtttaactgtggtggacccgaaagggtatttaactgatttgaagagtatgaagattactagtgatgcggagatttcggatattaagaaggctaggttgttgttgaaaagtgttacacagacaaatccgaaacatccacctggctggattgctgcagcaaggttggaggaagtggctgggaagatccaggcagctaggcagttgattcagaaagggtgtgaggagtgtcccaagaatgaggatgtttggttggaggcttgtaggctatccagcccagatgaggccaaggctgtgattgctaggggcgtgaagtcaattcccaattcagtgaagttgtggctgcaagctgcaaaattggagcatgatgatgtgaataagagcagggttttgagaaggggtttggagcatataccggattcagtaaggttatggaaggcagttgtggagcttgcaaatgaggaggatgcggtgttgttgcttgagagggctgtagagtgttgtcctttgcatgtggagttgtggttggcacttgccaggttaagggattatgacaaagctaagaaagtgcttaatagggcaagggagaagttgcctaaggagcctgctatatggattacggctgcaaagttggaggaggccaatggaaataatgctatggtgggaaagattattgagaggtgtataagggcattgcaaagagaagggttggtgattgacagggaggcctggatgaaggaggctgaggctgcagagagggctgggtctgtggtgacatgccaggcaattattcgaaatacaattgggattggagtggaggaagaggatagaaagagaacttgggtggctgatgctgaggaatgcaagaagcgtggttctattgagactgctcgagctatttatgctcatgctcttaccgtgtttttgacaaagaagagcatttggctgaaagcagctcagcttgagaagagtcatgggactagggaatcgcttgatgctcttctacgtagagcagttacttatcggccgcaggctgaggttctttggcttatgggtgccaaggagaaatggcttgctggggatgtgcctgctgctcgagctattcttcaagaagcttatgctgcgataccaaactctgaggagatttggcttgctgcatttaagcttgaatttgaaaatcatgagcctgagagagcaagaatgcttcttgctaaggctcgagaaagaggaggcacagagagagtatggatgaaatcagccattgtggagagagaattagggaacactgaggaagagaggaggttgcttgatgaaggattgaagcaattcccatcattcttcaaactgtggttaatgcttgggcagctagaagaagggcttggtaacttggagaaagccaaggaagtttatgaatctggtttaaagcactgcccaagttgtataccgctttgggtttctcttgccattcttgaagagaaaatgaatggtatagctaaggctcgagctgtactcacattggcgaggaagaagaatccacaacagcctgaactctggcttgctgccatacgtgctgaatcaagacatggctacaagagggaagctgatattttgatggcaaaggcgttgcaagagtgtccaaatagtggtatattgtgggcagtgtctattgagatggttccacggcctcaacgtaaaaccaagagcatggatgccctcaagaaatgtgatcatgatccccatgttattgcagctgtggccaagttattttggcatgataggaaggtggataaagctaggacttggctcaacagggctgtgactcttgctcctgatattggggatttctgggcattgtactacaaatttgaacttcagcatggtagtgaggagaaccagaaagatgtgatgaaaaggtgtgttgctgcagaaccaaagcatggtgagaaatggcaagcaatttcaaaggctgtggagaactctcaccagccaaccgaagccattctgaagaaagtagttgttgcactgggaaaggaagagagtgctgcggaaaacaatagtaaacactaattacttttaaggttgtagtttctgattgttactctgttgaggttttgttgtagaatacttttactaagggtagtgccctactggtctctcacttgaatgaaattttgatttctttaatgaatgtggacagctgaattaatgctgaagcatgtttactttgatttttggttgcaatggtgaaaattgtgttttatcttgatgtttaagcatttagaatatatttattggttatta

SEQ ID NO: 3591 - DNA, 3533 bp, Gossypium hirsutum
aatcgaaatcgaagaagaagatggtgttcatcgcaacgcctaattccaaaacttttccctaaatctaaaccctaaaaccaccactctcctttccctccaacaatccattcaactccgcacccaaatccctatttcttaccaacactttctcctctcccccaaccccacctcttcccttctccattcccccgatcccgattccgtccttctttaccaactccaaatcaccccttactctaccttattccttcatgttcccctctgtggtggcacccaacctggccccagcggtgccgctgtgcccaagccacgcttagattttctcaactccaagcctccccctaactatgttgctggtttggggcgtggtgccacgggctttaccactcggtctgatatcggtcccgcccgtgctgctcctgacttacctgaccggtccgctactactattggtggtgctgcagcgccctctgggcttggccgtggccgcggaaagcctggtgaagacgaagaagacgatgaaggtgaggataagggttacgatgaaaatcagaaatttgatgaatttgaaggaaacgacgtgggtcttttcgcctccgcggagtatgatgaagatgataaagaagctgacgctgtttgggaggccatcgataagaggatggattcaaggaggaaagatagaagagaggcaaggctgaaggaagagattgagaaataccgagcgtctaacccgaaaattactgagcagttcgcggatttaaagagaaagttgcatactttgtcaaacgaggagtgggagagtattccagaaattggggattattcgttgaggaataagaaaaggaggttcgagagttttgtgccagtcccagatactcttttggagaaggcaaggcaggagcaagagcatgttacggctttggacccaagagcagggctgcggtgggacggaaactccgtgggcgcaaacccctgtaaccgatttaactgctgttggtgaagggagaggtactgtcttgtctttgaagttagataggttatcggattctgtttcgggtttaactgttgtggatccaaaaggttatttgactgatttgaaaagtatgaagattactagtgatgctgagatttcggatattaagaaggccaggttgttgttgaaaagtgttacgcagaccaatcccaaacatcctcccggttggattgcggctgcaaggctggaggaagtggctgggaagatccagacagctaggcagttgattcagaaagggtgtgaggagtgtcccaagaatgaagatgtatggctggaggcttgtaggcttgcgagcccggatgaggccaaggctgtgattgctaagggagtgaaatcaattcccaattcagtgaagttgtggttacaggctgctaaattagagcatgatgatgtgaataaaagcagggttttgaggaggggtttggagaacataccagattctgtgaggttatggaaggctgttgtggagcttgcaaatgagaaggatgcagcgactttgcttgaaagggccgtggagtgctgtcctttacatgtggagttgtggttagcacttgctaggttgaaggattatgataaagctaagaaagtgcttaatagggcaagggagaagttgcctaaagagcctgctatatggattacagctgcgaagttggaggaggctaatggaaataatgctatggtgggaaaaattattgagaggtgtattagggcattacaaagagaaggatttgtgattgatagggaggcttggatgaaagaggctgaggcggcagaaagggctggctctgttgtgacatgccaggcaatcattcgaaatacaattgggattggagtggaggaagaggataggaagagaacttgggtggctgatgccgaagaatgcaagaagcggggttcaattgagactgctagagctatctatgctcacgctcttactgtctttttgacaaagaagagcatttggctgaaagcagctcagctggagaagagtcatgggactagggaatctcttgatgctcttcttcgtaaagcagtcacgtaccggccacaggctgaggttctttggcttatgggtgccaaagagaaatggcttgctggggatgtgcctgctgcacgagctatccttcaagaagcatatgctgccatacctaattctgaggagatatggcttgctgcgtttaagcttgaatttgaaaaccatgagcctgagagagcaaggatacttcttgccaaggctcgagaaagaggaggcacagagagagtatggatgaaatcagccattgtggagagagaattggggaacaccgaggaagaaaggaggttgcttgatgaaggattgaagcaattcccatcattctttaaactgtggttgatgcttgggcagctcgaggaaaggcttggtaacttagaaaaggcaaagggagtttatgaatcaggtttaaagcactgcccaagttgtatacctctatgggtttctcttgctattcttgaagagaaaatgaatgggattgctaaggctcgagctgtactcaccttggcaaggaagaagaatccacaaaaacctgaactctggcttgctgccatacgagctgaggcaagacatggctacaagaaggaagccgatatcttaatggccaaggcattacaagagtgtccaaatagtggtatattgtgggcggcatctattgagatggttccaaggcctcaacgtaaaaccaagagcatggatgccctcaagaagtgtgatcatgatccccatgtcattgccgcggtggctaagctattttggcatgataggaaggtggataaagccaggacttggctaaatagggctgtgactcttgctccagatattggggatttctgggcattgtattacaaatttgaacttcagcatggtagtgaggagaaccagaaagatgtgatgaaaaggtgtgttgctgcagaaccgaagcatggtgagaaatggcaagctatttcaaaggctgtagagaactctcaccagcctactgaagccattttaaagaaagtagtggttgtgttgggcaaggaagagagtgctgcggaaaataacagtaaacactaattacttttaactaatagttactcgtgtacttgggggtagtgccagctgaatcaattctgaagcatgttttctttggtttttggacaattatggtgagactttatcttcaactatgatgtttttagcatatagcgtctacttgttttgttgcctcgttttgcttaccattgtttccagagaaataacaataggacaagctttggagtttggttttcagtggatatcagtcctgtttagctagagtagaagagtactcatccgtatttgtcgtattaaagcttaaaaagatccaaaagaattcgaatgctctttatatctcatcatagttctaatctcatgaccgctcgaaattatcattagtatgtactactattgcttagtttagtgtatatataatatgaagaatcaataatc

SEQ ID NO: 3592 - DNA, 3009 bp, Malus domestica
atctcgccatggtgttcatcacatcccccaatcacaaaaccctaaccctaaatctaaaccctaagaccaccaccctccaagccctaaagctccaaatcgagcaaaattcccacatacccattcctctgcagcgcctattcatctcgcaaagcctccaattactcacccaatccgactccgccctcctctccgacctcggaatcctacccctctcaaccctaactcttcacatccccttattcggcggcacccaacctcccgccgtccctaaaccccgcctcgagttcctcaactccaagcctcccccgaattatgtcgcagggctcggccgtggtgccactggcttcaccaccaggtctgatatcgggcccgcacgtgccgcgcccgacctgcctgataggtcggccaccacaatcggaggcgctagaagaggaggaggatgaaggggaggataaagggtacgatgagaatcagaagtttgatgaattcgaagggaatgattgttgggtttgtttgcatcggcggaatacgatgatgaggacaaggaggctgatgcggtgtgggaagccattgagcaaagaatggactctcggaggaaggacaggagagaagcacggttgaaagaagagattgaaaagtacagagcttcgaacccaaagatcacggagcagtttgccactctgaagaggaagttgtacactgtgtctgctcaggaatgggagagcataccggaaattggagactattcgtcgaggaacaagaagaagagattcgagagctttgtaccggtgcccgatacacttttagagaaagcaagacaggaaaaggagcatgttacggcattggaccccaagagtaggggagggatttgactgctgtaggtgagggtagaggtactgttttgtcattgaaattagataggctttctgattctgtttctggattgacggttgtggacccgaaagggtaccttactgatcttaagagcatgaagattactagtgatgcagagatttcagatattaaaaaggctaggttgttgcttaagagtgttatacagacgaatccaaagcacccacctggttggattgcggctgcaaggctggaggaggtggctgggaagattcaggcagctagacaattgattcagaaagggtgtgaagaatgtcctaagagtgaggatgtgtggttagaggcgtgtaggctttcaagccctgatgaagctaagtctgtgatttctaagggtgtgaagtcgattcccaattcggtgaagttgtggatgcaggctgcgaaattggagcgtgatgatttgaataggagcagggtattgaggaaaggtttggaacacattcccgattctgttaggctatggaaggcagtggtggagcttgccaatgaggaggatgcaagacttttgcttcatagggctgtggagtgttgtcccttgcacattgagttatggcttgcacttgcaagattagaaacttatgataatgcgaggaaggtccttaatagggcgagagagaagttatcaaaagagcctgccatttggatcacagcagcgaagttggaggaagctaatgggaacacggccatggttgggaagattattgaaaggggtataagggctttgcaaagagaagggttggcgattgatagagaggcatggatgaaggaggctgaagctgctgagcgtgcagggtctgttgcaacttgccaagcaatcattcggaacacgattgggattggtgtggaggaagaggataggaagaggacatgggttgctgatgctgaggaatgcaagaaaaggggttccattgaaacagccagagctatttatgcacacgcacttactgtctttttaaccaagaagagcatatggctcaaagccgcacagcttgaaaagagccatgggactagggaatctcttgatgctttacttcgtaaagcggtgacataccgaccacaggctgaagtcttgtggcttatgggtgctaaggagaagtggcttgctggggatgtgcccgctgctcgtgccatccttcaagaagcttatgctgccattcccaattctgaagaaatttggcttgctgcatttaaacttgaatttgagaaccatgaaccagagagagctagaatgcttcttgccaaagcccgagaaaagggaggcactgaaagagtgtggatgaaatcagcaattgttgagagagaattagggaacattaatgcagagaggaagttgcttgatgatgggttgaagcgcttcccttccttttataaattatggttgatgcttggacagctagaggaacgccttggtcatttggagaaagccaaggaggcctatgattcgggtctgaagtactgctccagttctattccactgtggctttctcttgctaatcttgaagagaagatgactggtctgagtaaagctcgtgcaattctgacgatggccaggaagaagaatcctcagaaccctgaattgtggcttgctgctgttcgagctgaattaaggcatggaaataagaaggaagctgatatcttgatggcaaaggccttgcaggagtgtcccaatagtggtatattgtgggctgcgtccattgagatggtaccccgtccacaacggaagacgaagagtatggatgccctcaagaaatgtgatcatgatccccatgtcattgctgctgtgtctaagttattttggcatgacaggaaggttgacaaagctaggacttggcttaacagggcagtgacactagcgccagatattggggatttctgggctttatactacaaatttgaacttcaacatgggaccgatgagaaccagaaagatgtacttaaaaggtgcatagctgcagaaccaaagcatggtgagaaatggcaacctatttcaaaggccgtggagaactcccaccaaccaactgaagccatcttgaagaaagtggtggttgctcttgggaaggaagagagtgcagctgaaaataataaacagtagttcaagct

SEQ ID NO: 3593 - DNA, 3426 bp, Mimulus guttatus
aatcatggtgtttgttaaatcaccggataacaaaaccctaattctgaatcttaatccttccaccaccaccagacaggcgcttagcctccacatccagcggaattacctaatacccattgctcaacagcgcctctacttgagccaccgtcttctctccaccccggagaacgacgccgtattactctctcacctcggcgtttccccaaactcaaccctaaccctacacgttcccttcctcggcggtatgcaagcccccgtcgctcccaagaagttagaattcctcggcacaaggccgccgcccaattacgtcgccggtctcggccgtggtgccactggattcaccacccgttctgatattggcccggcccgttccgcccccgatttgccggatcgatccgccgctgcaattggcgttaccgcgccgccccttggggcggctgcggttggccgtggccgtgggaagggcactggggatgaggatgaagatgaagacccggaggagaaaggatacgacgagaatcagaagtttgacgagtttgagggaaacgatgccggattgtttgcctctgcggagtatgatgaggaggataaggaggctgatgctgtgtgggatgcaatcgacgagaggatggattcgcgtaggaaagataggagggaggctaggcttaaggaggaaatcgaaaagtatcgagcctcgaaccctaaaattacggagcagtttgctgatttgaaaaggaaattgtacacattgtccacttcggattgggatagtattcctgatataggagattacacttccaagaataagaagaagaggtttgagagttttgttcctgttcccgacactctcttggaaaaagcaaggcaagaaaaggagcatgtgagtgctttggatccgaagagcaggggagttggtggtactgaaactccgtgggggcagacccccgttacggatttgactgctgtgggtgaagggagaggaaccgtgttgtccttgaagttggatagattgtccgattctgtttccgggttgactgtggttgatcctaagggttacctgaccgatttgaagagcatgaaaattactagtgatgcagaggtatccgatattaacaaggctaggttgttgctcaaatcggtgacacagacgaatccaaagcatccaaatggttggatagccgcggctaggttggaggaggtggcagggaagattcaggcggcccagcatttgatcaagagagggtgtgatgaatgtccgagaagcgaggatgtttggttggagtcgtgcagattggcgtcccatgctgatgctaaggctgttattgcaaagggtgttaaagcgattcctaagtcggtgaggttgtggatgcaagcagccaagctagagcaggatgatacgaataaaagtagggtgttgaggaaagcgcttgagaatattccggactcggtcaggctctggaaggcagttgtcgagcttgccaatgaagaagatgcgagacttttgctgcagagagctgcggaatgctgcccgttgcatgtggagttgtggctggctcttgctagattggaaacttatgaaaatgcaaagaaggtgttgaataaagctagagagaagcttcctaaggagccagctatatggatcactgctgccaagctagaagaagctaatggcaacactgccatggtcgggaagattattgaaagaggtatacgagctttgcagagggaaggcctggaaatcgacagagaaatgtggatgaaagaggctgaggcagctgaaagagctggttccgttgcaacttgtaaggctataatcgaaaatactattaaggttggtgtagaggaagaagataggaaaagaacatgggtggctgatgctgaggagtgcaagaagagaggttccattgagacagcaagggccatctatggacatgcacttaatgtgttcttgactaagaagagcatatggcttaaagctgctcagcttgaaaagagccacggaacaagagaatctcttgatgcactgctgcgaagggcagttacttacattccgcatgctgaggttttgtggctaatgggggctaaagaaaagtggcttgctggtgatgtaccgtctgctcgggcaattcttcaagaagcatacgctgctatccccaattctgaggagatttggcttgctgcattcaagcttgagtttgagaaccaagaacccgagagagcaagaatgcttcttgcaaaggcacgtgaaaggggtggaacagagagagtttggatgaaatccgcaatagttgagagggaactagggaacaccgctgaggagaggaggttattggacgaagggctgaaactattcccttcgtttttcaagctttggctgatgctggggcagttggaggagcgtctctcgaacttggacaaagccaaagaaacatacgagctgggcttgaagcattgccagaactgtatccagttatggctttcgctcgctcacctggaggaaaaagtaaacggtctaagcaaagctcgtgcaattcttactatggccagaaagaaaaatcctcagaatcctcacctctggcttgctgcagtttgggctgaggcccgacatgggaataagaaggaatctgatatattgatggccaaggcattgcaggaatgccccactagcggtattctgtgggctgcttcgatagagatggtttctcggcctcagcagaaaacgaaaagcagagatgcttacaaaaaatgcggtgacgacccacacgtacttgctgccgttgggaggatattttggcacgacaggaaggttgataaagctaggtcctggttcaacagggccgttactctttctccggatattggggatttttgggcattgtactataaattcgaacttcaacacggtacggaagagacccagagggatgttttgaacagatgcgtaacagcagagccaaagcacggtgagaagtggcaagccatatcgaaagctgtggagaattcacatcagcctactgaattcatcttgaagaaggtggttgttgcaattggtaaagaagagcatgcagctgagaatagtaaaaactagtagccatcgtaatacaagtcctagctgtctgtctagccatgatgcctcgttcaactgtggaagttctccttaaaaagttggattttgttcttttaacatttatcttctcatttccggggtgcttgttgatgacctttacttgttacaatactcagattcttgaagtaattcgtttggtttcttttttttttttttttactgcagttgcaacctttaagctgtcaacccgatgatgtttggagagatactttaatacattagtcatttgtggaaggtttttcgaagttgtattcttttctttatttcacaacttgtgcataaaatgaaaatggatagtc

SEQ ID NO: 3594 - DNA, 3221 bp, Glycine max
acacaaccatggtgttcatcgtgtcacccaatcacaaaaccttctccatagacataaaccctaacaccaccaccctccatctcctcaaactcgctatccaacacatcctaacccttccaatctcccaccagcgcctcttcctctcccacagtcgccgattatccgccgacaatgacggttccgacgattcccttctcatctccgatctcggcgtcggaccctactcaaccctaaccctccacgttcccttcctcggcggcaccaacccccctgcggtccccaaaccccgcttcgacttcctcaactccaagccgcctccgaattatgtcgccggtctcggccgtggagccaccggattcaccacacggtccgatatcggtcccgcccgcgccgctcccgacctccctgaccgctccgccaccaccattggcggaacctccggcgccggacgtggccgcgggaagcccggggaggacgaggacgacgacgatggggaagacaaaggctacgacgagaatcagaagtttgatgaattcgaagggaacgatgttgggttattcgcttcagcggaatatgatgaagatgacaaagaagcagatgcggtttgggaagcagtcgataagagaatggattctaggaggaaggataggagggaagcgaggttgaagcaggagattgagaaataccgtgcttcgaaccctaaaatcactgagcaattcgctgatttgaagagaagattgtatactctttcccctgatgattggcagagtcttgagaagttcgagagtggggggtattcgtcgaggaacaagaagaagaggtttgagagttttgtgcctgtgcctgatactcttttggagaaggcaaggcaggaacaagagcacgtgacagcgttggatcctaagagtagggctgctaatgggactgagactccttgggcacagaccccggttactgatttgactgctgttggtgagggtagagggactgtgttgtctttgaagttggataggttgtcggattcggtttctgggatgactaatgtggatcctaaagggtacttgactgtgcttaatagtatgaagattaccagtgatgctgagatttcggatttcaagaaggctaggttgcttctcaagagtgtcacgcagacgaatccaaagcaccctccgggttggattgcggctgcgaggctggaggagttggcggggaagcttcaagcggcaaggcagttgatacagaaagggtgtgaggagtgtcccaagaatgaggatgtgtggctggaggcttgtaggctggcgaatccggatgaggcaaaggcagtgattgcacggggtgttaagtccattcctaattcggtgaagctgtggatgcaggcttcaaagttggagaatgatgatgcaaataagagcagggttttgaggaaggggttggagcacattcctgattctgttaggctgtggaaggctgttgtggagcttgctaatgaggaggatgctaggcttttgcttcacagggctgtggagtgttgtcctttgcatgttgaactgtggcttgcacttgcgcggttggagacttatgacaatgctaaaaaggttcttaatagggcgagggagaggctgtccaaggagccggctatatggataactgctgccaagttggaggaagctaatgggaatacttccatggttggcaagatcattgagaggggtataagggctttgcagagagaaggtgtggtgattgatagggaagcttggatgaaggaagcagaggcagccgagcgtgctgggtccattgtaacttgccaagcaataattcataatactattggggttggagttgaagaagaagataggaagaggacatgggttgctgatgcggaggaatgtaagaaaagaggttctattgagactgccagagctatatatgctcatgccttgactgtcttcttaactaagaagagcatatggatcaaagcagcacagctggaaaagagtcatggtaccagagaatctcttgatgcattacttcgtaaagcagttacctacagaccacaggctgaagttctttggcttatgggtgccaaagagaagtggcttgctggagatgtgcccgcagctcgagctatcctccaagaagcttatgctgccattcccaattccgaggaaatatggcttgctgctttcaagctagaatttgaaaaccatgaacctgagagagctaggatgctgttggctaaagccagagagagaggaggtacagaaagagtctggatgaaatcagcaattgtggagagagaactggggaacattgaagaggagaggagattgttagatgaaggtctgaagcaattcccttcattctttaaattgtggttgatgcttggccagcttgaggaacagcttgctgagaatgaaaagcggcttgatcgcatgaatgcagctaagaaggtctatgaagctggattgagaaactgtcctaattgtgtaccactttggctctctcttgctaatcttgaagaggagatgaatggactgagtaaagaacgtgcagttctcacaatggctcgcaagaagaatcctcaaaaccctgaactctggcttgctgctgttagagcggaattgaagcatggatataagaaagaagctgatattttgatggcaaaagcattgcaggagtgtcctaacagtggtattctgtgggcagcatcgattgagatggttcctcgcccccaacgtaaaaccaagagcgcggatgccatcaagaaatgtgaccatgatccccatgttattgctgctgtggccaaattattctggcatgataggaaggtggacaaagccaggacttggttgagtagggctgtgacactagctcctgatattggggatttttgggcattgctatacaaatttgaactgcagcatggaactgaggagaaccagaaggatgtactgaagagatgtattgctgctgaaccaaaacatggagagaaatggcaagcaatctcaaaggctgttgagaattctcatcaaccaaccgaatccatcttgaagaaagtagtggttgcacttgggaaagaagagaatgcggctgagaataataaacattgatttgccaagtttcagctgtgtcataaatgattagttttgaagagaactttgaacattattgaatgtctcttgtagaatattgaaggaacttgtatattagtttgatcc

SEQ ID NO: 3595 - DNA, 4061 bp, Gossypium hirsutum
atctcaatactttttctttgatgttttcttggttcgatacgaacgtaagcgagagcccaatcgaaatcgaagaagaagatggtgttcatcgcaacgccaaattccaaaactttttccctaaatctaaaccctaaaaccaccactctcctttccctccaacaatccattcaactccgcacccaaatccctatttctcaccaacaccttctcctctcccccaaccccacctcttcccttctccattccccccgatcccgattccgtccttctttcccaactccaaatcaccccttactctaccttattccttcatgttcccctccgcggcggcacccaacctggccccagcggtgccgctgtgcccaagccacgcttagattttctcaactccaagcctccccctaactatgttgctggtttggggcgtggtgccacgggctttaccactcggtctgatatcggtccagcccgtgctgctcctgacttacctgaccggtccgctactactattggtggtgctgcagcgccctctgggcttggccgtggccggggaaagcctggtgaagacgaagaagacgatgaaggtgaggataagggttacgatgaaaatcagaaatttgatgaatttgaaggaaacgacgtgggtcttttcgcctccgcggagtatgatgaagatgataaagaagctgacgctgtttgggaggccatcgataagaggatggattcaaggaggaaagatagaagagaggcaaggctgaaggaagagattgagaaataccgagcgtctaacccgaaaattactgagcagttcgcggatttaaagagaaagttgcatactttgtcagccgaggagtgggagagtattccagaaattggggattattcgttgaggaataagaaaaggaggttcgagagtttcgtgccagtcccagatactcttttggagaaggcaaggcaggagcaagagcatgttacggctttggacccaaagagtagggctgcgggtgggacggaaactccgtgggcgcaaacccctgtaacggatttaactgctgttggtgaagggagaggtactgtcttgtctttgaagttagataggttatcggattctgtttcaggtttaactgttgtggatccaaaagggtatttgactgatttgaaaagtatgaagattactagtgatgctgagatttcggatattaagaaggccaggttgttgttgaaaagtgttacgcagaccaatcccaaacatcctcccggttggattgcggctgcaaggttggaggaagtggctgggaagatccagacagctaggcagttgattcagaaagggtgtgaggagtgtcccaagaatgaagatgtatggttggaggcttgtaggcttgcgagcccggatgaggccaaggctgtgattgctaagggagtgaaatcaattcccaattcagtgaagttgtggttacaggctgctaaattagagcatgatgatgtgaataaaagcagggttttgaggaggggtttggagaacataccggattctgtgaggttatggaaggctgttgtggagcttgcaaatgagaaggatgcagcgactttgcttgaaagggccgtggagtgctgtcctttacatgtggagttgtggttagcacttgctaggttgaaggattatgataaagctaagaaagtgcttaatagggcaagggagaagttgcctaaagagcctgctatatggattacagctgcgaagttggaggaggctaatggaaataatgctatggtgggaaagattattgagaggtgtattagggcattacaaagagaaggatttgtgattgatagggaggcttggatgaaggaggctgaggcggcagaaagggctggctctgttgtgacatgccaggcaatcattcgaaatacaattgggattggagtggaggaagaggataggaagagaacttgggtggctgatgctgaagaatgcaagaagcggggttcaattgagactgctagagctatctatgctcacgctcttactgtctttttgacaaagaagagcatttggctgaaagcagctcagctggagaagagtcatgggactagggaatctcttgatgctcttcttcgtaaagcagtcacgtaccggccacaggctgaggttctttggcttatgggtgccaaagagaaatggcttgctggggatgtgcctgctgcacgtgctatccttcaagaagcatatgctgccatacctaattctgaggagatatggcttgctgcgtttaagcttgaatttgaaaaccatgagcctgagagagcaagaatactccttgccaaggctcgagaaagaggaggcacagagagagtatggatgaaatcagcgattgtggagagagaattggggaacaccgaggaagagaggaggttgcttgatgaaggattgaagcaattcccatcattttttaaactgtggttgatgcttgggcagctcgaggaaaggcttggtaacttagaaaaggcaaagggagtttatgaatcaggtttaaagcactgccccagttgtatacctctatgggtttctcttgctattcttgaagagaaaatgaatgggattgctaaggctcgagctgtactcaccttggcaaggaagaagaatccacaacaacctgaactctggcttgctgccatacgagctgaggcaagacatggctacaagaaggaagccgatatcttaatggccaaggcattacaagagtgtccaaatagtggtatattgtgggcggcatctattgagatggttccaaggcctcaacgtaaaaccaagagcatggatgccctcaagaagtgtgatcatgatccccatgtcattgccgcggtggctaagctattttggcatgataggaaggtggataaagccaggacttggctaaatagggctgtgactcttgctccagatattggggatttctgggcattgtattacaaatttgaacttcagcatggtagtgaggagaaccagaaagatgtgatgaaaagatgtgttgctgcagaaccgaagcatggtgagaaatggcaagctatttcaaaggctgtagagaactctcaccaggctactgaagccattttaaagaaagtagtggttgtgttgaaaagagcccatttccgttacataaaattacagaatctcccctttttcttttgacatggcgagcgagaaggaaaatcatgttgtgaatggtgaagatgaggaagaagaggagaagatggagcagttttttgcgctgttaaggaattttcgagaggcgcgtaataggcgaaaacatgagctgatacaaagagagcaggaagagaaaagtaagaagaagaagaaaaacaagataagtaagttgggtgatgatggtgagaaatccagttgggttccaagcttcgaatgggaagattttactgcagagattgagtttcgaagaccatccatcatctttccaccctctttcaacaacaaacaagaggagaaaaaacacgaagatgatggtttggatcttaacctcaccctgtccccagcttcatcttaattttcttgttcaaatagaatattcctttctagtttttttttctttttgggggtaaaagaagaaaagctccatttggagtttgatcataatgtaaaatttaattaattgatgttaatgatcaatgttgaatctcgttcctcttggatattgagttagaagtgggttggtaaggtaggagcataccgtaagttttcttttggaattggatttcatagatggcaaaggatctgatgtaattaggtcgctggtaagagccggagatttgttaattgttttgtttgttgcttgagatttgggaattcaacaacagtacttagtttttgtggtctcagtaagattggaaaccccccccggggcgcccctcacgtggcctgatattttcttggggccaaaccccaaaaaccatttctatgctacatgcgtccttagatggatggtgaggttatttttgataaggttaaaaacaagtgtcgttataagaattaaacacctgcgcgg

SEQ ID NO: 3596 - DNA, 3114 bp, Amsonia hubrichtii
aactcaagctagaccttccggtctccctccaacgcttgtacctttccccacgcctgctgtcgactcctcaagacgatggcgttttcctctccgtccttggggttttgccccattcaaccctaaccctgcacgttcctctcatgggcggcatgcaagctcccgttgtacctaagaataccagactcgacttcctgaatacgaggccgccccctaattatgttgctgggctgggtcgtggtgctacgggttttactacccgttctgatattggtcctgcccgtgctgcaccggaccttcctgataggtctcttggtgctgctgctggcgcgcctggcgtaggccgtggcagaggaaaaggagggcctggcgaggaagaggaggaggaggagaatgatgagaagggttacgatgagaatcagaaatttgacgagtttgaaggaaatgatgtgggactgtttgcttcggccgagtatgatgacgaggataaggaggccgatgctatatgggaggccattgacaagaggatggacttgaggaggaaggatagaagggaagcaaggttgaaggaagaaattgaaaagtaccgtgcttctaatccgaagattactgaacaatttgctgatttgaagaggaaattgcatacaatgtcgaatgaggagtgggagagcataccagaaattggggattactcattaaggaataagaaaaagaggtttgagagctttgtgcccgttccagatacccttttggagaaggctaggcaggagaaagagcatgtcactgcactggatccgaaaagtagagctgttggtgggactgagactccatggtctcagactcccgttacagatttgacagctgttggtgaagggaggggcactgtgttgtccctgaagttggataggctctctgattcagttactggacagacagtagttgatccaaagggttatttgactgatttgaggagtatgaagattactagtgatgcggagatttctgatattaagaaagctagaatgttgcttagttcggtcatacattctaatccaaagcatccaccaggatggattgccgcagcaaggttggaagaggtggctggaaagattcagtccgccagacagcttattactaaaggctgtgaggaatgtccaaaaagtgaggatgtatggctggaggcctctaggttggcaaacccagatgaatctaaggcagtcatagccagggctattaaggctaatccaacttcggtgagactgtggctggaggctgcaaaattggaacatgatgacgcaaacaagagtagggtgttgaggaagggcctcgagcgcattccagattcggtgaggctctggaaggctgttgtggagcttgctaatgaagaagatgcgagacttctgctacacagagctgtggaatgttgccccttgcgtgtggagttgtggattgctctagctaggctggagacttatgataactctaagaaggttcttaatactgcaagggagaagctccctaaagagccagctatttggatcactgctgcaaagctggaggaagccaatgggaatgtttctatggttggaaaaattgtagaaagggctattagggctttacagagagaaggccttgagattgacagagaagcttggatgaaagaagctgaggctgcagaacgcgctggttctgttgtgacttgccaggctatcattcgtaacactatagggataggggtggaggaagaagataggaagaggacctgggttgcagacgcagaggagtgcaagaaaaggggttccattgagactgccagggcaatttatgctcatgcccttacagttttcttgaccaagaagagcatatggcttaaagctgcacagcttgaaaagagccatggcactagggaatctcttgatgctctgcttcggaaggcagttacatatataccacatgctgaagttttgtggttaatgggtgccaaagagaagtggcttgctggtgatgtgcctgcagctcgagcaattcttcaggaagcatacgctgcaattcctaattctgaggagatctggctagctgctttcaagctggagtttgagaaccatgaaccagagagagcaagaatgcttcttgctaaggcacgagagaggggaggcacagagcgagtatggatgaaatccgcaattgttgagagggaactgggtaacacggaggaagaaaggaagctgctggatgaaggtctgaagcgcttcccttcatttttcaaactctggttgatgctagggcagctggaggaaagactccataatttggagcaagcaaaggaaacatatgagtcaggtctgaagcactgtcccagttgtattcctctgtggctctcacttgcaaatctggaggagaagatgaatggacttagtaaagctcgagcggtccttaccatggccaggaagaagaatcctcggaatcctgaactttggcttgctgctgttcgtgctgaatctcggcatggctacaagaaggaggctgacaattttgatggccaaggcactacaggagtgcccgaacagcggtattctctgggctactgccattgacatggttcctcggcctcagagaaagtccaggagtgcagatgcatataaaaaatgtgatcaagatccttatgtgatagctgctgtggccaagttattttggcatgacaggaaggttgacaaggctcgaaattatctcaacagggcagttactcttgctccagatattggggatttttgggtattgtattacaaatttgagcttcagcatggcaatgaagagactcaaagggatgttgtgaaaagatgtgttgctgcagaacccaagcatggggagaaatggcaagcaatatctaaggctgtggaaaattctcaccaaccaacagaggctattttgaagaaggtggtagtttcactagggaaggaagaaaatgcagctgagaatggcaaagattagttggctgtgcttcttgagccttcctttagtttgggtttgcggtaaagacttgctttattgcagagagtaatcctggatcatcttggtgtccttgtgcaaattctgtgaacccttttgattattttgagg

SEQ ID NO: 3597 - DNA, 3125 bp, Lotus japonicus
ccatggtgttcatcgtgcccccgcacggcagaaccctagccctcaacataaaccccaaaaccaccaccctccatctcctcaaactcgccattgaacaaacccatggcatacccgtttcgcaacagcgcttgctcctctcacacagtctccgattgcttggagtaaacgattccctcctcatctctgacctcggtgtgggaccctactcaacgctcacccttcatgttcctttatacggcggtatgcaacctccggtggttcctaagccgcggttcgatttcctcaactcgaagccgccgccgaattacgtcgctggacttggtcgtggcgccaccggtttcactacccggtctgatatcggacctgcccgtgcagctcctgatcttcctgacagatctgcggccgctgccagtggcgccggaagggggagagggaagggtggtgaggatgaggaggatgaggaaggggaagataaagggtatgatgagaatcagaagtttgatgagtttgaagggaatgatgttgggttgtttgcttctgcggagtatgatgaggatgataaggaggctgatgcggtttgggaggagattgataagagaatggattcacggaggaaagatagaagagaggcgaggttgaaggaggagattgagaagtatagagcttctaaccccaaaatcactgaacaatttgctgatttgaagcggaagctgtataccctttcttcagatgattggcagagtttagagaagtttgagagtggagggtattcctcaaggagtaagaagaagaggtttgagagttttgtacctgtgcctgatactcttcttgagaaggcaaggaaggagcaagagcatgtgtcagctttggatcccaagagcagggttgctagtgggactgagactccctgggcacaaaccccagttactgatttgactgctgtgggagagggaagaggtactgtgttgtccttgaagttggataggctgtctgattctgtttcagggatgactaatgtggatccgaaaggttatttgactgttctgaatagtatgaagataacaagtgatgctgagatttctgatttcaagaaggcaaggttgttgcttaagagtgttactcagaccaatcctaaacatcctcctggctggattgcggctgccaggttggaggagctggctggcaagcttcaagtggctaggcaattgatagagaagggatgtgaagagtgtcccaagaatgaagatgtatggttggaggcttgtaggttggcgaatcctgaggaagccaaggctgtgattgctcagggtgttaagtcgattccaagttctgtgaagttgtggctgcaggctgcaaaattagaacacgatgatgcgaacaggagtagggtgttgaggaaaggcttggagcacatccctgattcagttaggctttggaaggcggtggtggagctcgcaaatgaacatgatgcgagtcttttacttcacagagctgtagaatgttgtccgttgcatgttgaattgtggctcgcacttgcaagattggaaacatacgacaatgctaagaaggtcctaaatagggcaagggagaggctgcccaaggagccggccatatggataacagctgccaaattagaagaggctaatgggaatacttccatggttggtaagataatcgaaaggggtatcagggctttgcagagggaaggtgtggtgattgatagagaagcttggatgaaggaagccgaggcagcggaacgtgctgggtctgttgcaacttgccaatcaataatccaaaatacaattggaattggggttgaagaagaagataggaagaggacatgggttgccgatgcagaggagtgcaagaaaagaggttccattgagactgctagagctatatatgctcatgccttgaccttgtctgttttcatgcagaagaagagcatatggctcaaagcagcccaacttgaaaagagtcatggtaccagggaatcccttgatgctttacttcgtacagcagttaagtatataccacaggcggaagttctttggcttatgggtgctaaagagaagtggttggctggagatgtgcctgcagcccgtgctattctccaagaagcttatgctgccattcccaattctgaggaaatatggcttgctgctttcaagctggaatttgaaaatcatgaacctgagagagctagaatgttgctggctaaagccagagagagaggaggtacagaaagagtgtggatgaaatcagcaattgttgagagagagctgggaaacattgaggaggagaggagattgttagatgaaggattgaagcaattcccttcattctttaaattgtggttgatgcttggccaactcgaggagcgacttggtgagaatgcaaagaggcttgatcagcctgagaagcggcttgatcacttgaaggaagccaagaaggtgtatgaatctggactgaaaaactgtcctaattgtgtaccgctttggctctctcttgctactcttgaagaggagacgaatggactgagtaaagctcgagcagttctcaccatggctcgaaagagaaatcctcaaaatcctgaactctggctggcagctgttagagcagagttgaagcatgcaagtaagaaagaagctgataatttgatatcaaaagcattgcaggaatgtcccaatagtggtattttgtgggcagctgctattgagatggttcctcgtccccagcgtaaaaccaagagtatggatgctcttaagaaatgtgaccatgatccccatgttattgctgctgtggccaaattattttggcatgataggaaagtggacaaagctcggacttggctgaatagggctgtaacactagctcctgatattggggatttctgggcattgtactacaaatttgaactccaacatggagctgaggagaaccagaaggatgtattgaagagatgtgttgctgctgaaccaaaacatggagagaagtggcaagtaatctcaaaggcagttgagaacgctcaccaaccgtcagaatccatcttgaagaaagtggtggttgcacttgggaaggaagagaatgcagctgataataatagtaaacattgatttaccaag

SEQ ID NO: 3598 - DNA, 873 bp, Solanum phureja
  misc_feature (804)..(807): n is a, c, g, or t
aaaaatttatatcaaaaatcaaatctttcatggatcattctccaaaaaagtggtaaattttccatacccagaaaatcccaagaaccaaaaagcaaatggggcagaatactggtgcaagtggcaaagggaagaaagaagcagaaatggaaaaggaaacggtagtagaagaagaagaagttgaagaaggtggagaagaagctgaacaagatggaatgtctgttcattctccctgtaaacctgcatcttctgctcttcgtaaggaacagtcacaggtggaattggagataagattgttggaggctcttgaaatctatccccctgccaaattgagaggcatccatcgtcattttgtcctatacggcttaacagagcatctgcgtagaagcttcaataggcaatttgctcccgatgaagttttgaagctgctggatcgcttctacaacttggatatggtgaaaccagaggacgaggactctgaaatcctaaatcaggaggaagagttttgcctacctcacagctatttctcgaaggatgaaccttgaactagtttggattcgatatggatattgaactttcacatatggcagtttttgtatagtagtatctgggtggttacattatttttttttgatgccatagagattctgcatcttaatcttactgaaaagtttgtatgcatgctgataattgatttcagctttccttatatatagacagcctccatccacacaccctctttctgtacttgatatattgtgaagcatcaacatcccttgtgctaagagatgctgtctacatcacatnnnntgccacccttacacagactgtgtgaacatgagatgctttgtgcatcgagctgtccttttgaatctg

SEQ ID NO: 3599 - DNA, 715 bp, Capsicum annuum
gaaaacccctttcaagaaaccaaaaaattacataaaaatcaaatctttcatcattctccaagaatttgctaatttccaacaccccaaaaaacccaaagagcaaaaaaaagcaaatggggcatcaaaacaatgggaaaggaaagaaagaagaagaaatgaagaaggaaagagtagtagaagaagaagaagttgaagaaggtggtgaagaaggtgaacatgatgaacaagatggaatgtctgttcattctccttgtaaacctgcttcttctgctcttcgtaaggagcaatcacaagtggaattggagattagattgttggaggctcttgaaatctatccccctgccaaattgagaggcatccatcgtcattttgtcctttacggcttaacagaatatctgcgtagaagcttcaataggcattttgctcctgatgatgttttgaagctgctggatcgcttctacaacttggaaatggtgaaaccagatgatgaggatgcagaaatcctaaatcaagaggaagagttttgcctgccgcatagttatttctcgaaggaggaaccttgaacaagttcggaatcaatgtggatattgaactttaacatatggcagcttttgtatagtagtaacaggttgttaaatttttgttttttgatgccataatcattctgcatcttctgttggatcttccttcacaggcagtcttgtatgcttgctga

SEQ ID NO: 3600 - DNA, 617 bp, Nicotiana tabacum
  misc_feature (21)..(21): n is a, c, g, or t
  misc_feature (40)..(40): n is a, c, g, or t
agaggaaatgaaaaaggaaanagtagaagaagaagaagangaagaagaggaagtagaagaaggaggagagcatgacgaacaagatggcatgtccgtacattctccttgtaaacctccctcttctgctcttcgtaaggagcaatcacaggtggaattggagataagattgctggaggctcttgaaatctatccccctgccaaattgagaggcatacatcgtcattttgtcctttacggcttaacagaatatctgcgtagaagcttcaataggcagtttgctcctgatgatgttttgaagctgctggatcgcttctacaacttggaaatggtgaaaccagatgacgaggatgcagaaatcctaaatcaagaggaagaattttcgttgccagagagttatttctcgaaggaagaatcttgaacgagtttgaaatcgatatggattttggacttcacctctggcaattcttgtatagtagtatcagaatggttaaattctttttgtttttgttgccataatcaatctggtactcttttcttgaatcttcttaaattggcaaattctaaaccttactgaaatttatgcatgctgagaattgatttcagctttcctaagcggc

SEQ ID NO: 3601 - DNA, 1371 bp, Triticum aestivum
ggatcagataagccgatgaaaaaaagaggtggggttcgaatagatagacacgcggtgcgaactaccctctgtgatcacttccgaggcagtttatccagcgaagcttagcaggcagcagcaatggcggccgagcccgagatctgcgtgctctccaatggcaggatcacggcgaacatcgccagctggggcgccactatcacctccctcctcgtccccgacgcgcaaggggatctcgcggatgtcgttcttgggttcgacacactggagccgtacttgaaaggcatggcgccttattttggttgcatagttggccgagttgcaaataggatcaagaacgggaagtttgatctgaacggagttgagtattcattgcctatcaacaatgtgccgaacagccttcatggtggattgaaggggtttgacaaggttgtgtgggatgttgtagagcgtaaagatggcgagtacccatcaataacctttcaatatgagagcaaagatggcgaagaaggttaccctggcgatgtaaccgtcagagcgatgtattctcttccggaggctaccactctaagacttgacatggaagctataccagctaacaaagccactcctatcagcttggcacagcatacttactggaaccttgcaggccacaactctggcagcatcttggatcattcgatccagatctgggcaaagcacatcactccagtcaatgaaaacacgattcctaccggagaaataatgcccgtccaggacacaccttttgatttcaccacggagcacaagattggagaccgcatcagcgatgttcctggagggtacgaccataactatgtgttggactcgggcgatgagaagaatggcttgaagcacgcagccaagctgaaggacccatcgagctcacgaactctggacctctggaccgatgcgcctggcatgcagttctatactgccaactatgtgaatggcatcacgggcaaaggtggagctgtttacggtaagcatgccggagtatgcttggaaacccaggggttccccaatgccatcaaccagcccaatttcccgtctgtggtggtgcagcctggtgcgaagtataagcacaccatgttgtttgagttctcggcatgattagagatgctgccggcagcttaaatggctgcaactgcaatagttatagagtggaataaaacgaccagaagaaaaaagtcaagttgtagtaccaaacaaaaataaaaagggtgtagtgaccagaactgagcgacatgatctcattcagaaaatcatgttcaagggtgtcttatattttggttgtgtatactgtgactgagaagaattgttcacatgcttgccaaaatattgaaggtcgtttgc

SEQ ID NO: 3602 - DNA, 1293 bp, Triticum aestivum
cctctgtgatcacttccgaggcagtttatccagcgaagcttagcaggcagcagcaatggcggccgagcccgagatctgcgtgctctccaatggcaggatcacagcgaacatcgccagctggggcgccactatcacctccctcctcgtccccgacgcgcaaggggatctcgcggatgtcgttcttgggttcgacacactggagccgtacttgaaaggcatggcaccttattttggttgcatagttggccgagttgcaaataggatcaagaatgggaagtttgatctgaacggagtcgagtattcattgcctatcaacaacgggccgaacagccttcatggtggattgaaggggtttgacaaggttgtgtgggatgttgtagagcgtaaagaaggcgagtacccatcaataacctttcaatatgagagcaaagatggtgaagaaggttaccctggcgatgtaaccgtccgagcagtgtattctcttccggaggctaccactctaagacttgacatggaagctataccagctaacaaagccactcctatcagcttggcacagcatacttactggaaccttgcaggccacaactctggcagcatcttggatcattcgatccagatctgggcaaaacacgttactccagtcaatgaaaacacgattcctaccggagaaataatgcccgtccaggacacgcctttcgatttcaccacggagcacaggattggagagcgcatcaacaatgttcctggagggtacgaccataactatgtgctggactctggcgatgagaagaatggcctgaagcacgcagccaagctaaaggacccatcgagctcacgaactctggacctctggaccgatgcgcctggcatgcagttctatactgccaactatgtgaatggcatcacaggcaaaggcggagctgtttacgggaagcatgccggagtatgcttggaaacccaggggttccccaatgccatcaaccagcccaatttcccgtctgtggtggtgcagcctggtgcgaagtataagcacaccatgttgtttgagttctcggcatgattagagatgctgccagcagcctagatggctgcaactgcaatagttgtagaatggaataaacgaccaggaaaaggaagtcaagttgtagtaccaggcgaaataaaaaggtgtggtgaccagaactgagtgacccattcagaaaatcatgttcaaaggtgtcttatattttggttgtgtataactgagaagaatttgttcacatgcttgccaaaatattggagttcgtttgc

SEQ ID NO: 3603 - DNA, 1270 bp, Leymus cinereus x Leymus triticoides
  misc_feature (29)..(29): n is a, c, g, or t
  misc_feature (46)..(46): n is a, c, g, or t
  misc_feature (58)..(58): n is a, c, g, or t
  misc_feature (140)..(140): n is a, c, g, or t
  misc_feature (175)..(175): n is a, c, g, or t
  misc_feature (265)..(265): n is a, c, g, or t
  misc_feature (316)..(316): n is a, c, g, or t
  misc_feature (343)..(343): n is a, c, g, or t
  misc_feature (370)..(370): n is a, c, g, or t
  misc_feature (472)..(472): n is a, c, g, or t
  misc_feature (687)..(688): n is a, c, g, or t
  misc_feature (703)..(703): n is a, c, g, or t
  misc_feature (708)..(708): n is a, c, g, or t
  misc_feature (716)..(716): n is a, c, g, or t
  misc_feature (776)..(776): n is a, c, g, or t
  misc_feature (784)..(784): n is a, c, g, or t
  misc_feature (886)..(886): n is a, c, g, or t
  misc_feature (922)..(922): n is a, c, g, or t
  misc_feature (958)..(958): n is a, c, g, or t
  misc_feature (961)..(961): n is a, c, g, or t
  misc_feature (967)..(967): n is a, c, g, or t
  misc_feature (1042)..(1042): n is a, c, g, or t
  misc_feature (1045)..(1045): n is a, c, g, or t
  misc_feature (1051)..(1051): n is a, c, g, or t
  misc_feature (1056)..(1056): n is a, c, g, or t
  misc_feature (1085)..(1085): n is a, c, g, or t
  misc_feature (1108)..(1108): n is a, c, g, or t
  misc_feature (1110)..(1110): n is a, c, g, or t
  misc_feature (1113)..(1113): n is a, c, g, or t
  misc_feature (1116)..(1116): n is a, c, g, or t
  misc_feature (1131)..(1131): n is a, c, g, or t
  misc_feature (1134)..(1134): n is a, c, g, or t
  misc_feature (1168)..(1168): n is a, c, g, or t
  misc_feature (1176)..(1176): n is a, c, g, or t
  misc_feature (1182)..(1182): n is a, c, g, or t
  misc_feature (1193)..(1193): n is a, c, g, or t
  misc_feature (1202)..(1202): n is a, c, g, or t
  misc_feature (1208)..(1208): n is a, c, g, or t
ctagctagcaggttcatccgaggcagcancaatggcggccgagccngagatctgcgtnctctccaatggcaggatcacggcaaacatcgccagctggggcgccaccatcacctccctcctcgtccccgacgcgcaagggnatctcgcggatgtcgttcttgggttcgacaccctngagccgtacttgaaaggcatggcaccttattttggttgcatagttggccgagttgcaaataggatcaagaacgggaagtttgatctgaanggagttgagtattcgttgcctatcaacaacgggccgaacagccttcatggnggattgaaggggtttgacaaggttgtntgggatgttgtagagcgtaaagatggngagtacccatcaatcacctttcaatatgagagcaaagatggcgaagaaggttaccctggcgatgtaaccgtccgagcaatgtattctcttcctgaggctacnactctaagacttgacatggaagctataccagctaacaaagccactcctatcagcttggcacagcatacttactggaaccttgcaggccacaactctggcaacatcttggatcatttgatccagatctgggcaaagcacatcactccagtcaatgaaaacacgattcctaccggagaaataatgcccgtccaggacacgccttttgatttcaccanngagcacaagattggngaccncatcaacnatgttcctggagggtacgaccataactatgtgttggactcgggcgatgagaagaatggcntgaagcangcagccaagctaaaggacccatcgagctcacgaactctggacctctggaccgatgcgcctggcatgcagttctataccgccaactatgtggatggcatcacnggcaaaggtggagctgtttacgggaagcatgccggngtatgcttggaaacccaggggttccccaatgccatnaancagccnaatttcccgtctgtggtggtgcagcctggtgcgaagtataagcacaccatgttgtttgagttctcggcatgattnganatgctnccagnagcttaaatggctgcaactgcaatagttntagaatggaataaaacgaccagnanaangangtcaagttgtagtancangcaaaaataaaaaggtgtagtgaccagaattgantgaccttntctcantcagaaaatantgttcaaangtggcntatgttttggttgtgtataactgaagaatttgttcacatgcttgccaaaatattggagttca

SEQ ID NO: 3604 - DNA, 1397 bp, Hordeum vulgare
ttcggcacgaggaagccgatgaaaaaaagaggtgggttcgaatagatagacactcggtgccaaacgcgaggggaactgatcacttccgaggcggtttgtctagcgaagcaagcaagcaggttcatccgaggcagcagcaatggcggtggagcccgagatctgcgtgctctccaatggcaggatcacggcgaacatcgcaaactggggcgccaccatcacctccctcctcgtccccgacgcgcaaggggatctcgcggatgtcgttcttgggttcgacaccctggagccgtacttgaaaggcatggcaccttattttggttgcatagttggccgagttgcaaataggatcaaggatgggaagtttgatctgaacggagtagagtattcgttacctatcaacaatgggccgaacagccttcatggtggattgaaggggtttgacaaggttgtgtgggatgttgtagagcgtaaagatggcgagtacccatcaataaccttccagtatgagagcaaagatggcgaagaaggttaccctggcgatgtaaccatccgagcaacgtattctcttcctgaggctaccactctaagacttgacatggaagctataccagctaacaaagccactcctatcagcttggcacagcatacttactggaaccttgcaggccacaactctggcaccatcttggatcattcgatccagatctgggcaaaacacatcactccagtcaatgaaaacacgattcccaccggagaaataatgtccgtccaggacacacctttcgatttcaccacggagcacaggattggagatcgcatcaacgatgttcctggaggatacgatcataactatgtgttggactcgggtgatgagaagaatggcctgaagcacgcagcaaagctaaaggactcgtcgagctcacggactctggacctctggaccgatgcgcctggcatgcagttctataccgccaactatgtgaatggcatcacgggcaaaggcggagctgtttacgggaagcatgcaggagtatgcttggaaacccaggggttccccaatgccatcaaccagaccaatttcccgtctgtggtggtgcagcctggtgcgaagtataagcacaccatgttgtttgaattctcagcatgattagagataatgccagcagcttaatggctgcaactgcagtagttgtagaatggaataaaacgaccagaagaaaggagtcaagttgtagtaccaaggaaaaataaaaaaaggtgtaatgatcagaactgagtgactttatctcattcagaaaataatgttcaaaggtggcttatattttggttgtgtataagtgagaagaatttgttcacatgcttgccaaaatatggagttcctttgcttatttgcatgc

SEQ ID NO: 3605 - DNA, 1232 bp, Avena sativa
tctagcgaagctaagccagcatccgaggcagcaacaatggcagccgagcccgagatctttgagctctccaatggcaggatcaccgcaaagatcgccaactggggcgccaccatcacctccctcctcgtccccgacgcccaagggaatctcgcggatgtcgttcttgggttcgacaccctggagccctacctgaagggcatggcaccttattttggttgcatagttggccgagttgcaaataggatcaagaatgggaagtttgatctgaatggagttgagtattcattgcctatcaacaatggaccgaacagccttcatggtggattgaaggggtttgacaaggttgtctgggatgtcgtcgagcgtaaagatggcgagtacccatcaatcacctttcaatatgacagcaaagatggtgaagagggttaccctggtgatgtaactatccgagcaatttattctcttcctgaggctaccactctaagacttgacatggaagctataccagctaacaaagccacccctatcagcttggcacaacatacttactggaaccttgcaggccacaactcgggcaacatcttggatcattcgatccagatctggggaaaacacatcactccagttgatgagaacacaattcccactggagaaataatgcccgtccaggacacgcccttcgatttcaccacagagcgcaagatcggggaccgcatcaatgatgttcctggagggtacgaccataactatgtgctggacttgggcgatgagaaggatggcctgaagcacgcagccaagctgaaggacacatcgagctcacggacgctggacctttggaccgatgcgcctggcatgcagttctatactgccaactatgtggatggcatcattgggaaaggtggatctgtttatgggaagcatgccggagtatgcttggaaacccaggggttccccgatgccatcaaccagccaaatttcccctctgtggtagttcagcctggtgcaaagtataagcacactatgttgtttgagttctcggcatgattagagatgctgccaaaagcttaaatggcacagcaacagtaatacttgtagaatggaataaaatgaccagaaagaaaatgtagtagtgccaggcgcaaaaaaaaggtgtagcgaccagaactgcgtgacactatctcaatcagaaaataatgtttcctcatgtttaaaggtggcttatattttggttg

SEQ ID NO: 3606 - DNA, 1270 bp, Avena sativa
ggaaacacaaccagtttatctagcgaagctaagccagcatccgaggcagcaacaatggcagccgagcccgagatctttgagctctccaatggcaggatcaccgcaaagatcgccaactggggcgccaccatcacctccctcctcgtccccgacgcccaagggaatctcgcggatgtcgttcttgggttcgacaccctggagccctacctgaagggcatggcaccttattttggttgcatagttggccgagttgcaaataggatcaagaatgggaagtttgatctgaatggagttgagtattcattgcctatcaacaatggaccgaacagccttcatggtggattgaaggggtttgacaaggttgtctgggatgtcgtcgagcgtaaagatggcgagtacccatcaatcacctttcaatatgacagcaaagatggtgaagagggttaccctggtgatgtaactatccgagcaatttattctcttcctgaggctaccactctaagacttgacatggaagctataccagctaacaaagccacccctatcagcttggcacaacatacttactggaaccttgcaggccacaactcgggcaacatcttggatcattcgatccagatctggggaaaacacatcactccagttgatgagaacacaattcccactggagaaataatgcccgtccaggacacgcccttcgatttcaccacagagcgcaagatcggggaccgcatcaatgatgttcctggagggtacgaccataactatgtgctggacttgggcgatgagaaggatggcctgaagcacgcagccaagctgaaggacacatcgagctcacggacgctggacctttggaccgatgcgcctggcatgcagttctatactgccaactatgtggatggcatcattgggaaaggtggatctgtttatgggaagcatgccggagtatgcttggaaacccaggggttccccgatgccatcaaccagccaaatttcccctctgtggtagttcagcctggtgcaaagtataagcacactatgttgtttgagttctcggcatgattagagatgctgccaaaagcttaaatggcacagcaacagtaatacttgtagaatggaataaaatgaccagaaagaaaatgtagtagtgccaggcgcaaaaaaaaggtgtagcgaccagaactgcgtgacactatctcaatcagaaaataatgtttcctcatgtttaaaggtggcttatattttggttgcacataattgagaacaattt

SEQ ID NO: 3607 - DNA, 1170 bp, Pseudoroegneria spicata
  misc_feature (6)..(8): n is a, c, g, or t
  misc_feature (1054)..(1054): n is a, c, g, or t
gtcccnnncgcgcaaggggatctcgcggacgtcgttcttgggttcgacaccctggagccgtacttgaaaggcatggcaccttattttggttgcatagttggccgagttgcaaataggatcaagaatgggaagtttgatctgaacggagttgaatattcattgcctatcaacaacgggccgaacagccttcatggtggattgaaggggtttgacaaggttgtgtgggatattgtagagcgtaaagatggcgagtacccatcaataacctttcaatatgagagcaaagatggcgaagaaggctaccctggcgatgtaaccgtccgagcaatgtattctcttcctgaggctaccactctaagacttgacatggaagctataccagctaacaaagctactcctatcagcttggcacagcatacttactggaaccttgcaggccacaactctggcagcatcttggatcattcgatccagatctgggcaaaacacatcactccagtcaatgaaaacacgattcctaccggagaaataatgcccgtccaggacacgccttttgatttcatcacggagcacaagattggagaccgcatcagtgatgttcctggagggtacgaccataactatgtgttggactcgggcgatgagaagaatggcctgaagcacgcagccaagctgaaggacccatcgagctcacgaactctggacctctggaccgatgcgcctggcatgcagttctataccgccaactatgtgaatggcatcacgggcaaaggcggagctgtttacgggaagcatgccggagtatgcttggaaacccaggggttccccaatgccatcaaccagcccaatttcccgtctgtggtggtgcagcctggtgcgaagtataagcacaccatgttgtttgagttctcggcatgattagagatgctgccggcagcttaaatggctgcaactgcaatagttatagagtggaataaaacgaccagaagaaaaaagtcaagttgtagtaccaaacaaaaataaaaaaggtgtagtgaccagaactgagtgacantatctcattcagaaaatcatgttcaaaggtgtcttatattttggttgtgtatactgtgactcagaagaatttgttcacatgcttgccaaaatattaaaggtcctttgcttgattta

SEQ ID NO: 3608 - DNA, 1369 bp, Setaria italica
aaagccgttttgctctcctacaagcaatcgaacaaacctcgcaagtcgagtcagcctcagcacccgagcagagtcccctcccattcggcggcgtcaatggcggccgagcccaagatcatcgagctctccaacggccggatcaccaccaggatcgccagctggggcgcaaccatcacctccctcctcgtccccgacgcccacgggaatgtcgcggatgtggtgctcggattcgatgacctggagccgtacatgaaaggcatggcaccttattttggatgcatagttggacgagttgcaaataggatcaaggatgggaagtttaccctaaacggagctgagtattcattgcctatcaacaatggacccaacagccttcatggtgggttgactggatttgacaaagtcatgtgggatgttgtagagcataaagatggcgaatgcccttcagtaacctttcagtatcacagcaaggatggggaagaaggctatccaggtgatgtaacagtcagagcaacatattctcttcctgaggccaccaccctaagacttgacatggaagccataccacatgataaagccactcctatcaacttggcacagcacacttactggaacctggcaggccataactctggtgacatcttaaatcatacaattcagatctgggggaagcacatcactccagttgacgaaaacacaattcccactggagagataatgcctgttgagggcactccttttgacttcacgacagagcacaagattggggagcgcatcaacgatgttcctggagggtatgatcataactatgtgctggactgtggggatgaaaaaaatggtgtgaagcatgcagccaagctgagagacccatcaagctcgcgaactctgaacctctggaccgatgcacctggcatgcagttctatactgccaactatgtgactggcatcactggcaaagggggtgctgtttatgagaaacatgccggtgtatgcttggaaacccaagggtttcctaatgccatcaaccaaccaaacttcccctcagtggtcgtgcagcctggtgagaagtataagcacactatgttgtttgagttttcagcctgaatggagaggctgtgaacagcttatatgactgcacaacttgtagaatgaagataaatgagcagaagaataaggtgtagttagcacatcttcgatgattgtatctttcttgtcttgcaaccagagaacaatattctggaatgttcaaagtttatacatttcttaattagaatggttgcacataattgtgaagattaacatgcgtgtgaactattaaacattcttgagaagggggcctgtcacagtggtacctctcaacttgtgtcct

SEQ ID NO: 3609 - DNA, 1382 bp, Oryza sativa
gagataacaaccttaccgcattgtttttggaagtgtgtgcgctgccgatgcgttgcttgattgcttcatcttcacgtgataaaaccgaaagcgacttctccgagtctcgtcaggtcagactcgcagtcgcagcaatggcggccgaggagatcttggagctctccaatggccgcatcaccgccaagatcgccgcctggggcgccaccatcacctccctcatcgtccccgacgcccacgggaatctcgcggatgtggttcttggattcgacactctggagccttacatgaaaggcatatcaccttattttggatgcattgttggccgtgttgcaaataggatcaaggagggaaagtttactctgaatggagttgagtattcactagctatcaataatggacccaacagtcttcatggtgggttgaaggggtttgacaaagtagtgtgggatgtagtagagcgcaaaagtgaatgcccatcaatcaccttccaatatcacagcaaggatggggaagagggctaccctggcgatgtgactgttcgagcaacatactctcttcctgattctaccaccttaagacttgacatggaagcagtagcagagaacaaagcgacgcccatcaacttggcgcagcacacctactggaacctggcagggcacaactccggtgacaccttggatcattcaatccagatctggggaaaacacataactccagttgacgagaacacgattcccaccggtgagataatgcctgtcaagggcacacctttcgacttcacaacagagcacaagattggagcccgcatcaacgatgtgcctggaggatatgaccataactatgtgctggactctggcgaagagaagaatggcctgaagcatgctgccaagctgaaagattcatcgaactcacggaccctggacctctggactgatgcacctggaatgcagttctacactgctaactatgtggatggcgtaactggcaaaggtggtgccgtttatgggaagcattccggagtatgcttggaaacccaggggtttcctaatgccatcaaccaacccaatttcccctccgtggtggtgcagcctggtgagaagtataagcacactatgctgtttgagttctcagcctaattagtgatgctgtgaacagctcaaatggctgcaactgcagctcattgtagaatcaaataagagaaaatctagcagaaatctaagatgtagagcaaagaataaatattagttaccagacctggatggttgtatcttgtcttacaaccagaataatataatacgaataaatatcagttaccagacctggatagttgtatcttgtcttacaaccagaataatataatacgaatgttcagaggtagattt

SEQ ID NO: 3610 - DNA, 1248 bp, Pennisetum glaucum
caagccatcgaacctcttcccccaagtcgaagcagagtcccctccctttcgtcggcgtcaatggccgccgagcccaagatcctcgagctctccaacggccggatcaccgccaggatcgccagctggggcgcaaccatcacctccctccttgtccctgacgcccacgggaatgtcgcggacgtggtgctcggattcgatgacctggagccgtacatgaaaggcatggcaccttattttggatgcatagttggacgagttgcaaataggatcaaggatgggaagtttaccctgaatggagctgagtattcattgcctattaacaatggacccaacagcctccatggtgggttgacgggatttgacaaagtcgtgtgggatgttgtagagcataaagatggtgaatgcccatcaataacctttcagtatcacagcaaggatggggaagaaggctatccaggtgatataacagtcagagcaacatattctcttcctgaggccaccactctaagacttgacatggaagccgtaccacatgacaaagccactcctatcaacttagcacagcacacttactggaacctggcaggccataactctggtgacatcttaaatcattcaattcagatctgggcgaagagcatcaccccagttgacgaaaacacaattcccaccggagagataatacccgttgaaggtactccttttgacttcacgacagagcacaagattggggagcacatcaatgatgttcctggagggtacgatcataactatgtgctggactgtggggatgaaaaaaatggtgtcaagcgtgcagccaagctgagagacccatcaagctcgcgaactctgaacctgtggaccgatgcacctggcatgcagttctatactgctaactatgtgagtggcatcactggtaaagggggtgctgtttatgagaaacatgccggtgtatgcttggaaacccaagggtttcctaatgccatcaatcaaccaaacttccccttggtagtggtgcagcctggtgagaagtataagcacactatgttgtttgagttttcagcatgaatggagaggctgtgaacagctcatatggttgcacaacttgtagaatgaaaataaatgagcagaagaatatgatgtagatgtgtagttagcacatcttcgatgactgtatcttccttgtgatgcaaccagagaacaatgttctttaatgctcaaagttcatacatttcttaattagaatgg

SEQ ID NO: 3611 - DNA, 1713 bp, Panicum virgatum
ggacagaaaacataaatccgttctctcccgcaagcaatcgaacctcccccgaaacaaagtcggcctcaagtgccagagcacacagctgagtcctcccccttccggcggcgtcaatggcgaccgagcccaagatcctcgagctctccaacggcaggatcaccgccaggatcaccagctggggtgccaccatcacttccctcctcgtccccgacgcccacgggaatgtcgcggatgtggtgctcgggttcgacgacctggagccgtacatgaaaggcatttcaccttattttggatgcatagttggccgagtagcaaataggatcaaggatggcaagtttgccctaaacggagctgaatattcattacctatcaacaatggacccaacagccttcatggtgggttgaagggatttgacaaagtcgtgtgggatgtcgtagagcataaagatggtgaatgcccatcaataacctttcagtatcacagcaaggatggggaagagggttatccaggtcatgtaacagtgagagcaacatattctcttcctgaggctaccactctaagacttgacatggaagccacaccacatgacaaagccactcctatcagcttggcacagcacacttactggaacctggcaggccataactctggtgacatcttgaatcattcagttcagatctgggggaagcacatcactccagttgatgaaaacacaattcccactggtgagataatgcctgttgagggcacacctttcgactttactacagagcacaagattggggaacgcatcactgatgttcctggagggtatgatcataactatgtgctggattgtggcgatgagcagaatggcgtgaagcacgccgccaagctgagagatccatcaagcttgcgaactctggacctctggactaatgcgccgggcatgcagttctacaccgccaactatgtgagtggcatcactggcaaagggggtgctgtttatgagaaacatgccggtgtatgcttggaaacccaagggtttcctaatgccatcaaccaaccaaatttcccctctgtggtggtgcagcctggagagaagtataagcacactatgctgtttgagttttcaacctgaatattgaggctgtgaacagctcaaatggttgcacttgtagaatgaaaataaatgagcagaagaataaggtgtggttggcacatatcaatgactgtatcaagtcatgcaaccagagaaaaatgttcttgaatgctcaaagttagatttacatatttcttaattagaatggttgcgtgtaattgagaacatcaaaatgcttgggaaaggagggcctgatgcagtggtagtctgccaatttgtggtgctagaggttctaagtttgaataagagaaagggtagtgctgcctagaaatgctcttccccatatcccagtttagatgggagcttcaagcactgggtgatccttttgttttaacatgcttgtgaactatcatcttttctatattttggtgagtgtaatgctgcagcaatattctttcatcctttggtacaagcatcataggcatgtctagtaagtaataaggatagaactcgttcaggttgggtatctatgacgacccagaatgctattcgtctagatttcaggacatgcagaagtcagtcacaccttgttgatgctaaaattgtaaaatacatatcatgacaatcatga

SEQ ID NO: 3612 - DNA, 1498 bp, Panicum virgatum
ctcccccgaaacagagtcggcctcagcgccagagcacgcagcagagacctcccccttccggcggcgtcaatggcggccgagcccaaaatcctcgagctctccaacggcaggatcaccgccaggatcgccagctggggcgccaccatcacctccctcctcgtccccgacgcccacgggattgtcgcggatgtggtgctcgggttcgatgacctggagccgtacatgaaaggcatttcaccttattttggatgcatagttggccgagttgcaaataggatcaaggatggcaagtttgccctaaatggagctgaatattcattacctatcaacaatggacccaacagccttcatggtgggttgaagggatttgacaaagtcgtgtgggaagtcgtagagcataaagatggtgaatgcccatcaataacctttcggtatcacagcaaggatggggaagaaggttatccaggtgatgtaacagtgagagcaacatattctcttcctgaggctaccactctaagacttgacatggaagccacgccacatgacaaagccactcctatcagcttggcacagcacacttactggaacctggcaggccataactctggtgacatcttaaatcattcagttcagatctgggggaagcacatcactccagttgatgaaaacacaattcccacaggtgagataatgcctgttgagggcacacctttcgacttcactacagagcacaagattggggaacgcatcactgatgttcctggagggtatgatcataactatgtgctggattgtggagataaaaagaatggcgtgaagcatgccgccaagctgagagatccatcaagcttgcgaactctggacctctggactaacgcgctgggcatgcagttctacactgccaactatgtgagtggcatcactggcaaagggggtgctgtttatgagaaacatgccggtgtatgcttggaaacccaagggtttcctaatgctatcaaccaaccaaacttcccgtctgtggtggtggagcctggagagaagtataagcacactatgctgtttgagttttcaacctgaatattgaggctgtgaacagctcaaatggttgcactagtagaacgaaaataaatgagcagaagaataaggtctggttggcacatatcaatgactgtatcttacttgtcatgcaaccagagaaaaatgttcttgaatgctcaaagttagatttacatatttcttaattagaatggttgcatataattgagaacatcaaaatgcttgggaaaggagggcctgatgcagtggtagtctgccaaattgtgctgctagaggtcctaagtttgaataagagaaagggtagggctgcctagaaatgctcttccccatatcccagtttagatgggagcttcaggcactgggtgatccttttttaacgtgcttgtgaactatcatgatttctatattttggtgcagtgtaatgctgcagtaatattctttc

SEQ ID NO: 3613 - DNA, 1577 bp, Brachypodium distachyon
gatttttcttctttatccctagaaatcctactaagcaaaacggcctcggcgatagacatgaatagcgtcgtaatccaaagggcctaaaagcccgcggggtagccaactctacatcggatagtttggatacagatcacgttgaatgggcccggaatagggccaaaggtctccgacgaaagcgcagagacggatccacaaagctttgaagtgtgtgcgacgagaattggataaatagatagaaacggacgcacggtaccaactgcacagcgcaagctttagcagattcgctcacgagcctccgaggcaagcagcaatggcggccgagatcttcgagctctccaatggcaggatcaccgccaagatcgccaactttggcgcaaccatcatctccctcctcgtccccgacgcccaaggggatctcgcggatgttgttctcggattcgacaccctggagccgtacttgaaaggcatttcaccttattttggctgcatagttggccgagttgcaaataggatcaagaatgggaaatttactctgaacggagttgagtattcattgcctatcaacaacggacccaactgccttcatggtgggctgagggggtttgacaaggttgtgtgggatgtcgtagagcgtaaagacgggaaagacccatctatcacctttcaatatcacagcaaggatggagaggaaggttttcctggcgatgtagtggtccgagcaacgtattctcttcctgagcctaccactttgagacttgatatggaagctatagcagaaaacaaagccacccccatcagcttggcacaacatacttactggaacctggcaggtcacaactccggtgacacattgggccattcgattcagatctggggaaagtactacacgccagttgacgaaaactcgattcctaccggagaaatagtgcctgtcaaggacacgcctttcgatttcaccacattgcacaaggttggagcacggatcaatgacgttcctggagggtacgaccataactatgtgctggactgtggtgatgagaagaacggcctgaagctcgctgccaagctgaaggacccgtcgacctcgaggaccctgaatctctggaccgatgcgcctggcatgcagttctatactgccaactatgtggatggcatcaccggcaaaggtggagctgtttatgagaagcattctgctgtatgcttggaaacccagggtttccccaatgccatcaatcagcccaacttcccctctgtggtggtgcagcctggtgagaagtataagcacaccatgttgtttgagttctcggcatgattagagatgctgtcaacagctcaaatggctgcaactgcagcacttgtagagtggaataaaactagcagaagaaacatggtctagccctaggcgtaaaaataaggtgtgtttaccagaactgaatgagttttaccttgcttaggaaacagtgttcctgaatgttccaatggtagatgatattttggttacacataactgagaagattttgctcacattcttgccaaaatattagagttcattctcttgtgaaattccgtattg

SEQ ID NO: 3614 - DNA, 1543 bp, Sorghum bicolor
cccacggagccagtggggcaaaggacgcacgtcataggtgcgggcggtgtagcacgtctgatgctgtgcggcgccgtcgcatctggaagtgcgtgcgtttggatagacagagagaagacccacagatcgaagcggcagcacaacagaaagccgtttaactactgtagcactgtaatccgctaagcaagcgaatcgagctcagagccctaacgagcgtcaatggcggccgagcccgagcccaggatcctagagctctccaacggcaagatcactgcgaggatctccaactggggcgccaccatcacctccctcctcgtccccgacgcccaagggagtatcgcggatgtggtgctcggattcgatgacctggacccgtacgtgaaaggcatgtcaccttattttggctgcatagttggccgagttgcaaataggatcaaggatggaaagtttagactcaacgaagttgagtattcattgcctgtcaacaatggacctaacagccttcatggtgggttgaggggatttgataaggttgtgtgggatgtcgtagaccacaaggatggtgaatgcccatcaataacttttcagtatcacagcaaggatggtgaagaaggctatccaggggatgtaaccattagggcaacatactcacttcctgaagctgctactctaagacttgacatggaagctacaccagaaaacaaagcaactcctataagcttggcgcagcacacctattggaaccttgcaggccatgcttccggtgacatcttaaatcattcaatacagatatgggggaagcacatcactccagttgatgaaaacacaattcccactggtgagataatgcccgtcaatggcacttcttttgatttcacaacagagcacaagattggagagcgcatcaatgatgttcctggagggtatgatcataactacatgctggactgtggcgatgagaagaatggcctgaagcatgcggccaagctgagagatccatcaagcttgcggaccctagagctctggactgatgcacctggcatgcagttctacaccgccaactatgtgaatgacatcagtggcaaagggggtgctgtctatgagaagcatgctggagtatgcttggaaacccaggggttccctaatgccatcaaccaacctaattttccctctgtagttgttcggcctggtgagaagtataagcacactatgctgtttgagttctcaaactgaatagtgattggacaacacaaatagctctaaaacatgttgaatgaataaacaagcagaagaataatatgtgataatgactgtaaatcttgtttgtcatggaaccagagaatgatcgaggtaaatttataaattttttaatgagagtggctctgaaactaatgattttggaaccatagaatagtgattttgattttgttcctgtcatggaaccagagaataacgttgcagtaatacatcttgtcctttatcacaaacatcggatgcatacctaataaagaaaaacccatcagcctgggtatccttgacgccc

SEQ ID NO: 3615 - DNA, 1495 bp, Sorghum bicolor
cataggtgcgggcggtgtagcacgtctgatgctgtgcggcgccgtcgcatctggaagtgcgtgcgtttggatagacagagagaagacccacagatcgaagcggcagcacaacagaaagccgtttaactactgtagcactgtaatccgctaagcaagcgaatcgagctcagagccctaacgagcgtcaatggcggccgagcccgagcccaggatcctagagctctccaacggcaagatcactgcgaggatctccaactggggcgccaccatcacctccctcctcgtccccgacgcccaagggagtatcgcggatgtggtgctcggattcgatgacctggacccgtacgtgaaaggcatgtcaccttattttggctgcatagttggccgagttgcaaataggatcaaggatggaaagtttagactcaacgaagttgagtattcattgcctgtcaacaatggacctaacagccttcatggtgggttgaggggatttgataaggttgtgtgggatgtcgtagaccacaaggatggtgaatgcccatcaataacttttcagtatcacagcaaggatggtgaagaaggctatccaggggatgtaaccattagggcaacatactcacttcctgaagctgctactctaagacttgacatggaagctacaccagaaaacaaagcaactcctataagcttggcgcagcacacctattggaaccttgcaggccatgcttccggtgacatcttaaatcattcaatacagatatgggggaagcacatcactccagttgatgaaaacacaattcccactggtgagataatgcccgtcaatggcacttcttttgatttcacaacagagcacaagattggagagcgcatcaatgatgttcctggagggtatgatcataactacatgctggactgtggcgatgagaagaatggcctgaagcatgcggccaagctgagagatccatcaagcttgcggaccctagagctctggactgatgcacctggcatgcagttctacaccgccaactatgtgaatgacatcagtggcaaagggggtgctgtctatgagaagcatgctggagtatgcttggaaacccaggggttccctaatgccatcaaccaacctaattttccctctgtagttgttcggcctggtgagaagtataagcacactatgctgtttgagttctcaaactgaatagtgattggacaacacaaatagctctaaaacatgttgaatgaataaacaagcagaagaataatatgtgataatgactgtaaatcttgtttgtcatggaaccagagaatgatcgaggtaaatttataaattttttaatgagagtggctctgaaactaatgattttggaaccatagaatagtgattttgattttgttcctgtcatggaaccagagaataacgttgcagtaatacatcttgtcctttatcacaaacatcggatgcatacctaataaagaaaaacccatcagcctg

SEQ ID NO: 3616 - DNA, 1172 bp, Zea mays
atcccacgctagtaaaggacccccgctagtaaatcgagctcggaggcgaatctctcgctaactgtcatcaatggcggccgagcccaagatcctagagctctccaacggcaagatcaccgcgaggatctccaactggggcgccaccatcacctccctcctcgtccccgacgcccaggggagtgtcgctgatgtggtgctcggattcgatggcttggatccgtacgtgaaaggcatgtcaccttattttggctgcatagttggccgtgtcgcgaataggatcaaggatgggaagtttacactaaacggacttgagtattcattacctgtcaacaatggacctaacagccttcatggtgggttgaagggatttgataaggtcgtgtgggatgtcgtggagcacaaagatggcgaatgcccttcaataacttttcagtatcacagcaaggacggggaagaaggctatccaggcgatgtaaccattcgagcaacatactctcttcctgaagctactactctaaggcttgacatggaagctacaccagagaacaaagcaactcctataagcctggcgcagcacacctactggaacctcgcaggtcacgcctgcggcgacatcttaaaccactcgctgcagatctggggcaagcacatcactccggtcgacgagaacacaattcccaccggcgagataatgcccgtcgatggcaccccttttgacttcacgacggagcgcaggattggcgagcgcatcgacggtgttcctggagggtatgatcataactacgtgctggactgtggcgacgagaaggacggcctgaagcgtgcggccaggctgaaagatccgtcgagcttgcggaccctggacctgtggactgacgcacccggcatgcagctgtacactgccaactacgtggatggcatcggtggcaaggcgggcgctgtctacgcgaagcatgctggagtgtgcttggaaacccaggggttcccgaatgccatcaaccagcctgagtttccctctgtggttgttcggcccggtgagaagtataagcatactatgctgtttgagttctcgggatgttgaatagtgactggacagcataaattgatgtaaaacatgttgaatgaataaacaagcagaaggataagctgtgataataatgcactagtttgct

SEQ ID NO: 3617 - DNA, 1666 bp, Festuca arundinacea
  misc_feature (589)..(589): n is a, c, g, or t
  misc_feature (820)..(820): n is a, c, g, or t
  misc_feature (847)..(847): n is a, c, g, or t
  misc_feature (1030)..(1030): n is a, c, g, or t
  misc_feature (1199)..(1199): n is a, c, g, or t
  misc_feature (1306)..(1306): n is a, c, g, or t
  misc_feature (1336)..(1336): n is a, c, g, or t
  misc_feature (1342)..(1342): n is a, c, g, or t
  misc_feature (1417)..(1417): n is a, c, g, or t
  misc_feature (1419)..(1419): n is a, c, g, or t
  misc_feature (1426)..(1426): n is a, c, g, or t
  misc_feature (1440)..(1440): n is a, c, g, or t
gcacgaggggccgccccactttgaccggctcctcctctcctctgctccacccacccgccggcgggagaggccagcggcggcgcgcgaggagggtagcgtcagcgccccggcggcgaagatgttcggccggtcgcccaagaagagcgacaacaccaagtactacgagatcctcggggtgcccaagaccgccgcccaggacgacctcaagaaggcctaccgcaaggccgccatcaagaaccaccccgacaagggcggagaccccgagaagttcaaggagctagcacaagcttatgaggttttgagtgaccctgagaagcgtgagatctatgatcagtatggtgaagatgccctcaaggaaggaatgggaggaggaggaggaggtggagttgatccatttgacatcttctcatcattctttgggccctcttttggaggtggtggtggcagcagcaggggcagaaggcaaaggaggggagaggatgttgttcatccactgaaagcttctctagaagatctttacaacggtacctcaaagaagctctctctttcccgcagcgtcctctgctccaagtgcaagggcaagggctcnaagtctggtgcttccatgaggtgcccaggttgccagggttcaggcatgaaagtgactatccgtcagctgggtccttccatgatacagcagatgcagcagccttgcaatgaatgcaggggtactggagaaagtattaacgagaaggatcgctgcccaggctgcaagggtgagaaggttcatcaggagaagaaggttctggaggtccatgttgagaaggggatgcaacacaancagaagatcaccttccctggagaagcngatgaagcgcctgatactgttactggggacattgtatttgtcgtccagcagaaggaacacccgaagttcaagcggaagggtgacgatctcttctatgagcacaccttatctctcactgaagctctctgtgggttccaacttgttctgacccatctggacaacaggcagctgctcgttaagtcnaaccctggtgaagttgttaagcctgattcattcaaggcaatcagcgacgagggaatgccgatgtaccagaggcctttcatgaagggcaagctctacatccatttcaccgtagacttccccgactccctggcgcctgaccagtgcaaggctctcgaggccgtgcttccancaaagcctgcttccaagctgactgacatggagcttgatgaatgcgaggagacaacgatgcatgatgtgaacaacatcgaggaagagatgcgcaggaaagcccaggcngctcaggaggcgtacgacgaggatgatganatgccnggaggcggtggccaaagagtgcagtgcgcacagcagtaagcaagcggagtacattatctaggaacctgtcgttgntncgccaangttggcagcaagtntgtttggatccaagatgcctgctctctggttttggtgttgctatcgatgaagctgatttaggggcgtatggcgccaggactgtatccctccttgcctttgaaaattgctatccaggaatagcttgctacttttgctgtagtatgatacctcgtagtacgagtgcttcctataatggtaatcttgtggtggacactacaatgcacggtctctgaatatgtttgtcta

SEQ ID NO: 3618 - DNA, 1033 bp, Brassica rapa
gaatcttttgcgaacgaacacaaacgcagaagaacagaacatcctaagatcttcccagcgatcttcaatcgattgggtggaggtagaagagatcgaagtgtggttttattcaaagccggtgaattaagcaagatcttcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggccaaagaatacactcgtgctaagaacaaacgcgcggctatacagtgtttgaaaaggaagaggttatatgagcaacaagtcgaacagcttggcaatttccagctccgtatacatgatcagatgattatgttagaaggcgcaaaagcaacaaccgaaactgtcgatgctttgaggagtggagcttctgcaatgaaagcaatgcagaaagctacaaatatcgatgatgtagacaagaccatggatgagatcaatgagcagacagagaacatgaaacagatccaagaagcattgtctactccaatcggggcagcagctgacttcgacgaggatgagctagaagcagaactcgaggaactagaaggtgcagagcttgaagagcagcttcttcagccgaccacagtattgccttcagttcctgcagggcgtcaacaagcacgtcctatacctaagaggaccgcagaggaggaagaacttgctgcattacaggctgagatggccctctaaggttatttcacgattcggagcagacctgtatgcattgataaacacgaacaggcgatgtatatatggatttcaatgtcaaaatttaaaaccctgagcggaagaacttataataataattgtcgtcgtgcatgttattttatcaaacattctactgtttcgtttccttcacatatatttatcatcttttgtatttcttttgaaactctttttccttttgggtaatctaatgggttaatacctcgtgc

SEQ ID NO: 3619 - DNA, 972 bp, Brassica napus
aaacgcagaagaacagaacatcctaagatcttcccagcgatcttcaatcggggggggggaggtaggagagatcgaagtgtggttttattcagagccggtgaattaagcaagatcttcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggccaaagaatacactcgtgctaagaacaaacgcgcggctatacagtgtttgaaaaggaagaggttatatgagcaacaagtcgaacagcttggcaatttccagctccgtatacatgatcagatgattatgttagaaggcgcaaaggcaaccaccgaaactgtcgatgcattgaggagtggagcttctgcaatgaaagcaatgcagaaagctacaaatatcgatgatgtagacaagaccatggatgagatcaatgagcagacagagaacatgaaacagatccaagaagcattgtctactccaatcggggcagcagctgacttcgacgaggatgagctagaagcagaactcgaggaactagaaggtgcagagcttgaagagcagcttcttcagccgaccacagtattgccttcagttcctgcagggcgtcaacaagcacgtcctatacctaagaggaccgcagaggaggaagaacttgctgcattacaggctgagatggccctctaaggttatttcacgattcgaagcagacctgtatgcattgataaacacgaacaggcgatgtatataaggatttcaatgtcaaaatttaaaaccctgagcggaacttataataataattgtcgtcgtgcatgttatttttatcaacattctactgtttcgtttccttcacatatatttatcatcttttgtatttcttttgaaactcttt

SEQ ID NO: 3620 - DNA, 961 bp, Brassica napus
aaacgcagaagaacagaacatcctaagatcttcccagcgatcttcaatcgattgggtggaggtagaagagatcgaagtgtggttttattcagagccggtgaattaagcaagatcttcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggccaaagaatacactcgtgctaagaacaaacgcgcggctatacagtgtttgaaaaggaagaggttatatgagcaacaagtcgaacagcttggcaatttccagctccgtatacatgatcagatgattatgttagaaggcgcaaaagcaacaaccgaaactgtcgatgctttgaggagtggagcttctgcaatgaaagcaatgcagaaagctacaaatatcgatgatgtagacaagaccatggatgagatcaatgagcagacagagaacatgaaacagatccaagaagcattgtctactccaatcggggcagcagctgacttcgacgaggatgagctagaagcagaactcgaggaactagaaggtgcagagcttgaagagcagcttcttcagccgaccacagtattgccttcagttcctgcagggcgtcaacaagcacgtcctatacctaagaggaccgcggaggaggaagaacttgctgcattacaggctgagatggctctctaaggttatttcacgattcgaagcagacctgtatgcattgataaacacgaacaggcgatgtatataaggatttcaatgtcaaaatttaaaaccctgagcggaacttataataataattgtcgtcgtgcatgttatttttatcaacattctactgtttcgtttccttcacatatatttatcatcttttgtatttcttt

SEQ ID NO: 3621 - DNA, 973 bp, Brassica napus
aaacgcagaagaacagaacatcctaagatcttcccagcgatcttcaatcgattgggtggaggtagaagagatcgaagtgtggttttattcagagccggtgaattaagcaagatcttcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggccaaagaatacactcgtgctaagaacaaacgcgcggctatacagtgtttgaaaaggaagaggttatatgagcaacaagtcgaacagcttggcaatttccagctccgtatacatgatcagatgattatgttagaaggcgcaaaagcaacaaccgaaactgtcgatgctttgaggagtggagcttctgcaatgaaagcaatgcagaaagctacaaatatcgatgatgtagacaagaccatggatgagatcaatgagcagacagagaacatgaaacagatccaagaagcattgtctactccaatcggggcagcagctgacttcgacgaggatgagctagaagcagaactcgaggaactagaaggtgcagagcttgaagagcagcttcttcagccgaccacagtattgccttcagttcctgcagggcgtcaacaagcacgtcctatacctaagaggaccgcggaggaggaagaacttgctgcattacaggctgagatggctctctaaggttatttcacgattcgaagcagacctgtatgcattgataaacacgaacaggcgatgtatataaggatttcaatgtcaaaatttaaaaccctgagcggaacttataataataattgtcgtcgtgcatgttatttttatcaacattctactgtttcgtttccttcacatatatttatcatcttttgtatttcttttgaaactctttt

SEQ ID NO: 3622 - DNA, 944 bp, Brassica napus
aaacgcagaagagcagaacatcctaagatcttcccagcgatcttcaatcgattgggtggaggtagaagagatcgaagtgtggtttctccgtagccggtgaattaagcaagatcctcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggctaaagaatacactcgttcaaagaacaaacgcgcggctatacagtgtttgaaaaggaagaggttatatgagcaacaagtcgaacagcttggcaatttccagctccgtatacatgatcaaatgattatgttagaaggcgcaaaggcaaccactgaaactgttgatgcgttgaggagtggagcttctgcaatgaaagccatgcagaaagctaccaatatcgatgatgtggacaagaccatggatgagatcaatgagcagacagagaacatgaaacagatccaagaagcattgtctactccaatcggggcggctgctgacttcgatgaggatgagctcgaagcagagctggaagaactagaaggtgcagagcttgaagagcagcttcttcagccgaccacagtcttgccttcagttcctgcagggcgtcaacaagcacgtcctatacctaagaggaccgcagaggaggaagaacttgctgcattacaggctgagatggccctttaaggttattcacgattcggggcaggcctgtatgcattgataaacaagaacaggcgatgtatataaggatctcagtgtcaaaatttaaaaccctgagcggaacttataataataattgtcgtcgtgcatgttattttatcaacattctactgtttccttcacatatatttatcatcttttg

SEQ ID NO: 3623 - DNA, 968 bp, Brassica napus
gaaacgcagaagagcagaacatcctaagatcttcccagcgatcttcaatcgattgggtggaggtagaagagatcgaagtgtggtttctccgtagccggtgaattaagcaagatcctcaagtaatcatgatgaatcggctgttcgggaaaccaaagccggagacgaatgctctccagacattagacaaacttaacgagacacttgagatgctagagaagaaggagaaggtactcttgaagaaagctggacaagaggttgagaaggctaaagaatacactcgttcaaagaacaaacgcgcggctatacagtgtttgaaaaggaagaggttatatgagcaacaagtcgaacagcttggcaatttccagctccgtatacatgatcaaatgattatgttagaaggcgcaaaggcaaccactgaaactgttgatgcgttgaggagtggagcttctgcaatgaaagccatgcagaaagctaccaatatcgatgatgtggacaagaccatggatgagatcaatgagcagacagagaacatgaaacagatccaagaagcgttgtcgactccaatcggggcggctgctgacttcgatgaggatgagctcgaagcagagctggaagaactagaaggtgcagagcttgaagagcagcttcttcagccaaccacggtattgccttcagttcctgcagggcgtcaacaagcacgtcctatacctaagaggaccgcagaggaagaagaacttgctgcattacaggctgagatggccctctaaggttattcacgattcggggcaggcctgtacgcattgataaacaagaacaggcgatgtatataaggatctcaatgtcaaaatttaaaaccctgagcggaacttataataataattgtcgtcgtgcatgttattttataaacattctactgtttccttcacatatatttatcatcttttgtatttcttttgaaactctttttc

SEQ ID NO: 3624 - DNA, 965 bp, Brassica oleracea
  misc_feature (11)..(13): n is a, c, g, or t
gcgtccgcggnnncgtggggcagaagagcagaacatcctaagatcttcccagcgatcttcaatcgattgggtggaggtagaagagatcgaagtgtggtttcttcgtagccggtgaattaagcaagatcctcaagtaatcatgatgaatcggctgttcgggaaaccaaagccggagacgaatgctctccagacattagacaaacttaacgagactcttgagatgttagagaagaaggagaaggtactcctgaagaaagctggacaagaggttgagaaggctaaagaatacacacgttctaagaacaaacgcgcggctatacagtgtttgaaaaggaagaggttatatgagcaacaagtcgaacagcttggcatttttcagctccgtatacatgatcaaatgattatgttagaaggcgcaaaggcaaccactgaaactgttgatgcgttgaggagtggagcttctgcaatgaaagccatgcagaaagctacaaatatcgatgatgtggacaagaccatggatgagatcaatgagcagacagagaacatgaaacagatccaagaagcattgtctactccaatcggggcagcagctgagttcgatgaggatgagctcgaagcagagctggaagaactagaaggtgcagagcttgaagagcagcttcttcagccaaccacggtgttgccttcagttcctgcagggcgtcaacaagcacgtcctatacctaagaggaccgcagaggaagaagaacttgctgcattacaggctgagatggccctctaaggttattcacgattcggagcaggcctgtatgcattgataaacaagaacaggcgatgtatataaaggatctcaatgtcaaaatttaaaaccctgagcggaacttataataataattgtcgtcgtgcatgttattttatcaacattctactgtttccttcacatatatttatcatcttttgaaact

SEQ ID NO: 3625 - DNA, 1029 bp, Raphanus sativus
gggatcttaatcttctgtgaacacaaaaaacacggaagaacataaccaaaccaaaccagcaaagtcctaagatctccctccccagggaagaagagatcgaagtgtggttttcttcatagccggtgaattaaagcaagatcctctaagtaaccatgatgaatcgtctgttcgggaaaccaaaggtggagaacaatgctctccagacattagacaagcttaacgagacacttgagatgctagagaagaaggagaaggtactcttgaagaaggctggtcaagaggttgagaaggctaaagaatacactcgtgctaagaacaaacgcgcggctatacagtgtttgaaaagaaagaggttatatgagcaacaagtcgaacagcttggcaatttccagctccgtattcatgatcaaatgattatgttggaaggcgcaaaagcaacaactgaaactgttgatgcattaaggagtggagcttctgcaatgaaagcaatgcagaaagctacaaatatcgatgacgtggacaagaccatggatgagatcaatgagcagacagagaacatgaaacagatccaagaagcattgtctactcctatcggggcagcagccgacttcgatgaggatgagctagaagcagagttggaagaactagaaggtgcagagcttgaagagcagcttcttcagcccaccacagtattgccttcagttccggtgcctgcagggcgtcaagcagcacgtcctactcctaagcggaccgcagaggaggaagaacttgctgcattacaggctgagatggccctctaagggtttattcacgaactggagcagacctgtatgcattgataaaccaagaacaggcgatgtatataaggatctcaatgtcaaaatttaaaatcggagcgaaacttaataataaataatcctcgtcgtgcaatgttatttttatcaaacatttgactgttttcttcttcacatatactatttatcttttgtatttgatttggtaatctgatgggttacttactacgtaaga

SEQ ID NO: 3626 - DNA, 1045 bp, Raphanus sativus
gggatctcaatcttctgtgaacacaaaaacacggaagaacataaccaaaccaaaccagcaaagtcctaagatctcccccacccccagtgatctgcgatcgattcggttagggaagaagagatcgaagtgtggttttcttcatagccggtgaattaaagcaagatcctcaagtaaccatgatgaatcggttgttcgggaaaccaaaggtggagaacaatgctctccagacattagacaagcttaacgagacacttgagatgctagagaagaaggagaaggtactcttgaagaaggctggtcaagaggtcgagaaggctaaagaatacactcgtgctaagaacaaacgcgcggctatacagtgtttaaaaaggaagaggttatacgagcaacaagtcgaacagcttggcaatttccagcttcgtatacatgatcaaatgattatgttagaaggcgcgaaagcaacaaccgaaactgttgatgcgttgaggagtggagcttctgcaatgaaagcaatgcagaaagctacaaatatcgatgacgtggacaagaccatggatgagatcaatgagcagacagagaacatgaaacagatccaagaagcattatcgactcctatcggggcagcagctgacttcgacgaggatgagctagaagcagagttggaagagctagaaggtgcagagcttgaagagcagcttcttcagcccaccacagtattgccttcggttcctgtgcctgcagggcgtcaagcagcacgtcctactcctaagcggaccgcagaggaggaagaacttgctgcattacaggctgagatggccctctaaggttgtattcacgaaccggagaagacctgtatgcattgataaaccaagaacaggcgatgtatataaggatctcaatgtcaaaaaaatttaaaacctgagcgaaacttaataataaataatcctcgtcgtacaatgttatttttatcaacaattgacttttttttcgccacatatactattatcttttgtatttgatttggtaatctgatgggttacttact

SEQ ID NO: 3627 - DNA, 927 bp, Eutrema parvulum
acacgtgttagcacgattcacttcaacgcgtgtgaacaaaaggaaagttgcttccttcgatctaaatcttctgcgaacacaaacgcggaagaacaaacccagaaaaattttcccagtgatctgcaatcgattcggttgtggtagaagatatcgaagtgggttttgttcatcgcgaagtgatttaagaaacatccttaatcaaacatgatgaatcggcttttcggcaaacccaagcaggagacaaatgctctccagacattagacaagcttaacgagactcttgagatgctagagaagaaggagaaggtactcttgaagaaggctggacaagaggtcgagaaggcgaaagagtacactcgtgccaagaacaagcgcgcggctatacagtgtttgaaaaggaagaggttatatgagcaacaagtcgaacagcttgggaatttccagctgcgtatacatgatcaaatgattatgttagaaggcgcaaaagcgacaaccgaaactgttgatgcattgaggagtggagcttctgcaatgaaagcaatgcagaaagcaacaaatatcgatgatgtggacaagaccatggacgagatcaatgagcagacagagaacatgaaacagatccaagaagcgttgtcgactccaatcggggccgcggctgactttgatgaggatgagcttgaagcagagcttgaagaattagaaggtgcagagcttgaagagcaacttcttcagccgacaacaacattgccttcagttcccgtgccttccgggcgtcaaacaaaccgtcctgctgctaagcggaccgcagaggaagaagaacttgctgcattacaggctgagatggccctctaaggtcaattcacttttcttatctacacgcaaaaacaaatcaatcgattgtttctaacaatgtttaaattcacatat

SEQ ID NO: 3628 - DNA, 964 bp, Brassica juncea
aggaagcaaagatgatgaatcggctatttgggaagcccaagcatgagggtaatgctctccagacattagacaagctcaacgagacacttgagatgttagagaagaaggagaaagtgcttttgaagaaagctggacaagaggttgagaaagccaaagagtacactcgtgctaaaaacaaacgcgcggctatacagtgtttgaaaaggaagaggttgtatgagcaacaagtcgaacagcttggcaacttccagctccgtattcacgatcaaatgattatgttagaaggcgcaaaagcaacaacagaaactgttgacgcattgaggagtggagcttctgcaatgaaagccatgcagaaagctacaaacattgatgatgtggacaagaccatggacgagatcaatgagcagacagagaacatgaaacagatccaagaagcattgtctactcctatcggtgctgctgctgacttcgatgaggatgagcttgaagcagagcttgaagagctagaaggtgcagagcttgaagaacaacttcttcagccgacaccaatgccttcagttccagggcgtcaacccgtccgtcctgctgctcctaagcggacagctgaggaagaagaactcgctgcattacaagctgagatggccctctaaggttatggacttggtcgagcagatctgtgtatgcattgatgataaacaagaacatgcgatgtatatatataaaaggatcaccgagtcaaaattaaactggagcggaactttaagaatcatcatcgtcttgaatgttttcaacatttgacttgtttacatatattttatcgtgttttgtaatttttgaatcgtttggtacacgttgtttttctgcgttactactttttcttttgagggagattcatatcattatcctcctcaattaaaatcctctcacaatggatcagacacacatgtcaaaattattatcaaac

SEQ ID NO: 3629 - DNA, 996 bp, Brassica napus
ggtcctctctccgaagatttctattttctaatcgaaatccagaatttttcccagcaaacgattgggaagaagagattgaattaaggaagcaaagatgatgaatcggctatttgggaagcccaagcatgagggtaatgctctccagacattagacaagctcaacgagacacttgagatgctagagaagaaggagaaagtgctcctgaagaaggctggacaagaggttgagaaggccaaagagtacactcgtgctaaaaacaaacgcgcggctatacagtgtttgaaaaggaagaggttgtatgagcaacaagtcgaacagcttggcaacttccagctccgtattcatgaccaaatgattatgttagaaggcgcaaaagcaacaacagagactgttgatgcgttgaggagtggagcttctgcaatgaaagccatgcagaaagctacaaacatcgatgatgtggacaagaccatggacgagatcaatgagcagacagagaacatgaaacagatccaagaagcattgtctactccaattggggcagctgctgacttcgatgaggatgagcttgaagcagagcttgaagagctagaaggtgcagagcttgaagaacaacttcttcagccgacaccaatgccttcagttccagggcgtcaacctgtccgtcctgctgctcctaagcggacagcggaggaagaagaactcgctgcgttacaggctgagatggccctctaaggttatggacttggtcgagcagatctgtgtatgcattgatggtaaacaagaacatgcgatgtatatatatataaaaggatcacgtcaaaattaaactggagcttaactttaagaatcatcgtcgtcttgaatgttttcaacatttgacttgtttacgtatttttatattttatcttttcgtaatttttgaatcgtttattacacgttgtttttcgataatgtgcgtcgttactacttagtcctttgaatgagttgcgacaaag

SEQ ID NO: 3630 - DNA, 989 bp, Brassica napus
gaaaggtccggtcctctctccgaagatttctattttctaatcgaaatccagaatttttcccagcaaacgattgggaagaagagattgaattaaggaagcaaagatgatgaatcggctatttgggaagcccaagcatgagggtaatgctctccagacattagacaagctcaacgagacacttgagatgctagagaagaaggagaaagtgctcctgaagaaggctggacaagaggttgagaaggccaaagagtacactcgtgctaaaaacaaacgcgcggctatacagtgtttgaaaaggaagaggttgtatgagcaacaagtcgaacagcttggcaacttccagctccgtattcatgaccaaatgattatgttagaaggcgcaaaagcaacaacagagactgttgatgcgttgaggagtggagcttctgcaatgaaagccatgcagaaagctacaaacatcgatgatgtggacaagaccatggacgagatcaatgagcagacagagaacatgaaacagatccaagaagcattgtctactccaattggggcagctgctgacttcgatgaggatgagcttgaagcagagcttgaagagctagaaggtgcagagcttgaagaacaacttcttcagccgacaccaatgccttcagttccagggcgtcaacctgtccgtcctgctgctcctaagcggacagctgaggaagaagaactcgctgcgttacaggctgagatggccctctaaggttatggacttggtcgagcagatctgtgtatgcattgatggtaaacaagaacatgcgatgtatatatatataaaaggatcacgtcaaaattaaactggagcttaactttaagaatcatcgtcgtcttgaatgttttcaacatttgacttgtttacgtatttttatattttatcttttcgtaattttgaatcgtttattacacgttgtttttcgataatgtgcggcgttactacttagtcctttgaa

SEQ ID NO: 3631 - DNA, 909 bp, Brassica oleracea
  misc_feature (812)..(812): n is a, c, g, or t
  misc_feature (822)..(822): n is a, c, g, or t
cacgcgtccggaagaagagattgaattaaggaagcaaagatgatgaatcggctatttgggaagcccaagcatgagggtaatgctctccagacattagacaagctcaacgagacacttgagatgctagagaagaaggagaaagtgctcctgaagaaggctggacaagaggttgagaaggccaaagagtacactcgtgctaaaaacaaacgcgcggctatacagtgtttgaaaaggaagaggttgtatgagcaacaagtcgaacagcttggcaacttccagctccgtattcatgaccaaatgattatgttagaaggcgcaaaagcaacaacagagactgttgaagcgttgaggagtggagcttctgctatgaaagccatgcagaaagctacaaacattgatgatgtggacaagaccatggacgagatcaatgagcagacagagaacatgaaacagatccaagaagcattgtctactccaattggggcagctgctgacttcgatgaggatgagcttgaagcagagcttgaagagctagaaggtgcagagcttgaagaacaacttcttcagccgacaccaatgccttcagttccagggcgtcaacctgtccgtcctgctgctcctaagcggacagctgaggaagaagaactcgctgcgttacaggctgagatggccctctaaggttatggacttggtcgagcagatctgtgcatgcattgatggtaaacaagaacatgcgatgtatatatataaaaggatcacgtcaaaattaaactggagcttaactttaagaatcatcgtcgtcttgaatgttntcaacatttnacttgtttacgtatttttatattttatcttttcgtaatttttgaatcgtttgttacacgttgtttttcgataatgtgctgcgttact

SEQ ID NO: 3632 - DNA, 841 bp, Brassica rapa
gcttcgcccgcgcaggttcgtaccctgctgtcgacgccaaattgacctgagaaagtcatctctccgaagatttctaatttttttaatcgaaatccagatttttcccagtaatcgattgaattaaggaagcaaagatgatgaatcggctatttgggaagcccaagcatgagggtaatgctctccagacattagacaagctcaacgagacacttgagatgctagagaagaaggagaaagtgctcttgaagaaagctggacaagaggttgagaaagctaaagagtacactcgtgctaaaaacaaacgctcggctatacagtgtttgaaaaggaagaggttgtatgagcaacaagtcgaacagcttggcaacttccagctccgtattcatgatcaaatgataatgttagaaggcgcaaaagcaacaaccgaaactgttgatgcgttgcggagtggagcttctgcaatgaaagccatgcagaaagctacaaacattgatgatgtggacaagaccatggacgagatcaatgagcagacagagaacatgaaacagatccaagaagcattgtctactcctatcggtgctgctgctgacttcgatgaggatgagcttgaagcagagcttgaagagctagaaggtgcagagcttgaagaacaacttcttcagccgacaccaatgccttcagttccaggtcgtcaaccagtccgtcctgctgctcctaagcggacagctgaggaagaagaactcgctgcattacaagctgagatggccctctaaggttatggacttggtcgagcagatctgtgtgtgcattgatgataaacaagaacatgcgatgtatatat

SEQ ID NO: 3633 - DNA, 935 bp, Brassica napus
gagaaagtcatctctccgaagatttctaatttttttaatcgaaatccagatttttcccagtaatcgattgaattaaggaagcaaagatgatgaatcggctatttgggaagcccaagcatgagggtaatgctctccagacattagacaagctcaacgagacacttgagatgctagagaagaaggagaaagtgctcttgaagaaagctggacaagaggttgagaaagctaaagagtacactcgtgctaaaaacaaacgctcggctatacagtgtttgaaaaggaagaggttgtatgagcaacaagtcgaacagcttggcaacttccagctccgtattcatgatcaaatgataatgttagaaggcgcaaaagcaacaaccgaaactgttgatgcgttgcggagtggagcttctgcaatgaaagccatgcagaaagctacaaacattgatgatgtggacaagaccatggacgagatcaatgagcagacagagaacatgaaacagatccaagaagcattgtctactcctatcggtgctgctgctgacttcgatgaggatgagcttgaagcagagcttgaagagctagaaggtgcagagcttgaagaacaacttcttcagccgacaccaatgccttcagttccagggcgtcaacccgtccgtcctgctgctcctaagcggacagctgaggaagaagaactcgctgcattacaagctgagatggccctctaaggttatggacttggtcgagcagatctgtgtatgcattgatgataaacaagaacatgcgatgtatatatataaaaggatcaccgagtcaaaattaaaaactggagcggaactttaagaatcatcatcgtcttgaatgttttcaacatttgacttgtttacatatatttttatattttatcgtgtttttgtaatttttgaatcgtttgttac

SEQ ID NO: 3634 - DNA, 964 bp, Brassica napus
gatttcttttttttaaattcgaaatccagaattttcccagagggatctagcaatcgattgggctgtgggtggggagaagagattgaattgaggaagcaaagatgatgaatcggctatttgggaagcccaagcgtgagggtaatgctctccagacattagacaagctcaacgagacacttgagatgctagagaagaaggagaaagtgcttttgaagaaggctggacaagaggttgagaaagctaaagagtacactcgtgctaaaaacaaacgctcggctatacagtgtttgaaaaggaagaggttgtatgagcaacaagtcgaacagcttggcaacttccagctccgtattcatgatcaaatgataatgttagaaggcgcaaaagcaacaaccgaaactgttgacgcgttgaggagtggagcttctgcaatgaaagccatgcagaaagctacaaacattgatgatgtggacaagaccatggacgagatcaatgagcagacagagaacatgaaacagatccaagaagcattgtctactcctatcggtgctgctgctgacttcgatgaggatgagcttgaagcagagcttgaagagctagaaggtgcagagcttgaagaacaacttcttcagccgacaccaatgccttcagttccagggcgtcaacccgtccgtcctgctgctcctaagcggacagctgaggaagaagaactcgctgcattacaagctgagatggccctctaaggttatggacttggtcgagcagatctgtgtgtgcattgatgataaacaagaacatgcgatgtatatatataaaaggatcaccgagtcaaaattaaaaactggagcggaactttaagaatcatcatcgtcttgaatgttttcaacatttgacttgtttacatatatttttatattttatcgtgtttttgtaatttttgaatcgtttgttactcgttgtttttctg

SEQ ID NO: 3635 - DNA, 1075 bp, Raphanus sativus
gggctgcttaataatatttcgcggaagaaggaaggaagaccagagaaagtcctctctttcgaagattccaatttttaatcgaaatccagatttttccccagggatctagcaatcgatttgggtagaagagggtgaaataaaggaagaaggaaaaagatgatgaatcggctatttgggaaaccaaagcatgagggtaatgctctccagacattagacaagctcaacgagacgcttgagatgctagagaagaaggagaaagtgctgttaaagaaagctggacaagaggtcgagaaagccaaagaatacactcgttctaaaaacaaacgcgcggctattcagtgcttgaaaaggaagaggttgtatgagcaacaagttgaacagcttggcaacttccagctccgtattcatgatcaaatgattatgttagaaggcgcaaaagcaacaaccgagactgttgatgcgttgaggagtggagcttctgctatgaaagctatgcagaaagctacgaacatagatgatgtagacaagaccatggacgagatcaatgagcagacagagaacatgaaacagatccaagaagctttgtctactccaatcggtgcggctgctgacttcgatgaggatgagctcgaagctgagcttgaagaattagaaggtgcagagcttgaagaacaacttcttcagccaacaccaatgccttctgttccagggcgtcaaccagtccgtcctgttgctcctaaacggacagccgaggaagaagaactcgctgcattacaggctgagatggccctctaaaggttattgacttggtttgagcagatctgtgtatgcattgatgataaacaagaacatgcgatgtatattatataaaaaggatcaccagagtcaaaatcaaactggaccggaactttaagaatcatcatcgccgtgaatgttatcaacatttgacttgctcacatatttttatattttatcgttttgtaatatttgaatcgtttgtgacacgttgttttttctgtagtttgtgacatgcatcgttatactcaattcaaatcctcacagccaatagatgaga

SEQ ID NO: 3636 - DNA, 1019 bp, Eutrema halophilum
acacgtgtcatcacgattaacttcaacgcttgtggaaaagaggaaagttgcttccttcgatcttaatccatctctgtgaacacaaacgcggaagaacaaaaccagaaaatttctccagtgaatttgcaaatcgtgtcgactgagtgtagaagagatcggagtgggtttcttcatcgcgggtgattcaattaacatcctcaatcatgatgaatcggctatttgggaaacccaagcaggagtcaaatgctctccagacattagacaagcttaacgagactcttgagatgctagagaaaaaggagaaagtactcctgaagaaggctggacaagaggttgagaaggcaaaagaatacacccgtgcaaagaacaaacgcgcggctatacagtgtttgaaaaggaagaggttatatgagcaacaagttgaacagcttgggaatttccagctgcgtatacatgatcaaatgattatgttagaaggcgcaaaagcaacaaccgaaactgtagatgcattgaggagtggagcttctgcaatgaaagcaatgcagaaagcaacaaatatcgatgatgtggacaagaccatggacgagatcaatgagcagaccgagaacatgaaacaaatccaagaagcattgtcgactccaatcggagcggcggctgacttcgatgaggatgagcttgaagcagagcttgaggaactagaaggtgcagagcttgaagagcaacttcttcagccgacaacaaccgctccattgcctacagttccgatgcctgcagggcgtcaacaagcccgtcccgctgctcagaagcggaccgctgaggaagaagaactcgctgctttacaggctgagatggccctctaaggtcacttccacttctcttatctataagcaaaacacatttgtttttaaacacaagtttttccttttacatttgcctttatatgtgggaaacaaaaattcacatgtaagtggaaacgaaaattcacgtttttttttattataaaacattttctactgtac

SEQ ID NO: 3637 - DNA, 967 bp, Thellungiella halophila
  misc_feature (5)..(15): n is a, c, g, or t
  misc_feature (18)..(22): n is a, c, g, or t
  misc_feature (24)..(24): n is a, c, g, or t
  misc_feature (27)..(34): n is a, c, g, or t
  misc_feature (36)..(37): n is a, c, g, or t
  misc_feature (39)..(43): n is a, c, g, or t
  misc_feature (47)..(47): n is a, c, g, or t
  misc_feature (49)..(52): n is a, c, g, or t
  misc_feature (54)..(60): n is a, c, g, or t
  misc_feature (64)..(65): n is a, c, g, or t
  misc_feature (67)..(71): n is a, c, g, or t
  misc_feature (75)..(78): n is a, c, g, or t
  misc_feature (83)..(84): n is a, c, g, or t
  misc_feature (87)..(87): n is a, c, g, or t
  misc_feature (89)..(89): n is a, c, g, or t
  misc_feature (91)..(93): n is a, c, g, or t
  misc_feature (95)..(96): n is a, c, g, or t
  misc_feature (694)..(694): n is a, c, g, or t
  misc_feature (702)..(702): n is a, c, g, or t
atcannnnnnnnnnnaannnnncntcnnnnnnnncnntnnnnntttntnnnncnnnnnnntttnnannnnntttnnnnatcgnntcnantnnntnnagaagagatcggagtgggtttcttcatcgcgggtgattcaattaacatcctcaatcatgatgaatcggctatttgggaaacccaagcaggagtcaaatgctctccagacattagacaagcttaacgagactcttgagatgctagagaaaaaggagaaagtactcctgaagaaggctggacaagaggttgagaaggcaaaagaatacacccgtgcaaagaacaaacgcgcggctatacagtgtttgaaaaggaagaggttatatgagcaacaagttgaacagcttgggaatttccagctgcgtatacatgatcaaatgattatgttagaaggcgcaaaagcaacaaccgaaactgtagatgcattgaggagtggagcttctgcaatgaaagcaatgcagaaagcaacaaatatcgatgatgtggacaagaccatggacgagatcaatgagcagaccgagaacatgaaacaaatccaagaagcattgtcgactccaatcggagcggcggctgacttcgatgaggatgagcttgaagcagagcttgaggaactagaaggtgcagagcttgaagagcaacttcttcagccgacaacaaccgntccattgnctacagttccgatgcctgcagggcgtcacaagcccgtcccgctgctcagaagcggaccgctgaggaagaagaactcgctgctttacaggctgagatggccctctaaggtcacttccacttctcttatctataagcaaaacacatttgtttttaaacacaagtttttccttttacatttgcctttatatgtgggaaacaaaaattcacatgtaagtggaaacgaaaattcacgtttttttttattataaaacattttctactgtac

SEQ ID NO: 3638 - DNA, 916 bp, Arabidopsis lyrata
tgacttgtgatcgtgtcggttggggtatagaagagatcgaagtgggtgatatttgagcaagatcatgatgaatcggctattcgggaaacccaaacaggagtctaatgctctccaaactctagacaagcttaacgagacgcttgagatgctagagaaaaaggagaaagtactcttgaagaaagctggtcaagaggttgacaaggcaaaagaattcacccgggcaaagaacaaacgagcggctatacagtgtttgaaaaggaagaggttatatgagcaacaagttgaacagcttgggaatttccagctccgcatacatgaccaaatgattatgttagaaggcgcaaaagcaacaaccgaaactgttgatgcattaaggagtggagcttctgctatgaaagcaatgcagaaagcaacaaatattgatgatgtggacaagaccatggacgagatcaatgagcagaccgagaacatgaaacagatccaagaagcattggcgactccaatcggggcagcggctgactttgatgaggctgatcttgaacaagagcttgaagatttagaaagtgaagagcttgaatcgcaacttctacagccggcaacaaccgctccattgccttcagttcccgtgcctgcagggcgtcaacccgcccgtcctgttccccagaagcggactgctgaggaagaagaactcgctgcattacaggctgagatggccctctaaggttatttacctctccaaacagagacatgtatgcattgataaacaagaacagacgatgtatataaggatctgaatcagattaaatcagagcaacttttatcttcattaatgttatctgcatttgagtgttcttcacataatttatcttttgtaatttttgtatcttttatgacacttttccctttgattaataat

SEQ ID NO: 3639 - DNA, 1099 bp, Arabidopsis thaliana
gcgtgtggaaaaaggaaagttgcttccttcgttcttaatcccttctctgtgaacacaaaaacgcgaaataacaaacaaaaaccaatacaagtgatttccattatttctcgtctacgtatacaattgatcttcccccatctccaattcagatttggacagagtaacctgtgatcgtgtcggttggggtagaagagatcgaagtgggagcaaaatcatgatgaatcggctattcgggaaacccaagcaggaggctaatgctctccaaactttagacaagcttaacgagacgcttgagatgctagagaaaaaggagaaagtactcttgaagaaagctggtgcagaggttgagaaggcaaaagaatactcccgggctaagaacaaacgagcggctatacagtgtttgaaaaggaagaggttatatgagggacaagtcgaacagcttgggaatttccagctccgtattcatgatcaaatgattatgttagaaggtgcaaaagcaacaaccgaaactgttgatgcattgaggagtggagcttctgcaatgaaggcaatgcagaaagcaacaaatattgatgatgtggataagaccatggacgagatcaatgagcaaaccgagaacatgaaacagatccaagaagcattggcgactccaatgggggcagcggctgacttcgacgaggatgagcttgcagcagagcttgatgaactagaaagtgaagagcttgaatcgcaacttctacagccggcaacaacagctcctccattgccttcagttccagtgcctgcagggcgtcaaccggctcgtcctgttccccagaagcggactgctgaggaagaagaactcgctgcattacaggctgagatggccctctaaggttattcacctctccgagcagagacatgtatgcattgatagacacgaacagacgatgtatataaggatctgaatcagattaattcggagcgaaaaacttttataatccccgtcgttaatgttatctgcaatttgagtgttcttcacataatttatcttttgtaatttttgtatctttttatgacactttttcctttggttaataatcactttactcctatgttc

SEQ ID NO: 3640 - DNA, 859 bp, Tropaeolum majus
aaccaaatacgcacaaagaacctcttttctcagtgttttacccatatctctagtttcccgttgaagtcctcgatccgtcggttacaattacaaaggggaatttgaggtttaattgaagactaaaaccatgttgaaccggctctttggtaaacctaagcaggagacaaatgctctagctacgctagacaaattaaatgagacacttgaaatgctagagaaaaaggagaaagtgctcctgaaaaaggctggtgccgaagtcgaaaaggcaaaggatttctccagagctaaaaataaacgagcggccatacagtgtttgaagaggaagaggctatacgaacaacaaattgagcagcttggaaatttccagttgcggattcatgatcaaatgataatgttagaaggtgctaaagccactactgagactgtagatgcattacggagtggggcatctgctatgaaggcaatgcagaaagcaacgaatattgatgatgtggacaaaactatggatgaaatcaatgagcagacagagaacatgaaacagatccaggaagcattgtcaactccaattggtgccgcagctgattttgatgaggatgagttagaagcagaactcgaagaactagaaggtgctgagttggaagagcaacttcttcagcctgcaacaactgctcctgcagctccattgcaggtgccagctggtcgtcaaccagctcgtcctgctcctcaaaagcgcacggctgaggaagatgaacttgctgccttgcaggccgaaatggcactttaagatcgaggaaatggctgtagcattgactttgtggtctgtttcagttcgagaaaacgccctattgtactacaaggc

SEQ ID NO: 3641 - DNA, 954 bp, Euphorbia peplus
cttctttttatcttactgattgggggaacctaattaatttattcgatctcttcctcaatcctgcaacaatcttaaaggagatcaggggcagttgtttcattcgcggataagaatcaaccatgtttaaccggctttttggaaaacccaagcaggaaaccaatgctctgaccacgttggacaaattaaatgagacacttgaaatgctagagaaaaaggagaaagtgcttataaaaaaagctgctcaagaagttgaaaaggctaaggaattcactcgagcaaagaataaaagagcggctattcaatgtttgaagaggaagagactatatgaacagcaaatagaacagctaggaaatttccaattgcgcattcatgatcagatgataatgttagaaggtgcaaaagcaaccacagaaactgtggatgcattgaggactggagcagctgcaatgaaggcaatgcaaaaggcaactaatattgatgatgtggacaagaccatggatgagatcaacgagcagacagaaaacatgaaacagatccaagaggcactttcaacgcccattggtgctgcagctgattttgatgaggatgaattggaggcggaactcgaagaattagaaggtgctgaattggaagaacagcttcttcagcctgcaaccacagctcctgcagctccagtgcatgttccagcaggcagacaaccagctcgtcctgttcctcaaaagcgcacagctgaggaagatgaacttgctgccttacaggctgagatggcactttaagcaggtgctgtttcgtatattgcagagaggtaatttaaggatttgtcacattgtataatggagattctactattgtgcatcgtgagtgcattgaatggtctgaacaaacgatgtatatagaagattgcaaactaaatgaacagttccttctaaaacttgtaatcttccttttgggatc

SEQ ID NO: 3642 - DNA, 1120 bp, Euphorbia peplus
agaaccctaaccatctaattcgatctctctgccctaaatcttaaaggagatcggagctgaaatttgattggaagataagaagcaatcatgtttaaccgccttttcggaaaacctaagcaggaaactaatgctctaaccacgttagacaagttaaatgagacacttgagatgctagagaagaaggagaaagtgcttattaaaaaagcggccgcagaagttgaaaaggctagggaattcacccggtcgaagaataaaagagcggctattcaatgtttgaagaggaagaggctatatgaacagcaaatagaacagctaggaaatttccaattgcgcattcatgatcagatgataatgctagaaggtgcaaaggcaaccacagaaactgtggatgcattgaggactggagcatccgcaatgaaagcaatgcagaaggccactaatattgatgatgtggacaagactatggatgagatcaatgagcagactgaaaacatgaaacagatccaagaggcactttcaacacccatcggagctgcagctgattttgatgaggatgaattggaggcggaacttgaagaattagaaggtgccgaattggaagaacagcttcttcaacctgcaactacagctcctgcagctccagtacatgtcccagcaggcagacaaccaactcgtcctgttcctcaaaagcgcacagctgaggaagatgaacttgctgccttacaggctgagatggcactttaagcaggtgtcgttgcctatattccagaagagcttatttaaggacttgtcacattgtattatggaaattccgttactactttagtccttttccgcgtcgtgagtgcattgttcatggtcgacaaacgatgtacataaaagattgcaatctcaatgaacagttactttctaaaacatgtaatttcattttggatatttgattccagtgttatatcctattctgtcagtgttccctacctcgcattctctctcttaagaaaaatgtggtttctcagccaattcgaccttccatgtcgatgttaccaacttggtgacttgttacgctttatgtagcaaataattatatgtatgatctcctgatgctagtattggactcaat

SEQ ID NO: 3643 - DNA, 1228 bp, Tripterygium wilfordii
cagacagaaaacggtggcgacaaatccccgaacttgctggaccgagaacgcgatgaacaaattcgcaagcttcgagttctcctccaacagaaccgcacagacactgcacataggctacttctctccctcgttcagaaaaaatcagtcttttcttcaccctctgatcttttttctcttttctctttgtccgtaccctccttgaaaccagctttctctagtatgctcctctccgtttgctgtgaggctaagatgctccccgaagcaactcaagtctacggcttgatcagaaatgaggggaatcgcaagggttttcaaagcggaggatcgaccatgtctatgtttaacaggcttttcgggaaacctaagcaggaaactaatgctttaactactttagacaagttaaatgagacactggaaatgctagagaagaaggagaaagtacttctgaaaaaagctgctgcagaggttgaaaaggccagagattttaccagattgaagaacaaaagggcggctatacagtgtttgaagaggaagaggttatatgagcagcaaatagaacagcttggaaatttccaactgcgcattcatgaccagatgataatgttagaaggtgcaaaggctacgactgagaccgtggatgcattgagaactggagcttctgcaatgaaggcaatgcagaaagcaacgaatatagatgatgtggacaagaccatggatgagatcaacgagcaaaccgagaacatgaaacagattcaagaagcattgtcaactccaattggtgctgcagctgattttgacgaggatgaactggaagcagaacttgaggaacttgaaggtgctgaattggaggaacagcttcttcagccagtgacaacagctcctgcagctccagtgcaagtcccagcaggccgtcagccagcccgtcctgctccacaaaagcgtacagctgaggaggatgaacttgctgccttacaggctgagatggcactctagacaggatgcaaaaattgttcaaaagtcggccttattgtattattgtgggactcctttcacagatccagatttctgtgtgcattaagtggtgaacgcacaatgtatatagagattgcataaacaaatttccgcacaaaacttgtgtcctgtgatttggagctttaaattaagattgtgatcttctttttttgttttaaacattgcttcaaaaacactgaaaacatttttcaatgtt

SEQ ID NO: 3644 - DNA, 1489 bp, Aristolochia fimbriata
tctgcgactcagcgatcgactcagtgatttactcagctagcgtctcagcgaacgactcagcgatgatttttttccgactgccccctggttcgaaccaaaacgagtggaggactaattagaaatagggaaatgacctaaaacaaccttcccctcaaaatcgaccgccggcgaagggaatccgtggggtgcctcctggaatcgattccttacactacaagttcgcgcgccgaagagtctagcctggtctttgaggtcaatcttgcttccaatttcaggctggaagattaccttcggactgacctctttcgcgcgatcgaagatctactgctcctcttccacgcagtttcccctcgttttcttgagaaaaaataatccgttttttcagattacgcacgtcggccatatattagagggaaggccgatctcgttattgttctcttgcggcaggctgctctgtaacccttcaattgactgcgaggcaaaatcagaggcgaggactccactagaaggaatcatgtttcagaggattttcgggaagcctaagcaggaaaccaatgccttggccactcttgataagttaaacgagacacttgaaatgctagaaaagaaagagaaggtacttttgaagaaagtggctgctgaaattgaaaaggccaaggaatacacccgagctaaaaataagagggctgctatacaatgtttgaagcgtaagaggctctatgaacagcaagttgagcagcttggaaattttcagttgcgtattcatgatcagatgatattgctggaaggtgcgaaagccaccactgaaactgtggacgcattgaggacaggtgcatctgcaatgaaagcaatgcagaaagccacaaatattgatgacgtggataagacgatggatgagatcaatgaacagacggagaacatgaaacagattcaggaggcattatctactccaattggtgccgcagctgattttgatgaagatgaattggaagctgagcttgaagagctggaaggagctgaattggaggagcagctgctccaacctgctacaactgctcctgctactgtcccttacgtccctgctggcaggcaagcagctcgacctgcaccccagaagaccacaccagaggaagacgagctagcagcattacaagcggaaatggccctgtagagacacctcataacttgtgctgagtagggtttatgtaaagatacccttgtgtgatggaagcttgttgctagggcagcgcgtttccgcctcactaataataatttgcatttctcagtgtgtatagtataagctgtggtaagtgtttcattttaatgtggtggacgaaaaacccacctttgcttcttcaatgtgcttcctttttctttaacgagtctcatcttgtatgtgtttagtcattcaggtaatctctctgcatgaaacaagtgtataagattttagtgaagaaatgttatcatgtccataattttacttaaaaaa

SEQ ID NO: 3645 - DNA, 1115 bp, Solanum phureja
ttaagaaaagccatatacccacccacaaagaagccaaccgggtcggcccgttattgttctccttcctagaattttcgcttaaattcatttaaccaaattcagtcttccttgttgaagcaaatttgctgttgaatcgctgatattgcttctactctaaattgtaacttgtaatcaacagaattttcgcctttgtttgttgtataagcaaacatgttttcgcggatgtttgggaaacccaagcaggaaactaatgctcttatgactcttgacaaattaaacgagacactggagatgcttgagaaaaaggaaaaggtgcttcagaagaaggcctctacagaggttgagaaggccaaagattttacaagagcaaagaacaaaagagctgcaatacaatgtttgaagaggaagaggctctacgaacagcaaattgagcagcttggcaatttccagcttcgcatccatgatcagatgataatgctagaaggcgcaaaagctacaactgaaactgttgatgctttgcgaactggagcttctgcaatgaaagcaatgcagaaagcaacaaatattgatgatgtggacaagacaatggatgaaataaatgaacagacagagaatatgaagcaaatacaggaggctttggctactccaattggtgcagcagctgattttgatgaggatgaattggaggcagaacttgaagaactggaaggtgctgaattagaagagcagctgcttcaaccagcaactacagctcttgctgctccagtccatgttcctgcagggaagcaacctgctcggcccattcctcagaagcgtacagctgaagaagatgaacttgctgcgttgcaagcagagatggctctttgagctagtccgtcttttattttaaccggtattatcacgggtagcttacatatagagactggttatatgcatgtaaaaaactactgcaaatggtttcacatttctcgatatctatgtgggttaaaatatagggctgtatacatattggtgttgcagaaaatggtgaattctatggacaccagaatttgtggtttatgttcataagtgaattttatgttcactaccgtcttctttttttcttttcttttttt

SEQ ID NO: 3646 - DNA, 1195 bp, Cannabis sativa
aaagcaaagcaaagcaccttcgctctccatttcttcttcttctctcccaacgcaacacgcctaagaaatcccaaattaacccaacacacagagggaccaaacctaatcgccctgcactctctctccctctcatacttcatagatccaatcccttcttttctccaaaccctaaattccctttctctttcctctgataatttctgccattaatttgaggtatttttgggggataatatttgttctattgaagattgaataagcgtaaagaatcaatcaaccatgttgaatcgcctttttggaaagcctaaacaggaaaccaatgctctaaccacgttagacaagttaaacgagacacttgaaatgcttgagaaaaaagagaaagtactactaaaaaaggctggtgcagaagttgaaagggctaaagaattcaccagagcaaagaacaaaagagctgccatacaatgtttaaaaaggaagaggctctatgaacagcaaatagagcaacttggaaatttccagttgcgtatccatgatcagatgataatgttagaaggtgcgaaagccacaactgaaacagttgatgctttgagaactggtgctgctgcaatgaaagcaatgcagaaagcaacgaacatcgatgatgtcgacaagaccatggatgagattaatgagcagactgagaacatgaaacagatccaggatgcattgtcagctccatttggtgcagcagctgatttcgatgaggatgaactggaagctgagcttgaagagcttgaaggtgctgagttggaagagcaacttctccagcctgctacaacagctcctgctgctccagtgcacgtccctgctggccggcaacctgctcgccctgttcctcagaaacgcactgctgaagaagatgaattggctgccttgcaggctgaaatggctctttaatcaggtcattcatcagctgtatatgatttctccattttcttatctacatgtgtagtgggctttatctgcttgggaaactactttctttgtcaattgattatcatcattatatttcttttaaatgagattcagatccttgaaggttcaaagtttgtatgtgacaacataacatgaatctacaacgaattcctcttatatttagttgacattaatttttagtggcaatagtttttgatcgtagttggttagagtgttgcag

SEQ ID NO: 3647 - DNA, 1020 bp, Euphorbia peplus
gcttaaggaaaacaaaaatccccaaattatacatcttctccttcagtctctggttcgatcaagaaccctagtaatctaattcgatctctcttcctcaaatcctacaccaatctcaaaggagatcggagctgaactttgattcgaggataagaagcaaccatgtttaaccggctttttggaaaacctaagcaggaaaccaatgctctaacaacgttagacaaattaaatgagacacttgagatgctagagaaaaaggagaaagtgctcataaaaaaggctggtgcagaagttgaaaaggctagggaattcactcgatcaaagaataaaagagcggctattcaatgtttgaagaggaagaggctctatgaacagcaaatagaacagctaggaaatttccaattgcggattcacgatcagatgataatgttagaaggtgcaaaagcaaccacagaaactgtggatgcattgaggactggagcatctgctatgaaggcaatgcaaaaggccactaatattgatgatgtggacaagactatggatgagatcaatgagcagactgaaaacatgaaacagatccaagaggcactttcaacacccatcggagctgcagctgattttgatgaggatgaattggaggcggaacttgaagaattagaaggtgctgagttggaagaacagcttcttcaacctgccaccacagctccggcagctccagtgcatgttccggcaggaagacaaccaactcgtcctgttcctcaaaagcgcacagctgcccaagatgaacttgctgccttacaggctgagatggcactttaagcaggtgtcgttgcctatattccagaagagcttatttaaggacttgtcacattgtattatggaaattccgttactactttagtccttttccgcgtcgtgagtgcattgttcatggtcgacaaacgatgtacataaaagattgcaatctcaatgaacagttactttctaaaacatgtaatttcattttggatatttgattccagt

SEQ ID NO: 3648 - DNA, 1420 bp, Humulus lupulus
gcaacacgcctaagaaatcccaaattaatccatacagagggaccaaacctaatcgctctccacactctctctctccctctcataattcatagatccattccaatcccatattttctccaaaccctaaattccttttctcttctctctgataatttctgccatcaatttcgaggtttctttttgggcgttaattttgttctgttgaagattgaagagggttgaataagcgcggagaatcaatcaaccatgttgaatcgcctttttggaaagcctaaacaggaaaccaatgctctaaccacgttagacaagttaaacgagacacttgaaatgctggagaaaaaagagaaagtattactaaaaaaggctggtgcagaagttgaaagagctaaagaattcactagagcaaagaacaaaagggcggccatacaatgcttaaaaaggaagaggctttatgaacagcaaatagagcaacttggaaatttccagttgcgtattcatgatcagatgataatgctagaaggtgcaaaagccactaccgaaactgttgatgctttgaggactggtgctgctgcaatgaaagcaatgcagaaagcaacgaacatagatgatgtggacaagaccatggatgagattaatgagcagaccgagaacatgaaacagatccaggatgcattgtcagctccatttggtgccgcagctgattttgatgaggatgaactggaagctgagcttgaagagcttgaaggtgctgagttggaagagcaacttctccagcctgctacaacagctcctgctgctccagtgcacgtccctgctggccggcaacctgctcgtcctgttcctcagaagcgcactgctgaagaagatgaactggctgctttgcaggctgaaatggctctttaatcaggtattgctgggcacaattaaaaaaggctatgtaaagaagtggcctgattgtataatggagatttctgcgcgtttcaggaaaaatctagatttccgtatggggttggggctattgttgaacagattcttacacttcttatcacatatatggagattgaatacttgtttttacatggttgacttaagccatagaccaaaccaactgccttattttggttttctgtgtcatatctaccctcgttttttttcctttttttggccactgcgttgtcaatattaataatatatactcttctcattgcttttgtcatctaaacatatttaagttattctggttattataagtttgaccagctatatatattaaagaagattaatgtacagttgattttggttattattttaaaatatgtcagtactcagtaatatcaatatcttctcaataatcaaacaaattattgaaaggaacaagcatacgaatcgaaagtttcatttctatgtgtggtcaaactat

SEQ ID NO: 3649 - DNA, 1026 bp, Cleome gynandra
caatacgattaagcaaaaaaaaaaaaactactgatcgtttttccgcttcgccaaaatctctcctcgttaagccctaattgattatctcggatagaggagatcgaagtgggttttcaaaatcgcaaataatcaaccatgttcatgaatcggctattcgggaaaccaaaacaggagtctaatgctctccaaacgttagacaagctaaacgagacgcttgagatgttggagaaaaaggaaaaagttctcctgaagaaggctgcttcggaggtcgaaaaagcaaaggaattcacccgggcaaagaacaaacgtgcggctatacaatgtttgaaaaggaagaggttatatgaacagcaagttgaacagctgggaaatttccagctgcgtattcatgatcaaatgattatgttagaaggtgcgaaagcaacaactgaaactgtagatgcattgaggagtggagcttctgccatgaaggctatgcagaaagcaacaaacattgatgatgtggacaagaccatggatgagataaacgagcagactgagaacatgaaacagatccaggaagcattgtcggctccaattggtgctgcggctgatttcgacgaggatgagctagaagcagaacttgaggaactagaaggcgctgaacttgaagagcaacttctccagccagcaacgacagctccagcagctccagttcctgtgtctgcaggcagacaacccgcacaccctgccgcccagaagcagcggacagctgaagaagatgaactcgctgcattacaagctgagatggccctctaagccacgggaagcttgttgaaattctagtgaaacagggctttgtgtgcgtcgataaaagaagaacagacgatgtatatacaagggtccgagtcgattaatcggagcgtcatctatgtaattcagtcttgaatgtcatcttgcatttgagtgttcaactctctgtttatcttgtatcttcgtcactttgtgacactcttttgtgttaatcagttggttttctcactgtcg

SEQ ID NO: 3650 - DNA, 1175 bp, Arachis hypogaea
ggtatcaacgcagatacgggggcttcttttctcctctttgaacctccaaacaccgaaacaacacgcttgaagggaactaaaactaccggtctttctttcctcttttgcttttcctttaccatacccagatctcaagttctgatctttttgttgacttctctatcgatctcactccaaaatctgatttttctagaaggggaagatcggttctgcaacgaagaagggtactattgtaaaggagtttgaatctacatctgtatatattaatctataaggatcaaccatgtctatgtttgggcgcatgtttggtaaacctaaacaggaaaccaatgctttaaccactttggataagttaaacgagacgcttgaaatgctggagaaaaaggagaaagttctccttaagaaggtttcagctgaagttgaaaaggcaaaagaattcacaagggcgaagaacaaaagggcggcaatacaatgtttgaagaggaagaggctatatgagcaacagatagagcaacttgggaatttccagttgcgcattcatgatcagatgataatgttggaaggtgccaaagccaccacagaaacagtagatgcattaagatctggagcatcggctatgaaggctatgcagaaagcaacgaatattgatgatgttgacaagaccatggatgagatcaatgagcaaaccgaaaacatgaagcagattcaggaagcactgtctgctccaattggtgcagcagctgatttcgatgaggatgaattggaagctgagcttgaagaactggagggtgctgaattggaagaacagcttcttcaaccagcaactacagctcctgctgccccggtgcaagtcccagccggccggcaacctactcggcccgtccctgcaaaacgaactcaagaagaagacgaattggcagctttgcaggctgagatggcactttgagcaggtccatattctcaaatgtaatacaatccgatatccacactacgcattagtttgttttagttcaatgaatgttgcgtcgcatccaacatcgcagtttaatggcttgtgtatttatcattttcatgttagctatcaacttttgcacctttgagagtgcacttgtacaatagtctgaaaaagttgaacctgagatcacttgtctataagataaatatcattttgtgct

SEQ ID NO: 3651 - DNA, 1190 bp, Citrus clementina
gtctcaaacacaacacgcttaagataatcgcagaccgaaccacgctctctccctctcatataattcacagatctctaccgattgtatcttttaataaagtcagaatcccaattctctttttttttttccctcatttttataattacggaggtaaaatcgagggtttttgattaatcgcggagaatcaaacatgtttactcggctttttggaaaacctaaacaggaaaccaatgccttaaccacgctcgataagctaaatgaaactcttgaaatgctagagaaaaaggagaaagtactcctgaaaaaggcttctgtagaggttgaaaaggccaaggactactccaaagcaaagaacaaaagagcggccatacaatgtttgaagaggaagaggctatacgaacagcaaatagagcagcttgggaatttccaattgcgcattcatgatcagatgataatgctagaaggtgctaaagccacaactgagactgtagatgcattgaggacgggagcatcgacaatgaaggctatgcagaaagcaacgaacatagatgatgtggataagaccatggatgagatcaatgagcagaccgagaacatgaagcagattcaagaagcattatcaactcctattggtgctgctgctgatttcgatgaggatgaattggaagcagaacttgaagaactggaaggtgctgagttggaagagcagcttctacagccagctacaacagctcctgctgctccggttcaggtccctgctggcaggcaacaagcccgtcctgttccccaaaagcagcgaacagctgaggaagatgagcttgctgctttacaagctgagatggctctttaagcaggttttaccgccataatgaagatattatttaaatagctggccgtataatgtggagatttatgcctacttggattaccttcaagatttctgtgtgcattcaatgaacagactgtatataaagtttgcgtaaactagtcctgtttgaaatatgtatcctgtattctgtcttatagaccttttaattgagttcatcatctttgatgtgttttttccttctcctgtgaaaattttatgttcgttgagctcttggtagcaacttcacatctcatgaagaagtactgccaggttatggtgtgaaactctttaggcatactaataaatgaacaaattgtgaatc

SEQ ID NO: 3652 - DNA, 1182 bp, Citrus sinensis
gtctcaaacacaacacgcttaagataatcgcagaccgagccacgctctctccctctcatataattcacagatctctaccgattgtatcttttaataaagtcagaatcccttttttttttccctcatttttataattacagaggtaaaatcgagggtttttgattaatcgcggagaatcaaacatgtttactcggctttttggaaaacctaaacaggaaaccaatgccttaaccacgctcgataagctaaatgaaactcttgaaatgctagagaaaaaggagaaagtactcctgaaaaaggcttctgtagaggttgaaaaggccaaggactactccaaagcaaagaacaaaagagcggccatacaatgtttgaagaggaagaggctatacgaacagcaaatagagcagcttgggaatttccaattgcgcattcatgatcagatgataatgctagaaggtgctaaagccacaactgagactgtagatgcattgaggacgggagcatcgacaatgaaggctatgcagaaagcaacgaacatagatgatgtggataagaccatggatgagatcaatgagcagaccgagaacatgaagcagattcaagaagcattatcaactcctattggtgctgctgctgatttcgatgaggatgaattggaagcagaacttgaagaactggaaggtgctgagttggaagagcagcttctacagccagctacaacagctcctgctgctccggttcaggtccctgctggcaggcaacaagcccgtcctgttccccaaaagcagcgaacagctgaggaagatgagcttgctgctttacaagctgagatggctctttaagcaggttttaccgccataatgaagatattatttaaatagctggccgtataatgtggagatttatgcctacttggattaccttcaagatttctgtgtgcattcaatgaacagactgtatataaagtttgcgtaaactagtcctgtttgaaatatgtatcctgtattctgtcttatagaccttttaattgagttcatcatctttgatgtgttttttccttctcctgtgaaaattttatgttcgttgagctcttggtagcaacttcacatctcatgaagaagtactgccaggttatggtgtgaaactctttaggcatactaataaatgaacaaattgtgaatc

SEQ ID NO: 3653 - DNA, 1170 bp, Citrus sinensis
cacgcttaagataatcgcagaccgaaccacgctctctccctctcatataattcacagatctctaccgattgtatcttttaataaagtcagaatcccatttttttttttccctcatttttataattacagaggtaaaatcgagggtttttgattaatcgcggagaatcaaacatgtttactcggctttttggaaaacctaaacaggaaaccaatgccttaaccacgctcgataagctaaatgaaactcttgaaatgctagagaaaaaggagaaagtactcctgaaaaaggcttctgtagaggttgaaaaggccaaggactactccaaagcaaagaacaaaagagcggccatacaatgtttgaagaggaagaggctatacgaacagcaaatagagcagcttgggaatttccaattgcgcattcatgatcagatgataatgctagaaggtgctaaagccacaactgagactgtagatgcattgaggacgggagcatcgacaatgaaggctatgcagaaagcaacgaacatagatgatgtggataagaccatggatgagatcaatgagcagaccgagaacatgaagcagattcaagaagcattatcaactcctattggtgctgctgctgatttcgatgaggatgaattggaagcagaacttgaagaactggaaggtgctgagttggaagagcagcttctacagccagctacaacagctcctgctgctccggttcaggtccctgctggcaggcaacaagcccgtcctgttccccaaaagcagcgaacagctgaggaagatgagcttgctgctttacaagctgagatggctctttaagcaggttttaccgccataatgaagatattatttaaatagctggccgtataatgtggagatttatgcctacttggattaccttcaagatttctgtgtgcattcaatgaacagactgtatataaagtttgcgtaaactagtcctgtttgaaatatgtatcctgtattctgtcttatagaccttttaattgagttcatcatctttgatgtgttttttccttctcctgtgaaaattttatgttcgttgagctcttggtagcaacttcacatctcatgaagaagtactgccaggttatggtgtgaaactctttaggcatactaataaatgaacaaattgtgaat

SEQ ID NO: 3654 - DNA, 1201 bp, Citrullus lanatus
tctctctcccatcctacactaaaacaacacgcctaagcaaagcagaatctaattcgcctatcaaccagatctccccttaattctttactttccatttcttcacacccatcgttcttcgatttccgatcatcgcttctcagaaattcggaggtcggttcgaatcgcacataatccaccatgtccatgttcaataagctttttggtaaacctaaacaggagtctaatgccctggccacgcttgataaattaaacgagacacttgaaatgctggagaagaaggagaaagtacttttgaaaaaagctgccacagaggttgagaaggctaaagattataccagagcaaagaacaagcgggctgctatacaatgtttgaagaggaagaggctatatgaacaacagatagagcagctcggcaacttccaattgcggattcatgatcagatgatattactagaaggtgcaaaagccacaactgagactgtagacgcattgaggaccggggcagctgcaatgaaagcaatgcagaaagcaacgaatatcgatgatgtggataaaacaatggatgagatcaatgaacaaactgagaacatgaaacagatccaagaagcactatcaaatccaattggtgctgcagccgattttgacgaggatgaactggaagcggaacttgaggagctagaaggtgctgagttggaagagcaacttcttcaacctgcaacaactgctcctgctgctccaattccagtccctgcaggccgacaaactgctcgacccgctcctcagaaacgaactgctgaagaagatgagctggcagctctgcaggccgagatggcactttgatgtgatatccgacaatgttctgaagcaggtggcattgccagatgagaattcgaaagagaggcgatgtgaagaattggccagatgttccgaagatttgaacattttttgctatgttcagcaaagcctgatgaacaggtctctttgtgataatatcagacaataatgcaaatttaatttaggtcttgtatactctgtaaatgaatataacattactgtggttagtatttgacctaatatggagctaatgtgtaagtgtctcaattacacgaatgctgggtgttcaatttgagttggttatttaaaaatccgtgtgtccagtttggttattaataagcgcatccatctggtgctccctcacaaa

SEQ ID NO: 3655 - DNA, 1000 bp, Manihot esculenta
ggactctgattacaacacgcttaagaaaaagccgaacaaaatctattttctctcgatctattcttcattcgaaaaccctaatcactcaataagatctctgatccccaatttcaaagaagatcgcgtaagcgttttgatttgtggatcggagtaaaccatgtttaaccggctgtttggaaaacctaagcaggaaacgaatgctctaaccactttagacaaattaaatgagacgcttgaaatgctagagaaaaaggagaaagtacttgttaagaaggctgctgcagaggttgaaaaggccagggaattcacccgagcaaggaataaaagagcggctattcaatgcttgaagaggaagaggctatatgaacaacaaatagaacagcttggaaatttccaacttcgcattcatgatcagatgataatgttagaaggggcgaaagccactacagaaactgtagatgcattgagaactggagcagctgcaatgaaggcaatgcagaaggcaacaaatattgatgatgtggacaagactatggatgagattaatgaacagacagaaaatatgaaacaaattcaagaggcactgtcgactcccattggcgctgcagctgattttgatgaggatgaattggaggcagaacttgaagaattagaaggtgctgaattggaggaacaacttcttcagcctgcaactacagctccagcagcaccagtgcaggttccagcaggaaggcaaccagctcgccctgttcctcaaaggcgcacagctgaggaagatgaacttgctgccttacaggctgagatggcactttgagcaggtattgtttactaaattgctgaagagcttatttaaagattggtcatattgtattatggagttcatgcaactcctttcaggcatcatgtgtgcattgaatggtctgaacagaaatgtatataaagacggcgtaaactaaagaaactgcccttgtaacgtgtatctatgttttgaagttctctc

SEQ ID NO: 3656 - DNA, 837 bp, Castanea mollissima
cacgcctaagaaaaccaatctcattctcttttatctctctcacataaaatttacagttccaaaccctaatcgatcaattggatcgctctctcttcaatttccaacctccatttcacagaagatcgaggaaggtttaatcgttgagaatcaaccatgtttaaccggctttttggaaaacctaaacaggaaaccaatgctctctccacgttagataaattaaacgagacacttgaaatgctagagaaaaaggagaaagtacttttaaaaaaggcagctgcagaggttgaaaaggcaaaggaattcaccagagctaagaacaaaagggcggctatacaatgtttgaagaggaagaggctatatgaacagcaaatagagcagcttgggaatttccaattgcgaatccatgatcagatgatattgttagaaggtgcaaaagcaactactgaaactgtagatgcattgagaactggagcttctgcgatgaaggcaatgcagaaagcaacgaatattgatgatgtggacaagaccatggatgagatcaatgagcagactgagaacatgaaacagattcaggaagcattgtcaactccgattggtgcaacagccgattttgatgaggatgagttggaagctgaacttgaagaactggaaggtgctgagctggaagaagaacttcttaagcccgcaactactgctcctgcagctccagtgcaggtcccagcaggccctcaacgaaaccgtcctactccaaagcctacagctgaggatgatgaactggctgcactacaggctgagatggcactataagcagaattttgcagatattgttggtgtatg

SEQ ID NO: 3657 - DNA, 1071 bp, Cucumis melo
ctaaaccaacacgcctaagcaaagccgaatcctattcgcctctcaatcagatctgttcttaattctttactctccatttcttcacatcaaattcctcttcgatttgcgatcatcgcttctcagttcgaagctcggttcgaatcgtacataatccaccatgtccatgctcaataagctttttggtaaacctaaacaggagtctaatgccctggccacgcttgataaattaaacgagacactggaaatgctggagaagaaggagaaagtacttctgaaaaaggcttccacagaagttgagaaggccaaagactataccagagcaaagaacaaaagggctgctatacaatgtttgaagaggaagaggctatatgaacaacagatagagcagctcggcaacttccaattgcggattcatgatcagatgatattactagaaggtgcaaaagccacaactgagactgtagatgcattgaggaccggggcagctgcaatgaaagcaatgcagaaagcaacgaacatcgatgatgtggacaaaacaatggatgagatcaatgaacaaactgagaacatgaaacagattcaagaagcactatcaaatccaattggtgctgcagccgattttgatgaggatgaactggaagcagaacttgaagagctagaaggtgccgagttggaagaacaacttcttcaaccggcaacaacagctcctgctgctccaattccagtccctgcaggtcgacaaactgctcgacctgctcctcagaaacgaactgctgaagaagatgagctggcagctctacaggctgagatggcactctgatgccacatccaacaatgttccaaagcaggtggcgttgctggatgagaatttgaaagagaggcgacgtgaagaattggctatgaggttgttccgaagatttgaacattttttgctttgttctcaacaaaggctgatgaaaggtctctttgtgatatcagacaataatgcaaatttcgattaggtcttgtatactctctgtaaatgaatatgataacattattgtggttagtaatgacctaatatggagctaa

SEQ ID NO: 3658 - DNA, 1264 bp, Cirsium arvense
gcggggggatacatcattatgatcgacattgaaggtaactggtaaggttaagcaaatctcctccataccaagtcctccaatttgagtccccacccacttctacaactcatcgaatctatttccttcgatcttcatcatcatccctcttgatcaattcaaaacccctttgattttcatattaattctgaactcaatttcgatttttcagtatatcttttgcaataaaccctagacgcaggttaagaatcatcttttgattccgacgacaacatctcactcttgtttaatttcagatcggagggtttcaagaagaaaagcaggtgacaatgttttcgcgtatgtttgggaagcctaagcaagaaacgaacgctgtaacaacgttagacaaattgaacgagacgcttgagatgttagagaagaaagaaaaggtacttctgaagaaagcggctgcagaggttgagaaggcaaaggaatttacgagggcaaaaaataagagggcggcgatacagtgtttaaagcgaaaacgactttatgagcagcaaattgaacagcttggcaattttcaattgcgcattcatgatcagatgataatgcttgaaggtgcaaaagctaccacagagacggtggatgctttgagaactggagctcaagcaatgaaggcaatgcaaaaggcagtgaatattgatgatgtcgacaaaacaatggatgagataaatgagcaaacggagaacatgaaacaaattcaggaagcattgtcaacacctattggtgcagcagctgattttgatgaggatgagttggaggctgaacttgaagagttagaaggagctgaattggaagaacagcttctacagcctgccacaactgcccctgcagctccagtgcatgtgcctgctggaagacaaccaacacgtccacctcctaggaagaacacagctgaggaagatgaacttgctgcattgcaggcagaaatggcactttagaaggttcaattcaatgcccagttggaagatcctgtaaagatcggaggtatgacatatggtgataggtttgatctgttaaattcattcacatcaacacgaattgtttgtgtgtgatcgatgacttctattttattaggaatggaaaaggatttaagtgttcatgatgttgatgtgggttatttaagaaatttgtcttcaattattatagaaactcgaatactatcgttgttaacaatgtaatatacgacgattgttttcaagtaaaaatgttccaagagttg

SEQ ID NO: 3659 - DNA, 980 bp, Cucurbita pepo
gcgacgggaagagagggaactccaaatcttcgtccttccttttctggagcgccttggaagaaaccctttctacttcaaatttcttcacaaattctttcatttaattctgatcgaggggcgattctttttcttagcttaaacaatgttaaacaggctttttggtaaacctaaacaagaagccaatgctttggctacgttagacaagttgaacgagacacttgaaatgctggagaagaaagagaacgttcttattaagaaggctgctgcagaggttgaaaaagctaaagaattcacaagagtgaagaataaacgagcggccatacagtgtttgaagaggaaaaggctttatgaacagcaagtagagcaacttggaaatttccaattgcgtatccatgatcagatgattatgttagaaggcgcaaaagctacaacggagactgtagatgctttgagaacaggagcgtctgcaatgaaggccatgcagaaagcaacaaacattgatgatgtggacaagacgatggatgagatcaatgagcagactgagaatatgaaacagatacaggaagcgctgtcaactccaattggtgctgcagctgatttcgatgaggatgaattggaggcagaactcgaggagcttgaaagtgctgagttggaagaacaacttctccagccagcctcgacggctcctgctggacctgtctcagtcccgtcaggccgagttcctgctcgccctgttccacagaagagaactgctgaagaagacgagctggcagctctgcaagctgagatggccctctaaccaggtggtgcatacgagtatcatcttctggcagattacatccggatcttctaagcgtttgattgaaattttacacaaattacccttccctgcggcaagacaatgtatatataaaggtgcaaaattactgggatcttcatcttaaaatcatctaaaatcttatacgaatcttcaattttaa

SEQ ID NO: 3660 - DNA, 1081 bp, Cucurbita pepo
atccctcactgaaccaacacgcctaagcaaacaccgaatccaattcacctctcaatcagatctgcccttcttctttaatctccatttctccacaccggcagctcttcgatttccgatcatcaattctcagaggttcggaggtcggttcgactcgctgataatccaccatgtctatgttcaataagctttttggtaaacctaaacaggagtctaatgctctggcgacgcttgataaattaaacgagacactggaaatgctggagaagaaggagaacgtgcttctgaaaaaggctgccacagaggttgagaaggccaaagattataccagagcaaagaacaagcgggctgctatacaatgtttgaagaggaagagactatacgaacaacagatagagcagctcggcaacttccaattgcggattcacgatcagatgatattattagaaggagcaaaagccacaaccgagacggtagatgccttgaggaccggtgcagctgcaatgaaagcaatgcagaaagcaacgaacatcgatgatgtggataaaacaatggatgagatcaatgaacaaactgagaacatgaaacagatccaagaagcactatcaaatccaattggtgctgcagccgattttgatgaggatgaactggaagctgaacttgaagagctagaaggtgctgagttggaagagcaactccttcaacctgcaacaactgctcctgttgcttcaattcctgtccctgctggccgacaaaccgctcgacctgctcctcagaaacgaactgccgaggaagatgagctggcagctctgcaagctgagatggcactttgatttaatatccgttatggttttgaagcaggtggcactgcctgatggtatatccaaaagagaggcgatgtgaagaattgggtcgaggttgtaccgaagatttgaacattttttgctaagatcagcaaagcttgatgaacaggtttctttgtgataataccaaataataatgcagattgaatttaggccgtatatactctgtaaatgaatataacattattgtggttagtattatgggtaagtgtctcaatttc

SEQ ID NO: 3661 - DNA, 1232 bp, Solanum lycopersicum
gtggattgagagtagcattacgcttaagaaaaggcatatacccaataaacaaaccgggtcggcccgtcattgttctccttcgtagaattttcacataaaaccatttaaaaccaaattcagtgaatcttctttgttgaagcaaatttgcagttgaatcgttgatcttcttcaacagaactaaagcaagttcgcctttgtttgttgtataacccaacatgttttcgcggatattcgggaaacccaagcaggaaactaatgctcttatgactcttgacaaattaaacgagacactggagatgcttgagaaaaaggaaaaggtgcttcagaagaaggcctctacagaggttgagaaggccaaagattttacaagagcaaagaacaaaagagctgcaatacagtgtttgaagaggaagaggctctacgaacaacaaattgagcagcttggcaatttccagcttcgcatccatgatcagatgataatgctagaaggcgcaaaagctacaactgaaactgttgatgctttgcggactggagcttctgcaatgaaagcaatgcagaaagcaacaaatattgatgatgtagacaagacaatggatgaaataaatgaacagacagagaatatgaaacaaatacaggaggctttggctactccaattggtgcagcagctgattttgatgaggatgaattggaggcagaacttgaagaattggaaggtgctgaattagaagagcaactgcttcaaccagcaactacagctcctgctgctccagtccatgttcctgcagggaagcaacctgctcggcccattcctcagaagcgtacagctgaagaagatgaacttgctgcattgcaagcagagatggctctttgagctagtccgtcttttattttaaccggtgttatcacgggtagcttacatatagagactggttgtacgcatgtaaaaactactgcaaatgctttcacatttttcgatatctatgtgggttaatatatagagctgtgtacatattggtgttgcagaaaatggtgatttctatggacaccagaatttgtggttcatgttcattagtgaattttatattaactactactactttttttcttttctttttttaaattcacaatttccatagttatcttgtaccatgtcggaaggataatgatatagaatgtatcgtctgtttctgcaaattggtgattgaataatgtgtaccttggtatttttgta

SEQ ID NO: 3662 - DNA, 968 bp, Aristolochia fimbriata
ctctctctcaacgcgttttattcgatctttattacctctcttttccctcggattttttcttctcggtcctagtcttcaaaatctgataaagtctcccgtcttgagaggtgagggtattgacagaggaaatcatgtttgagaagattttcgggaaacctaagcaggaaaccaatgccttggggactctggataagttaaatgagacacttgaaatgctagaaaagaaagagaaagttcttctaaagaaagtagctgcggaagttgagaaggccaaggaatataccagagctaaaaataagagagctgcaatacaatgtttaaagcgaaaaaggctttatgaacagcaagtggagcaacttggaaatttccaattgcgtattcatgatcagatgataatgcttgaaggagcaaaagctaccactgaaactgtggatgcattgaggacaggagcagctgcaatgaaagcaatgcagaaagccacaaatattgatgatgtggataagacgatggatgaaatcaatgagcagacagagaacatgaaacagattcaggaggcactatctacccctattggtgttgcagctgattttgacgaggatgaattggaagccgagctcgaagagttggagggagctgaactggaagagcagcttctccagccagccacaactgcacctgctactgtcccttatgtccctgctggcaaacagccaattcgtgcaggtcccctgaagaccactccagaggaagacgagctcgcagcattacaagcagaaatggccctctagagagatggtgccgatactaggaatatgtaaagattgcttatccattgtatgatgaaagtctgttgcgtaagcgacctctctccatcccacttcagaagtacattctcagtgtgtatactgtgttagaacttaaaagagttcactgtaatgtggtataaagaaagcccaccttcggatctt

SEQ ID NO: 3663 - DNA, 1085 bp, Theobroma cacao
aacagatcaagtggacgacacgtggatagccgatgcattcaacgtcatgaggaagaggagaccgacgcaggttattttctaacacaacacgcttaaggaaaaatcccatataaaaaccgacttccctttttcgttctttctcttataagttgacagatctctctccctctctcaactccccaaatccctagtttctcaattgtacagaagatcgggggtttaatcgcggcgagttaatcatgtttaaccggctttttgggaaacccaagcaggaaacaaatgctttaaccactttagacaaattaaatgagacccttgaaatgctagagaaaaaggaaaaagtacttgtgaaaaaggctgccgcagaggttgaaaaggccaaggaattcgccaaagggagaaacaagagagcggctatacagtgcttgaagaggaagagactctatgaacaacaaatagaacagcttggaaacttccagcttcgtattcatgatcaaatgataatgttagaaggtgccaaagccacgactgaaactgtggatgcattgagaactggagcgtctgcaatgaaggcaatgcagaaagcaacgaacatagacgatgttgacaaaacaatggatgagatcaatgaacagactgagaacatgaaacagattcaggaagcattgtcagctcctattggagctgcagctgattttgacgaggatgaattggaagcggaactcgaagagcttgaaggtgctgagttggaagaacagcttctccagcctgcaacaactgctcctgcagctccaatacaggtgcctgctggcaggcaaccagctcgccctgttcctcaaaagcgcacagctgaggaagatgaacttgctgcattgcaggctgagatggcactttaaggcggctacaggagaactgattttgttgcttggactagcgcaggtcatgttgcaaaacatgaaaaagaggccatattgtattattgaatcgtctactttaaatttgtgtgcatttaaggtttgacagacaatgtacataaagattgcatgaactaaacaaagccccttatttgtactctgcttccttga

SEQ ID NO: 3664 - DNA, 1245 bp, Ricinus communis
attgtaaggaaccgaggataataattgggtgccacgtgtaaaagcatattcaacgccgtgaagaaaaggagaagcaacttcgctgcgttctccatctctaattacaacacgcttaagcaaaccaaaacctaaaagtccgatctctcctcccatcactcaaattgatttctcctttcaatttctcatatcttcaatttctaagaagatcggggcagcctttttgcagataggagtcaatcatgtttaaccggctttttggaaaaccaaaacaggaaactaatgctctaactacgttagacaaattaaatgagacacttgagatgttagagaaaaaagagaaagtactttcaaaaaaagctattgcagaagttgaaagggcaaaagaatttactcgaacaaagaacaaaagagctgctattcaatgtctgaagaggaaaaggctatatgaacaacaaatagaacagcttggaaatttccaactccgtattcatgatcaaatgataatgttagaaggtgcaaaagccactacagaaactgtagatgcattgagaactggagccgctgcaatgaaggcaatgcagaaagcaacgaatattgacgatgtggataagacgatggatgaaatcaatgagcagactgagaacatgaaacaaattcaagaggctctttcaactcctattggtgctgcagctgattttgatgaggacgaattggaggcagaacttgaagaattggaaggtgctgaactggaagaacaacttcttcaacctgcaaccacagctccagcagctccagtgcaggttccagcaggccggcaaccaaatcgtcctgctgctcagaaacagacagctgaggaagatgaacttgctgcattgcaggctgagatggcactttgagcgggtactttttcccagaacactgaagagtttatttatggttacattgtggacatggagtttctgctactccttcggggatcctgtgtgcattatatggtctgaacagacaatgtatataaagattgcgtaaactaaagagacattgccatttaaaacttgtaatctgcattttggaggttgaatccagttttaaatctgtgtccccttgtctccaaccttttttatttttccttgtgcggtcaagctgattcaaacttccatttttaatgtcaccaacttcttgtccttaaaatgtctacccgacatatatagcaaataaatttatgttatatttttggtgttgtta

SEQ ID NO: 3665 - DNA, 5243 bp, Ricinus communis
aaacatattccttgatggatgtcaatatgtacaaaattttcctccattaacagagagagaactcatgttgaagatagtaatcaaagttctaaacagcacagatcaacaacaacaacaaagacgcaaatatgataatgcacattcaagatgacattgacatctgcaggcctgaaatagtcgaatatcaattctaacttctttatcaggcagtttctgatactcagctgtcaacttgatcatgtttcatgacatttcatccattattacataggctcttgtacttcataattcatcgagtaagttttccttggttgtcctggattcgggttgatattccaggaggtacctcacagctaatgatgcatgtagggaggctccatatggaagcacctcttcattaactctgaaatatggtgaatgaccagatccaggtggtccgtgagactcatccttcatcccaagaaagaagaagcatccaggaactgcctctgcaaagaagaagtcttctgctcccattagtggttgcatttctttaacgttctgggcacccagcatggctattgcaatatttacaaactgcttatgcaaatctttattatttacagtcactgtgtagaggggtttttcatctacgttaaagcggacagttgcattacacctctgaacgctagcttgttttgtgataacctgtgatttgtgttgtaatagaattaacaaatgttatagcatgactttatatggcttcaacatgacagcaaattcaaacacccaaagaacctatttgtcaaacatggtgcaaaccaagcaatacttagtaacatatacctcttcaatacgttgtttaatttggatgaaactatcttttgaaaatgccctgaatgtgccaccaattgtaacagaatctggaataatattgaatgcaccacctccttggaatttcgcaattgttactacctgcacagatattcttcttcttggaaatgcttattgaacagtcacagagtgagcatatatagggcaataatatgaggcaatgcacaagcatgcaataggagaagctcaattcatcaaattttaatttgtaataagatgactaaacaccataaaagaaaaagactacacactttgtccaatttctacgtaaatatcattgccatggataaggttatctaaacataagatactttgtcttgaaaatgaattaataaattggaaacaagaaagtttgattaagacaatttttcttttagtaatacaaaagaaataaaggatggcatcaagaaactctacctaggaatacaaaggcacaattcacataagacagtgaaccagctcatgttgttactctgatgagacagagatcagggagagaactttacaacagaatttacgtggatcatgcactagagatgtcccaggcataaaataaaataatgttagaggtggaaatgactaggagacaactgacaggttatgtactcatcaacattgattcatcttgcttgaaaaggttataaagcaagaggagacagggggtgttaaaacccttatgttatgtcttaaaactggcagtaaatatctatgtatccacacattgatgcacacacatgaacgtatatatgtgtacaaaagagagaaagatacctgtgaatccaagggagcttcacgtgaaacaagatgctgtaaactaacaatcacattggaagctgctaaaataggatcaactgtgtgctggggaatggtagcatgccccccttttccacttatctcagcctcaaagaaacccctgccagccaaaacagggccaggtctggaggcaactgtatcaataggaaatagagtagaaacttatattccaaagatggcatcgacattcctgagaaccccagaatccaacattctcttggctcccccatgtccttcctcagctagttgaaaaacaagaacgaccgttcgctaaaagcacaataaaaattcatacaaatttatcttgatacagaatttggcattcagcattattaccttcagaggacagaaaaattaaataatgaggaagcataaaactaacttttgttaaaaagcgccagacaaatctgtcaagaatggtttgaaagggattaaaaaaacaaagagagaggaaagataagcatatttggaagttcctttctcaatttttgatacaaggcaatccaccatccttgagcaattaaattataagtttacttctgttatcagattttagcaaggttgctaaccacataatccaagaacaaacttgcatcttgggattacaatgtatgagcagtagaattaactgatccagctttgactacctttttcttaagaaggatgtgaatgtgactggaaccttttaaaaagtacaaatactttgtgaaagttaaggatatgaaattgagaattactagcaatctaagcaaatatttgatatagaaataggtaaccttttcgaatttagattacaaagtccaaaagaaaaaagcatttaacatgtagaaatactacaaatatatgcagatacaactatccaggggagcagaaagttgagggaaaatcttcaagagtaagaactagggaatacaaaattctttcaagacgaaaagaacagaaaatcatggaatagtacaaaaggtgacaattctttttgccacgtagttgtaagaatgaaattgtaaaacttgattaatcaatggcagaattcagtacaaagagaatggcaaggacaacagcaaattaagtgctcaactagtcaggtaccttaaaaacaagccttttacatctccacgagaatcaaacaagtatagtgtgtctcatagcctttgaagtttgaatatcactacgaatatccatttccacccaatattggattaagcaattatagcctagtggaataattcccatattctgcagtggtaaaatcattccacaaatgtggcaggccaatcataaaacctccataaagtaacaaattacattattcaactaatgaaataagtaaaaagatagaacctgtaactcgtggcgatgctcatgaagcatcttagcagcaccaagaagcattgcaacatggacctcatgccacaagcatgcattttccctgcaactttactcttgtgctcccactccatagccttctatgataacaactgaacctccatgaattaatttttaacatcactaatcctctcaaggcaactaaccacaagcattcaggcaccagaaactgattaattaatttttcttcttaaggaaaaaaaaaaaaaaccaagacctgcattgccagaccatccatatcagctcttatggcaacataaggcggcccaccagttccactatagccaaaaataccagtaacagcaactggatattcataacggatgcccaaatgatcaagttcagctctaacaagcttactggtctcaaattcctcaaaagcaagttctgggttctcgtgaattttactcctaatacttaccatataatcaaaaagcttggtctttttgcgaggtgaaggaaattaacagggatttgagcaagttgttctttgctaataaaaggtattgaggagatgaattttgagagaaagaagtggagaagtagaatcagaagagaaccattaaattgtgtaaagattggaaccttagagaagtgtgactgttaaactgaagagtgagcaaacagaggggaaaacaaaaataatgttctctaatttattttttccaatacctttaaagcatttttataattggtaaagttttgtttattcttttaatttttttgattgagtaatctttaagattcttgatcggaggcgtttcttcttcttttttttttttaggaaatgcatactttttgcttttttaagagaacttagacttttattttggttcaagtatacatgtttttttatcttctaaaaaaaaaaaagggtatacatgttatatatatatatatatattttaacataatcgattattgtaaggaaccgaggataataattgggtgccacgtgtaaaagcatattcaacgccgtgaagaaaaggagaagcaacttcgctgcgttctccatctctaattacaacacgcttaagcaaaccaaaacctaaaagtccgatctctcctcccatcactcaaattgatttctcctttcaatttctcatatcttcaatttctaagaagatcggggcagcctttttgcagataggagtcaatcatgtttaaccggctttttggaaaaccaaaacaggaaactaatgctctaactacgttagacaaattaaatgagacacttgagatgttagagaaaaaagagaaagtactttcaaaaaaagctattgcagaagttgaaagggcaaaagaatttactcgaacaaagaacaaaagagctgctattcaatgtctgaagaggaaaaggctatatgaacaacaaatagaacagcttggaaatttccaactccgtattcatgatcaaatgataatgttagaaggtgcaaaagccactacagaaactgtagatgcattgagaactggagccgctgcaatgaaggcaatgcagaaagcaacgaatattgacgatgtggataagacgatggatgaaatcaatgagcagactgagaacatgaaacaaattcaagaggctctttcaactcctattggtgctgcagctgattttgatgaggacgaattggaggcagaacttgaagaattggaaggtgctgaactggaagaacaacttcttcaacctgcaaccacagctccagcagctccagtgcaggttccagcaggccggcaaccaaatcgtcctgctgctcagaaacagacagctgaggaagatgaacttgctgcattgcaggctgagatggcactttgagcgggtactttttcccagaacactgaagagtttatttatggttacattgtggacatggagtttctgctactccttcggggatcctgtgtgcattatatggtctgaacagacaatgtatataaagattgcgtaaactaaagagacattgccatttaaaacttgtaatctgcattttggaggttgaatccagttttaaatctgtgtccccttgtctccaaccttttttatttttccttgtgcggtcaagctgattcaaacttccatttttaatgtcaccaacttcttgtccttaaaatgtctacccgacatatatagcaaataaatttatgttatatttttggtgttgttactggac

SEQ ID NO: 3666 - DNA, 977 bp, Cichorium intybus
tttcgttatcttttctttgttaagcttttgtcctccaagccctaatactttaaactaaacccatatcaaattcatcgaatccaatttgtccattatcaccgatcatcgtgaaggtcttggagatttcaattttacgggagcagatcgtgcacatatccactagaatcaaccatgtttacgcgaattttcggaaaacctaagcaagaagctaacgctgtcgcaacgttagataaattaaatgagacacttgaaatgctggagaaaaaggagaaagtacttttaaagaaagctgctgcagaagtggagaaggccaaagaatttactagagctaaaaacaaaagggctgcaatccaatgtttaaagaggaaaaggctatatgaacaacaaattgaacaactcgggaatttccagttacgtattcatgaccagatgattatgctggaaggtgcaaaagccaccacagaaaccgttgatgctttaagaaccggtgcatcagcaatgaaagccatgcaaaaggcaacgaacattgacgatgttgacaagacaatggatgaaattaacgagcaaaccgaaaacatgaaacaaattcaagacgcattgtcagcacccattggtgcagctgctgattttgatgaggatgaattggaagctgaacttgaagaattggaaggagctgagctggaggaacaacttctccaaccaaccaccaccgcccctgccgctccggtacatgctccggcgagccgccagcaagtccggccacctccccggaaaaacacggctgaggaagatgaacttgctgcattacaggcagaaatggcactttaaaactaaaagatggagagtggagatgcatataaatgaagaaattgaaaaaatggtgagagcttggttggattttatatcttgtacatttgtgatattacacatgaaaaacatgtttggatttggtttattgaaggaggttatatttgtaa

SEQ ID NO: 3667 - DNA, 1012 bp, Cucumis sativus
gcaaagccgaatcctattcgcctctctatcagatctgttcttaattctttactctccatttcttctcatcaaattcctctttgatttccgatcatcacttctcagaagttcgaagctcgggtcgaatcatacataattcaccatgtccatgttcaataagctttttggtaaacctaaacaggagtctaatgccctggccacgcttgataaattaaacgagacactggaaatgctggagaagaaggagaaagtacttctgaaaaaggcttccacagaagttgagaaggccaaagattataccagagcgaagaacaaaagggctgctatacaatgtttgaagaggaagaggttatatgaacaacagatagagcagctcggcaacttccaattgcggattcatgatcagatgatattactagaaggtgcaaaagccacaactgagactgtagatgcactgaggaccggggcagctgcaatgaaagcaatgcagaaagcaacgaacattgatgatgtggacaaaacaatggatgagatcaatgaacaaactgagaacatgaaacagatccaagaagcactatcaaatccaattggtgctgcagccgattttgatgaggatgaactggaagcggaacttgaagagctagaaagtgccgagttggaagaacaacttcttcaacctgcaacaacagctcctgctgctccaattccagtccctgcaggtcgacaaactgctcgacccgctcctcagaaacgaactgctgaagaagatgagctggcagctctacaggctgagatggcactttgatgcgacatccaacaatattccaaagcaggtggcgttgcaggacgagaattcgaaggagaggcgatatgaagaattggctatgaggttgttccgaagaattgaacattttttgctatgttctcaacaaagcctgatgaaaggtctgtttgtgataatatcagacaataatgcaaatttgaattaggtcttgtatactctgtaaatgaa

SEQ ID NO: 3668 - DNA, 1110 bp, Elaeis guineensis
  misc_feature (83)..(83): n is a, c, g, or t
  misc_feature (806)..(806): n is a, c, g, or t
  misc_feature (939)..(940): n is a, c, g, or t
  misc_feature (945)..(947): n is a, c, g, or t
  misc_feature (1048)..(1048): n is a, c, g, or t
cgagggcgggggatttcggaacctatcgtcccctctgcgatttcctcgaagagcccttgctatcgccttctttccatccaaangcctccttcttcgttttcgatcattctgtccaaaaccttaattacctacatcgatcgttcgatcgatcgatcgatctactcttcttgatacgttagaggcgagttatttagaagctggccaccatgtttggtaggattttcggaaagcccaaggagcagacaaatgccttggccaccctcgacaagttaaacgagacacttgagatgctagagaaaaaggagaaagttctcctgaagaaggttgctgctgaggttgagaaggctaaggagttcacaagagcaaagaataaaagggccgcaatacaatgcttgaagagaaaaaggctttatgagcagcaagttgagcaacttgggaatttccaattgcgtattcatgatcagatgataatgttggaaggtgcaaaagctacaacagagactgttgatgcattgagaactggagcagcagcaatgaaggctatgcagaaagcaactaatattgatgatgttgacaagactatggatgaaattaatgagcagacagagaacatgaaacaaattcaggaagcactatctgctccgattggggctgcagctgattttgatgaagatgaattggaggcagaactcgaagagttggagggtgcagagttggaggaacagctactgcaacctgccacaaccgctcctgctgctccagtgcatgtccctgctggcaggcaacaggttcggcctgctccacanaaaaatacagctgaagaagatgaacttgcagcattacaagcagaaatggcaatgtaggcaggtactcaatgcttgaagtgcaacaaatgtaaaaatgattgggtgtaatctattgtggaggtgaagactcttnnctctnnnttttacatcatccggtgtgtacatttgcacaacatattatcatggtggctgatagaaaaggtgttgctgtcaacttgttttccattgacgatttcttttanttggatggttcctgtaatcactcaatattgcaagacaaaattctagtctgctgttcaagatt

SEQ ID NO: 3669 - DNA, 984 bp, Carica papaya
tttccccaaaatcttctcttccttttcctccgaaaacctcataattctaccctcccttgaccgccggagtcacagccggtcttctgatctcgagaccgtctcagatcgtctattctctctgacgattcgcgcgcgttaatcacctgcaaacaaacgaatttgcgcctgatttcttttgctcctccgattactagacggtaactccctgagatcggagtttaataacatatatcaagatgttcaatcggctattcgggaaacctaaacaggagacaaatgccttggccacgttagacaagttaaacgagactcttgaaatgctagagaaaaaggagaacgtccttctgaaaaaggctgcaacagaggttgaaagggcaaaagaattctcaagggcaaaaaataaaagggcggctatacaatgcttgaagagaaagaggctatatgaacaacaaattgagcagcttggaaatttccagctgcgcattcatgatcaaatgataatgttagaaggtgctaaagcaacaactgaaactgttgatgcattgaggactggagcagctgccatgaaggcaatgcagaaagcaacgaatattgatgatgttgacaaaacgatggatgagataaatgagcagacggagaacatgaaacagattcaggaagcattgtccactccgcttggagctgcagctgattttgatgaggatgagttagaagcagagcttgaagaacttgaaggtgctgagttggaagaacagcttctacagccggcaacaaccacccctgcagctccagtgcaggtgccttctggcaagcaaccagtgcgtcctgcacctcaaaagcgtactgccgaggaggatgaactggccgccttgcaggcagaaatggcactttaagtggtatatttcagtttaattcacacgtctagatttgtgtaaaggcacagaccatgtatatagagattgcataaactgattgtcctcctta

SEQ ID NO: 3670 - DNA, 1118 bp, Solanum tuberosum
gatttgctgttgaatcgttgatattgcttctactctaaattgtaacttgtaatcaacagaattttcgcctttgtttgttgtataagcaaacatgttttcgcggatgtttgggaaacccaagcaggaaactaatgctcttatgactcttgacaaattaaacgagacactggagatgcttgagaaaaaggaaaaggtgcttcagaagaaggcctctacagaggttgagaaggccaaagattttacaagagcaaagaacaaaagagctgcaatacaatgtttgaagaggaagaggctctacgaacagcaaattgagcagcttggcaatttccagcttcgcatccatgatcagatgataatgctagaaggcgcaaaagctacaactgaaactgttgatgctttgcgaactggagcttctgcaatgaaagcaatgcagaaagcaacaaatattgatgatgtggacaagacaatggatgaaataaatgaacagacagagaatatgaagcaaatacaggaggctttggctactccaattggtgcagcagctgattttgatgaggatgaattggaggcagaacttgaagaactggaaggtgctgaattagaagagcagctgcttcaaccagcaactacagctcctgctgctccagtccatgttcctgcagggaagcaacctgctcggcccattcctcagaagcgtacagctgaagaagatgaacttgctgcgctgcaagcagagatggctctttgagctagtccgtcttttattttaaccggtattatcacgggtagcttacatatagagactggttatatgcatgtaaaaaactactgcaaatggtttcacatttctcgatatctatgtgggttaatatatagggctgtgtacatattggtgttgcagaaaatggtgaattctatggacaccagaatttgtggtttatgttcataagtgaattttatgttcactaccgtcttctttttttcttttctttttttttaaattcacaatttccatagttatcttgtaccatctcggaagggataataatataaaatgtattgtctgtttctgcaaattggtgattgaataatgtgtaaccttgtatttttgtaaataa

SEQ ID NO: 3671 - DNA, 802 bp, Euphorbia esula
cgcttaaggaaaacaaaaatccccaaattatacatcttctcctcagtctctggttcgatcaagaaccctagtaatctaattcgatctctcttcctcaaatcctacaccaatctcaaaggagatcggagctgaactttgattcgaggataagaagcaaccatgtttaaccggctttttggaaaacctaagcaggaaaccaatgctctaacaacgttagacaaattaaatgagacacttgagatgctagagaaaaaggagaaagtgctcataaaaaaggctggtgcagaagttgaaaaggctagggaattcactcgatcaaagaataaaagagcggctattcaatgtttgaagaggaagaggctctatgaacagcaaatagaacagctaggaaatttccaattgcggattcacgatcagatgataatgttagaaggtgcaaaagcaaccacagaaactgtggatgcattgaggactggagcatctgctatgaaggcaatgcaaaaggccactaatattgatgatgtggacaagactatggatgagatcaatgagcagactgaaaacatgaaacagatccaagaggcactttcaacacccatcggagctgcagctgattttgatgaggatgaattggaggcggaacttgaagaattagaaggtgctgagttggaagaacagcttcttcaacctgccaccacagctccggcagctccagtgcatgttccggcaggaagacaaccaactcgtcctgttcctcaaaagcgcacagctgaggaagatgaacttgctgccttacaggctg

SEQ ID NO: 3672 - DNA, 1232 bp, Solanum lycopersicum
gtggattgagagtagcattacgcttaagaaaaggcatatacccaataaacaaaccgggtcggcccgtcattgttctccttcgtagaattttcacataaaaccatttaaaaccaaattcagtgaatcttctttgttgaagcaaatttgcagttgaatcgttgatcttcttcaacagaactaaagcaagttcgcctttgtttgttgtataacccaacatgttttcgcggatattcgggaaacccaagcaggaaactaatgctcttatgactcttgacaaattaaacgagacactggagatgcttgagaaaaaggaaaaggtgcttcagaagaaggcctctacagaggttgagaaggccaaagattttacaagagcaaagaacaaaagagctgcaatacagtgtttgaagaggaagaggctctacgaacaacaaattgagcagcttggcaatttccagcttcgcatccatgatcagatgataatgctagaaggcgcaaaagctacaactgaaactgttgatgctttgcggactggagcttctgcaatgaaagcaatgcagaaagcaacaaatattgatgatgtagacaagacaatggatgaaataaatgaacagacagagaatatgaaacaaatacaggaggctttggctactccaattggtgcagcagctgattttgatgaggatgaattggaggcagaacttgaagaattggaaggtgctgaattagaagagcaactgcttcaaccagcaactacagctcctgctgctccagtccatgttcctgcagggaagcaacctgctcggcccattcctcagaagcgtacagctgaagaagatgaacttgctgcattgcaagcagagatggctctttgagctagtccgtcttttattttaaccggtgttatcacgggtagcttacatatagagactggttgtacgcatgtaaaaactactgcaaatgctttcacatttttcgatatctatgtgggttaatatatagagctgtgtacatattggtgttgcagaaaatggtgatttctatggacaccagaatttgtggttcatgttcattagtgaattttatattaattactactactttttttcttttctttttttaaattcacaatttccatagttatcttgtaccatgtcggaaggataatgatatagaatgtatcgtctgtttctgcaaattggtgattgaataatgtgtaccttggtatttttgta

SEQ ID NO: 3673 - DNA, 1026 bp, Solanum melongena
aaaatttctcaggtcagtcaatggaactctactctcaaacgtataagaaagcaaaaatcttttttggattgtaattgttgctgacaaaatcaagaatgtttggccgaatatttggaaagcctaaacaagaaacaaatgctttagctacgctagacaagttaaacgagactcttgatatgcttgagaaaaaggagaaggttttactgaagaaggctgcagctgaggttgaaaaagcaaaggaattcactagagcaaaaaacaaaagggctgcaatacaatgtttgaaaaggaaaagactttatgagcagcaaatcgagcagcttggaaacttccaattgcgtattcatgatcagatgataatgttagaaggtgcaaaagccacaacggaaactgttgatgctttaagaaccggagcagctgcaatgaaagctatgcaaaaggcaacgaatattgatgatgtcgacaaaacaatggatgagattaatgagcagactgagaatatgaaattgattcaggaagcattatcaacgccaattggttcagctgctgattttgatgaagatgaattggaggcagaacttgaagaactggagggggctgaattggaggaacagctcctccagcctgctacaactgctcctgttgcaccaattagtgtacctgctggcaggcaacaagtgcgtcctgctgctcagaagacggaagaagatgagcttgctgctttgcaggctgaaatggctctttgaacagtgctcgttgcctcccacgagacagtgatgtgttcttatggtggatggttataccttgggggctttgaattggatatttgcaggatgagaagttactctataaacgccagcagatgatgagtttacattctatgtgatgttgaagtgggaagaaagcattgctactttggtgtgaaatatgaaaaagataattttaagatacttttaaatgaattgtcaagacttggttgtttatgatgaaaaccttctaaattattattctatacaagcacttatt

SEQ ID NO: 3674 - DNA, 1047 bp, Nicotiana tabacum
  misc_feature (54)..(54): n is a, c, g, or t
  misc_feature (78)..(78): n is a, c, g, or t
  misc_feature (86)..(86): n is a, c, g, or t
  misc_feature (91)..(91): n is a, c, g, or t
  misc_feature (99)..(100): n is a, c, g, or t
  misc_feature (102)..(102): n is a, c, g, or t
  misc_feature (115)..(115): n is a, c, g, or t
  misc_feature (124)..(124): n is a, c, g, or t
  misc_feature (207)..(207): n is a, c, g, or t
  misc_feature (217)..(217): n is a, c, g, or t
ggccattacggccgggggatttcctttgagaaatttctcagatcatttacaaanttcaaagtcaaaatttgattaatntccaattntccanaacctctnnanttttctcagttanataattttnattttctgaagctttaacaaaatttaacaatgtttccccgactctttggaaaacctaaacaagaaacaaatgctctagctacnctagacaagntaaacgagactcttgagatgcttgagaaaaaggagaaagttttactgaagaaggctgctggtgaggttgaaaaagctaaggaatttactagagcgaaaaacaaaagggctgcaatacaatgtttgaaaaggaaaaggctttatgagcagcaaattgagcagcttggaaactttcaattgcgtattcatgatcagatgataatgttagaaggtgcaaaagccacaacggagactgttgatgctttaagaactggagcagctgctatgaaagctatgcagaaggcaacgaatattgatgatgtcgacaaaaccatggatgagatcaacgagcaaacagagaatatgaaactgattcaggaagcattggcaacaccaattggttcagctgctgattttgatgaagatgagttggaggcagagcttgaagaactggaaggagctgagttggaggagcagctccttcagccagctacaaccgctcctgttgcgccaattaatgtacctgctggtaggcaacaagtgcgtcctgctgctcagaagacagaagaagatgagcttgctgctttgcaggctgaaatggctctttgaacagttctcgttgcctaccacgagacagtgtaaagatgtgatgtattcttatggtggaggattatacgtcgggctctactctccctccagtcttcatgttgaattcgtaacatgcatgcaggatcaaaagtaaatgtgtaaatgacagcagatgagtttaattctatatcaagttgaagtgggaaagagcatgctacttttgcgtgaaatatgaaaaagatgttataaaattctctttaacga

SEQ ID NO: 3675 - DNA, 1176 bp, Tabernaemontana elegans
agcaagcaaaggtcccaaagaccaatatccaatccttttccaatcgggaatccccctcccttcttcttcttcttcgtcctctctccacgttgctttctgaatcagagtcctaactctgaatcttttttgtccctgcggtttcgttgaatcgatcgatcgctgattttgaagccctaggctccaatttcacaaggttttttattagccggaagcggaggagatcagttctttgtatttgcaacagaagatgtttactcggatatttggcaagccaaaacaggagactaatgctgtcgcaaccctagataaattaaacgagaccttagagatgctcgagaaaaaggagaaagtacttcaaaagaaggcatcagctgaggttgaaaaggccaaggagttcaccagagcaaagaacaagagggctgccatccaatgcttgaagaggaaaaggctctatgaacaacagattgagcagcttggtaatttccagttgcgcatccacgatcagatgataatgttagaaggggctaaagctacaacagaaactgttgacgccttgagaactggagcatctgcaatgaaagcaatgcagaaagcaacaaatattgatgatgtggacaagacaatggatgaaataaacgaacagacggagaatatgaaacagattcaggaagctttggctactccaattggtgcagccgctgattttgatgaggatgaattagaggcagaactggaagaattggaaggtgctgagctggaagaacagcttcttcagcctgcaaccacagcccctgcagcaccagtgcatgtccctgcaccagcaggcaggcaacaagctcggcctactcctcagaggcaaacagctgaggaagacgaacttgctgctctgcaagcagaaatggcactttgagcagttcaacaatttgttgatttaagggtacgagattacatgcggatctgatcaatcaatatggagagcgctggttctatgtaggccagttctgcacgtattctggttataatactgtacttctgtacataaaggcatgacgaaaattggagcaagcttctttcgacattttaattaatattccatgcttacagttgaaatggttgacaatcttttgtaagcaatataataataatactactggttttgcttgtccacacagtcct

SEQ ID NO: 3676 - DNA, 1368 bp, Eucalyptus grandis
aaggcgacgaagcaaggaagccttgtctcctcctctctctctctctctatcaacacgcctaagcaaacctccattatcatccctcccccaaaattcaaccctcctcaccaccaccactgccgccgccgattcctctccaccggcccagcgcgtcgcgatcaccggatcccagcctcccgtttttccgatccctcggccggcgtccagctccgccgtcgatctcttccgaggacatcgcgaggattgtgttagggacgcgatcgatcgacaaccatgtttaaccggctcttcgggaaacctaagcaggagaccaacgctctcacgacgttggataagctgaacgagacacttgaaatgctggagaaaaaggagaaggttctcataaagaaggcatctcaagaggttgagaaagcgaaggagttcactagagcaaaaaataaaagggcggcaattcaatgcttgaagaggaagaggctgtatgaacagcaaattgagcagcttggaaatttccaacttcggattcatgatcagatgataatgttggaaggagcaaaagcaaccactgagactgtggatgctctgagaactggagcagcagcaatgaaagcaatgcagaaggcgacaaatattgatgatgtggacaagaccatggatgagattaatgaacaaacggagaacatgaaacaaattcaagaggcattgtcaactcccattggtgcagccgctgactttgatgaggatgagcttgaggcagagctcgaagaactggaaggtgctgagttggaagagcagctccttcagcccgccacaacagctcctgctgctccagtgcatgtcccaactggtcctggtccgcgtccagcccgccctgttcctcagaggacagccgaggaggatgaacttgctgctttgcaggctgagatggcactttgagcaggtcttgctgctcatagttaactgaggctgtgtaaagacctggccaaaacctgtaatatggacattcctgctgctgtgctgctatgcctatgcatcaatatttttctgtggatccatactgaaaagacgtgtatataaaggtggcatgattcaaaagatgtccccctttcagacttgtattctgctttctggtgcttctagtgtggtctcttttttcaatttcaacttcatgtcaaaccttattgtttggaagacatctctagatatctcaggttaggttttttttttccctttgtatgtcacttttaaaattaatgcggctgaatctctgaggggggcggtacttatcatgagcgatatgctttattatacgtctagtggaagacatgttggttgttgagttactcctggtatcggaattgagtagttatg

SEQ ID NO: 3677 - DNA, 997 bp, Tragopogon dubius
tcgggggtccctaacttgttaccataatttgcttaagctatgttcccgagccctcgaatactttaaactaaacccatatcaaattcatcgaataccatttgttcttcatcccaccgatcgtgcggatacatcataaattttaaggtgtagcagatttagttttacgggagcagatcgtgtatacatctactagaaacaacaatgtttacgcgaattttcggaaaaccgaagcaagaagctaatgcggtagcaacattagacaaattaaatgagacactagaaatgctggagaagaaggaaaaagtgcttttaaagaaagctgccgctgaggtggaaaaggccaaagaatttactagagctaagaacaaaagggcggcaatacaatgtttaaagaggaaaaggctctatgaacaacaaattgaacagcttgggaacttccaattgcgtattcacgaccagatgattatgctggaaggtgcaaaagctaccacagagactgttgatgctttgagaaccggtgcatcagcaatgaaagccatgcaaaaggcaacgaatattgatgatgttgacaaaacaatggatgagataaatgagcaaactgaaacatgaaacaaattcaggaggctttggcagcacccattggtgcagctgctgattttgatgaggatgaattggaagctgaactggaagaactagaaggagcagagctggaggaacaacttctccaaccagccaccaccaccccagctgctccggtacatgttccggcaggccgccaacaagcacggccacctcctcggaagaacacagctgaggaagatgaacttgctgcattgcaggcagaaatggcactttaaaacaaaaggttagtagttgcctcttttcagattccaacaatcacattcttctattgtcggggtttaatgtatatttgtgataacatgaagatcaattgacatttatatttgtacatggattcgaggaaatgcgtgttgac

SEQ ID NO: 3678 - DNA, 1143 bp, Solanum lycopersicum
gcaaattccattggtctgtcatagcacagcactgacgtctcctccacatgagcaatcttctgccaaaaagatccaacctttaaaattgattgagaaatttctcaattattacaaacttcgaaggtcaaaacccgattgatttcagaaacccttcaaagtttctcagggtttaaataattttgatcttttgaagcttttttgtattataattgttgctgacaaaatcaagaatgtttacccgaatgtttggaaaacctaaacaagaaacaaatgctctagctacgctagacaagttaaacgagactcttgagatgcttgagaaaaaggagaaggttttactgaagaaggctgcagctgaggttgaaaaagcaaaggaatttactagagcaaaaaacaaaagggctgcaatacaatgtttgaaaaggaaaaggctttacgagcagcaaatcgagcagctcggaaacttccaattgcgtattcatgatcagatgataatgttagaaggtgcaaaagccacaacggagactgttgatgctttaagaactggagcagctgcaatgaaagctatgcaaaaggcaacgaatattgacgatgtcgacaaaacaatggatgagatcaatgagcagactgagaatatgaaattgattcaggaagcattgtcaacaccaattggttcagctgctgattttgatgaagatgaattggaggcagaacttgaagaactagagggggctgaattagaggaacagctccttcagcctgctacaaccgctcctgttgcgccaattaatcttcctgctggcaggcaacaagtgcgtcctgctgctcagaagacagaagaagatgagcttgctgctttgcaggctgaaatggctctttaaacagttcttgttgcctcccacgagacagcgtaaaggcttgatgtattcttatggtggatggatatacctttggggctttgaattcttaaagatgcatgcaggatcagaagttactgtataaatgacagcagatgatgagtttacattctgtgtgaagttgaaagtgggaaaattgtatgctaatttcgtgtgaattattatgaaaaaagatgttctaagatatacttttaaatgaattttcaagacttctgttgtttacatt

SEQ ID NO: 3679 - DNA, 1208 bp, Manihot esculenta
gttgatcatacaacacgcttaagaaaagccgggacaaaacctgccccctttctccttccccttccccttccccttccccctccccctccctcctcgatctctgctctaataaaaaactcttattagtcaattagatttctactgaaaatccgtataaccaatttcagagaaaatcgcagcagcgttttaaatttcgggtaggagtaaaccatgtttaaccggctgtttggaaaacctaagcaggaaacgagtgctctagctacgttagacaaactaaatgagacacttgaaatgctagagaaaaaggagaaggtacttgttaaaaaggctgctgctgaagttgaaaaggccagagaattcacccggacaaggaacaaaaaggcggctattcaatgtttgaagaggaagaggctttatgaacagcaaatagagcagcttggaaatttccaactgcgaattcatgatcagatgataatgttagaaggtgcaaaagccactacagaaactgtagatgcattgagaactggggcatctgcaatgaaggcaatgcagaaggcaacaaatattgatgatgtggacaagacaatggatgagatcaacgaacagacagaaaatatgaaacagatacaggaggcactgtccactcccattggtgctgcagctgattttgatgaggatgaattggaggcggaacttgaagaattagaaggtgctgaattggaagaacaactccttcagcctgcaaccacagctccagcagctccagtgcaggttccggcaggaaggcaaccagcccgcccagttgctcaaaagcgcacagctgaggaagatgaacttgccgccttacaggctgagatggcactttgagcagatattttttaccagaatgttgaagagcttatttaaagattggtgaataggaatttatgctgctttacgcatcatacgtgcatttagtggcttgagcagaatgtatataaagatggctaaagaaactgtcttgattatgtaacctgtgttctgagagtttattcagttatttctccgtctgtccgcgctctcaatgcgaacaacttttttttcttgcaagtttaaactttcatcatgtcaccttgttatccttgcattgtctattaggcaatagtacagagcaaggaaatgtacgtaatatgatagtctttgtggacgaataacattagccattactt

SEQ ID NO: 3680 - DNA, 1000 bp, Gossypium hirsutum
ccgcgcaggtgtatcaacgcagagtacatgggcaagacttcaagttcaacgtcgtgaagaagaggcaaaaacctattttttttcagatcgggcggtttgatcggagaatttaaccatgttcaaccggctttttggaaaacccaagcaagaaatcaatgctctaaccacgttagacaaattaaatgagacccttgaaatgctagagaagaaggagaaggtacttctcaaaaaggctgctgcagaggttgaaaaggccaaggaattcgccaaagcgagaaacaagagagcggctatacagtgcttgaagaggaagagactatatgaacaacaaatagagcagcttggcaacttccagcttcgtgttcatgatcaaatgataatgttagaaggtgctaaagccacaaccgaaaccgtagatgctttgagaaccggagctgctgcaatgaaggcaatgcagaaagcaacgaatatagatgatgttgacaaaacaatggacgagatcaatgaacaaaccgaaaacatgaaacagatccaagaagcactgtcaactcctattggagctgcagctgattttgacgaggatgaattggaggcagaactcgaagagcttgaaggtgctgagttagaagaacagcttctccagcctgcaacaacagctcctgcagcaccaattcatgtgcctgctggaaggcaaccggctcgtcctattcctcaaaagcacacagctgaggaagatgaactcgccgcattgcaggctgagatggctctttaaggcttacagtagagaactgatttttttttgcgtggcctacggaaaagagacgccatatttgtattactgaatgtgtgcatttaaggtttgacagacaatgtacaaaaattatttgtactttgcttccttcaaaagaaaaccattgattctaagtccttgtacctatattgacttgccttgtaatgtcaacaacttggtgacaaaatcgtatggaaaatgacatttggt

SEQ ID NO: 3681 - DNA, 1104 bp, Ipomoea nil
gttacacccctcctcacataagcaatctcgatacgagtcgtcgttctcctggtgctcaagcttttttagaagtacgattgggttatcagtcatcggatcattcggaaaacgtcgaatctgaataattgatccgattcaatattcggtgttctcaggaaatcggaatttttattcaatttactagggaacgttataattcaccatgtttacgcgaatcttcgggaaacctaaacaggaaacaaatgctctagccacacttgacaagttgaatgagacccttgagatgttagagaaaaaggagaaagttctacagaagaaagctgctgctgaagttgaaaaggcaaaggagtttactagagctaaaaacaaaagggctgcaattcaatgtcttaaaaggaaaaggctttatgaacaacaaattgaacagcttggtaacttccaattacgcattcatgatcagatgataatgctagaaggtgcaaaagccacaacagagactgttgatgctttgagaactggagcagccgcaatgaaagccatgcaaaaggcaacgaatattgatgatgtagacaaaacgatggatgaaattaatgagcagacggagaatatgaaacagattcaggaggcactgtctacaccaattggagcagcagctgatttcgatgaggatgaattggaggcagaacttgaggagctagaagaagctgaattggaggaacagcttcttcaacctgccaccacagcacctgctgcaccaattcatgtaccagctggtaggcaacccgaacgacatgctcctcgaaagaacaccgctgaggaagatgagctcgctgctttgcaggcagaaatggctctttagaaagtttatgattcttgaggagagattgtgtgacggatcggatggtagtctaaggtcgacaatgctgcttgctgtatctttacccttcgatctttaagatttcgtgatgtgcatttggaaaataactgtattgtaactgtatagatggcatcaaacaatctgtatttcgttgtgttgcagtttaaaaaaaagaaatattgctgctctattattcttggagatgaattaactttgcacaattccat

SEQ ID NO: 3682 - DNA, 984 bp, Lactuca sativa
tattgagtaagcgtgtatatcgacattggaggtaaccattaagcctaagaaaatcccccctccaattggattctattatagattcattcaatcttcatcatcgtttcaaaaccctcctcggtttcaatataaatcctttcaatttcgatttgcttcagtgtttttatctcacaaaccttccacacaggttaagaagtatcacttgattattagggtaatcactcacacttgtcaattctcagatcgcaggggtttcaagtaaaaatagttaacaatgtttgctcgaatgtttggcaaacctaagcaagaagctaacgccgtaacgacgttagacaaactaaatgagacacttgaaatgctagagaagaaagaaaaagtgcttctgaagaaagctggtgctgaggttgaaaaggcaaaggagttcactagagccaaaaacaaaagggctgcaatacagtgtctgaagcgaaaaagactttatgaacaacaaattgaacagcttggcaattttcaattacgtattcatgatcagatgataatgcttgaaggtgcaaaagctacaacagagacagtggatgccttgagaactggagctcaagcaatgaaggcaatgcaaaaggctgtgaatattgatgacgtggacaagacaatggatgagataaatgagcaaacagagaacatgaaacaaattcaggaagcattgtcaacacctattggtgcagcagctgattttgatgaggatgagttggaggctgaacttgaagaattagaaggagctgagctggaagaacagctgctacagcctgccaccaccgcacccgcagctccactccatgtacctgcaggcagacaatcaacacgtccacctccccgccacaacacagctgaggaagatgaactcgctgcattgcaggctgaaatggcactttaaagtttcaactctcggttggaagaatttgtaaagatttgggatgttgaaaaatg

SEQ ID NO: 3683 - DNA, 1343 bp, Lotus japonicus
acccctcacaatcttagctgatgaagggacccacatagttgcgcgccacgtggaggcatcttccgttcactttcttctcattttgttgttgtttcctacgcggtaaagtctctatcatcttctccctcgctaatcgcaatcgcaatcgcaatcgcagatctctcatctcaaccctttctccgatccaaaccctaattattcaacagggaagatcggttggtcatcaccgattgaccttgtaccttcaattttcatctcagaaaggggttttcactcatcatctaataataaccaatcatgtttactcgaattttcggtaaacctaagcaggaagccaacgctctcaccaccttggacaagttgaatgagacacttgaaatgctcgagaaaaaggagaaagttctcctcaaaaaagcttctgcagaagttgaaaaagccaaagagttcactagggcaaagaataaaagggcggcgatacaatgtttgaagaggaagaggctatatgagcaacaaatagagcagcttggaaacttccagttgcgtattcatgaccagatgattatgttggaaggtgccaaggcaactacagaaactgttgacgcgttgagaactggagcatctgctatgaaggctatgcagaaagcaacgaatattgatgatgttgacaagaccatggatgagatcaatgaacaaactgaaaacatgaaacagattcaggaagcattgtcagctccaatcggtgcagcggctgactttgacgaggatgagttggaagcagaacttgaagaactggagggtgctgagttggaagaacagcttcttcagcctgcaactacagctccagctgctccagtgcacgccccagctggccgacagcctactcgccctgtgactacaaagcctactcccgaggaagatgaattggcagctttgcaggctgagatggcactttgagcagaattttgcatttgcaggcattgatgtgcatgttacgttgcccctataaagatttgtaaccagtgacatggagaattcagccccctctcacgctctgcttatctttgtgaaattattgaaagagcagatgatgatgtatataaagttgattaaaaagttaatagcccttcaaaacttgtactttgtcacctcttcattttagacgtcccgtttctttctgaaagtttaaaacccagctttgtacaattgtgcgtagtcgagtatcgacgcatatggtttctttttatattccttgagaacctagtcgaatttaaaattattcatcagactgatcgatgtatatcttaaattatgctataacagaataaatatgataaaagaaattg

SEQ ID NO: 3684 - DNA, 1290 bp, Nicotiana benthamiana
attgatcatcgtctgctctaatcctatcatctaattaacagaataaagcaggtttcgccgttgtttgttgtatacgcaaagatgttttcgaagatatttgggaagcccaagcaggaaactaatgctcttgcgactcttgacaaattaaacgagactctggagatgcttgagaagaaggagaaagtacttcagaagaaggcttctgcagaggttgaaaaggccaaagattttacaagagcaaagaataaaagagcggcaatacaatgtttgaagaggaagaggctctatgaacaacaaattgagcagcttggcaatttccagcttcgcatccatgatcagatgataatgctagaaggtgcaaaagctacaactgaaactgttgatgctttgagaactggagcatccgcaatgaaagcaatgcagaaagcaacaaatattgatgatgtagacaagacaatggatgaaataaatgaacagactgagaatatgaaacaaatacaggaggctttggctactccaattggtgcagcagctgattttgacgaggatgaattggaggcagaacttgaagagctggaaggtgctgaattggaagagcaactccttcaaccagcaactactgcccctgctgcaccagtccatgttcctgcggggaggcaacctgctcggcccattcctcagaggcgtacagctgaggaagatgaacttgcggctttgcaagcagagatggctctttgagctactccctctattgttttaaccagtaagctgtcctatcagtccatctgaatattagtcagtatgattttcaactgcaaacttactgattggtgaaatgagagcacctttctttgaaagatttcacctaagacatgctattgcctgagccttcttggatttgaatgattgaggtcctcagttgcaatcacatatagtgtatcgagatttacactcatttgtttgtaataacttggaggaagtgcttgtctgcaatcatttgttggtttattatgatattttttttctgcagatattatcacgggtagcttacaaatatagactggttgacgcatgcatgagactgctgcaattactttcacttgcgagagactactgcaattgctttcacatgtctcgatatctatgtcggttagtagggctatgtacataattgtgttgcagaaaatggtggattccatgaacatcagaatttatggttcatgcttaagtgaatcttatgttcactacgtccctttttcttaaataaaattaagaatctccttttgtcat

SEQ ID NO: 3685 - DNA, 1184 bp, Solanum tuberosum
agcgcacagcactgacgtctcttccacatgagcaatcttctgccaaaaagatccaacctttaaaatttgttgagaaatttctcagatcattaccaacttcaaaggtcaaaacctgattgattccaattattcaaatacccttcaaattttctcagggtttaaataattttgattttttgaagcttttttgtattataattgttgctgacaaaatcaagaatgtttacccgaatgtttggaaaacctaaacaagaaacaaatgctctagctacgctagacaagttaaacgagactcttgagatgcttgagaaaaaggagaaggttttactgaagaaggctgcagctgaggttgaaaaagcaaaggaatttactagagcaaaaaacaaaagggctgcaatacaatgtttgaaaaggaaaaggctttatgagcagcaaatcgagcagcttggaaacttccaattgcgtattcatgatcagatgataatgttagaaggtgcaaaagccacaacggagactgttgatgctttaagaactggagcagctgcaatgaaagctatgcaaaaggcaacgaatattgacgatgtcgacaaaacaatggatgagatcaatgagcagactgagaatatgaaattaattcaggaagcattgtcaacaccaattggttcagctgctgattttgatgaagatgaattggaggcagaacttgaagaactggagggggctgagttggaggaacagctccttcagcctgctacaactgctcctaatgcgccaattaatctacctgctggcaggcaacaagtgcgtcctgctgctcagaagacggaagaagatgagcttgccgctttgcaggctgaaatggctctttgaacagttcttgttgcctcccacgagacagcgtaaaggcttgatgtattcttatggtggatggattacctttggagctttgaattcttatggatgcatgcaggatcagaagttactgtataaatgacagcagatgatgagtttacattctgtgtgaagttgaagtgggaaaaagcatgctactttcgtgtgaattatgaaaaagatgttctaagatacttttaaatgaattttcaagacttggttgtttacattattatggtcagaaaaccttctatatatacaagcacttaattcaggtgagtgaaaaaaaaatc

SEQ ID NO: 3686 - DNA, 1194 bp, Prunus persica
cgcttctccttcttctaacacaaaccaacacgcctaagaaatccccaatcaacccaatcggcaaagccacggccattacacggtcctcttccttcttctccttcgaaaccctaattttcccaatccgatccttcttcctcaaaatctagcgtcaatttcaagaagatcgagagggttcgataattgcagagaatcaaccatgtttaccaggcttttcgggaaacctaaacaggaaggcaatgccctgaccaccttagacaaattaaatgagacacttgaaatgctagagaaaaaggaaaaagtactacagaaaaaggctgctgcagaagttgaaagggccaaggaattcaccagagcaaagaacaaaagggcggctatacaatgtttaaagaggaagaggttatatgaacaacaaatagaacagcttggaaatttccagttgcgtatccatgatcagatgataatgctagaaggtgcaaaagccacaaccgaaactgtagatgccttgagaactggagcagctgcaatgaaagcaatgcagaaagcaacgaacatagatgatgtggacaagaccatggatgagattaatgagcagacagagaacatgaaacagatacaggaagcattgtcagctccaattggtgcagctgctgattttgatgaggatgaactggaagcagaacttgaagagctggaaggcgctgagttggaagaacaacttcttcagccagcaacaacagctcctgctgctccagtgcaagccccagcaggaaggcaaccaacccgtcctattccccagaagcgcactgctgaagaagatgaattggctgctttgcaggctgagatggcactttgagcaggtattattctgcaggatgaaaggaggttatgtaaaggattggtctgattttataatggagatttgtgctccgatcgcgcatccagatttctgtgtggcttcattattaaaccgaatgtatataaaggtggcataaatcaaacagtcccctttgaaacttgtattctgcttttttcagagttttctctttcttttctttttctttttctttttaacttatctttgaacatttattcaatgttctgtcaggcctgaatcagtagcttgttctattatgtgatattaccaagtgaataatatgagatgatcttggagcctatactatgaagctcttc

SEQ ID NO: 3687 - DNA, 1143 bp, Solanum lycopersicum
gcaaattccattggtctgtcatagcacagcactgacgtctcctccacatgagcaatcttctgccaaaaagatccaacctttaaaattgattgagaaatttctcaattattacaaacttcgaaggtcaaaacccgattgatttcagaaacccttcaaagtttctcagggtttaaacaattttgatcttttgaagcttttttgtattataattgttgctgacaaaatcaagaatgtttacccgaatgtttggaaaacctaaacaagaaacaaatgctctagctacgctagacaagttaaacgagactcttgagatgcttgagaaaaaggagaaggttttactgaagaaggctgcagctgaggttgaaaaagcaaaggaatttactagagcaaaaaacaaaagggctgcaatacaatgtttgaaaaggaaaaggctttacgagcagcaaatcgagcagctcggaaacttccaattgcgtattcatgatcagatgataatgttagaaggtgcaaaagccacaacggagactgttgatgctttaagaactggagcagctgcaatgaaagctatgcaaaaggcaacgaatattgacgatgtcgacaaaacaatggatgagatcaatgagcagactgagaatatgaaattgattcaggaagcattgtcaactccaattggttcagctgctgattttgatgaagatgaattggaggcagaacttgaagaactagagggggctgaattagaggaacagctccttcagcctgctacaaccgctcctgttgcgccaattaatcttcctgctggcaggcaacaagtgcgtcctgccgctcagaagacagaagaagatgagcttgctgctttgcaggctgaaatggctctttaaacagttcttgttgcctcccacgagacagcgtaaaggcttgatgtattcttatggtggatggatatacctttggggctttgaattcttaaagatgcatgcaggatcagaagttactgtataaatgacagcagatgatgagtttacattctgtgtgaagttgaaagtgggaaaattgtatgctaatttcgtgtgaattattatgaaaaaagatgttctaagatatacttttaaatgaattttcaagacttctgttgtttacatt

SEQ ID NO: 3688 - DNA, 1153 bp, Cucurbita pepo
ttttatttctccaaaccgatcgctcttcgatttcctatcatcagctctcagaagttcggaggtcgattcgattcgcagataatccaccatgtctatgttcaataagcttttggcaaacccaagcaggagtctagtgccctggcgacgcttgataaattaaacgagacactggaaatgctggagaagaaggagaaggtacttttgaaaaaggcttccacagaggttgagaaggccaaagattataccagagcaaagaacaagcgagctgctatacaatgtttgaagaggaagaggctatatgagcaacagatagagcagctcggcaacttccaattgcggatccatgatcagatgatattattagaaggtgcaaaagccacaactgagactgtagatgcattgaggacaggggcagctgcaatgaaagcaatgcagaaagcaacgaatatcgatgatgtcgataaaacaatggacgagatcaatgaacaaaccgagaacatgaaacagatccaagaagcattatcaaatccaattggtgcttcagctgattttgatgaggatgaactggaagcagaacttgaagagctagaaggtgcagagttggaagaacaacttcttcaacctgcaacaactgctcctgctgcaccaattcccgtcccggcgggcagacaaactgctcgacctgctccaaaacgaactgctgaagaagatgaactggcagctctgcaggctgagatggctctttgatttggtggcttaagcatggttaacattcgaagagagacgctataacgaagaattggcccgaggatgtaccaaagatttgaacatttttgccaagttcagcaaagcctgatcaacaggtttctttgtgacattaccagataataatgcaattttaatttggtcctgtatattctgtaaatgaatataccattcctgtggttagtattgacctaatatggagctgaatgtgtaagtgtctcagttacacaaagaccatgtgttaagtttaagtgtgagttggttttttgaaaatccatgctttgagtttgtgttggttatttactatggattacacaagaattccataaactctgccgtatagctcgaaagaacaggaattcattccaatacatacaacaaattacac

SEQ ID NO: 3689 - DNA, 1472 bp, Vitis vinifera
aaaatcttctattaagaaaaatgtaaccgtctgtcacgtatcaacagagcgacggaccaatcaaagtttagattttgaacgaaaaaggtgagtcagacaggaaacttgagtgacaggcaggcaccgggctccatctctccaaccaaactctaatcggagtcttccacctatagcgatccttcttcttcgtactctcccaaatcctcgaacctatcaattcgatcatggttcaaagcgtttttccttaaaacgctagcaacgatttcgatttgttgaagcgtttatcagattctttgattttcttgttctatcgaaatcaatcatgtttacgcgtttgttcgggaaacctaagcaggaggccaatgccctaacaacattggacaagttaaacgagacacttgaaatgctagagaaaaaagaaggtgtccttttgaagaaggccgctgcagaggttgaaaaggctaaggaatttactagagcaaagaacaaaagggcggcaatacaatgtttaaagaggaagaggctctatgaacagcaaattgaacaacttggaaatttccaattgcgcattcatgatcagatgatattgctagaaggtgccaaagctacaacagagactgttgatgcattgaggactggagcttctgcgatgaaggcaatgcaaaaggcgacgaatattgatgatgttgacaaaacaatggatgagattaatgagcagacagagaacatgaaacagattcaggaggcattagccacacccattggtgcagcagctgattttgatgaagatgaattggaagcagagcttgaagaattagaaggagctgaattggaggaacagcttctccagcctgccacaactgccccagcagcaccaatccctgcaggcagagtaccagcccgcccagctcctcagaggaacactgctgaggatgatgagcttgctgcattacaggcagagatggcactttaagaagttaccaattccaagcaaagaccatgtaaagactggttgtactctatgattgatggagcctgacagcctgttacttcactccctggaccctccatttccgtatttattcttcagcgtgcattcactggtaaggaagcatttgtatagatggcttcaagtaaattacattccaagtaaaattacgttctatctaaaatctgtaccctgcttctgtggtttcctaaacgagttggccaggattggttgtggacatctgatatatctatttcgtatcagtgtgatgagattccctaatttttcctcgtaagagttttcacttgattggcagatagatattgaacaaaaatagaaagatggaattaatagggggtggggattggctccttatgagttttccctttcctatgaatttgtcttcaatcaaacctaagtgatgcttagaactgattagaataatggaaaatgattaatatcgatgaataatcttcccatgaca

SEQ ID NO: 3690 - DNA, 1433 bp, Vitis vinifera
atcaacagagcgacggaccaatcaaagtttagattttgaacgaaaaaggtgagtcagacaggaaacttgagtgacaggcaggcaccgggctccatctctccaaccaaactctaatcggagtcttccacctatagcgatccttcttcttcgtactctcccaaatcctcgaacctatcaattcgatcatggttcaaagcgtttttccttaaaacgctagcaacgatttcgatttgttgaagcgtttatcagattctttgattttcttgttctatcgaaatcaatcatgtttacgcgtttgttcgggaaacctaagcaggaggccaatgccctaacaacattggacaagttaaacgagacacttgaaatgctagagaaaaaagaaggtgtccttttgaagaaggccgctgcagaggttgaaaaggctaaggaatttactagagcaaagaacaaaagggcggcaatacaatgtttaaagaggaagaggctctatgaacagcaaattgaacaacttggaaatttccaattgcgcattcatgatcagatgatattgctagaaggtgccaaagctacaacagagactgttgatgcattgaggactggagcttctgcgatgaaggcaatgcaaaaggcgacgaatattgatgatgttgacaaaacaatggatgagattaatgagcagacagagaacatgaaacagattcaggaggcattagccacacccattggtgcagcagctgattttgatgaagatgaattggaagcagagcttgaagaattagaaggagctgaattggaggaacagcttctccagcctgccacaactgccccagcagcaccaatccctgcaggcagagtaccagcccgcccagctcctcagaggaacactgctgaggatgatgagcttgctgcattacaggcagagatggcactttaagaagttaccaattccaagcaaagaccatgtaaagactggttgtactctatgattgatggagcctgacagcctgttacttcactccctggaccctccatttccgtatttattcttcagcgtgcattcactggtaaggaagcatttgtatagatggcttcaagtaaattacattccaagtaaaattacgttctatctaaaatctgtaccctacttttgtggtttcctaaacgagttggccaggattggttgtggacatctgatatatctatttcgtatcagtgtgatgagattccctaatttttcctcgtaagagttttcacttgattggcagatagatattgaacaaaaatagaaagatggaattaatagggggtggggattggctccttatgagttttccctttcctatgaatttgtcttcaatcaaacctaagtgatgcttagaactgattagaataatggaaaatgattaatatcgatgaataatcttcccatgaca

SEQ ID NO: 3691 - DNA, 1367 bp, Chelidonium majus
taggtctaacgcggagggactctctctgtgagatcgatcttcctttcctccgaatttcacttaaaccctttctcactctaaaatctctaatcgatcatttcaaatttttcgatctattttttcattaatctttgattcttacagggttttgaatcatttgggttttgtatgttttgattggaatagaagagaagggttttcaaagtacagaatcagacatgtttacacgaatttttggcaaacccaagcaggaaacaaatgctctaacaacgttagataagttaaacgagacgcttgaaatgcttgagaaaaaagaaaaagttcttataaagaaggcttcgggagaagtggaaaaagccaaagagttcacaagagcaaagaacaaaagggccgcaatacaatgtttgaagaggaagaggctttatgaacaacaaattgagcaacttggaaattttcaattacgaattcacgatcagatgataatgcttgaaggtgcaaaagctacaacggagactgttgacgcattgagaactggagcagctgcaatgaaggctatgcagaaagcaacaaacattgacgatgtagacaaaacaatggatgagattaatgagcagacagagaacatgaaacagatacaggacgcattgtcagctcccattggtgcagcagctgactttgacgaggatgaattggaagcggagctcgaggagttggaaggagcagaattggaggagcagcttcttcagccggctacaactacccctgcggcgccaatttatgtcccggctggaagacaaccaacacgtcctgttgcacaaaagaacactgctgaggaagacgagttggctgcattacaagcagaaatggcactttaagcaggtctccagtgcgcagcttaaatcaaggttttgtaaagattgattgtactgtatgatggatgctgttcatgggcagctatataccattcgcagatttaagctttctcagtgcttttgctgctaagaagacattgtataggtgggatataaagtaaatgacctcccctcttaaaatctgtaatttcaattttcaggagctttcttctaaaaagtttctagttttatttggatatcttgtgtgttgaaagcctttggttgatttcctctgcacgcattggaaccaattagtctatgaataatgaagtacatatataccttatttgccgttagttttaactactgtaatcgtatggtttgttggtatgaaagggctcttgggctatgtacaatatttgaggtttgaaatctctagtgctaatatggcatgtactcaaattatctgaatgatcagttagattgtggttgttaggggtatcaaaaaacctgcta

SEQ ID NO: 3692 - DNA, 1051 bp, Cirsium arvense
aaaacccttttgattttatcatacaattctttcacccaatttcgattattttttcagtatcgaaaaccctagacccaggttaagaatcatcgtttgattctcacggtatctgttaaatcaatctcagatccaagaacaaaaaagggggtgacaatgttttcgcggatgtttgggaagcctaagcaagaaacgaacgctgttactacgttagacaaattaaacgagacgcttgaaatgttagagaagaaagaaaaggtacttctgaagaaagctgccgcagaggttgagaaggcaaaggaatttacgagggcaaaaaataagagggctgcgatacagtgtttaaagcgaaaaagactttacgaacagcaaattgaacagcttggtaatttccaattgcgtattcatgatcagatgataatgcttgaaggtgcaaaagctaccacagagacggtggatgctttgagaactggagctcaagcaatgaaggcaatgcaaaaggcagtgaatattgatgatgtcgacaaaacaatggatgagataaatgagcaaacggagaacatgaaacaaattcaggaagcgttatcagcacctattggtgcagcagctgattttgatgaggatgagttggaggctgaacttgaagagttagaaggagctgaattggaggaacagcttctacagcctgcgacaactgcccctgcagctccagtgcatgtgccagctggaagactaccaacacgtccgcctcctaggaagaacacagccgaggaagatgaacttgctgcattgcaggcagaaatggcactttaaggttcatttcaattcccagttggaagatcctgtaaagatcagagggaggtatggcatcaacacgaattgtttgtgtgatcaatgacttttatcttattaggaatggtaaaaaggattaaagtgtttatgtgttgatgtatgccatattgttggttatttgagagattcgtcttcaattatggaagtcgaatactatcattattaacaatgtaatatacgacgattgttttcaagtaaattg

SEQ ID NO: 3693 - DNA, 1161 bp, Cirsium arvense
acgtaaaacgagtaagtcggggggtaatctattaaacaattagcaaattccttgcatctccttccaatcattccaaaaccccccccttttcatcgaaattccttctccagttcttcaccacaagttactcagaaacgttaaaatcattatttaattccgaagttaatctctcaaacctgctgattaccagagcactaggttttaagagcaaagagttaacgatgtttactcgattgtttggcaaacccaaacaagaagctaacgcggttacaacgttagataagttaaatgagacacttgaaatgctagagaagaaagagaaggtacttctaaagaaagctgctgcagaggttgaaaaggcaaaggaattcactagagcaaaaaataaaagggcggcaatacaatgtctaaagcgaaaaagactttatgaacagcaagttgaacaacttggaaattttcaattacgtattcatgatcagatgataatgcttgagggtgcaaaagctaccacagagacggtggatgcattgagaactggagctcaagcaatgaaggccatgcagaaggcagtgaatattgacgatgtggacaaaacaatggatgaaataaacgagcaaaccgagaacatgaaacaaatccaggaagcattgtcggcacctattggtgcagcagcagattttgatgaggatgaattggaggctgaacttgaagaattagaaggagctgagttggaggaacaacttctccaaccagccacaactacccctacaacctcagtgtatgcacctgccggcaaacaaccaacacggccagctccacggcagaacaaagccgaggaagatgaacttgctgcattgcaggccgaaatggcgttataagcagttttgatttccgattgggaaaagattggaatacaaagaatggaggtatgatggtaagatgatccacacattaaaaaaaatcatttggttttctttaatcctccatggctgacttgatctgttgattcattaccatcaatgtgcatgatttggggtataaagtagtcaatttgtcactaatttatgaacatatgatataatatgggattgtctttttgtgttccgttgtgttactgatatcttatgtgatctaattaatgggggtaccagaaaaaagaaa

SEQ ID NO: 3694 - DNA, 1166 bp, Euonymus alatus
agaccatgacataacacaaatcagccacacgcgattcttctccaaggaaaaccctaaatcggaggcagagctgactcgaagaagatcctgatcaaagagctggtttatcagtttctgacgcagggaatcgcaagggttttcaaagcggaggatcgactatgtctatgtttaacaaacttttcgggaaacctaagcaggaaactagcgctttagctactttagacaagttaaacgagacgctggaaatgctagagaagaaggaaagtgtacttattaaaaaagctgctgcagaggttgaaaaggccagagattttactagatcaaagaacaaaagggcggctatacaatgtttgaagaggaagaggttatatgagcagcaaatagaacaacttggaaatttccaactgcgccttcacgaccagatgataatgttagaaggtgcaaaggctacgactgagactgtagatgcattgagatctggagcttctgcaatgaaggcaatgcagaaggccacgaatatagatgatgtggacaagaccatggacgagatcaacgagcaaactgagaacatgaaacagattcaagaagcattgtcaaatccaattggtgctgcagctgattttgacgaggatgaactggaagcagaacttgaggaacttgaaggcgctgaattggaggaacagcttcttcagccagcaacaacagctcctgctgctccagtgcaagtcccagcaggtcgtcaaccagcccgtcctgctccacaaaagcgtacagctgaggaggatgagcttgctgccttacaggctgagatggctctctagacaggatgcaaaaattgtttgaaggtcgggcttgttgtattattgcaggactcctttcacatatccagatttctgtgtggaataagtggtgaacgcacaatgtatatagagcagcatgagcaaatttactcacaaaacatgtattctatcatgtggagctttaaatctttcttgtttttaacatgatttcataacgttgaaaccctttttcaatgttctgaatctttgacagctcagataatcttatgcaatgtcatataatctgagtcttgcgttcattgaattctgctacatctttgtactgtattgaagatactttattatcggtagctcttaggagtgtga

SEQ ID NO: 3695 - DNA, 1105 bp, Aquilegia formosa
aagcaaagcaattaagcaaacagagtcctttctttctctttctttttacttctttcacaatcgtccaccgattgatcttgtattcttctcaatcattcaaaaccctaatataatcgatcaaattgattaaatcgaaatcttccttccttttcaattccaacttaatcagagagaaaaaaagaaagcaataatgtttgctcgggtatttggtagacctagacaagaagcaaatgctttaacaacgttagataaattgaatgagacacttgaaatgctagagaaaaaggaaaaggttcttctaaagaaggcctctggagaggttgaaagggccaaggagtttactagagcaaagaacaaaagagctgccatacaatgtttaaagaggaagagactctatgagcaacaaattgagcagctgggaaatttccaactgcgcattcatgatcagatgataatgctagagggtgcaaaagctacaactgagactgttgatgccttgagaactggagcagctgcaatgaaggcaatgcaaaaagcaactaacattgatgatgtggacaagacaatggacgagatcaatgagcagacagagaacatgaaacaaattcaagaagcattgtcaactccaattggctcagctgccgattttgatgaggatgaattggaagcagagcttgaggaactggaaggagctgagttggaggaacaacttcttcagcccgcaactactgccccggctgcgtcagtgcatgttccggcgggaaggcaaccaacacgtcctcttccccaaaagaggacagccgaagaagaagagtttgctgcattacaggcggagatggcactttgagagaggacctctatccaccaagtatgaagggatgtaaagattggttctattgtgtgatagagattggtgctggtcaatcactcaaattcacactttaaggaggatgattgtataggcttcataaagtaaactgcccttactttattattgtattctacttcagattctaaaatgttccatataaaacaatcctggaattcatttgcttgtatcatgtgatgctttgatttcttgcctcatggttttgcattagtcgaa

SEQ ID NO: 3696 - DNA, 1246 bp, Centaurea maculosa
  misc_feature (23)..(23): n is a, c, g, or t
  misc_feature (62)..(62): n is a, c, g, or t
  misc_feature (67)..(67): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (133)..(133): n is a, c, g, or t
  misc_feature (140)..(142): n is a, c, g, or t
  misc_feature (161)..(161): n is a, c, g, or t
  misc_feature (166)..(166): n is a, c, g, or t
  misc_feature (254)..(254): n is a, c, g, or t
  misc_feature (268)..(268): n is a, c, g, or t
  misc_feature (301)..(301): n is a, c, g, or t
  misc_feature (338)..(338): n is a, c, g, or t
  misc_feature (341)..(341): n is a, c, g, or t
  misc_feature (404)..(404): n is a, c, g, or t
  misc_feature (425)..(425): n is a, c, g, or t
  misc_feature (524)..(524): n is a, c, g, or t
  misc_feature (731)..(731): n is a, c, g, or t
  misc_feature (836)..(836): n is a, c, g, or t
ggcgggggaattggaggtaaccngtaggctaagcaaatcaattggagtcccacccacttctncactnanttnttnaatctaaattccttcaattcgatcttattaaatcatcaattcatcatcccctttcatnatcaatnnnaaaacccctttgatttttntcatncaattcattttcacccaatttcgattatttttcagtatcgaaaaccctagacccaggttaagaatcatctttgattttgattcccacnacatttgttaaatnaatctcagatccaagaacaaaaaagggggtganaatgttttcgcgtatgtttgggaagcctaagcaaganacnaacgctgttactacgttagataaattaaacgagacgcttgaaatgttagagaagaaagaaaangtacttctgaagaaagctgcngcagaggttgagaaggcaaaggaatttacgagggcaaaaaataagagggctgcgatacagtgtttaaagcgaaaaagactttacgaacagcaaattgancagcttggcaatttccaattgcgtattcatgatcagatgataatgcttgaaggtgcaaaagctaccacagagacagtggacgctttgagaactggagctcaagcaatgaaggcaatgcaaaaggcagtgaatattgatgatgtcgacaaaacaatggatgagataaatgagcaaacggagaacatgaaacaaattcaggaagcgttntcagcacctattggtgcagcagctgattttgatgaggatgagttggaggctgaacttgaagagttagaaggagctgaattggaggaacagcttctacagcctgcnacaactgcccctgcagctccggtgcatgtgccagctggaagactaccaacacgtccgcctcctaggaagaacacagccgaggaagatgaacttgctgcattgcaggcagaaatggcactttaaggttcatttcaattcccagttggaagatcctgtaaagattggagggaggtatgacatcaacacgaattgtttgtgtgatcaatgacttttatcttattaagaacggaaaaaggattaaaagtgttggtgtgttggtgtatgccatatgggtatgttggttatttgagagatttgtcttcaattataggaagtcgaatactatcattattaacaatgtaatatacgacgattgttttcaagtaaattgtttcaagagttgcagaaatggaagtctatgcattgtatgc

SEQ ID NO: 3697 - DNA, 1174 bp, Cichorium intybus
agcgtgtacgacattggaggtaaccattaagcctaagcaaatcccccctccaattggattctagattcattcaatcttcttcatcgtttcaaaacccttctcgtttttatataaatccttcgttcaatttcaatcattgttcttgcctcacaaaccttaacggttaagaactatcacttgattatcagggtagtcactcgcacttgccaattctcagatcgcagggttttcaagaaaagaatagttaacaatgtttgctcgaatgtttggcaaacctaagcaagaaaccaacgcggtaacaacgttagacaaattgaatgagacacttgaaatgctagagaagaaagaaaaagtacttctgaagaaagctgctgcagaagttgaaaaggcaaaggaattcactagagccaaaaataaaagggctgcaatacagtgtttaaagcggaaaagactatatgaacaacaaatcgaacagcttggaaattttcaattgcgtattcatgatcagatgataatgcttgaaggtgcaaaagctactacagagacagtggatgccttgagaactggtgctcaagcaatgaaggcaatgcaaaaggctgtgaatatcgatgacgtggacaaaacaatggacgagataaatgagcaaacagagaacatgaaacaaatccaggaagccttgtcagcacctattggtgcagcagctgattttgatgaggatgagttggaggctgaacttgaagaattagaaggtgctgagctggaagaacagcttctacagcctgccaccaccgcacccgcagccccactccatgtacctgcaggtagacaatcaacacgcccagctccccgccagaacacagctgaggaagatgaacttgctgcattgcaggcagaaatggcactttaaagagtttcaactcccggttggaagaaattgtaaagattggatgtttgagaaaaggtggttttgatgtgttaaatctgttcacatggacacgtattgtttatttgataacatgattaatgactttttatcttattaggaacgaaaaaggattgtcgttccgttttttatcctagttttcatgtgttggtgtgttattttgaaaaagtttttcttagtgaattttatcattgttaatggtgtattacaaaatgtgttacattgaaaaaa

SEQ ID NO: 3698 - DNA, 1206 bp, Vigna unguiculata
agtttattttaatttgtctgttgattaaaataaaccctaagtttttcaaggggagttcgagttgcgaattgtagtgcacagagtcccatctattttcctattagacgagcaaggtatcgttgtctcgtaatcaaccatgtttacccgaatttttggtaaacctaaacaagaagccaatactctgacgaccctggacaaattaaacgagacacttgaaatgttagagaaaaaagagaaagtacttcttaaaaaggccgcagcagaagttgaaagggccaaagagttcaccagagcaaagaataaaagggcggcgattcagtgtttgaagaggaagaggctatatgaacagcaaatagaacagcttggaaattttcagctgcgtattcatgaccagatgataatgttggaaggtgccaaggctaccactgaaacagttgatgcattgagaactggtgcagctgctatgaaggctatgcaaaaagcaacgaatattgatgatgttgacaagaccatggatgagatcaacgaacagacagagaacatgaaacaaattcaggaagcattgtctactcccattggtgcagcagctgattttgacgaggatgaattggaagcagaacttgaagagctggagggtgctgaattggaagagcagcttcttcagccggcaactacagctccagcagctccagtgcatgttcctgctgggcgacaacccactcgccctgcatcctcaaagcccactgctgaggaagatgagttggcagctttgcaggctgagatggcactttgagcaggtcccttttctcagctgcgacactattgatttatgctatattcattaatctgtttcagtttggttggtattgcaatcaatgtgcagttgaatggtttgtgtgtgcaccagttcgatatcaacctttgcacagttgagttcacttgtataatcatagtttggaatgaatcgtctaaagttgcttctcaggaaaagtttgacaaccttattttacgcatttcttattgattttgctgctggctttgattaagctagaactttgcaggcatttacgtgcatgatcttgtaaaaacagtgacacggagaattctgctccctctcatgcttgcttatctatgaaattattaagcagaccagaaatgtatataaaggttattaaattcaataaccctttaaaacttctactttca

SEQ ID NO: 3699 - DNA, 1017 bp, Cynara scolymus
cgggatctcattcgtttcgatttcttcaccacagtccattgaagcgttacacataattcattccgaagataatctctcaaacgggctgattaccagagcagtaggtttcaagagcaaagagtttacgatgtttactcgattgtttggcaaacccaaacaagaagctaacgcggtcacaacgttagacaagttaaatgagacacttgaaatgctagagaagaaagagaaggtacttctaaagaaagctgctgcagaggttgaaaaggcaaaggaattcactagagcaaagaataaaagggcggcaatacaatgtctaaagcgaaagagactttatgaacagcaagttgaacaacttggaaattttcaattacgtattcatgatcagatgataatgcttgagggtgcaaaagctaccacagagacggtggatgcattgagaactggagctcaagcaatgaaggccatgcagaaggcagtgaatattgatgacgtggacaaaacaatggatgaaataaatgagcaaactgagaacatgaaacaaatccaagaagcattgtcagcacctattggtgcagcagcggattttgatgaggatgaattggaggctgaacttgaagaattagaaggagctgagttggaggaacaacttctccaacctgccacaactacccctacaacctcagtgtatgcacctgccggcaaacaaccaacacgtcctgctccacggcagaacaaagccgaggaagatgaacttgctgcattgcaggccgaaatggcattataaacagtttcgtcttccaattgggaaaagattgtaaagattgaaatacaaagaatggaggtatatgatggtaaggtgatcctgacattaaaatttcatttggttttctttgatccttcatggctggcttgatctgttgattcattaccatcaatgtgcatgtggtcaatcatgttatggtcactaatttatgaacataagaacatgatatgatatgggattatcttttcgtgttc

SEQ ID NO: 3700 - DNA, 1384 bp, Vitis vinifera
ggatgatgactccaaacgcgacgttagggagaggcaaaagaccggaacttttttctcacgtctctttctattttcatcttcaacacgcctaagcaatccctttgaatctccctctcctacttcttttttctttccctcgaagaaccctaatctcagttttattcacagatcggggtttaattccagggaatcggccatgtttacccgaattttcggcaagcctaagcaggaagccaatgctttaacaacgttggacaaattaaacgagacacttgaaatgctagagaaaaaagagaaagtacttctaaagaaagctgctgctgaggttgaaaaggccaaggaattcactagggcaaaaaataaaagagctgcgatacagtgtttgaaaaggaagaggctatatgaacagcaaattgaacagcttgggaatttccaattgcgcattcatgatcagatgataatgttagaaggtgcaaaagcaactactgagacagtggatgcattaagaactggagctgctgcaatgaaggcaatgcaaaaagcaacgaatattgatgatgtggatcagacaatggatgagatcaatgagcagactgagaacatgaagcagattcaggaagcattgtcaactcccattggttcagcagctgattttgatgaggatgagttggaagcagaacttgaggaactggaaggctttgagttggaggaacaacttcttcagcctgcaacaactgctcctgcagctccagtccatgtcccagctggccgccaaccagctcgtgctgctcctcagaagcgcacagctgaggaagacgaacttgctgcattgcaggctgagatggcactttaagcagtctggaatgtatactgctggatcttcgacgtcaattgtttttcagtttgaacgatttgaggccatacacacgaatcacctaagaagctgagactcttgccatactgatacttataaagagttatttgctggttttcttgttttctttatcttccaggtattgttgtgcagaatgaatggagattatgtaaagaatcaaattgtattgatgtggaatagtgcaaatcctatcgtgcatccgttcttctgttgtatgggtttaccggtaaacagacaatgtatataaaggtggcataaactaaatgcttctcctttgtattctgccttttggtgcttctaagggtttgtttcctttcacattttgtggacaattgttttaacattttgttaaggccttaactgagagcttatttgttatctcccatgttataagagtatattatagaggattatagtgtgctttggatgtggttcaagtcttcgagatgtcagttagtcaccagtggatagagggttatgtcacttgat

SEQ ID NO: 3701 - DNA, 1177 bp, Vitis vinifera
ggatgatgactccaaacgcgacgttagggagaggcgaaagaccggaacttttttctcacgtctctttctattttcatcttcaacacgcctaagcaatccctttgaatctccctctcctacttcttttttctttccctcgaagaaccctaatctcagttttattcacagatcggggtttaattccagggaatcggccatgtttacccgaattttcggcaagcctaagcaggaagccaatgctttaacaacgttggacaaattaaacgagacacttgaaatgctagagaaaaaagagaaagtacttctaaagaaagctgctgctgaggttgaaaaggccaaggaattcactagggcaaaaaataaaagagctgcgatacagtgtttgaaaaggaagaggctatatgaacagcaaattgaacagcttgggaatttccaattgcgcattcatgatcagatgataatgttagaaggtgcaaaagcaactactgagacagtggatgcattaagaactggagctgctgcaatgaaggcaatgcaaaaagcaacgaatattgatgatgtggatcagacaatggatgagatcaatgagcagactgagaacatgaagcagattcaggaagcattgtcaactcccattggttcagcagctgattttgatgaggatgagttggaagcagaacttgaggaactggaaggctttgagttggaggaacaacttcttcagcctgcaacaactgctcctgcagctccagtccatgtcccagctggccgccaaccagctcgtgctgctcctcagaagcgcacagctgaggaagacgaacttgctgcattgcaggctgagatggcactttaagcagtctggaatgtatactgctggatcttcgacgtcaattgtttttcagtttgaacgatttgaggccatacacacgaatcacctaagaagctgagactcttgccatactgatacttataaagagttatttgctggttttcttgttttctttatcttccaggtattgttgtgcagaatgaatggagattatgtaaagaatcaaattgtattgatgtggaatagtgcaaatcctatcgtgcatccgttcttctgttgtatgggtttaccggtaaacagacaatgtatataaaggtggcataaactaaatgcttctcctttgtattc

SEQ ID NO: 3702 - DNA, 778 bp, Hevea brasiliensis
ggagtaagccatgtttacccggctgtttggaaaacctaagcaggaaacgaatgctctaaccacgttagacaaattaaatgagacgcttgaaatgctagagaaaaaagagaaagtacttgttaaaaaggctgctgcagaagttgaaaaggccagggaattcacccgagcaaggaacaaaagagcggctattcaatgtttgaagaggaagaagctatatgaacaacaaatagaacagcttggaaatttccaacttcgcattcatgatcagatgataatgttagaaggtgcaaaagccactacagaaactgtagatgcattgagaactggagcagctgcaatgaaggcaatgcagaaggcaacaaatattgatgatgtggacatgaccatggatgagatcaatgaacagacagagaatatgaaacaaattcaagaggcattgtccactcccattggtgctgcagctgattttgatgaggatgaattggaggcagaacttgaagaactagaaggtgctgaattggaagaacaacttcttcagcctgcaaccacagctccagcagctacagtgcaggttccagcaggaaggcaaccagcccgtcctcttcctcaaaggcacacagctgaggaagatgaacttgctgccttacaagctgagatggcactttgagcaggtattgtttactagaaagctgaagagcttatttaaagattggtcatattgtattgtggagtttatgcaactcctttcacacatcttgtgtgcattgatggtctgagc

SEQ ID NO: 3703 - DNA, 920 bp, Ipomoea batatas
tcggatcattcggaaaacgtcgaagctgaataattgatccgattcaatatccggtgttctcaggaaatcgaaatttttattcaatttactagggaacgttataattcaccatgtttacgcgaatcttcgggaaacctaaacaggaaacaaatgctctagccacacttgacaagttgaatgagacccttgagatgttagagaaaaaggagaaagttttacagaagaaagctgctgctgaagttgaaagggcaaaggagtttactagagctaaaaacaaaagggctgcaattcaatgtcttaaaaggaaaaggctttatgaacagcaaattgaacagcttggtaacttccaattacgcattcatgatcagatgataatgctagaaggtgcaaaagccacaacagagactgttgatgctttgagaactggagcagctgcaatgaaagccatgcaaaaggcaacgaatattgatgatgtagacaaaacgatggatgaaattaatgagcagacggagaatatgaaacagattcaggaggcactgtctacaccaattggagccgcagctgattttgatgaggatgaattggaggcagaacttgaggagctagaagaagctgaattggaggaacaacttcttcaacctgccaccacagcacctgctgcaccaattcatgtaccagcgggtaggcaaccagaacgtcatgctcctcggaagaataccgctgaggaagatgagcttgctgctttgcaggcagaaatggctctttagaaagtatatgattcctaaggagagattgtgtgacggatcggatggtagtctaaggtggacaacactgcttgatgtatctttacccttcgatccttaagatttcgtgatgtgcatttggaaaataactgtattctaactgtatagatggcatca

SEQ ID NO: 3704 - DNA, 1090 bp, Momordica charantia
acactacaacaacacgcctaagcaaaacccgaatcaaattcacctctcttgcagatcttcccttgttctttaatcctgttttgcgacaccgatcgctcttggatttcctctcttcagttctcagaagttcgggggtgggttcgaattcgcagacaatccaccatgttcaataagctttttggtaaacctaagcaggagtctacggctctggcgacgcttgataaattaaacgagacactggaaatgctggagaagaaggagaaagtacttttgaaaaaggcggccacagaggttgagaaggccaaagattataccagagcaaaaaacaagcgggctgctatacaatgtttgaagaggaagaggctatatgaacagcagatagagcagcttggcaacttccaattgcggatccatgatcagatgatattattagaaggtgcaaaagccacaactgagactgtagatgcattgaggaccggggcagctgcaatgaaagcaatgcagaaagcaacgaatatcgatgatgtggataagacgatggacgagatcaatgaacaaactgagaacatgaaacagatccaagaagcattatcaaatccaattggtgcctcagctgattttgatgaggatgaactggaagcagagcttgaagagctagaaggtgctgagttggaggagcaacttcttcaacctgcaacaactgctcctgctgccccaattcctgtcccagcgggcaaacaacctgctcgacctgctccacagaaacgaactgctgaagaagatgagctggcagctctgcaggctgagatggcactttgagttgatatccttcatggttttcaagcaggtcgcattgcctgatgaatattggaagcgagaggctatgtgaagaattggcctgaggttgtaacaaagatttgaacattttttgctaagttcagcgaaacctgatgaacaggtttctttgtgataataccagataataatccgaattcaatcttaggtcctgtataccatgtaaattaatataccactactatggtttcgcgttggcctaatatggagttaatttgtaagtgcctcaattact

SEQ ID NO: 3705 - DNA, 1071 bp, Cajanus cajan
tacccacaattagttgcacgctacgtggaggagtcaagaaatcgaagaaagaacgaagcaaatcaatttctgtttactttttattttatttttcttcgattggattcaatttctgaatttcccaatacccttcacgacctaatttttcaacagggagatcggttggcgaattggtagcgtcccgttgattttcctattcgacgcataaagggtatcactgtttcatcatctcttaatcaatcatgtttacccgaatttttggcaaaccgaaacaggaagccaatactctaaccactttggacaagttaaatgagacacttgaaatgctagagaaaaaggagaaagtactccttaaaaaggctgcagcagaagttgaaagagccaaagaattcacacgagcaaagaataaaagggcggctatacaatgtttgaagaggaagaggctatatgaacagcaaatagagcagcttggaaatttccagctgcgtattcatgaccagatgataatgttagaaggtgccaaggcaaccacagaaacagttgatgcattgagaactggagcagcggcaatgaaggctatgcaaaaagccacgaatattgatgatgtcgacaagactatggatgagatcaacgaacagacagagaacatgaaacaaattcaggaagcattgtctactccaattggtgcagctgctgactttgacgaggatgaattggaagcagaacttgaagagctggagggtgctgaattggaagaacagcttcttcaacccgcaactacagctccagcagccccagtgcatgttccagctgggcgtcaacccactcgtcctgtgtcttcgaagcccactgctgaggaagatgaattggcagctttgcaggctgagatggcactttgagcaggtccctttttccagctgaaacactattgatatatgcatctattcattaatctgttctagttcggttgggtattgcaattaatgtggccgttgaatggtttgtgtgtgcaccagtttcatgttcgatatcaacctttgcacagttgaattcacttgtataatcttagtt

SEQ ID NO: 3706 - DNA, 1208 bp, Populus trichocarpa
ccaatacaagaacaacacgcttaagagggaaaggggaaaaaaaaaaaacccaaaacaaaaaaactccgctctctctctgtgttcttcaacatcatcaagaaccctattctctgaattcgatcgattttcacagaagatcgcgaggaaaaacatacagacagggtttttaaacgaaaacaatccgccatgtttaaccgcttatttggaaaacctaagcaggaaaccaatgctctaactacgttagacaaattaaacgagacacttgaaatgctagagaaaaaggagaaggtgctccttaaaaaggcagctgccgaagttgaaaaggctaaggaattcacccgagggaaaaacaaaagggctgcaattcaatgtttgaagaggaagaggctgtatgagcagcaaatagaacaacttggaaactttcaattgcgcattcatgatcagatgataatgttagaaggtgcaaaagctactactgaaactgtagatgcgttaagaactggtgcagccgctatgaaggcaatgcagaaagcaacgaatattgatgacgtggacaagacgatggatgagatcaatgagaacatgaaacagattcaagaagcattatcaacccccattggtgctgcagctgatttcgatgaggatgaattggaggcagaacttgaagaactggaaggagctgaattggaagagcagcttcttcagccagcaacaacagctcctgctgctccagtgcaggtcccagctggcaagaaaccagttcctcaaaaacgcacagctgaggaagaagaacttgctaacttacaggctgagatggccctttgagcaggcatcatgttcgagaatgaagagattatttatagattggccatgttgtatgatagagtttgtgccagtcctacgcatccagtgtgcattgaaacgtgaacagacaatgtatataaagattgcgtaagctgaatgtagttcttcaaatttgtatcctgcctcgtggagctttcgattgtgttcgttatccttgtttctttctctgcaggactgtcttgaattactttttatcatgatgtgtcaccaacttggtaatcttcaattatcgttcagaatattgtgaataattgaatataatatccccttggcatcactgttttattggttgtatttacagttcatctccaatgaatgttatgaaatgtggatctatttacagt

SEQ ID NO: 3707 - DNA, 1406 bp, Nicotiana tabacum
  misc_feature (1072)..(1072): n is a, c, g, or t
  misc_feature (1211)..(1211): n is a, c, g, or t
  misc_feature (1281)..(1281): n is a, c, g, or t
  misc_feature (1338)..(1338): n is a, c, g, or t
  misc_feature (1340)..(1340): n is a, c, g, or t
  misc_feature (1395)..(1397): n is a, c, g, or t
  misc_feature (1399)..(1400): n is a, c, g, or t
ggccattacggccggggaccatttccaacttcactcaacacgcttaagaaaagccatagccccccagccccactcccgaaagccaatcccaacctaaccgggtcgacccgttacattccaaatcgttttcctctctttcctctccccttccttgatacttcccataaattcattgccttacaaccaaattcaatcttgataatctcgagttgaatcaaatttcctctagaatcacataccttcgagttgatcattgatcaatcgtctactctaatcctaacttctaattaacagaataaagccaggtttcgctgttgtctgttgtataagcaaagatgttttcgaagatatttgggaaacccaagcaggaaactaatgctcttgcgactcttgacaaattaaacgagactctggagatgcttgagaagaaggagaaagtgcttcagaagaaggcttctgcagaggttgagaaggccaaagattttacaagagcaaagaataaaagagcggcaatacaatgtttgaagaggaagaggctctatgaacaacaaattgagcagcttggcaatttccagcttcgcatccatgatcagatgataatgctagaaggtgcaaaagctactactgaaactgttgatgctttgagaactggagcatccgcaatgaaagcaatgcagaaagcaacgaatattgatgatgtggacaagacaatggatgaaataaatgaacagactgagaatatgaaacaaatacaggaggctttggctactccaattggtgcagcagctgattttgatgaggatgaattggaggcagaacttgaagagttggaaggtgctgaattggaagagcagctccttcaaccagcaactactgcccctgctgcaccagtccatgttcctgcggtgaggcaacctgctcggcccattcctcagaggcgtacagctgaggaagatgaacttgctgctttgcaagcagagatggctctttgagctactccctcttttgttttaaccgatattatcacgggtagcttacatatatagactggttgtacgcatgcatgagactnctgcaattactttcacatgcgagagactactgcaattgctttcacatgcgagagactactgcaattgctttcacatgtctcgatcgagagactactgcaattgctttcacatgcgagagatctatgtcggttagtaggnctatgtacataattgtgttgcagaaaatggtgaattccatgaacatcagaatttatggttcatgcttaantgaatcttatgttcactacgtcccttttttcttaaacaaaattaagaatctcctttntnatcttgtaccatctcagaaggatgattatatgaaatgttttgtctgcttctgcannngnngatgag

SEQ ID NO: 3708 - DNA, 1232 bp, Solanum lycopersicum
gtttaatcaacggcctgttataggtttacactcttttctccttctccaaatacaagaaatcttcaaaagtcccaatattttaatctccataaatgaaataaaaataattaaatttctacaaaaatcatcaatcgattgatcaatttactcttcaatacgtcaattttttcccaggaattgtataattttgaagttctttttgggacccaattgattcgggattgaggagtagttgattgattgtttggtgagttgaactgtgaatatttttgctgcaaccaattcctgtgcaaaattgaaaatgtttaagcgattacttggaaaacccaaacaagaaacaaatgctctagcaacattagacaagttaaatgagacgcttgaaatgcttgagaaaaaggagtcagttttattgaagaaggctactgctgaggttgaaagagcaaaggaatttactagagcaaaaaacaaaagggctgcaatacaatgtttgaaaagaaaaaggctctatgaacagcaagtcgaacagcttggaaatttccaattgcgtatccatgatcagatgatactgctcgaaggtgcaaaagccacaacagaaaccgttgatgctcttagaactggagcagctgcaatgaaagccatgcagaaggcaacgaacattgacgatgttgacaaaacaatggatgaaattaatgagcagactgagaacatgaaaatgattcaggaagcattgtctacaccaattggtgcagccgctgattttgatgaagatgagttagaggcagaacttgaagaactggaaggagctgagttggaggaacaactccttcagcctgctactgctgccccttctgcacctattcatatgcctgctggtaggcaacaagtgcgtcctgctgcccaacacagcagaacggaagaagatgaacttgctgctttgcaggctgaaatggctctttgacgaggtcattttcttgttctctatttcttgtgattacggtgataatcgccgaataaagaatgctgtaaagatcaaatgtactctctttgaattcttgatgtgctgcaatgcagccttagcttacaagtataactgtatagattgcaggagttgatttattatttcttgtgaaagttgaaatgggaagagttttgctacttttacatgaaatttcattgtttaaattgtacaaaatatctcttctatcaacattgaagtgcattttttgtgttta

SEQ ID NO: 3709 - DNA, 1090 bp, Taraxacum officinale
gagtaagcgtgtatcgacattggaggtaaccattaatcctaagcaaatccaccctccaattcgattcttccaatcttcatcatcgtttcaaaaccctcttccgttttctataaatcctttcaatttcgatttcttccagtattttggcctcacagataagaactatcacttgattaccagggtaatcactcacacttgtcaatcaattcccagatcgcggggtttgaagaaaagaatagttaacaatgtttgctcgaatgtttggcaaacctaagcaggaagctaacaccgttacgacgttagataagctaaacgagacacttgaaatgctagagaagaaagaaaaagtactattgaagaaagcttcagcagaagttgaaaaagcaaaggaattcactagagctaaaaataaaagagctgcaatacagtgtctgaagcgaaaaagactatatgaacagcaagttgaacagcttggcaattttcaacttcgtattcatgatcagatgataatgcttgaaggtgcaaaagcaaccacagagacagttgatgcattgagaactggagctcaagcaatgaaggctatgcaaaaggctgtgaatattgatgacgtggacaaaacaatggatgagataaatgagcaaacagagaacatgaaacaaattcaggaagccttgtcagcaccaataggagcagcagctgattttgatgaggatgagttggaagctgaacttgaggagttggaaggtgctgagctggaagaacagcttctgcagcctgccaccactgcacccgcagctccattccgtgtacctgcaggtagacaatcaacacgtccacctcccacagctgaagaagatgaacttgctgcattacaggccgaaatggcactttaaagattcgactcgcggggtggaagaaattgtaaaaatttgggtgtttggaaaacggtggttatgatttgttgagatattattgtttatttgataacgtgattaattaaatgactttttatatgttattaggaacggaaaaaaaggaattgtcgttcccttttatgttagtttttaagtgttggtgtgtacaatgtagt

SEQ ID NO: 3710 - DNA, 1154 bp, Actinidia deliciosa
  misc_feature (54)..(54): n is a, c, g, or t
  misc_feature (820)..(820): n is a, c, g, or t
  misc_feature (1083)..(1083): n is a, c, g, or t
ccccgcgtccgcaaaaaggcaaagccacagccaacgcttacctctcttcccccntcaacacgcctaagaaactctctctctctctctctctttctctctccttcttcgttgtttcccccaaactcgaacccctatctattgttcgtctctaagtgattctcaattcacctatttttctgcggtcaattcgtcgatcgatcgatcgatcgattgattttcaagccatatccgatacagaagatccggagagtccgattttgttactgaatcgacgatgtttactaagcttttcggcaaacccaagcaagaggccaatgctcttaccacgatagacaagttaaacgagactcttgaaatgcttgaaaagaaggagaaagtactccagaagaaggcttctgcagaagttgagaaggccaaggagttcaccaaagcaaagaacaagagggcggctatacaatgtttgaagaggaagaggctctacgaacaacaaattgagcagcttggaaatttccaattacgcatccacgaccagatgataatgttagaaggtgcaaaagcaacaactgagactgtggatgcattgagaactggagcatctgcaatgaaggccatgcagaaagcaacgaacattgatgatgtggacaagacaatggatgaaataaacgagcagactgagaacatgaaacagatacaggaagcattggctacaccaattggtgcagcagccgattttgatgaggacgagttggaagcagagcttgaagaattggaaggtgcagagctggaggaacagcttcttcaaccagcgacaacagccccngcagcaccagtgcaagtgccagccggcaggctaccagctcgtgttgctccgaagcgcacagctgaggaagatgaacttgcagcgttacaggcagaaatggcactttgagcaggtcgttcctatttatctgtagcttgatcaatcgttgtgctgatgtggcattcactctatataagttgatgcagtagtcatttgacttagtgggtaagctgttggactagtcttttggaacctctccacctagactgttatattgtgtatantatgggccatttgcttaaaatgtcttccactggaagcacagtttgatgcagataatattgtcgtattgaaa

SEQ ID NO: 3711 - DNA, 1173 bp, Quercus alba
atctcattctctcccactctcacacataaaatttacagttccaaaccctaatcgatcaattcgatccctctctcttcaatttccaacctccatctcacagaagatcgaggaaggtttaatcgttgagaatcaaccatgcttaaccggctttttggaaaatctaaacaggaaaccaatgctctctccacgttagataaattaaacgagacacttgaaatgctagagaaaaaggagaaagtacttttaaaaaaggcagctgcagaggttgaaagggcaaaggaattcaccagagctaagaacaaaagggcggctatacaatgtttgaagaggaagaggctatatgaacagcaaatagagcagcttgggaatttccaattgcgaatccatgatcagatgatattgttagaaggtgcaaaagcaactactgaaactgtagatgcattgagaactggagctgctgcgatgaaggcaatgcagaaagcaacgaatattgatgatgtggacaagaccatggatgagattaatgagcagactgagaacatgaaacagattcaggaagcattgtctactccaattggtgcatcagccgattttgatgaggatgagttggaagctgaactcgaagaactggaaggtgctgagctggaagaagaacttcttaagcctgcaactactgctcctgcagctccagtgcaggtcccagcgggccctcaacgaaaccgtcctacaccaaagcctacagctgaggatgatgaactggctgcactacaggctgagatggcactataagcagaattttgcagatattgtttgggtgtaatgatgggaggctatgtaaagaattggcctgattgcttatggagatttctgccctttcatgcattctgatttctgtgtcggatgattggtaaacagacaatgtacataaaggtggcgtcaaaattgaacgaagtcaccactcaaacttgtaatctgctctttgatgctccaaaacgagtctgtctttttcaagttgtcacatttaatttatttattaaatgttcgggtgatattcgataacttaatgattctctcatgtcttatcctagttaatcaataatcttagatcatcgtggagccaaaaaaaaaaaagcaaaagatggagaaaagcagtgatgggtttgttcgtgcaga

SEQ ID NO: 3712 - DNA, 755 bp, Brassica juncea
aatttttaatcgaaatcccagattttttcccaggaagcaaagatgatgaatcggctattcgggaaaccaaagcatgagggcaatgctctccagacattagacaagcttaacgagactcttgagatgctagagaagaaggagaaagtgcttctgaagaaggctggacaagaggtcgagaaagccaaagaatacactcgtgcaaaaaacaaacgcgcggctatacaatgtttgaaaaggaagaggttgtatgagcaacaagttgaacagcttggcaacttccagctccgtattcatgatcaaatgattatgttggaaggtgctaaagcaacaactgagactgtagatgctttgaggactggtgctgctactatgaaagctatgcagaaagctacaaacattgacgatgtcgacaagacgatggatgagatcaatgagcaaaccgataacatgaaacagatccaggacgcattgtccgctccctttggctctgctgctgatttcgatgaggatgaattggaggcagaacttgaagaacttgaaggcttagagctagaggaccaacttcttcagccagcaagacccgttcctgaaggaaagcaacctgctcgtcctctacctcagaagcaacagtccgctcatgaagatgaactcgctgcactacaggctgagatggcactctaaggttaccttataaaaacaaacaacgggttctgtttactgcatcgtaagggtttgagtgtgcattatttaaaaaa

SEQ ID NO: 3713 - DNA, 1104 bp, Zostera marina
ctttacttacgcgtttcttcaaggattcacaaattcgtcacccctctttctccccttctatcccagggatctgattgcttatctgatttcgtggttggggggttttggattgtgaggttctgcttctttcataggattattgtgtgttgggagaaaaaaaagtaggcaaggatgtttgggagaatttttgggaaacctaaacaggaaaccaatgctctgactacgttggataagttgaatgagacactagaaatgctagaaaagaaggagcatgttctcctgaaaaaagctggtgtggaagtggaaagagctaaagaatttaccagagcaaagaataaaagggctgcgatacaatgcctaaagaggaagagattgtatgaacagcaagttgaacaacttggaaacttccaactccgtattcatgatcagatgattatgctagaaggtgcgaaagcaactacagaaactgttgatgcactgaggactggagcggctgctatgaaagccatgcagaaagcaacaaatattgatgatgtagacaagacgatggatgatatcaatgagcaaaccgagaatatgaaacaaattcaagaggctctttcgactcctattggagcagcttctgattttgatgaagatgaattggaagcagaacttgaggaattggagggagctgagttagaagaacaacttcttgaacctcctattgttgtgccgcgtccttctgttccacagccaacgcgacccactccacaaaagaacaccgctgaagaagacgaatttgcagcattacaggcggagatggcactttgagaggtaaaaaacagcaggcaaggaattatataaagaatgcaaatttgtggggggcatgggggagagtgggcacacaagggcagacattatatcccatttcttctttttgttatgccctattatatttaatatcatcgttatgacagtgtgtgtctgtgcgtgtgaaaaatgttgtgaacgacataaagaaagtaacattcttaattgaaagttgaaacttgtatccatatctgtgactctgtataataactaagtacatggatttttatcttaaatcaaatctgaagtttc

SEQ ID NO: 3714 - DNA, 1391 bp, Catharanthus roseus
ctttggcgtgtaaactccaattacgcgccgattaaaatattactcttaaaaaggctccaacaaaatcaacgcgactaagcaaagcacaggcgaaaggaaggtccctagaccaatatccaatccttttcctcccagaactctcctccctttcttcttcatcggttcatggttcctgaaccggagccctaattctattattatcctatttttccccctctgggaattgttgatccatttaattgaaccgatcgatcgctgactttgaagccctaggtcctatttttcacgaggaaaagcaggagatcagtttttgtatctgcaaccgaataaaatgtttacccggatatttggcaagccaaagcaggagagtaatgctgtcgcgactctagataaattgaatgagacgttagagatgctggagaaaaaggagaaagtacttcaaaagaaggcatcagcagaggttgaaaaggccaaggaattcactagagcgaagaacaagagggccgccatccaatgtttgaagaggaaaaggctctacgaacaacagattgagcagcttggtaatttccagttgcgtatccatgatcagatgatcatgttagaaggagctaaagctacaacggaaactgttgatgccttgaggactggagcagctgcaatgaaagctatgcagaaagcaacaaatatcgatgatgtggataagacaatggatgaaataaatgaacagacggagaacatgaaacagatccaggaagctttgtctactccaattggtgcagctgctgactttgatgaggatgaattagaggcagaacttgaagaattggaaggtgctgagttggaggaacagcttcttcagcctgcaacaacagcccctgcagcaccagtgcatgtacctgcaccagcaggtcggcaacaggctcggcctgctcctcagaagcaaacagctgaggaagatgaacttgcagcattgcaagcagaaatggcactttgagcagttcaacgcttttgttgattttaagtggtaatttagtcaatatttgcgtatgtgatttaaggttttagaggaccttgcagtcaaactcgtacatcttctgttaatgaaatttaggcatgttgatggaattatctttccaattacccttagtgtatattattattttctggccaatgcctacttgttcaagagatcggatgatttccctatataaatgctgtgtttgatatttaaatttgaacggtcacaatacctcagttatctgcaggtatgagattacgtgcggatctgaatctggtcaatcaatatgaagagtgctggttatgtaagccaatttctgcgctcattatgagttttaatactgtactactagtgtacataaagttgtgacaaa

SEQ ID NO: 3715 - DNA, 1227 bp, Euonymus alatus
gggacttcaacgcgacgacgtaaagaaaggggaaaacagctttctcctccgtgggccgatatcaatctaacacaatccttacacgcctaagcaaattccgatgcaacaacgcctctctttctccctcgctcttacataatttcacgtacctcctcccgttcctgttgaaagccctagcactctacatcccacttcgattccaatcttcccgttctaatacctccattttcagggaaatcgcgagggttttcaaagcggaggatcggccatgtctgtgtttaacaggcttttcgggaaacctaagcaggaaactaatgctttgactactttagacaagttaaatgagacactggaaatgctagagaagaaggagaaagtacttctgaaaaaagctgctgcagaggttgaaaaggccagagattttaccagatcaaagaacaaaagggcggctatacagtgtttgaagaggaagaggttatatgagcagcaaatagaacaacttggaaatttccaactacgccttcatgaccagatgataatgttagaaggtgcaaaggctacgactgagacagtagatgcattgagaactggagcttctacaatgaaggcaatgcagaaggccacgaatatagatgatgtggaccagacgatggatgagatcaacgagcaaactgagaacatgaaacagattcaagaagcattgtcaactccaattggtgctgcagccgattttgacgaggatgaactggaagcagaacttgaggaacttgaaggtgctgaattggaggaacagcttcttcagccggcaacaacagctcctgcagctccagtgcaagtcccagcaggtcgtcagccagcccgtcctgctccacaaaagcgtacagctgaggaggatgaacttgctgccttacaggctgagatggcactctagacaggatgcaaaaattgttcaaaagtcagccttattgtattattgcgggctcctttcacagatctagatttctgccgtgcaatgtatatagagattgcataaacaaatttacgcacaaaacttgtattctgttatgtggagctttaaattaagattgtgatcttttttgttttaaacatcttttcaaaacgttgaaaacatttttcaacgttctgaaactctgacagctaagttgttcttatgtgatgtgaccaagttcatagtgtttaatctgagtcgtgctacattgaattatg

SEQ ID NO: 3716 - DNA, 814 bp, Cleome spinosa
cttccccttgaaagttatactccgtcccaattccatcggcgggaatccctaattgattctctgatcggagtggggttttttttttatcacagataattaaccatgttcgtgaatcggctcttcggaaaacctaaacaggagtctaatgctctccagacattagacaagctaaacgagacactcgagatgttggagaaaaaggagaatgtactcctgaagaaggcttctgcagaggtcgaaaaagcaaaggaattcacccgggcaaagaacaaacgagcggctatacagtgcttgaagaggaagaggttatatgaacaacaagttgaacagctggggaatttccagctgcgcattcatgatcaaatgattatgttagaaggtgccaaagcaactactgaaactgtagatgcattgaggagtggagctgctgcaatgaaagctatgcagaaagcaacgaacattgatgatgtggacaagacaatggatgagatcaatgagcagacagaaaacatgaaacagatccaggacgcattgtcagctccaatcggtgctgccgctgattttgacgaggatgaactagaagcagagcttgaagaactagaaggagccgagctggaagagcaacttctccagccagcaacgatggctccaacagcaactgttcccatgccagctggcaggcaaccggcccgtccagccgcccaaaagcagcggacagctgaggaagatgaactcgctgcattgcgggctgagatggccctctaaaggtaacaccttggtttaatgccgcaggggttagtccatgggaaagcta

SEQ ID NO: 3717 - DNA, 1075 bp, Coffea canephora
atctctcgaatttgacgaaaaaattcgtcgatttgatcgttcgcttgttcgttgactctgaaaccctaaccccccgatcacaaggagatcggagaagaatagttattcgtgtagatattctgaatcatacgtccaagatgtttactagaatattcggcaagccaaagcaggagactaatgctgtcacaactttggataaattaaatgagactttagagatgctagaaaagaaggagaaagttcttcagaagaaggcatctgcagaggttgaaaaggctaaggaattcaccagagcaaaaaacaagagggcggccatccaatgtttaaagaggaaaaggctctatgaacagcaaattgagcagcttggtaatttccagttgcgcatccatgatcagatgatcatgctagaaggtgcaaaagctacaacagaaactgttgatgccttgagaactggtgcatcagcaatgaaagcaatgcagaaagcaacaaatattgatgatgtggataagacaatggatgaaataaatgagcagacagagaatatgaaacagatacaggaagctttggctactcctattggtgcagcagctgattttgatgaggatgaattggaggcagaacttgaagaattggaaggcgctgagttggaagagcagcttcttcagcctgcaattaatacccccgctgcacctgtgcatgctcctacaccagctggcaggcaaccagctcgccctgctcctcagaagcaatcagcggaggaagatgaactggctgcattgcaagcagaaatggctctttgagcagctccatttcttcagtttaacgggtaatttggcctgtatttgtgtatgtggcatttatggcactagtggatctgtatctatcttccctgttttcagccattgatgaaagcactgagcttcttggaatcatttggaactgcgtggcccaattatctttagtgtataatttatagcggccagtgttacttcggcaaatattaaataacagaattcctttgtaattgatccattggagtgtatttttgtgttgtcgtgatacatttagttttctg

SEQ ID NO: 3718 - DNA, 930 bp, Gossypium hirsutum
aagaaatccagagatctttcaatctcttaatttcacagatcgggggttcaatctcggggaattcaccatgtttaaccggcttttaggaaacccaaacaggaaccaaatgctctaacctcattagataaattacacgagacccttgaaatgctagagaaaaaggaaaaagtacttctgaagaaggcttctgcagaggttgaaaaggccaaggaattcaccaaagcgaaaaacaagagagcggctatacaatgcttgaagagaaaaagactatatgagcagcaaattgaacagcttggaaacttccagcttcgtattcatgatcagatgataatgttagaaggtgctaaagccacaactgagactgtagatgcattgagaagtggagcatctgcaatgaaggcaatgcagaaagcaacgaatatagatgatgttgacaaaacaatggacgagatcaatgaacaaaccgaaaacatgaaacagattcaggaagcactgtcaactcccattggagctgctgctgattttgatgaggatgaactggaagcggaactcgaagaacttgaaggtgctgagttggaagaacagcttctccagcctgcaacaactgctcctgctcctgcagctacggtgcaggctcctgctggcaggcaaccagctcataatgctccaaagcgcacagctgaggaagatgaactcgcagcattgcaggctgagatggcactttaaggcgtctagtagagaactggttttgttcatgttgcaaaacatgagagggaagctaccacattgtattattgaatcttgccttttaaatttgcatggcattaattgttcagaacattcaatgtacataaaaaagattgcaaggacttaaataaaggttgcattattttctatgaaaaaagaaaaaagtaaccgacacctgcgcgg

SEQ ID NO: 3719 - DNA, 964 bp, Ambrosia trifida
acaataatatcatatccatccaactcaattgctttacctttcttcctctgatcataatatcccttcaatccaacttcaattcttcaaaagttttcaggtgttcaagatcgttactctgtttatagaatcaactatgttttcccgcgttttggtaaacctaagcaagaaactaatgcggtgacaacgttagacaagttaaatgagacacttgaaatgctggagaagaaagagaaagtacttttgaagaaggcttctgcagaggtggagaaggccaaagagtatactaaagcacataataaaagggcggcaatacaatgtttgaagaggaagaagctgtatgagcaacaagttgaacagcttgggaactttcagttacgtattcatgatcagatgattatgctagaaggtgctaaagctaccacagagactgtagatgctttgagaactggtgcagcagcaatgaaagccatgcagaaggcaacaaatattgatgatgttgataagactatggatgagataaatgaacaaactgaaaatatgaagcaaattcaggaggcattggcaacaccactcggtgcagctgctgattttgatgaggatgaactggaagctgaacttgaggaactagaaggagctgagttggaggaacagcttctccaacctgccactaccgcacctgctgctccggtgcatgtgccagctggcaggcaacaaacacgtccagctcctcgccaaaacaaagcggaggaagatgaacttgctgcattgcaagcagaaatggcactttaagaaaagtcagaattccatttgcagatctctggagatgtactcatacaccataaaaactgatgaagtgtgtgttaaatatatattgtacagttgcgattgtagactgaatgacaagttgggaatgttgtattattatacattgaagatcataaaggtctgatatactgttttctga

SEQ ID NO: 3720 - DNA, 942 bp, Ambrosia trifida
aatccatccaactcaattgctttacctttcttcctctgatcatatcccttcaatccaacttcaattcttcaaagattttcaggtgttcaagatcgttactctgtttacagaatcaacaatgttttcccgcgtttttggtaaacctaagcaagaaactaacgcggtgacaacattagacaagttaaatgagacacttgaaatgctggagaagaaagagaaagtacttttgaagaaggcttctgcagaggtggagaaggcgaaagagtatactaaggcacataataaaagggcggcaatacaatgtttgaagaggaagaagctgtatgagcaacaagttgaacagcttgggaactttcagttacgcattcatgatcagatgattatgctagaaggtgctaaagctaccacggagactgttgatgctttgagaactggtgcagcagcaatgaaagccatgcagaaggcaacaaatattgatgatgttgataagactatggatgagataaatgaacaaactgaaaatatgaagcaaattcaggaggcattggcaacaccattgggtgcagctgctgattttgatgaggatgaactggaagctgaacttgaggaactagaaggagctgagttggaggaacagcttctccaacctgccactaccgcacctgctgctccggtgcatgtgccagctggcaggcaacagacacgtccacctcctcgccaaaacaaagcggaggaagatgaacttgctgcattgcaagcagaaatggcactttaagaaagtcagaattccatttgcagatctctggagatgtactcatacaccataaaaactgatgaagtgtgtgttaaatatatattgtacagttgcgattgtagactgaataacaagttgggaatgttgtattattatacattgaagatcataaaggtctgatatactgt

SEQ ID NO: 3721 - DNA, 972 bp, Chelidonium majus
caaaatcgattcgtctctcactctcatcgatcgcttcaatcctcaattctacaaaccctaattgctgatctttgattttttttaaattggagtaaagggtttgcagaccaagatctaatcatgttttcgcggatgttcggcaaacctaaacaggagacaaatgcgttgacgacgctagataagttgaatgagacacttgaaatgctagaaaaaaaggagaaagtccttataaagaaggcttctgcagaggtggagaaggccaaggagttcacaagagcgaagaacaaaagggctgccatacaatgtctgaagaggaagaggctgtacgaacagcaagttgaacaacttgggaatttccaattgcgtattcatgatcagatgattatgctggaaggtgcgaaagccacaactgagactgttgatgcactaagaactggagcagccgctatgaaggcgatgcaaaaggccacgaatatcgatgatgtagacaagacaatggacgagattaacgagcagactgagaacatgaagcagattcaggatgcgttgtctgctcccattggtgcagctgccgactttgatgaggatgaattggaagctgaacttgaggagttggaaggagctgagttggaggaacaacttttacaacctgcaacaactactcctgcggctccagtgcatgtctcagcaggaaggcaacctacacgccctgctcctcagaagaacaaagctgaggaagatgagttggctgcactagaggctgagatggctctataaacaggtttttaatccaatcaaacctggagtcaaatgagattcatgtaaagattggtttctgtacaatggaggatgtcgcttgggacagctactatttcatcaacaattgcttgctcattgtgcattccctgctaaggaacataatattctgtatagatcttcataaagttaacaatcactcttatcaaagttctg

SEQ ID NO: 3722 - DNA, 1230 bp, Tripterygium wilfordii
gacgtaaaagaaagggaaaacaagcttcctcctccgttgcccgatgtctatctagcacaacacgcctaagcaaattcccatctctctttctccctctctctctcacatgatttcacatacctcctcctgttcctgttgaaagccctagcaatctacatactatttcgattccaatcttcccgatctaattcatccattttcagggaaatcgcaagggttttcgaaacggaggattgaccatgtctatgtttaataagcttttcgggaaacctaagcaggaaactaatgctttaactactatagacaagttaaatgagacactggaaatgctagagaagaaggagaaagtacttctgaaaaaagactgctgcagaggttgaaaaggccagagattttaccagatcaaagaacaaaagggctgctatacagtgtttgaagaggaagaggttatatgagcagcaaatagaacaacttggaaatttccaactgcgccttcatgaccagatgatactgttagaaggtgcaaaggctacgactgagactgtagatgcattgagaactggagctgcggcaatgaaggcaatgcagaaagccacgaatatagatgatgtggacaagaccatggatgagatcaacgagcaaactgagaacatgaaacagattcaagaagcattgtcaactccaattggtgctgcagctgattttgatgaggatgaactggaagcagaacttgaagaacttgaaggtgctgaattggaggaacaacttcttcagccggcaacaacagctcctgcagctccagtgcacgtcccagcaggtcgtcagccagcccgtcctgctccacaaaagcgtacagctgaggaggatgaacttgctgccttacaggctgagatggcactttagacaggatgcaaaaattgttcaaaggtcggccttattgtattattgtgggactcttttcacagatacagatttctgtgtgcattaagtggtgaactcgcaatgtaaatagagattgcataacaatcacaaaacttgtattctgttatgtggatctttaaattaagattgcgatccttttgtgttttcaaacatcgtttcaaaacattgaaaacatctttcaatgttctgaatctgactgcttagttaatcccatgtgatgtcaccaagttaattgtgtttaacgatctgagtcgtaagtacattgaattctgttaaatcttgtaccgt

SEQ ID NO: 3723 - DNA, 883 bp, Phaseolus coccineus
aagcaagtggtattcaacgaacaggggacaatatcactttgtgagtttctcgatactcctacgagggagatcgaattgcaaattccggtgtaaagcgcctcgttgattttcctatttgaccaataagggtatcgttgtttcaacatctcttaaatcaaccatgtttacccgaatttttggtaaacctaagcaggaagccaatactctaacgactctggacaagttaaatgagacacttgaaatgttagagaaaaaagagaaagtacttcttaaaaaggccgcagctgaagttgaaagagccaaagattttactagagcaaagaataaaagggcggcaatacagtgtttgaagaggaagaggctatatgaacagcaaatagaacagcttggaaattttcagctgcgtattcatgatcagatgataatgttggaaggtgccaaggccaccactgaaacagttgatgcgttgagaactggtgcagctgctatgaaggccatgcaaaaagcaacgaatattgatgatgttgacaagaccatggatgagatcaacgaacagacggagaacatgaaacaaattcaggaagcattgtctactccaattggtgcagctgctgattttgacgaggatgaattggaagcagaacttgaagagctggagggtgctgaattggaagagcagcttcttcagcctgcaactacagctccagcagctccagtgcatgttccagctgggcggcaacccactcgccctgcatcgtcgaagcccactgctgaggaagatgagttggccgctttgcaggctgaaatggcactttgagcagttaaatggtttgtgtgtgcaccagttcgatatcaaccattgcacaaacttcgcaggcaatta

SEQ ID NO: 3724 - DNA, 892 bp, Gossypium hirsutum
gccgatcaatgaggccacgtggaaagccgataacgtcaacgtcgtcaagaacagaagaagaaacgaagcaaaggcagctcttattctaatacaacacgcttaaggaaaaatcgccaaataaaataccactaccctcaaggaatctacagatctctgtccctctttctctacgtctcaaaccctaattccttaatttttacagaagatcgggggtttaatcgcggagaatcaaccatgtttaacaggcttttcgggaaacccaagcaggaagcaaatgctctaaccacgttagacaaattaaatgagacccttgaaatgcttgagaagaaggagaaagtacttgtgaaaaaggctgctgctgaggttgaaaaggccaaggaatttgccaaagggagaaacaagagagcggctatacagtgcttgaagaggaagagactatatgaacagcaaatagagcagcttggaaacttccagcttcgtattcatgatcaaatgataatgttagaaggtgctaaagccacaactgaaactgtagatgcattgagaactggagcagctgcaatgaaggcaatgcagaaagcaacgaatatagatgatgttgacaaaacaatggacgagatcaatgaacaaactgaaaacatgaaacagattcaggaagcactgtcaactcctcttggagctgcagctgattttgacgaggatgaattcgaggcagaacttgaagaacttgaaggtgctgagttggaagaacaacttctccagcctgcaacaactgctcctgcagctccagtgcaggtgcctgctggtaggcaaccagctcgtcctattcctcaaaagcgtactgctgaggaagatgaacttgctgcattgcaggctgagatggcactttaag

SEQ ID NO: 3725 - DNA, 1241 bp, Cynara scolymus
  misc_feature (794)..(794): n is a, c, g, or t
  misc_feature (813)..(813): n is a, c, g, or t
  misc_feature (824)..(824): n is a, c, g, or t
  misc_feature (843)..(843): n is a, c, g, or t
  misc_feature (959)..(959): n is a, c, g, or t
  misc_feature (981)..(981): n is a, c, g, or t
tgatcgacttggaggtaaccggtaggttaagcaatcccctccagttggagtccccacccacttctacaacccatcggatctaaaaatttcttcgatcttcatcgtcatcccttttgatcaattcaaaacccttttgattttcatttaaattctcactcaatttcgatttttcactatttcttttccaataaaccctagacgcaggttaagaatcatctcgtgattcccacgacgatatctcacacttgtttaaatttctgatcgtagggtttccaagaaaaaaaacaggtgacaatgttttcgcgtatgtttgggaagcctaagcaagaaacgaacgctgtaacaacgttagacaaattaaacgagacgcttgagatgttagagaagaaagaaaaggtacttctgaagaaagctgctgcagaggttgaaaaggcaaaagaatttaccagggcaaaaaataaaagggcggcaatacagtgtttaaagcgaaaacgactttatgaacagcaaattgaacagcttggcaattttcaattgcgcattcatgatcagatgataatgcttgaaggtgcaaaagctaccacagagacggtggatgctttgagaactggagctcaagcaatgaaggcaatgcaaaaggcagtgaatattgatgatgtcgacaaaacaatggatgagataaatgagcaaacggagaacatgaaacaaattcaggaagcattgtcagcacctattggtgcagctgctgattttgatgaggatgagttggaggctgaacttgaagagttagaagnagctgagttggaggaacancttctacagcntgccacaactgcccctgcngctccagtgcatgtgcctgctggaagacaaccaacacgtccagctcctaggaagaacacagctgaggaagatgagcttgctgcattgcaggcagaaatggcactttaaaggttacncactctttcaggttcattcaantcccagctggaagatcctgtaaagatcggaggtatgacatatggtgataggtttgatccgttaaaaatttattgacatcaacatgaattgtttgtgtggaaaaggattaaagtgttcatgtgttggtgtatgctatatgggtacaatgttgatgttgattatttgagaaatttgtcttcaattatagaaagtcgaatactatcgttattaacaatgtaatatgcgacagattgttttcgagtaaaatgttcaagagttgc

SEQ ID NO: 3726 - DNA, 1155 bp, Zingiber officinale
  misc_feature (548)..(548): n is a, c, g, or t
  misc_feature (578)..(578): n is a, c, g, or t
  misc_feature (581)..(581): n is a, c, g, or t
  misc_feature (611)..(611): n is a, c, g, or t
  misc_feature (710)..(710): n is a, c, g, or t
  misc_feature (782)..(782): n is a, c, g, or t
  misc_feature (792)..(792): n is a, c, g, or t
  misc_feature (804)..(804): n is a, c, g, or t
gcaccatgcatcggcgtccatctctcctgaaagtttacgggggcgaagaggggaaggaagttatcccccaaaaccgatctatcaatcgaggcttggaatcggctccttacgaagatagatctttcggatcttcatctaggactttggacctggacgggggattcgcggctaaagctttgtttttgttgagggttgttgtttaggggacggctaagatgtttactcggcttttcggaaagcccaaggaacaaaccaataccttggccactctcgataaactaaatgagacacttgaaatgcttgagaagaaggagaaagttttattgaagaaggttgacgcggaggttgaaaaggctaaggagtataccagagcgaagaataagagagctgctatacaatgcttgaagaggaagagactttacgagcaacaagttgagcagcttggcaacttccagttgagaattcatgatcagatgataatgctggagggtgcaaaagctactacagagacagttgatgccttaagaactggagcagcagcaatgaangccatgcaaaaagcaactaacattgatgangtngataagactatggacgagattaatgagcanacagagaacatgaaacaaattcaggaagcattgtccacaccaattggagcagcagctgattttgatgaagatgaattggaagcagaactagaagagctngagggagcagagttggaggaacagcttcttcaacctgctacaactgctcctgctgctccagtccatgctccngctggtaganttgctcgacctnctgctcagaaaaatactgctgaagaagatgagcttgctgctttgcaagctgagatggcaatgtagtcaggcttctttattctactgtgagaaagtgatgctgaataagtgaaaatgacttgtccttcaagggacggtggaaaatttgagttgaaaaatgcaacaatacagtctgtatgataaactgaagtggttaaagaaacgagtttgccattgacttaatattatgatctatttgtggttccttgtgtctatacatacacattcttgatgtaactatcgaaccactatgctgtacgctgaaagttggcgtgtttataaggtcttttgctgcaaaagtttacatgaaggt

SEQ ID NO: 3727 - DNA, 1000 bp, Lactuca sativa
cggggactcgatatttgttcagcttttgtcccctgagccctcaaacttcaaacaaaacccatatcaaattcatcgaatccaatttgttcatcatcacatcgatcaattgtatacaccgtgaaagtttttggtgttggagattttgattttacgagagcagatcgtgtatatatctactagaatcaaccatgttcacgcgaattttcggaaaacctaagcaagaagctaacgctgtagcaacattagatagattaaatgagacacttgaaatgcttgagaaaaaagagaaagtgcttttaaagaaagctgctgcagaggtggaaaaggccaaagaatttactagagctaagaacaaaagggctgcaatacaatgtttaaagaggaaaaggctctatgaacaacaaattgaacaacttggaaacttccagctacgtattcacgaccagatgattatgcttgaaggtgcaaaagccaccacagaaactgttgatgctttgagaaccggtgcttcagccatgaaagccatgcagaaatcaacgaacattgatgatgttgacaagacaatggatgagataaatgagcaaactgagaacatgaaacaaatccaagaggcattgtcagcacccattggtgcagctgctgattttgatgaggatgaattggaagctgagttggaagaacttgaaggagcagagctagaggaacagcttctccaaccagccaccaccgcccccgccgctccggtacatactccggcgggccgccaacacgcacgaccaccgccacagaagaacacggctgaggaagatgaacttgctgcattacaggcagaaatggcactttaaaacaaaaagatggaggggagtggagatgatgcatataaatgaagaaagtgaggaaatggtgaaaagtttggttgaactttatctcttgtacatttgtgatattaaacttgaataacatgtttgaatttggaacttgggaaaagatcgattataga

SEQ ID NO: 3728 - DNA, 1233 bp, Solanum phureja
gtttaatcaacgacctgttataggttacactcttttctccttctccaaatacaagaaatcttcaaaagtcccaattttttaatctccataaataaaaaataaaataattaaatttctacaaaatcatcgaccgattgatcaatttactcttcaatacttcaaatttttcccaggaattgtataattttgaagttctttttgggaccccattgattcgggattgaggagtagttgattgattgtttggtgggttgaaccgtgaagatttttgctgcaatcaattcctgtgcaaaatcgaaaatgtttaagcgattacttggaaaacccaaacaagaaacaaatgctctagcaacattagacaagttaaatgagacgcttgaaatgcttgagaaaaaggagtcagttttattgaagaaggctactgctgaggttgaaagagcgaaggaatttactagagcaaaaaataaaagggctgcaatacaatgtttgaaaagaaaaaggctctatgaacagcaagtcgaacagcttggaaatttccaattgcgtatccatgatcagatgatactgctagaaggtgcaaaagccacaacagaaaccgttgatgctcttagaactggagcagctgcaatgaaagccatgcagaaggcaacgaatattgacgatgttgacaaaacaatggatgaaatcaatgagcagactgagaacatgaaaatgattcaggaagcgttatctacaccaattggtgcagctgctgattttgatgaagatgagttagaggcagaacttgaagagctggaaggagctgagttggaggaacaactccttcagcctgctactactgccccttctgcacctattcatctgcctgctggtaggcaacaagtgcgtcctgctgcccaacacagcagaacggaagaagatgaacttgctgctttgcaggctgaaatggctctttgacgagtgataatcgccaaataaagaatgctgtaaagatcaaatgtactctttgtggtggatgatttttgaattcttgcaatgcagccttagcttacaagtataactgtatagattacaggagttgatttcatattttatgtcaaagttgaaatgggaagagttttgcttttacatgaaatttcattcttgaaattgtacaaaatatctcttctatcaacattaaagtacatttttttgtgatccaacttgaagctgaaagtacattcctataacttt

SEQ ID NO: 3729 - DNA, 1147 bp, Nicotiana tabacum
  misc_feature (298)..(298): n is a, c, g, or t
  misc_feature (340)..(341): n is a, c, g, or t
  misc_feature (349)..(349): n is a, c, g, or t
  misc_feature (352)..(352): n is a, c, g, or t
  misc_feature (361)..(361): n is a, c, g, or t
  misc_feature (364)..(364): n is a, c, g, or t
  misc_feature (370)..(370): n is a, c, g, or t
  misc_feature (394)..(394): n is a, c, g, or t
  misc_feature (412)..(412): n is a, c, g, or t
  misc_feature (1026)..(1026): n is a, c, g, or t
  misc_feature (1033)..(1033): n is a, c, g, or t
  misc_feature (1056)..(1056): n is a, c, g, or t
  misc_feature (1090)..(1090): n is a, c, g, or t
  misc_feature (1106)..(1106): n is a, c, g, or t
cattacggccggggagatcattattacaaacttcaaagtcaatattcatcaatcaattcacttctcaacacaacttcaaaattttcgcaggaattgtagaattttgattatttttgaagtttttttggaccccaattgatttggattgaggggtagttaattgatttattgattaattgatctttggagatttactgctaacaattcctgtggataagcgaaaatgtttacgaaaatctttggaaaaccaaaacaagaaacaaatgctctagcaactttagacaagttaaatgagacncttgagatgcttgagaaaaaggagaaagttttattgaaaaannctgctgcngangttgaaaangcnaaggantttactagagcaaaaaataaaagngctgcaatacaatgtttnaaaaggaaaaggctctatgagcagcaagtcgaacagcttggaaatttccaattacgtatccacgatcagatgatactgttagaaggtgcaaaagccacaacagaaactgttgacgctttgagaactggagcggctgcaatgaaagccatgcagaaggcaacgaatattgacgatgttgacaaaacaatggatgaaatcaacgagcagactgagaatatgaaaatgattcaggaagcattatctacaccaattggtgcagcagctgattttgatgaagatgagttggaggcagaacttgaagaactagaaggagctgagttggaagaacaactccttcagcctgctgcaactgccccttctgcacctattcatctgcccgctggtaggcaacaagtgcgtcctgctgcccagcagaacaaagcagaagaagatgaacttgctgctttgcaggctgaaatggctctttgaagagttataatcgccaaataaagaagcgaatgctgtaaagattgaatgtactcttgtggtggatgattgcttgaattcttgatgaccatgctgccttacaagtaactgtatagattacaggagttgaaatgggaagagtgtgctanttttatntgaaatttttattcttgaaattntacaaaaattgtctcttctagcaacattaaagtncacttttgttctccancttgatgttgtgagtacctggcattcttcagcaatctggtc

SEQ ID NO: 3730 - DNA, 931 bp, Ambrosia trifida
tttaccttccttcctctgatcatatcccttcaatccaacttcaattcttcaaaagttttcaggtgttcaagatcgttactttgtttatagaatcaacaatgttttcccgcgtttttggtaaacctaagcaagaaactaacgcggtgacaacgttagacaagttaaatgagacacttgaaatgctggagaagaaagagaaagtacttttgaagaaggcttctgcagaggtggagaaggcgaaagagtatactaaggcacataataaaaaggacggcaatacaatgtttgaagaggaagaagctgtatgagcaacaagttgaacagcttgggaactttcagttacgcattcatgatcagatgattatgctagaaggtgctaaagctaccacggagactgttgatgctttgagaactggtgcagcagcaatgaaagccatgcagaaggcaacaaatattgatgatgttgataagactatggatgagataaatgaacaaactgaaaatatgaagcaaattcaggaggcattggcaacaccattgggcgcagctgctgattttgatgaggatgaactggaagctgaacttgaggaactagaaggagctgagttggaggaacagcttctccaacctgccacaaccgcccctgctgctccagtgcatgtgccagctggcaggcaacagacacgtccagctcctcgccaaaacaagctgaggaagatgaacttgctgcattgcaagcagaaatggcactttaagaaaagtcagaattccatttgcagatctctggagatgtactcatacaccataaaaactgatgtgtgtgttaaatatatattgtacagttgcgattgtagactgaatgacaagttgggaatgttgtattattatacattgaagatcataaaggtctgatatactgttttctgaaaaa

SEQ ID NO: 3731 - DNA, 1113 bp, Amorphophallus konjac
taatatttaattgttaatataattatatattgtgagcttctgttgatctgcccttcgatttggagacccgatcgtttcttctctcctccgtcctctcccccacctccggccgggcaatctcgagtctccggtagatcgatcgagggtgttgggggggtgacgatcccggcgttgctagggttttcccgagggaggcagcgatgttcagcaggctctttgggaagcccaaggaggaggccaatgccctcaccacgctcgataagttgaatgagacacttgaaatgttagagaaaaaggagaaggttctcttgaaaaaggttgctgctgaagttgaaaaggcaaaggagtttacgagagccaaaaataaaagggctgcaatacaatgcctgaagaggaaaaaattatatgagcagcaagttgaacagctcgggaatttccagttgcggattcatgatcagatgataatgcttgaaggtgcgaaagccacaacagaaactgtcgatgcattgcgaactggagcagcagctatgaaagccatgcaaaaggcaactaacattgatgatgttgacaagaccatggatgaaatcaatgaacagaccgagaacatgaaacagatacaggaagcattgtctgctcctattggcactgctgctgattttgatgaagatgagctggaggctgaacttgaagaattggagggggctgaattggaggagcagcttctgcaacctgctacgactgcacctgctgctcctgtgcaggttccatcaggcagacaacctgtacgccctcctccacagaaaacagcggaggatgacgaacttgctgcattacaagctgagatggctctgtagttgggtccacggcacttcaaggtaggagaaacgtgtataaagttggtgccaaggagattgttccttctgggtgagcgcattgtgtttgataccgtgtaaaaaaccccacgctatataatggaggtagaaaggacggacctccctttatcatatcgaacagttggtgatggctgttaacagaatgtttcatcgaggtcttcaatttctatgatcatgtaaaaatgcttagtaattgaggttgtgtacacagtttgcaggg

SEQ ID NO: 3732 - DNA, 1120 bp, Aquilegia formosa
ggtcgttctctttccttgttccttccttcgctcgctttcttctcttccccaaagtgaccaattcgattcatattttctccattcttaatcattgaaaaccctaatcgatcaaatcgattaattcacttatttaataatataattcaagaccggttttgattgtttcaacggagtttttacctttgtgaagaagagaagagaagatattgttaacgcattagaaaacaatcatgtttactcggatttttggtaaacctaaacaagatacaaatgctttaacaacattagataaattgaatgagacacttgaaatgctagagaaaaaggaaaaggtccttttaaagaaggcctctggagaggttgaaaaggccaaagagtttactagagcaaagaacaaaagagctgcaatacaatgtttaaagaggaagaggctctacgagcagcaaattgagcaactcggaaattttcaattacgcattcatgatcagatgataatgctagagggtgcaaaagctacaaccgacactgttgatgccttgagaactggagcagctgcaatgaaggctatgcaaaaagcagttaacattgatgatgtggacaagacaatggatgagatcaacgagcagacagagaatatgaaacaaattcaagaagcgttgtcaactccaattggttcagctgcagactttgatgaggatgacttggaagcagagcttgaggaactggaggaagctgagttggaggaacaacttcttcagcccgcaactactgccccgtcagcgtcagtgcatgttccggcgggaaggcaaccaacacgtcttcctcagaagaggacagctgaagaagaagagtttgctgcattacaggcggagatggcactttgagagaggacgacgtctatccaccaagtatgaacgtatggtgtaaagtctggtttgattgtgtgctcgagattggtgctggtcaacaactcaaatcacacacttatggaagatgattgtataggcttcataaagtaaactgcatttactttataaatgtattttacctcagaagattataaattgttccttgtaaaacatttgtggaaatcatttgcttgtattatgtgtttgctttg

SEQ ID NO: 3733 - DNA, 1259 bp, Amsonia hubrichtii
gagtgcgagtcaagtggttttggcgtgtagactccaatttaaccgattaaattaccactcctaaaaggtccaaccaaatcaacacgacgaagtcaaacaaaggtccctgagaccaatatccatccctttttcatccagaaacccctttcttattcctgggatcagagccctaatctctgataatactccgactctgttccctctgcgattgttattccacttgtggaatcgatcgatcgctgactttgaagccctaggtcccaatttcaccaggaagcgaggagattagttctttgtatttacaacagaaaaaatgtttactcggatatttggcaagccgaaacaggagagcaatgctgtcgcaactctagataaattaaacgagacattagagatgctagagaaaaaggagaaagtacttcaaaagaaggcatcagcagaggttgaaaaggctaaggaattcacaagagcaaagaacaagagagctgccatccaatgtttgaagaggaaaaggctctatgaacaacaaattgagcagcttggtaatttccagttgcgcatccacgatcagatgataatgttagaaggggctaaagctacaacagaaactgttgatgccttgagaactggagcagctgcaatgaaagcaatgcagaaagcaacaaatattgacgatgtggacaagacaatggatgaaataaatgaacagacagagaatatgaaacagattcaggaagctttgtctactccaattggtgcagcagctgactttgatgaggatgaattggaggcggaacttgaagaattggaaggtgctgagctggaagaacagcttctgcagcctgcaaccacagcccctgcagcaccagtgcacgtccctgcatcagcaggcaggcaacaagcccggcctgctcctcagaagcaaacagatgaggaagatgaacttgctgcactgcaagcagaaatggcactttgagctgttcaacgctttattgatttaagtggtacaagattacatgcggatctgaccaatcaatatggagactgctggtcttatgtaagccaatttctgcacgtattctggcttataatactgtactactgtacataatggcgtcacaagaattggagcaagcttcttttaacatttgaatttatgttccatgcatacagatggaatggttgacaatcttttgtaagcggtataataataataatgccaactgtttttctgtgtctacacggtttattttttcggt

SEQ ID NO: 3734 - DNA, 1306 bp, Vinca minor
aaagtcccagaccaaatatccaatcctttcctcccataactttcttccttttctgattctaataataatatcccaatttgtttcccttctcagattattaatccattttcggaattgatcgatcgcggactttgaagcctaagccctaatttttaccaggaagcggaggaggagatcagttatttgtattatttacaacagggaaaaaatgtttactaggatatttgggaagccgaagcaggagactaatgctgtagcaactctagataaattaaacgagacattagagatgctggagaaaaaggagaaggtacttcaaaagaaggcgtcagcagaggttgaaaaggctaaagaattcacaagagcaaagaacaagagggctgccatccaatgtttgaagaggaaaaggctctacgaacaacagattgagcagcttggaaatttccagttgcgcatccatgatcagatgatcatgttagaaggggctaaagcgacgacagaaactgttgacgccttgagaactggagcagctgcaatgaaagcaatgcagaaagcaacaaatattgatgatgtagaccagacaatggacgaaattaatgaacagacagagaatatgaaacagattcaggaagctttgtctactccgattggagcagcagctgactttgatgaggatgaattggaggcagaacttgaagaattggaaggtgctgagctggaggaacagcttcttcagcccgcaaccacagcccctgctgcaccggtgcatgtccctgcagcagcaggcaggcagcaagctcggcctgcccctcagaagcaatcagctgaggaagatgaacttgctgcattacaagcagaaatggcactttgagcagttcaactctttattgattttcagtggtaatttggtctatatttgtgcacgtgacatttaaggctttagaggacctttagcagtcaacttgttcatcttctgttcatgaaacctaggcatggtggccattctagtcacttggaactattcgttccaagtatcgttgtgtatattattattttcaggccagtgcctacttgttcaagagattgaatgactgaatttctatataagtgctgtgtttgatatataagtttgaaccgtcacaatacctcagttatctgcaggtatgagactacatgtggatgtgaatcaaccaaatggagagtgctggttatatgtaagccaatttctgcacgcattctatgttactaatcatgtacttctactgtacataaaggtgtagacaaaaatgagacaacttctactaac

SEQ ID NO: 3735 - DNA, 1199 bp, Vinca minor
gattgttaattcatcactggaatcgatcgatcgatcgctgacttcgaaacctaggccctaatttttatcaggaaacggaggaggagatcagtttgaatttttacaacaggaaaaatgtttactaggatatttggaaagccgaagcaggagagtaatgctgtcgctactctagataaattaaacgagacattagagatgctggagaaaaaggagaaggtgcttcaaaagaaggcctcaggagaggttgaaaaggccaaagaattcacaagagcaaagaataagagggctgccatccaatgtttgaagaggaaaaggctgtatgaacaacaaattgagcagcttggaaatttccagttgcgcatccatgatcagatgatcatgttagaaggggctaaagcgacaacagaaactgtagacgccttgagaaccggagcagctgcaatgaaatcaatgcagaaagcaacaaatattgacgatgtggacaagaccatggatgaaattaatgaacagacagagaatatgaaacagattcaagaagctttgtctactccaattggtgcagcagctgactttgatgaggatgaattggaggcagaacttgaagaattggaaggtgctgagctggaggaacagcttcttcagcccacaaccacagcccctgctgcaccaattcatgtccctgcagcagcaggtaggcaacaagctcggcccgcccctcaaaagcaatcagctgaggaagatgaacttgctgcattacaagcagaaatggcactttgagcagttcaactctttattgatttaaagtggtaatttggtctaatatttgtgcacgtaacatttaaggctttcgaggtacctttagtagtcaacttgttcatctctttattgcctacttgttcaagagattggatgaccgaatttctatataagtgctgtgtttgatatataagtttggactgtcacaatacctcagttattgcaggtatgagattgcatgtggatctgaatctgatcaatcaatgtggagagtgctggttttatgtaagccaatttttgcacgcattcttagttataatcctgtacttctactgtacagaaaggtgtgacaaaattgagcaaacttctcttagcattttactttatatccaggcttactgctggaatggttgacaatctttgtaagctatcaaataataata

SEQ ID NO: 3736 - DNA, 1033 bp, Medicago truncatula
ggccttggaatcttgtcctcaacttcatccatcatcatcggtttttcttcaaccagatcgccagatcccaacttctaatccaatccgattcaattttcaacgatccaaacaacaatattttttgtttcaatattaatcatgtttacgagagttttcggtaaacctaaacaagatacatccagcaatgctcttgccactttagacaaattaaacgagacactagaaatgctcgagaaaaaggaaaatgtactccttaaaaaggccgcggcagaagttgaaaaagccaaagaatacacaaaaagaaagaacaaaaaggctgcaattcaatgtttgaagaggaagaggttatatgaacaacaagtcgagcagcttggtaatttccagttgcgtattcatgaccagatgataatgttagaaggtgctaaagccaccacggaaacggtagatgcgttgagaacaggagcagctactatgaaggctatgcagaaagcaacgaatattgatgatgtcgacaagaccatggacgagataaatgaacagaccgagaacatgaagcagattcaagaagcattgtcggctccaattggtgcagctgctgatttcgacgaggatgaactagaagcagaacttgaagaattggagagtgctgagttggaagaacagcttcttcagccaacatttacagctcctgctccctcaatgcaagtcccagctgggaggcaacctgcacgtcctgctcctgcaaagccgactcctgaggaagatgaattggcagctttgcaggctgagatggcactttgagcgggtgtgcgtatcgaatatggatttgttcggctatctgatattttgtgtggatatctcaagcatatgttgatttataggacatgcactgtgccttaaaaagttatcttttgataacaagtatgtaaatgaaaagtatgtttcctaaatcattttgagttaaatattcataactaacagtatatgactaccacagcaataccaaatatgtgtggactacaagcattacttc

SEQ ID NO: 3737 - DNA, 1342 bp, Gossypium hirsutum
agaaggggatggaaaatggaagtctgtaacgaaaatggtacctccattacctctgcaacggaaaatattagtgtggactgttttgttacttttcaaaagttgagtcactgaattaaaacttgagaaactgtttcgtcaactaacttaaaattgagtgagtattggtgtaatttattctataatataatattatttcactacttaaattaaccaacaaaaatattaattctttatctctcttttatttctatcgaaatctgttaataaaaatcccccccccttctttcgtcgaagaaatccagagatctttcaatctctcaatttcacagatcgggggtttaatcgcggggaattcaccatgtttaaccggcttttaggaaacccaaacaggaaccaaatgctctaacctcattagataaattacacgagaccctcgaaatgctagagaaaaaggaaaaagtacttctgaagaaggcttctgcagaggttgaaaaggccaaggaattcaccaaagcgaaaaacaagagagcggctatacaatgcttgaagagaaaaagactatatgaacagcaaattgaacagcttggaaacttccagcttcgtattcatgatcagatgataatgttagaagctgctaaagccacaactgagactgtagatgcattgagaagtggagcatctgcaatgaaggcaatgcagaaagcaacgaatatagatgatgttgacaaaacaatggacgagatcaatgaacaaaccgagaacatgaaacagattcaggaagcactttcaactcccattggagctgctgctgattttgatgaggatgaattggaagcggaactcgaagaacttgaaggtgctgagttggaagaacagcttctccagcctgcaacaactgctcctgctcctgcagctgcggtgcaggctcctgctggcaggcaaccagctcataatgctccaaagcgcacagctgaggaagatgaactcgcagcattgcaggctgagatggcactttaaggtaattcactcttagttcagtttattctagggagaattacagatggatcttatggactactgctctgacaaatggagttcaccatagccagccatgatgggaccattatttgatgctaattatttgattttattatatatttttgttattcaggcgtctagtagagaattggttttgttcatgttgcaaaacatgagagagaagctaccacattgtattattgaatcgtgccttttaaatttgtatggcattaattgttcaaaacattcaatgtacataaaagattgcaagaacttaaataaaggttgcattattttctatgaa

SEQ ID NO: 3738 - DNA, 1234 bp, Lotus japonicus
aaccgatcactagtttgtttccttgttcttccaaattgcaaccccaacccaacccttacgttcatcaccctttctctctttcactgcaaaccctaactcattacacgcacgcaggtttgctttcctctttattcttcacaatttcactccaaataatcgattcagattaattccaccctattgttgttccagcgtgatcggtttgtgaatttttgccccttcaatcttggtcctcgaacaataataatcaaccatgtttacgcggatttttggtaaacctaagcaggaagccaatgctctcgccactttggacaagctaaacgagacacttatatgctagagaaaaaggagaaagtgctcattaaaaaggcttctcaagaagttgaaaaggccaaagatttcactaaggcaaagaataaaagggcggcaatacaatgtttgaagagaaagaggttatatgaacagcaaatagagcagcttgggaacttccagttgcgtattcatgaccagatgatcatgttggaaggtgccaaggcaaccacagagacagttgatgcattgaggactggtgcttctgctatgaaggctatgcagaaagcaacgaatattgatgatgttgataagaccatggatgagatcaatgaacagactgagaacatgaaacagattcaagaagcattgtcagctccaattggcgcagctgctgacttcgatgaggatgaattggaagcagaacttgaagagctagagggtgctgagttggaagaacagcttcttcagcctgcaactacagctccagcggcctcagtgcatgttccagccgggcggcaacctactcgtcctgtgtctgccaagaccactcccgaggaagatgaattggcagctttgcaggccgagatggcactttgagcgggcattgatgtgcaatataagtggtctctatgaagagttgtgagcacaatgacatggagctcgcttatttttgtgaatttattgaacattcttaggatgtatatataaaggtgaacagcccttcaaaacttgtactttagcctggaatatttggtatcgtgtttttcagaaggttggaaaccgcggcactctacacttgtgttgatcgtgccaaatattgttggttttggttgtcctttttttttgtcatgggccgactttaaacattattcaaatgtataattcatcgtgtttatgagtaattgattatgatgtttgaata

SEQ ID NO: 3739 - DNA, 1059 bp, Arnica chamissonis
cattattcgaagccccttctccgttttacgtcaatctttcattcaattccgattcttcagtattttgtttcacaaacattagatacagattcagaactatcctttgattcccacgataatcacccgcgcttcttaatcctcagatcgtagggcttccaggaaaagaagggttacaatgttttcgcgaatgtttggcaaacctaaacaggaatctaacactgtaacaacgctagacaagttaaacgagacacttgaaatgctagagaagaaagaaaaggtacttctgaagaaagctgctgctgaggttgaaaaggcaaaggaattcactagagcaaaaaataaacgggcggcaatccaatgtttaaagcggaaaagactttatgaacagcaaattgaacagcttggcaattttcaattacgtattcatgatcagatgataatgcttgaaggtgcaaaagctaccacagagacagtggatgccttgagaactggagctcaagcaatgaaggcaatgcaaaaggcagtgaatattgatgatgtcgacaagacaatggatgagataaatgagcaaacagagaatatgaaacaaattcaggaagcattatcaacacctattggtgcagcagctgattttgatgaggatgagttggaggctgaacttgaagagttagaaggagctgagttggaggagcagcttctacagcctgccacaactgcacctgcagcaccagtgcatgtgccagctggaaaacaaccaacacgtccagctccccgccagaacaccgctgaggaagatgaacttgccgcattgcaggctgaaatggcactttaaagttacaactcccagctggaagaaattgtaaagattggatgctcaaacaatgtcggtattatatatattcattcacatcaatatgttttgcttgtgtgataacatgatcgacgacttgttatcttatttggaacgaaaaaacgacccttcctagtttttacttttggtgagtgcttcgaaacgaacactctttcaaaatgtgttgaccgggttactaaaatatgtgc

SEQ ID NO: 3740 - DNA, 1071 bp, Cirsium arvense
tccatttattaattgttgatcggtcttctttcttcttacctctttcttttgctaatctggttgaatgaatttgatcgctgttttggcctcgaatacttcaaattgaacccatatcaaattcatcgcttccaatccatcgatcattctgattctaaaggtgttggagattttgactactagaatcaaccatgcttaagagaattcttggaaaacctaagcaagaagctaacgccgtaactacgattgaaaaattaaacgagacacttgaaatgctagagaagaaagagaaagtacttttaaagaagtctgctgccgaggtggaaaaggccaaagaatttactagagctaaaaacaaaagggcggcaatacaatgtttaaagaggaaaagactctatgaacaacaaattgaacagcttggaaacttccaattacgtattcatgatcagatgattatgctggaaggtgcaaaagctacaacagaaactgttgatgctttaagaacaggtgcatcagcaatgaaagctatgcagaaggcaacgaatattgatgatgtcgacaagactatggatgagataaatgagcaaactgaaaacatgaaacaaattcaagaagcattggcaacacctattggtgcagctgctgatttcgatgaggatgaattggaagctgaacttgaagaactcgaaggagctgagctggaggaacagcttcttcaaccagccacaacagctcctgttgctccaatacatgctccagctggcagacaacaagttcgaccacctcctaggaagaatacttccgaggaagacgaacttgctgcattgcaggcagaaatggcactttaaataaatgggcttaatgaattattgaagaagtgcatttgaagggcagacgaagaaatggtgggaggttgatttaagtgatatcttgtacatttgtgatactagacttgaataactagttagatgagtaatttgagtgtgttacatttgtaaaatggagtcaaagagatgaatatgactttgtatatcaagttctaccttcttgttcataaaaaataaaagtaaacta

SEQ ID NO: 3741 - DNA, 953 bp, Cirsium arvense
cagtttcaatagtaggtttcaagagttaacgatgtttacgagattgtttggaaaacctaaacaagaagctaacgctgtaacaacgttagacaagttaaatgagacacttgaaatgctagagaagaaagagaaggtacttctaaagaaagctgctgcagaggttgaaagggcaaaggagttcactagagcaaaaaataaaagggcggcaatacagtgtctaaagcgaaagagactgtatgaacagcaagttgaacaacttggaaattttcaattacgtattcatgatcagatgataatgatagagggtgcaaaagctaccacagagacggtggatgcattgagaactggagctcaagcaatgaaggccatgcagaaggcagtgaatattgatgatgtcgacaaaacaatggatgaaataaacgagcaaaccgagaacatgaaacaaatccaggaagcgttgtcagcacctattggtgcagcagccgatttcgatgaggatgaattggaggctgagcttgaagaattagaaggagctgaattggaggaacaacttctccaacctgccacaactacccctacaacttcagtgtacgcacctgccggcaaacaaccaacacgtccagctccacggcagaataaagccgaggaagatgaacttgctgcattgcaagcggaaatggcgttataaacagttttgtcttccaattgggaaaatattggaatacaaagaatggaggtatgatggtaatttggttttctgacttgatctgttgattcattcattcacatcaatgtgcatgatttggggtataaagtgtcacactaatttattatatgaacatatgaacatgatatgagatgggattatttttcgtgttccgttgtgtcactgtcatcttatctgatctagatgatcagtaccagaaagctggaaagtgtttatggttcgttgc

SEQ ID NO: 3742 - DNA, 1046 bp, Cirsium arvense
gcgggggattgtaaaatcagtcgtcttttcctccgttttttcctttgccaatctggtttatcaatctgtttgcctgttttggccctcaaaccctcaaagaagaatacttcaaaaattcatagcttccaatttgttcttcatctcatctcatcgatcattctgatccatcctgattaataaaggtgtttgggagattttgattactagaatcaaccatgcttaagcgaattctcggaaaacctaagcaagaagctaacgctgtaactacgattgagaaattaagcgagacacttgaaatgctagagaagaaagagaaagtacttttaaagaagtctgctgctgaggtggaaaaggccaaagaatatactagagctaagaacaaaagagcggccatacaatgtttaaagaggaaaaggctctatgaacaacaaattgaacagctcgggaacttccaattacgtatccatgaccagatgattatgctggaaggtgcaaaagctaccacagaaactgttgatgctttgagaacaggtgcatctgcaatgaaagccatgcagaaggcaacgaatattgatgatgttgacaagactatggatgagataaatgagcaaactgaaaacatgaagcaaatccaagaggcattggcaacacccattggtgcagctgctgatttcgatgaggatgaattggaagctgaacttgaagaactggaaggagccgagttggaggaacaacttctccaaccagccacaacagcccctgcagctccagtacatgctccagccggccggcaacaagtacgcccacctcctcgcaagaatacttccgaggaagatgaacttgctgcattgcaggcagaaatggcactctaaataaataaatggggttaggagaagtgcatttccagggcagatggagaattgaagatgcataaacatatgaggaaatggtcagaggttggttttaagggatctcttgtaaatttgtgatggtattatacttgaataaaaaacaagttagataatggatctgagtgttgtatttgt

SEQ ID NO: 3743 - DNA, 1147 bp, Lippia dulcis
cccaccacaataatcgacgcttacttttgttattccgtattttataatttcgcaaaaatttaatccgcagtatctccgcagagaaaatcagggcgattttctcatcggttgaatcaaagggtttccaagctacaattttgcttcaatttatctccgtaattgttggtagatttgggaaataaaatcatccacgatgtttacgcgaatttttggaaaacccaagcaagagactaatgctctggcaacgctagacaagttaaatgagactcttgagatgctagagaaaaaagaaaaagttctcttgaagaaggcttctgctgaagttgaaaaggccaaggagtttactagagctaaaaataagagggctgcaatacaatgtttgaagaggaaaaggctttatgaacaacaagttgagcagcttggaaattttcagttgcgtattcatgatcagatgattatgctggagggggcaaaagctacaacagaaactgttgatgctttgagaactggagcggctgcaatgaaagctatgcagaaggcaacgaatatcgatgatgttgacaagacaatggatgagatcaacgagcagactgaaaatatgaaaatgattcaagaagcactgtcaacaccaattggtgccgcagctgattttgatgaggatgaattggaggcggagctagaagaacttgaaggagctgagctggaggaacagcttctgcaacctgcaacaacagctcctgctgctcctgttcgagtacctgctggaaggcaaccggcaaagaaagttgaagatgaggatgatgagcttgctgaactgcagagggagatggctctttaaggagacaccaattccagatcctgagaacgctttggaatcgttggccgttcttataatggagatcttcatatcaaattccctggatgtgcattttccagtacaaagaactgtatagattacaatgaacattttatattgtttctgtttgtttgagaacaggtgtgttgttatcatgcattattgtgacattattgttatcattatgacatttatgtgcagtgtctcgttaagattatgtttgagtgattattagctggtgggtactgtgagaattgttctcgctttcgctattcactgtaattctagtct

SEQ ID NO: 3744 - DNA, 838 bp, Centaurea maculosa
  misc_feature (250)..(250): n is a, c, g, or t
  misc_feature (610)..(610): n is a, c, g, or t
  misc_feature (677)..(677): n is a, c, g, or t
  misc_feature (736)..(736): n is a, c, g, or t
  misc_feature (739)..(739): n is a, c, g, or t
  misc_feature (745)..(745): n is a, c, g, or t
gggcgtaacagttgggagtaaaattatcggctgaatcaattaagcaaaacaatcagcaaattccttgcatcttcttcttcttcttcttcctaaaacccctctttttcttctcgatttcttcataaaaaatcgttaaaatcttcatttgattccagtttcagtagtagttttcaagagttaaacgatgtttacgagattgtttggaaaacctaaacaagaagctaacgctgtaacaacgctagacaagttnaatgagacacttgaaatgctagagaagaaagagaaggtacttctaaagaaagctgctgcagaggttgaaagggcaaaggaattcactagagcaaaaaataaaagggcggctattcaatgtctaaagcgaaagagactttatgaacagcaagttgaacaacttggaaattttcaattacgtattcatgatcagatgataatgatagagggtgcaaaagctaccacagagacggtggatgcattgagaactggagctcaagcaatgaaggccatgcagaaggcagtgaatattgatgatgtggacaaaacaatggatgaaataaacgagcaaaccgagaacatgaaacaaatccaggaagcnttgtcagcacctattggtgcagcagccgatttcgatgaggatgaattggaggctgaacttgaagaantagaaggagctgagttggaggaacaacttctccaacctgccacaactacccctacaacntcngtgtangcacctgccggcaaacagccaacacgtccagctccacggcagaataaagccgaggaagatgaacttgctgcattgcaagcggaaatggcgtta

SEQ ID NO: 3745 - DNA, 1200 bp, Vigna unguiculata
ggggaagatgaaagaaagaagacaccaaaacaacacgcttaagcaaaccaaagcttagacacctcaaaaccacccttctctgttttttccctttcccttctcttcttggatccaatcccaatcacaatccctaatctttctcactttcacttcaaattccaatttttcaaccggtttcgttttcggaagatcggttgaagaatcgaggatatcttcgctttcgaggcagtagggtttgaatcgaccgcaatcatgtttagccgcatgtttggtaaacctaaacaggagaccaatgctgttgccactttggacaagttaaacgagacacttgaaatgctggagaaaaaggagaaagtgctccttaaaaaggttggagcagaagttgaaaaggccaaagagttcacaagggggaagaacaaaagggcggcaatacaatgtctgaagcggaagaggctatatgaacaacaaatagagcagcttggaaatttccagttgcgtattcatgatcagatgataatgttggaaggtgctaaagccaccacagaaaccgttgacgcattaagaacaggagcagctgctatgaaggctatgcaaaaagcaacgaacattgatgatgttgacaagaccatggatgagatcaacgaacagactgagaacatgaaacagattcaggatgcattatcagctccaattggtgcagctgctgattttgacgaggatgaattggaagcggaacttgaagaactggaaggtgctgagttggaagaacagcttcttcagccagctactacaactcctgcagccccagtgcaggtcccagctgggcggcaacctactcgccctgttgcttcaaagccaactcctgaagaagatgaattggcagctctgcaagctgagatggcactttgagcagaatttttgcaggcatttttgtgcatgacaactggtgacttcaatggagaatggtgtctctcctgcatgcttgtctttgtgatttatcgaacagaccagagaatgtatataggggggaaattgaacatgaaagtcgttcataaagtaaaacttactactttcatcttggatgtttccattatacttatgttatattttgtacggcccagtttaacacggtttgttaaattaatgtatatcttaaacatgctaaggcgaagtataaggaataagaatgtggttatccta

SEQ ID NO: 3746 - DNA, 1030 bp, Cynara scolymus
  misc_feature (129)..(129): n is a, c, g, or t
  misc_feature (131)..(131): n is a, c, g, or t
  misc_feature (162)..(162): n is a, c, g, or t
  misc_feature (185)..(185): n is a, c, g, or t
  misc_feature (812)..(812): n is a, c, g, or t
  misc_feature (840)..(840): n is a, c, g, or t
  misc_feature (863)..(863): n is a, c, g, or t
  misc_feature (867)..(868): n is a, c, g, or t
  misc_feature (874)..(874): n is a, c, g, or t
  misc_feature (876)..(876): n is a, c, g, or t
  misc_feature (878)..(881): n is a, c, g, or t
gggcggttcaaccgatgcctaacatttcttttataccaatcacttcccctataaacccatattaattcaattacttcttcgtttctcttgatcgttcaaatccaactgtagatcataaaagattttttnangtgttaggagtttttcaccgtattgattcgnaggagatcgtatacgaaaacaancatgtttacgcgagtttttggaaaaccgaagcaagaagctaatgccgtaacaacattagacaaattgaatgagacacttgaaatgctggagaagaaagagaaagtacttttgaagaaggcttctgcggaggtggagaaggctaaagactatactagagcgaagaacaaaagggcggcaatacaatgtttaaagaggaagaaactctacgaacaacaaattgaacagcttgggaacttccaattacgtattcatgaccagatgattatgctagaaggtgcaaaagctaccacagagactgttgatgctttgagaactggtgcagcagcaatgaaggccatgcagaaggcaacgaatattgatgatgttgacaagactatggatgagataaatgaacaaactgaaaatatgaaacaaattcaggaggcattggcaacccctattggtgcagctgctgattttgacgaggatgaactggaagctgaacttgaagaactagaaggagccgagttagaggaacagcttctccaacctgccacaactgcccctgctgctccagtgcaggttccagctggtaggcaaccaacacgcccagctcctcggcaaaacactgccgaggaagatgaacntgctgcattgcaagcagaaatggcactntaaaaacagatcactgagatgtnctcnncactgnanannnnctcatacaccatgaaaaaaccgaagaagtgttatattatctcatgtacagtcgtgattgtaaactaaataacgagtttggattttgagtgcgtgacggacgatgaagtgtgtatatacgttaaggtcataagaactatacgctactttc

SEQ ID NO: 3747 - DNA, 973 bp, Cajanus cajan
ctaatctctcttcaacttcaattttttcatctgggaagatcgcttgacgaatcgaggatctcatcgcttccgaggctctagagtttcaatcgatcgcaatcatgtttagccgggtgtttggtaaacctaaacaggaaaccaatgctgttgccactttggacaagttaaacgaaacacttgaaatgctggagaaaaaggagaaagtgctccttaaaaaggtgtcaacagaagttgaaaaggccaaagaattcactagggggaagaacaaaagagcggcaatacaatgtctgaaaaggaagaggttatatgaacagcaaatagagcagcttggaaatttccagttgcgtattcatgatcagatgataatgctggaaggtgctaaagccaccacagaaacggtagacgctttaagaactggagcagctgctatgaaggctatgcaaaaagcaacgaatattgatgatgttgacaagaccatggacgagatcaatgaacagactgagaacatgaaacagattcaggatgcattgtcagctccaattggtgcagctgctgattttgacgaggatgaattggaagcggaacttgaagaactggagggtgctgagttggaagaacagcttcttcagccagcaactacagctcctgcagccccagtgcaggtcccagctggtcggcaacctactcgcccagttactgcaaagcccactcctgaagaagatgaattggcagcattgcaggctgagatggcactttgagcaggtcccttttccagctgtaacactatcaaattgtattgtaacctatgcatagtttttgtttagcccaactagtgctgcatttattgtgacaaataaatcatgtgtatgctccattttcgtgctggaatatccaactgttaatcagtttagtctcctgtatggtgtatcatagtttgaaacgaattgcttaagataacttgtagagaagaagt

SEQ ID NO: 3748 - DNA, 1249 bp, Populus trichocarpa
cctacacaagaacatcacgcttcgggggaaataaaaaataaaataaaataaatccccaaaacaaaacctgcctctctctctctctctctctctgtattctctcgtcaacgtgtccatcatcaaaagccctaatatctgaattcgatcttcctcgatttgattttcacagtagatcgcgaggcagacgggcaggcagggttcttaaacctaacacaatccaccatgtttaaccgcttatttggaaaacctaagctggaatccagtgcccttacttcgttagacaaattaaacgagacacttgaaatgctcgagaaaaaggagaaggttctagttaaaaaggcagcggccgaagttgaaaaggctaaggaattcactagagggaagaacaaaagggctgcaattcaatgtttgaagaggaagaggctgtatgagcagcaaatagaacaacttggaaactttcaattacgtattcatgatcagatgataatgctagaaggtgcaaaagctactactgaaactgtagatgcattaagaactggtgcatctgctatgaaggcgatgcagaaagcaacgaatattgatgatgtggacaagacaatggatgagatcaatgagcagacagagaacatgaaacagattcaagaagcattatcaacccccattggttctgcagctgattttgatgaggatgaattggaggcagaacttgaagaactggaaggagctgaattggaagaacagcttcttcagccagcaacaacagctccagcggctccagtgcacgtcccagctggcaagaaaccagctcctaaaaaacgcacagctgaggaagaagaacttgctgacttgcaagctgagatggcactctgaacaggtaccatgttccagaacaaagagattatttactttgcgtaaattaagtttgtgcgtccatcttcttcttcagaagattgtccatcctgtattatggagtttctgctgctactcccacgcatccagtgtgcatcgaggagtgaatagacaatgtatataatattgcgtaaactgaatctagttccccttaaaatttgtatcctgacgtttgaagctttttggttgtgtttggtatcacttttactcgataacatttatttctcagcaaggggattctttgactaattctctcttattatgtgtcaccaacttggttaccttcaattatcgtttaaaatatagtgaataaatgcatatagtgtccttttgggtagta

SEQ ID NO: 3749 - DNA, 1138 bp, Carthamus tinctorius
  misc_feature (500)..(500): n is a, c, g, or t
cggggatctaatctaattccttcattcgatcttatcatcaattcatcctcccccttttcatcaatccaaaaacccctttgatttttttcatacacatccttccttcaccccaaatttggattatttttcagtacgaaaaccctagacgcaggttaagaatcatcgtttgattttgttataaataatctcagatcagatcgtagggtttccaagaaggcgacaatgttttcgcgtatgtttggcaagcctaagcaagaaaccaacgctgttactaccttagacaaattaaacgagacacttgaaatgttagagaagaaagaaaaggtacttctgaagaaagctgctgcagaggttgagaaggcaaaggaatttacgagggcaaaaaataagagggcggcgatacagtgtttaaagcgaaaaagactttacgaacagcaaattgaacagcttggcaatttccaattgcgcattcatgatcagatgataatgcttgaaggtgnaaaagctaccacagagacagtggacgctttgagaactggagctcaagcaatgaaggcaatgcaaaaggcagtgaatattgatgatgtcgacaaaacaatggatgagataaatgagcaaacggagaacatgaaacaaattcaggaagcattatcagcacctattggtgcagcagctgattttgatgaggatgagttggaggctgaacttcaagagttagaaggagctgaattggaggaacagcttctacagcctgcgacaactgcccctgcagctccggtgcatgtgccagctggaaggctaccaacacgtccgcctcctaggaagaacacagccgaggaagatgaacttgctgcattgcaggcagaaatggcactttaaggttcatttcaattcccagttggaagatcctgtaaagatcggagggaggtatgacaccaacgcgaattgtttgtgtgatcgatgacttttatcttattaggaatggaaaaaggattaaagtgttcatgtgttggtgtatgtcatatgggtatgttggttatttgagagattcgtcttcaattataggaagtcgattactatcattattaacaatgtaatatacgacgattgttttcaagtaaattgttttaagagttgc

SEQ ID NO: 3750 - DNA, 1422 bp, Glycine max
aaatttgatagtttaattgaaagtgagattcttgaaggatgcttcttcaattccctttccttctttcttagctttgaagaccaactcatttcaacttaacccatcaaaaccatcgctctctattttcgtcctttctacctttctccgatcccaatccctaatctttctctcttcaaactctaattttttcatctggggagatcggctgacgaatcgagaggatctcatcgctcgcaagggattagggtttcaatcgatcgcatcacatatcacaatcatgtttagccggatgttcggtaaacctaaacaggaaaccaatgctgttgccactttggacaagctaaacgagacacttgaaatgctggagaaaaaggagaaagtgctccttaaaaaggtggcagcagaagttgaaaaggccaaagaattcacaagggggaagaacaaaagggcggcaatacaatgtctgaagaggaagaggttatatgaacagcaaatagagcagcttggaaatttccagttgcgtattcatgaccagatgataatgttggaaggtgctaaagccaccacagaaacggtagacgcgttaagaactggagcagctgctatgaaggctatgcaaaaagcaacgaatattgatgatgttgacaagactatggatgagatcaatgaacagactgagaatatgaaacagattcaggatgcattgtctgctccaattggtgcggctgctgattttgacgaggatgaattggaagcagaacttgaagaactggagggtgctgagttggaagaacagcttcttcagccagcaactacagctcctgcggccccagtgcaggtcccagctgggcagcaacctactcgcccagttcccgcaaagcgaactccggaagaagatgaattggcagctttgcaggctgagatggcactttgagcagaattttgcaggcttttttttgtgcatggcttcaatgaagaattgtaaccactattacgtggagaattctgcttctctcctgctcgcttatctttgaaattattgagctgaccagaggatgtatataaaagtggaaaaaaaattatcataaaagtcttcaaaacgtactacttttattttggatgagttcgaacccctcctttccattatacgtatcaagtatattgatgcatttgactatcttatactttatgtggttgagtttaacgtggtcagtttaatcaatgtattatatcttaaacatgcttacagcaaagtataaggaataagaatttggttagcctatgagctagaacacagccatgattaaggtgatgatttttatttgtccataggaggatttacaagctgcactgccactgtgaatgtaaaattttattttctttatattataataatgattaagtaattaagatattttcctg

SEQ ID NO: 3751 - DNA, 1052 bp, Glycine max
tcccgttgattttccaattcgacgaataagggtatcacatctcttaatcaaaacatgtttacccgaatttttggtaaacctaaacaggaagccaatactctaaccactttggataagttaaatgagacacttgaaatgttggagaaaaaggagaaagtactcctaaaaaaggctgctgcagaagttgaaaaagccaaagaattcactagggcaaagaataaaagggcggcaatacaatgtttgaagaggaagaggctatatgaacagcatgtagagcagcttggaaatttccagctgcgtattcatgaccagatgataatgttggaaggtgccaaggcaaccacagaaactgttgatgcattgagaactggagcagctgctatgagagctatgcaaaaagcaacgaatattgatgatgttgacaagactatggatgagatcaacgaacagacagagaacatgagacaaatccaggaagcattgtctactccaattggtgcagccgccgactttgatgaggatgaattggaagcagaacttgaagagttggagggtgctgaattggaagaacagcttcttcagcctgcaactacagctccagctgctccagtgcatgttcccgctgggcggcaacccactcaccctgtgtcttcgaagctcactgctgaggaagatgaattggcggctttgcaggctgagatggcactttgagcagctggctttggttaggccagaattttgcaggcattgatgtgcattataagtggcctcttttaaaatcaagagtgacacggagaattctgccccctctcatgcttgcttacctatgaaattattaaacagaccagaggatgtatataaatgttataaaaattcaatagcccttcaaaatttatactttctcctggaatgtttgttagtttaaatgttattcagactgatcagcggagaataacgaatgaaaaagattgatcgagaggcaatgcttgagtaatagattattttagtttattggaatatcacaagcgccattgaagcagggaaaaatattt

SEQ ID NO: 3752 - DNA, 1341 bp, Fragaria vesca
agcagcttccattctcctccttccaacccaacacggctaagcaataattcccaatcccaatccccactccaattctccccaaaattaaaccgaaccggcgaacaagcccaattcattttccccagatccttatccctctcttctcctcccaaaccctaaatccgatcccttttcctcaaacctcgccgtaaattcccagaaagatagagagggatcgataatcggagataagcaaccatgtttaccaggatttttgggaaaccgaaaacggaaaccagcgctctgaccaccttagacaagttaaatgagacgcttgaaatgcttgagaagaaggagaaggtactacagaagaaggctgccgcagaagttgagagggccaaggaattcactagagcaaagaataaacgatctgctattcaatgtttgaagaggaagaagctgtatgaacagcaaatagagcagcttggaaacttccaactgcgaatccacgatcagatgataatgctagaaggggcgaaagccactacagaaactgtagatgccttgagaactggagcagctgccatgaaggcaatgcagaaagcaacgaacatagatgacgtggacaagaccatggatgagataaatgaacagactgagaacatgaaacagatccaggaagctctgtcaactccaattggttcagcagctgattttgatgaggatgaattggaagcagaacttgaagagctggaaggtgctgagttggaagaacaacttcttcagcctgcaactcaagctcctgcagctccagtgcaggtcccagcaggaaggcaaccagcacgtcctcttccccagaagcgcactgccgaagaagatgaactggctgctctgcaggctgagatggcactataagcaggtacatcttccgcagaatggaatcgaaagaatctatgtaaagaattggtctgattttataatggagatatctgctcctctcgcgcatccatattgctttgtggcttcattattaaacagattgtatataaaggtgggcataaattcacacaatgccccctttgaaacttgtgttctgcgtttccgagtcttctccttcctttttcctcttacctcaacatttctcttggaacatatgttcaatgttctgtcaagcattaatgaatagctattttgtgatataaccaagtcttatagatctaaatttcttattgatctttgagttcaacatcaagaagactccattcttgttttcttgctgttgccactttccactttgagttttggtgacctggtgacccaagtcaataatgagaagaaaaagatgcttataattcaccatca

SEQ ID NO: 3753 - DNA, 1013 bp, Helianthus annuus
gactcatcactttgacaactcatcgaatccaaatttcttccatcttcatcattattcaaaacccctttttcgtttctaccttaatctttcattcagtttcatattaaccctcagatcagagcagatcgtagggctttcaaaaaagaaggtttacaatgttttcgcgaatgtttggcaaacctaagccagaagctacaactgtaacaaccctagacaaactaaatgagacacttgaaatgctagagaagaaagaaaaggtacttttgaagaaagctgctgctgaggttgaaaaggcgaaggaattcactagagcaaaaaataaacgggcggcaatacaatgtttaaagcgaaagcgactttatgaacagcaagttgaacagcttggcaatttccaattgcgtattcacgatcagatgataatgcttgaaggtgcaaaagctactacggagactgtggatgccttgagaactggagctaaagcaatgaaggcaatgcaaaaggcggtgaatatcgatgatgttgacaagacaatggatgagataaatgagcaaacagaaaacatgaaacaaattcaggaagcattatcagcacctattggtgctgcagctgattttgatgaggatgagttggaggctgaacttgaagagttagagggagctgagttggaggaacagcttctacagcctgcaacaactgcacctgcagcaccagtgtatgtgccagccggaagacaacaaacacgtccagctccccgccagaacacagctgaggaagatgaacttgctgcattgcaggccgaaatggcactttaaagtttcaactcccacttggaagaatttgtaaagaccgggtgctcaaacattgtcggtatcatatcagttcgttcacatcaatacatattgtttgtgtgataatatgatcaacaacttttatcttatgtggaacggaaaattatcctttatcccagtatttacgtttgttatcggctttttttaaaatctgtgttatttctg

SEQ ID NO: 3754 - DNA, 1284 bp, Cirsium arvense
gctactcaacttagtttgttcggccccctgggttagaaaggcttgtgttccgccactgtgggacggtgattggttgggtgatgttggtcaaatatcccggatacctcgtcgactccgtgtcggaacatgtccggttaaaaagaagtaaccaaacacgaagggtcggttgcatatcgatgcacaaaggctggttttataccgatcacttggaagtataaaccaatatcaattcaattacttcttcgttcctttcgaatccaactgtagatcataaaagatttaaggtgtagaagattttcgcagtatttgattctactgaaggcgatcttattcgaaaaacaatcatgtttacgcgagtttttggaaaacctaagcaagaagctaatgctgtaacaacattagacaaattaaatgagacacttgaaatgctggagaagaaagagaaagtacttttgaagaaggcttctgcggaggtggagaaggctaaagactatactagagcgaagaacaaaagggcggcaattcaatgtttaaagaggaagaagctctatgaacaacaaattgaacagcttgggaactttcaattacgtgttcatgaccagatgattatgctcgaaggtgcaaaagctaccacagagactgttgatgctttgagaactggtgcagcagcaatgaaggccatgcagaaggcaacgaatattgatgatgttgacaagactatggatgagataaatgaacaaactgaaaatatgaaacaaattcaggaggcattggcaactcccattggtgcagctgcagattttgacgaggatgaactggaggctgaacttgaagaactagaaggagccgagttagaggagcagcttctccaacctgcgacaactgcccctgctgctccagtgcaggctccagctggtaggcaaccaacccgcccagctcctcggcaaaacactgccgaggaagatgaacttgctgcgttgcaggcagaaatggcactttaagatgactggatatgtatcctccatacaccatgaagaagtgtgttatatcatctcaagtacactcggtcatgattgtaaactaaataacaagttgggaatttggagtagttaacggaatgatgtaatgttgtattatacattaattaaaggtcatagagaactaatacgctgctttccagacgggttttcttttcagtctaggaaattcaaaacacgtatatatacgtcatccatacgaaaacctatgtacaaatagaggtatctctcctttgacttttataat

SEQ ID NO: 3755 - DNA, 1326 bp, Phalaenopsis aphrodite
attaaccagtctgatcaacccaagacgcgtgcgataaaattctttgccgtccgagtctcccttcggacaggaaacctgcaatatctatcttaaccgtcttcgaaattctcactatatctctggaaatccctcatcacttcgcggcagatcgaagccctggatcgatatccagtacttcgcacctctaatacttgtttcttttttcttctgctctccttaaccttcagttttgaactaatcgattaggatttcaacctgattcgaatctcatcgggagtcaagatcggctcgttgattgtctattacaggttaaggatttgagtggtgatctgagattggtatctttctttggagaagagaatctagataccggcgaacatgtttagtcggcttttcggaaagcccaaggagcagacgaatgctctggcgacgcttgacaagttaaacgagacaattgaaatgctagagaaaaaagagaaagttcttctaaagaaagctgctgccgaagttgaaaaggctaaggagtttacaagagccaagaacaaacgagccgcaatacaatgtttgaagaggaagaagctttatgaacagcaaatcgagcagctagggaattttcaattaagaattcatgatcagatgataatgttagaaggtgccaaagctacaactgagaccgttgacgctttgagaactggagcatcagcaatgaaggcaatgcagaaagcaactaacattgatgatgttgacaagactatggatgaaatcaacgagcagaccgaaaatatgaagcagattcaggaagcactctcagctcctattggttctgcagctgattttgatgaggatgaacttgaagcagaacttgaggaattggaaggagctgagttggaggcagaacttcttacaccagctactacagctcctgcagctccacttcccaatgttccatctggcaagcaaccacttcgtcctgctccacataagaatacagcggaagaagatgagcttgcagcactgcaagcggaaatggctttgtaataaggttatgagattggtgataatcatatagggatgatttgtgccctgggaatttagagatcctcgagccttgctctactgttttagctcaaatatatgttgctttcttcaatgtcttgttgtaggctgatgcttaggattgaactattccccaattataccgtttgtgatacacaatgtatttaatattcactattgattgtcattgatgcacataggctttactgtgtcagcttatgtttggtttatgtgaattgatgactttactcctgttaaaactctttgtgg

SEQ ID NO: 3756 - DNA, 1118 bp, Primula obconica
gatagatagatcttcccggtctttatcggccgatctccgatcaccccttttgcaattataatttttatccagatcgggaattaaggcttattcggagtccgatcaataaatcggaaattcctcaaatttttatttataataataataataataatcagagattaaaaggcagcaatcatgttttctcgagtatttggtaagcccaagcaggagactagtgctgttgccacgctggacaagctaaacgagacgctggaaatgctggagaagaaagagaaagtactacagaagaaggcttctcaagaaatcgaaaaagctaaggattttaccaaggcaaagaacaagagggccgctatacaatgtttgaagagaaagaggctatatgagcaacaaattgaacaacttggaaattttcaactacgtatacatgaccagatgataatgttagaaggggcaaaggctacgacagagacagtcgatgccctacgaactggagcagctgcaatgaaagccatgcagaaagcaacgaatattgatgatgtggacaagacgatggacgaaataaatgagcaaacagagaacatgaaacagatacaggaagcactgtcaactcctatcggcgctgcagccgactttgatgaggatgagttggaagcagagctggaagaattagaaggtgctgagctggaagagcagcttcttcaacctgcaacaatggctcctgcagcacctgtacacgtgccaggtggcagggtaccagctcgtgctgcccctcagaagcgcacagccgaggaagacgaacttgcagccttacaagcagaaatggcgctttaagttacttttttactcgatcaatcatcttgtctgtgtgacactctaaatattgattcggttgtaaatcagattttactgattctattttctgtaaaaacagccatctcctcaatatttgaatttctactttgattctgttgtgtataatatgttgcctcaggttgaaatattttctataaaaggcacaatctttgtgcatatgattgttttgtattgtattgtattgggaaagtgaagttatctcaaatgttttcatgtgagacattattaataaggggtttgat

SEQ ID NO: 3757 - DNA, 1183 bp, Sarracenia psittacina
aaaacttcaattttgtggcgctgccgcaccgattacgaaggggaaaggcgaattcttacctctctcatcacctcttcgtggtttcccggaaactcaaatcgctatctattttcgctcgtcgtctccacagtaaaatccctaattcggcttctttgttcaattcttcgatcgatcgaaggcctttcggaatctcacatcaaatttcacagacgatctctagagtttgatctgtaatcgaatccactatgtttggtcggattttcggcaagccaaagcaagaggccaacactcttaccaccttagacaagttaaacgagactcttgaaatgcttgaaaaaaaggagaaagtacttctgaagaaggctgctgctgaagttgaaaaggccaaggagttcaccaaagcaaagaacaagagggcggctatacaatgtttgaagaggaagaggctctatgaacaacaaattgagcagcttggaaatttccaattacgcatccacgaccagatgataatgttagaaggtgcaaaagctacaacagagactgtggatgcattgagaaccggagcagcggcaatgaaggctatgcaaaaagcaacgaacattgatgatgtggacaagacaatggacgaaataaacgagcaaaccgagaacatgaaacagattcaggaagcattggcaacgcccattggtgcatctgctgattttgatgaggatgaattggaagcagagctggaagaattggaaggtgcagagttggaggagcagcttctgcagcccgcaacgacagccccagcagcaccagttcaagtacctgccgggaggcaacccgcccgcgctgctcagaagcagcatacagccgaggaagatgaactcgctgcattacaggcagaaatggcgctctaaacaacaggtgtttgttttcataaatgtatttagattgatcattgtgcgtctgtgtggctttagagctaatattgtagcatatatattaatctctttatagttaactgatgggtgaattgtaaccattttctggaagctctccagctagagctgtagattccaatgaattattgaaagggtttgtttactcgaagaactattagtcccgcatttgtcttgctagattggattgaacttattaatccaatgaatttcaaattatcaattttaatttgtcgtgg

SEQ ID NO: 3758 - DNA, 1131 bp, Valeriana officinalis
gtgtgcttcaacgtgtggcgtatcaagtgatgtaacccaaactcacaaccccgtaacctaatcaccctctatatccgcaactaggatcttcatctccatacggagtcgtcgaagcagcaatctcttctcttcacattaaatccatctcttcaaatttcttcatccatccatccacgccgtcgtcgcttatattcgtacacaatcccttctatcgcagttctacaggtctcaaacctctccgatctctctttcaattttaaaaatgtttacaagaattttcggtaaacctaaggaagaagcaaatgccgtagctacgttagacaagttaaacgagactcttgaaatgctggagaaaaaagagaaagttcttgtgaagaaggcttctgcagaggttgagaaagctaaagaattcacaaaatccaaaaataaaagggcggcaattcaatgtttgaagaggaagagactttatgagcagcaagttgaacagcttgggaacttccaattgcgtattcatgatcagatgataatgctagaaggcgctaaagctaccacagagactgttgatgctttgagaactggagcagctgcaatgaaggctatgcaaaaggcaacgaatattgatgacgtggacaaaacaatggacgagattaatgagcagactgagaacatgaaaatgatccaggaagcgttgtcggcgccaatcggagctgctgctgatttcgatgaagatgaactggaagcggaacttgaagaactggaaggggcagaattggaagaacagcttctgcagccagcaacaacagccccagctgcaccaatacacgtgccaggtggcaggcaacaagctcggcctgctcctcagaaaaacacagccgaggaagatgaactcgcagcattgcaagccgaaatggcactctaatcagagagaatttcaaaaaaataaagttgaaggcaggtgtgtgaaaatcgtatttactgtactataatggtggtttctttgcttattactacctctcacagtactgtattttttcttcttattattattttctcggtgtgcattttattcaaaagaaaagaaaaagttatgattgtacacatttcattaaattactcggctctagaaaatga

SEQ ID NO: 3759 - DNA, 1058 bp, Centaurea maculosa
  misc_feature (23)..(23): n is a, c, g, or t
  misc_feature (47)..(47): n is a, c, g, or t
  misc_feature (51)..(51): n is a, c, g, or t
  misc_feature (81)..(81): n is a, c, g, or t
  misc_feature (103)..(103): n is a, c, g, or t
  misc_feature (112)..(112): n is a, c, g, or t
  misc_feature (118)..(118): n is a, c, g, or t
  misc_feature (171)..(171): n is a, c, g, or t
  misc_feature (725)..(725): n is a, c, g, or t
  misc_feature (926)..(926): n is a, c, g, or t
  misc_feature (940)..(940): n is a, c, g, or t
  misc_feature (972)..(973): n is a, c, g, or t
  misc_feature (976)..(976): n is a, c, g, or t
  misc_feature (978)..(978): n is a, c, g, or t
  misc_feature (981)..(981): n is a, c, g, or t
  misc_feature (993)..(993): n is a, c, g, or t
  misc_feature (1024)..(1024): n is a, c, g, or t
  misc_feature (1046)..(1046): n is a, c, g, or t
tgcgggggccaatctggttgatnaatctgtttgcctgttttggcccncaanccctcgaagaagaatacttcaaaaattcanagcttccaatttgttcttcatntcatccatngatcantctgatccatcgtgattaataaaggtgtttgggagattttgacttactagaancaaccatgcttaagcgaattctcggaaaacctaagcaagaagctaacgccgtaactacaattgagaaattaagcgagacacttgaaatgctagagaagaaagaaaaagtacttttaaagaagtctgctgctgaggtggaaaaggccaaagaatatactagagctaagaacaaaagagcggccatacaatgtttaaagaggaaaaggctctatgaacaacaaattgaacaactcgggaacttccaattacgtattcatgaccagatgattatgctggaaggtgcaaaagctaccacagaaactgtggatgctttgagaacaggtgcatctgcaatgaaagccatgcagaaggcgacgaatattgatgatgtcgacaagactatggatgagataaatgagcaaactgaaaacatgaagcaaatccaagaggcattggcaacacccattggtgcagctgctgatttcgatgaggatgaattggaagctgaacttgaagaactggaaggagccgagctggaggaacaacttctccaaccagccacaacagcccctgcngctccagtacatgctccagccggccgacaacaagcacgcccacctcctcgcaagaatacttccgaggaagatgaacttgctgcattgcaggcagaaatggcactctaaataaataaatgggggttaggagaagtcatttcaagggcagatggagaattggagatgcataaacatatgaagaaatggtcagaggttggtttnagtgatctcttgtncatttgtgatggtattatacttgaataaaaannaananaantggtgattgatnagagtgttgtatttgtaaaaatggactcaangagatgaatatatgaagttctncgtccttgttcc

SEQ ID NO: 3760 - DNA, 1124 bp, Cucumis melo
agttttgatttgatgaacagaaaccaataagtagattgccgcgtggagacgaaacagcgacttgaagagaaagggaactccaaatcttcgacctccgttttccggagcgtctgacgaaccctttctacaattctacttcaaattttttcattgaatctttcgattcattctctgttttctgaattcgtttcgggttctcatctttctgttttcaatctctctggtttctcgacttttgaagatcgagagaggattcttgttgctttgtatcaacaatgtttaacaggctttttggtaaacctaaacaagaagccaatgctttggctacgttggagaagctaagcgagacacttgaaatgctggagaagaaagagaatgttcttgtgaagaaggcagctgcagaggttgaaagagctaaagaattcacaagagtgaagaataaacgagcggctatacaatgtttgaagagaaagaggctatatgaacagcaaatagagcagcttggaaatttccaattgcgcatccatgaccaaatgattatgttagaaggggcaaaagctacaacggagactgtagatgctctaagaacaggagcatctgcaatgaaggccatgcagaaagcaacgaatattgatgatgtggacaagacaatggatgagatcaacgagcagactgagaatatgaagcagatccaggaagcgttatcagctccaattggtgctgcagctgatttcgatgaggatgaattggaggcagaacttgaagatcttgaaagtgcggagttggaagagcaacttctccaaccagcatcaacagctccagctgcacctgtttcagtcccggcaggccgagttcctgcacgccctgctcctcaaaagagaactgccgaagaagacgaactcgctgctttgcaagctgagatggcactctaatcaggtaaatgggatggatcatacatacattcattcatatatgtcgtggctgactgattgtgtgcatcatcatcatcatccaaagaaatcttctgacgagtgtttttatacgaattattaatattccctgacgcaagacggtgtatataaagtctgctaaatgattggaattgtgatttacatctttttatt

SEQ ID NO: 3761 - DNA, 928 bp, Thalictrum flavum
tttctctttaacaaaaccctaatctaacttaatcatcagcaatcatgtttagtcgggtatttggtagacctaaaccagaagcaaatgctttaacaacattagataaattgaatgagacacttgaaatgctagagaaaaaggaaaagttcttctgaagaaggcctctcaagaggttgagaaggccaaggagtttactagagcaaagaacaaaagagctgccatacaatgtttaaagaggaagaggctctatgagcaacagattgaacaacttggaaatttccaattgcgtattcatgatcagatgataatgctagagggtgcaaaagctacaaccgagactgttgatgccttgagaactggagcagctgcaatgaaggctatgcaaaaagcagttaacattgatgacgtggacaaaacaatggatgagattaacgatcagacagaaaatatgaaacaaattcaagaagcattgtcaactccagttggctcagctgctgattttgacgaggatgaattggaagcagagcttgaggaactggaagaagctgagttggaggaacaacttcttcagcccgcaactactgccccggcagcgtcagtgcatgttccagcgggaaggcaaccaacacgtcctcttccccagaagaggacagccgaagaagaagagtttgctgcattacaggcggagatggcactttgagaggacctctacccaccaagtatgaaggtatgatgtaaagattggttctattgtgtgatagagattggtgctggtcaacaactcaaaatcacgctttgaggaagatgattgtataggcttcataaagtaaactgcctttactttactattgtattctacgccagaagattctaaagtattccatataaaacaattctggaatttttttgtttgtattacgtgatgctt

SEQ ID NO: 3762 - DNA, 1144 bp, Antirrhinum majus
  misc_feature (69)..(69): n is a, c, g, or t
  misc_feature (90)..(90): n is a, c, g, or t
  misc_feature (102)..(102): n is a, c, g, or t
  misc_feature (152)..(153): n is a, c, g, or t
  misc_feature (940)..(940): n is a, c, g, or t
  misc_feature (942)..(944): n is a, c, g, or t
  misc_feature (946)..(946): n is a, c, g, or t
  misc_feature (966)..(966): n is a, c, g, or t
  misc_feature (969)..(969): n is a, c, g, or t
  misc_feature (972)..(972): n is a, c, g, or t
  misc_feature (977)..(977): n is a, c, g, or t
  misc_feature (979)..(979): n is a, c, g, or t
  misc_feature (981)..(981): n is a, c, g, or t
  misc_feature (985)..(985): n is a, c, g, or t
  misc_feature (988)..(989): n is a, c, g, or t
  misc_feature (992)..(992): n is a, c, g, or t
  misc_feature (994)..(994): n is a, c, g, or t
  misc_feature (997)..(998): n is a, c, g, or t
  misc_feature (1000)..(1000): n is a, c, g, or t
  misc_feature (1005)..(1005): n is a, c, g, or t
  misc_feature (1009)..(1009): n is a, c, g, or t
  misc_feature (1014)..(1016): n is a, c, g, or t
  misc_feature (1018)..(1021): n is a, c, g, or t
  misc_feature (1023)..(1023): n is a, c, g, or t
  misc_feature (1028)..(1029): n is a, c, g, or t
  misc_feature (1035)..(1035): n is a, c, g, or t
  misc_feature (1039)..(1039): n is a, c, g, or t
  misc_feature (1042)..(1042): n is a, c, g, or t
  misc_feature (1051)..(1051): n is a, c, g, or t
  misc_feature (1053)..(1053): n is a, c, g, or t
  misc_feature (1057)..(1057): n is a, c, g, or t
  misc_feature (1060)..(1060): n is a, c, g, or t
  misc_feature (1064)..(1064): n is a, c, g, or t
  misc_feature (1071)..(1072): n is a, c, g, or t
  misc_feature (1075)..(1075): n is a, c, g, or t
  misc_feature (1081)..(1081): n is a, c, g, or t
  misc_feature (1083)..(1083): n is a, c, g, or t
  misc_feature (1085)..(1085): n is a, c, g, or t
ctcctaatcaacgactagtataaattctttcacattcataaaaattaaaatcaatccccaaaaataatnaaatccgcgaaatattcatcnaagaaatcaagnccgattctgctcacagggtttaaaagatttcaaatttgatttattttttnngaaaaataaatcacaccgacgatgtttacgcggatttttggaaaaccgaagcaagagactaatgctctggcaacattagacaagttaaatgagactcttgagatgttagagaaaaaagagaaaattctcttgaagaaggctgctggagaagttgaaaaggcaaaggaattcacaagagctaaaaacaagagggctgcaatacaatgtctaaagaggaaaaggctttatgaacagcaagttgagcagcttggaaatttccagttgcggattcatgatcagatgatcatgctagagggggcaaaagcgacgacagaaactgttgatgctttgagaactggagcggctgcaatgaaagcgatgcaaaaggcaacgaatatcgatgacgtggacaaaacaatggacgagatcaacgaacagacggaaaacatgaaacaaattcaagaagcactttcaacaccaataggtgcagcagccgactttgatgaggatgaattagaggcagagcttgaagaacttgaaggagctgagcttgaggaacagcttctccaaccaacaacgacagctcctactacttccattagggtgcctactggaagacaaccagcaaagaaggttgaagacgatgatgatgaacttgctgaattgcagagggagatggctctctaaggagctttagtttaaagtctggagaattgtaaagagattggctctgctatttactggagatcatacgtgaagtgcctgcccgtattttcagacccaattcaagtgggatcaatgtgcattnannngnacagagaactgtatagatgncantanataanangnacanctnntgntngtnngnggganatantgtgnnnannnncntgcanncatcantgtnacntttgagagngnaagnaanggtntgttcannacnctattngntngaaatattcatcaactacaaaaatattggtaatgcaaaatgcatatcactgaaaagcgg

SEQ ID NO: 3763 - DNA, 835 bp, Taraxacum officinale
ctcgcggggattcgattcattgcttttttcctttcttcctctgatcatatcatcagaatccaactgtagatcataataaattcaagaggtgttgaagattgccactgtattgatttcaccgcaggggatctagtatagaaacaatcatgtttacacgagtgtttggaaaacctaagcaggaatcttctaatgctgtaacatcattagacaaattaaatgagacacttgaaatgctggagaagaaagaaagagtacttttgaagaaggcttctgcagaggtggagaaggccaaagactatactagagctaagaacaaaaaggcggcaatacaatgtttaaagaggaagagactctacgaacaacaaattgagcaacttggcaacttccaattacgtattcatgaccagatgataatgttagaaggtgcaaaagctaccacagagacagttgatgctttgagaaccggtgcagcagcaatgaaggccatgcagaaagcaacgaatattgacgatgttgacaagaccatggacgaaataaacgaacaaaccgaaaacatgaaattaattcaggaagcattggcaacacccatgggtgcagctgctgattttgacgaggatgaactagaagcggaacttgaggaactagaaggagctgagttggaggaacagcttctccaaccggccaccaccgctcccgtacaggttccggcagggcggcaacaaccaattccggcggctccccggaaaaacactgctgaggaagatgaacttgcggcattgcaagccgaaatggcactttgaaaaaagtttacaggagatgtattgatacatgcgga

SEQ ID NO: 3764 - DNA, 1262 bp, Mimulus guttatus
tatttggtccgtcacattgttatatgaacaacctgtcaattgatacttccctctaaccccatatccaagcgaagcgatctaaaacacggaaggattcaacccacccagcgacttctgcaatctgtatattttgtttcgtaattacgatattttgcataaagttaattggttaatccgaccgatttttctaatcgtttaaatccccaggggtaggactccaattttttttttgagttttttctctgtaatttataatcgttttgggaaaataaatcatcgacgatgtttacacgaattttcggcaagcccaagcaagagaccaatgctctggcaacgctggacaagttaaacgagactcttgagatgctcgagaaaaaagagaaagtcctcttgaagaaggctggtgctgaagttgaaaaggccaaggagtttactagagctaaaaataaaagggctgcaatacaatgtttgaagaggaaaaggctctacgagcaacaaattgagcagcttggaaatttccaattgcgcattcatgaccagatgataatgttagagggcgcaaaagctacaacagaaactgtcgacgctttgagaactggagcagctgcaatgaaagctatgcaaaaggcaactaatattgatgacgtggacaagacaatggatgaaatcaacgagcagacggagaatatgaagcaaattcaagaagcactctcaacaccaattggcgcagcagctgacttcgatgaggatgaattggaggcagagcttgaagaactcgaaggagctgagctggaggaacagcttctgcaacctgcaactacagctcctgatggtcctgttcgcattccagctggaaggcaaccagtcaaggttgaagatgatgacgacgagctcgctgagttgcagagagaaatggccctttaaggagatatcaattcgaaaatccgaagaaacagtagtattagatgtactatataattgagaccaacgctttcgctactgcccattctcagaccaaatttcctggattacgcatttacggtccgaagaaaaaactgtatagatgacaaagtaattcatgttttgaattcttatggagtcatttaagcatatcttatttttcaagcatgggattgttatttctgtcaatatatttgattatcctacttgagtcatgtcagtgtgtatcagaagagcctatattattatatgacattataatctgctgtttttatgaagttaaatttatcagaatattcaac

SEQ ID NO: 3765 - DNA, 1038 bp, Vinca minor
gattgttaatccatcactgggatcgatcgctgacttcgaagcctaggcccaattttatcaggaaacggagaggagatcagtttgaattttacaacaggaaaaatgtttactaggatatttggaaagccgaagcaggagagtaatgctgtcgccactctagataaattaaacgagacattagagatgctggagaaaaaagagaaggtgcttcaaaagaaggcctcaggagaggttgaaaaggccaaagaattcacaagagcaaagaataagagggctgccatccaatgtttgaagaggaaaaggctgtatgaacaacaaattgagcagcttggaaatttccagttgcgcatccatgatcagatgatcatgttagaaggggctaaagcgacaacagaaactgttgacgccttgagaaccggagcagctacaatgaaatcaatgcagaaagcaacaaatattgacgatgtggacaagaccatggatgaaattaatgaacagacagagaatatgaaacagattcaagaagctttgtctactccaattggtgcagcagctgactttgatgaggatgaattggaggcagaacttgaagaattggaaggtgctgagctggaggaacagcttcttcagcccacaaccacagcccctgctgcaccaattcatgtccctgcagcagcaggtaggcaacaagctcggctcgcccctcaaaagcaatcagctgaggaagatgaacttgctgcattacaagcagaaatggcactttgagcagttcaactctttattgatttaaagtggtatgagattgcatgtggatctgaatctgatcaatcaatgtggagagtgctggttttatgtaagccaatttttgcacgcattcttagttataatcctgtacttctactgtacagaaaggtgtgacaaaattgagcaaacttctcttagcattttactttatatccaggcttactgctggaatggttgacaatcttttgtaagctatcaaataataatagtaactggtccattttccccacagtt

SEQ ID NO: 3766 - DNA, 1043 bp, Vinca minor
cgttcctttcttcttcgtctcttgactttggttcctgaatcggatttggagccctattctaatgtaatatcccaatcttcccccaatcttcgattgttaatccaccagtggaatagatcaatagctaactttgaagccctaattttaccaggaaacggattgaatttcaacaagaaaaatgtttactaagatattcggaaagccgaagcaggagagtaatgctgtcgcaactctagataaattaaacgagacattagagatgctggagaaaaaggagaaagtacttcaaaagaaggcatcagccgaggttgaaaaggccaaggaattcacaagagcaaagaacaagaaggctgcaatccaatgtttaaagaggaaaaggctctatgaacaacaaattgagcagcttggaaatttccagttgcgcatccatgatcagatgatcatgttagaaggggctaaagcgacaacagaaactgttgacgccttgagaaccggagcagctgcaatgaaagcaatgcagaaagcaacaaatattgacgatgtggacaagacaatggatgaaattaatgaacagacagagaatatgaaacagatacaggaagctttgtctactccaattggtgcagcagctgactttgatgaggatgaattggaggcagaacttgaagaattggaaggtgctgagcttgaggaacagcttcttcagcctgcaaccacagctcctgctgcaccagtgcacgtccctgcagcagcaggcagacaacaagcccggcctgtccctcagaagcaatcagctgaggaagatgaacttgctgcactacaagcagaaatggcactttgagcagttcaacactttattgattttaagtggtaatttggtctatatttgtgcacgtggcatttaggctttaaagggcctttagcaatcaacttgttcatcttgtgttcctgaaacttaggcatgttggtctatccagtcacttggaactcttcgttccaagtatccttggtgtatattattattttcaggcaagtgcgcctac

SEQ ID NO: 3767 - DNA, 946 bp, Flaveria ramosissima
attcatcgaactcaatctcttctcctttgttcctctgatcacatcacttgaatccaactccgattcttacaaaatatgaggtgttgaagattctctcactctgttgataaattgatttaacccataagaagcaacaatgttttcgcgcgtttttggaaaacctaagcaagaagccaatgcggtaacaacattagacaagttaaacgagacacttgaaatgctggagaagaaagagaaagtacttttgaagaaggcttctgcagaggtggagaaggccaaagaatatactaaagcacataataaaagggcggcaatacaatgtttaaagaggaagaagctctatgaacagcaagttgaacagcttgggaacttccagttacgtattcatgaccagatgattatgctagaaggtgcaaaagctaccacagagactgttgatgcattgagaacaggtgcagcagcgatgaaggccatgcaaaaggcaacaaatattgatgatgttgataagaccatggatgagattaatgaacaaactgaaaatatgaagcaaatacaggaggcattggctacaccattggtgcagctgctgattttgatgaggatgaactggaagctgaacttgaagaactagaaggagctgagttggaggaacaacttctccaacctgcaacaactgccccgctgctccggtgcatgttccaactggcaggcaaccaacacgtccagctcctcaccaaaacaaagccgaggaagatgaacttgctgcattgcaagcagaaatggcactttaagaaagatcaccggagttgtactcaatacaccatgaaaaactgatgaactctttgttaaaatatatgttgtaaagttgtgattttagattaaataacaagctgggaatctggagaatgttgtaatattcattgaagatcataaagagtaatatact

SEQ ID NO: 3768 - DNA, 1044 bp, Sarracenia psittacina
cattgctcatctgtaacaatcctttgttctggttaattcgtcgatccatcgctgaatttcaagccctaacttcagtttaaccggtacagaagatccagagagagtttgattttgtgatcggagcgaccatgttcactcggcttttcggcaaacccaagcaagaggccaatactcttaccacgttagacaagttaaacgagacacttgaaatgcttgaaaaaaggagaaagtactccagaagaaggctgctgcagaagttgaaaaggccaaggaatttaccagagcaaagaacaagagggcggctatacaatgtttgaagaggaaaaagctctatgaacagcaaattgagcagcttggaaatttccagttacgcatccatgaccagatgatactattagaaggtgcaaaagctacaacagaaactgtggatgcattgagaactggggcagccgcgatgaaggccatgcagaaagcaacgaacattgatgatgtggacatgacaatggatgaaataaatgagcagactgaaaacatgaaacagatacaggaagcattggccacacccattggcgcagcagctgattttgatgaggatgaattggaagcagagcttgaagaattggaaggcgccgagttggaggaacagcttcttcaacctgcaacaacagcaccggcagcaccagtgcaagtaccagccggaaggctaccggctcgtgccgctcctcagaagcgcaccgccgaggaagatgaactggcggcattacaagcagaaatggcactctaagcaggttatattattcctctttatccgtaatctgatcaattattgttccaatgtggcatccatgcttttataagttgttgtcggttgactgataagggttaactgtaatagcagtatttcggaatccgtccggcctgagatgctagacttgtgatcccattgtatttgtgcatattatgaggccatttggttgtaatgttttctgctgaaagcacactttaatatgcatttgctgttaaagacaaatgaaacagatttgt

SEQ ID NO: 3769 - DNA, 1044 bp, Flaveria ramosissima
tttttcctctgatcatatcaattaactcaactgcaattcttaaaagatttgaggcgttgaagattgtccctctgttgattcaatcgaaggaagccttctatagaaacaaccatgttttcgcgagtttttggaaaacctaagcaagaagctaatgccgtaacaacactagacaaattaaacgagacacttgaaatgctggaaaagaaagagaaagtacttttgaagaaggcttctgcagaggtggagaaggccaaggactatactaaagcaaagaacaaaagggcggcaatacaatgcttaaagagaaagaaactctatgaacaacaaattgaacagcttgggaacttccagttacgtattcatgaccagatgattatgctagaaggggccaaagctactacagagactgttgatgctttgagaactggtgcagcagcaatgaaggccatgcagaaggcaacaaatattgatgatgttgacaagactatggatgagataaatgaacaaactgaaaatatgaagctaattcaggaggcattggcaacaccaatgggtgctgctgctgattttgatgaggatgaactggaagctgaacttgaagaactagaaggagctgagttggaggaacagcttcttcagcctgctacaaccgcccctgctgctccagtgcacgtgccagctggcaaacaaccaacacgtccagctcctcagaaaaacactgctgaggaagatgaacttgctgcattgcaagcagaaatggcactttaaagtcagaactctatatacacagattgcgggagatgtactcaaaagaccatggaaaactgaagaactgtgttaagattatatattttgtacagttgtgattgtagactaataaatattaagttggatatgtggagtacgtaatcggagggattgagtgttgtattatacttcaaatcatagaggaccgatacactggtctctagattaatgttgttattttcgtacaggatcattgtacactaaatgcttacattacttgtgtaagtatcacaggtt

SEQ ID NO: 3770 - DNA, 1123 bp, Flaveria ramosissima
gccacttacaatctcaaatacgttgttgggtaaagcgtgtgtcgacatcggagacaaccaatcagcctaagcaaaacccccatccattaaccaagtccaccccaattgtattcacaatcggattccttcgatcttcatcaacaatcaaaacccctttacgattttacatcaatttctccttcgatttcgattcttcagtgtattgtctcacaaacctttgataaaagggttaacaaccatcacgataacacacccacttgttaattctcagatcgtagggttttcagagaacaaaagggtacaatgttggcgcgaatgtttggcaaacctaagcaagaagctaacgctgttacaacgttagacaaattgaatgagacacttgaaatgctcgagaagaaagaaaaagtacttctgaagaaagcttctgcagaggttgaaaaggcaaaggaattcactagagcaaaaaataaacgggctgcaatacaatgcttaaagagaaaaagactttacgaacagcaaattgaacagcttggcaattttcaactgcggattcatgatcagatgataatgcttgaaggtgcaaaagctaccacggagacagtggatgcattgagaactggagcaaaagcaatgaaggcaatgcaaaaggcagtgaatattgatgatgtcgacaaaacaatggatgaaataaatgagcaaacagagaacatgaaacaaattcaggaagcattgtcagcacctattggtgcagcagctgattttgatgaggatgagttggaggctgaacttgaagagttagaaggagctgagttggaggaacagcttctgcagccagccaccactgcacctgcagcaccagtgtatgtgccagctggaaaacaaccgacacgtccagctcagcaccagaacaaagctgaggaagatgaacttgctgcattgcaggcagaaatggcactttaaagtttcatcttggttgaaggatattgtaaagattggatattcaaacaatggaggtatgcgtattgtttgtgtgattaacatgatcaacaacttttatcgtattaagaacagaaaatgacctatattctagttttcacgtgtggcgtggcacgtgaaaaatcct

SEQ ID NO: 3771 - DNA, 1026 bp, Flaveria ramosissima
ccctttacgattttacatcaatctctccttcgatttcgattcttcggtatattgtctcacaaacctttgatagaagggttaagaactatctaaataatcacacccacttgttatttctcagatcgagggttttcagagaacaaaagggtacaatgttggcgcgaatgtttggcaaacctaagcaagaagctaacgctgttacaacgttagacaaattgaatgagacacttgaaatgcttgagaagaaagaaaaagtacttctgaagaaagcttctgcagaggttgaaaaggcaaaggaattcactagagcaaaaaataaacgggctgcaatacaatgtttaaagagaaaaagactttacgaacagcaaattgaacagcttggcaattttcaactgcggattcatgatcagatgataatgcttgaaggtgcaaaagctaccacggagacagtggatgcattgagaactggagcaaaagcaatgaaggcaatgcaaaaggcagtgaatattgatgatgtcgacaaaacaatggatgaaataaatgagcaaacagagaacatgaaacaaattcaggaagcattgtcagcacctattggtgcagcagctgattttgatgaggatgagttggaggctgaacttgaagagttagaaggagctgagttggaggaacagcttctgcagccagccaccactgcacctgcagcaccagtgtatgtgccagctggaaaacaaccgacacgtccagctcagcaccagaacaaagctgaggaagatgaacttgctgcattgcaggcagaaatggcactttaaagtttcatcctggttgaaggagattgtaaagattggatattcaaacaatggaggtatgcgtattgtttgtgtgattaacatgatcaacaacttttatcgtattaagaacagaaaatagacctatattctagtttctacgtgtggcatggcacgtgaaaatcccgtgtacgatgttgtgttggttaatttaagtattttttctctaatcctagtaaag

SEQ ID NO: 3772 - DNA, 1160 bp, Flaveria ramosissima
gaatctcaaatacgttgttaagtaaagcgtgtgtcgacattggagataaccaatcagcctaagcaaatcccccatccataattaacaccaagtccaccccaattgtattcacaatcggattccttcgatcttctatcaacaatcaaaacccctttacgatttcacatcaatctatccttcgatttcgattcttcagtatattgtctcacaaacctttgataaaagggttaagaaccatcacgattatcacacccacttgttaattctcagatcgtagggtttccagaacacaaaagggcacaatgttggcgcgaatgtttgggaaacctaagcaagaagctaacgctgttacaacgttagacaaattgaatgagacacttgaaatgctcgagaagaaagaaaaagtacttctgaagaaagcttctgcagaggttgaaaaggcaaaggagttcactagagcaaaaaataaacgggcggcaatacaatgtttaaagagaaaaagactttacgaacagcaaattgaacagcttggcaactttcaactgcggattcatgatcagatgataatgcttgaaggtgcaaaagctaccacagagacggtggatgcattgagaactggagcaaaagcaatgaaggcaatgcaaaaggcagtgaatattgatgatgttgacaaaacaatggatgaaataaatgagcaaacagagaacatgaaacaaattcaggaagcactatcagcacctattggtgcagcagctgattttgatgaggatgagttggaggctgaacttgaagagttggaaggagctgagttggaggaacagcttctgcagccagccaccactgctcctgcagcgccagtgcatgtgccagctggaaaacaaccgacacgtccagctcagcaccagaacaaagccgaggaagatgaacttgctgcactgcaggcggaaatggcactttaaagttgcatcctggttggaagatattgtaaagattggattttcaaacaatggaggtatgcgtattatttgtgtgattaacatgatcaacaacgtttatcgtattaagaacaaaaaatacctatatcctagttttcacgtgtcggtgtggcacgtgaaaatcctgtgtacgatgtttgtgttggttaatttaagaattttttt

SEQ ID NO: 3773 - DNA, 932 bp, Flaveria ramosissima
aggcgtagaagattgttactctgttgattcaaccgaaggaagaccttatagaaacaaccatgtttacgcgagtttttggaaagcctaagcaagaagctaatgccgtaacaacactagacaaattaaacgagacacttgaaatgctggaaaagaaagagaaagtacttttgaagaaggcttctgcagaggtggagaaggccaaggactatactaaagcaaagaacaaaagggcggcaatacaatgcttaaagagaaagaaactctatgaacaacaaattgaacagcttgggaacttccagttacgtattcatgaccagatgattatgctggaaggtgcaaaagctaccactgagactgttgatgctttgagaactggtgcagcagcaatgaaggcgatgcagaaggcaacaaatattgatgatgttgacaagacgatggatgagataaatgaacaaactgaaaatatgaagctaattcaggaggcattggcaacaccaatgggtgctgctgctgattttgatgaggatgaactggaagctgaacttgaagaactagaaggagccgagttggaggaacagcttcttcagcctgccacaaccacccctgctgctccagtgcacgtgccagctggcaaacaatcaacacgtccagctcctcagaaaaacactgctgaggaggatgaacttgctgcattacaagcagaaatggcactttaaagtcagagctctatacacacggattgcgggagatgtactcaaaagaccatggaaaactgaagaactgtgttaaaattatattttgtacagttgtgaatgtagactaataaatatcaagttggatatgtggagtacataatcgaaggattgagtgttgtattatacttcaaagcatagaggactaatacactgtctttgaagtattaacgttgactt

SEQ ID NO: 3774 - DNA, 927 bp, Citrullus lanatus
gggagttttgatttgatctacggaaaccaataagtacattgccgcgtggagacgaaacagcgacttgaagagaaagggaaactccaaatcttcgtcctccgttttctggagcgtctgggaaatcctttgtacttcaaatttcttcacagattgccttttacgttttgtgaattcgtttctgattctcatctttctgtttcaatctctctggtttctcgacttttgaagatcgagagaggattcttgttgcttagcgtcaacaatgtttaacaggctttttggtaaacctaaacaagaagccaatgctttggctacgttagagaagttaagcgagacacttgaaatgctggagaagaaagagaatgttcttgttaagaaggcagctgcagaggttgaaagggctaaagaattcacaagagtgaagaataaacgagcggccatacaatgtttgaagagaaagagactttatgaacagcaaatagagcagcttggaaatttccaattgcgtatccacgatcagatgattatgttagaaggggcgaaggctacaacggagactgtagatgctttgagaacaggagcatctgcaatgaaggcaatgcagaaagcaacaaacattgatgatgtggacaagacaatggatgagatcaatgagcagactgagaatatgaaacagatacaggaagcgctatcagctccaatcggtgctgcagctgattttgacgaggatgaattggaggcagaactcgacgatctggaaagtgcagagttggaagagcagcttctccaaccagcgtcgacagctcctgctggacctgtctcagttccggcgggcagagttcctgcacgccctgctcctcaaaagagaactgctgaagaagacgaacttgcagcgttgcaagctgagatggccctctaaccaggttt

SEQ ID NO: 3775 - DNA, 967 bp, Arabidopsis thaliana
gagtaacaataataagtaagtacaggtaggacaaggctttcgaagaaacccaaacaaaaaaaaacttcaacgccgtttcttcttccattaatctcatctctcaatcaaccaaaagcttcccatctcaaatccctcagtttgattttctaggcaaacaatcatctgccaccatgtttatgaatcggctattcgggaaacccaaacaggagactagtactctccaaacgttagacaagctcaatgagactcttgagatgttagagaagaaggagaatgttcttctcaagaaagctactggagaggttgagaaagctaaggaattctcccgggcgaagaacaaacgcgcggctatacaatgtttgaaaaggaaaaggttatatgagcaacaagttgaacagctcgggaatttccagctccgtattcatgatcaaatgattatgttagaaggtgctaaagcaacaacagagactgtagatgctttgaggactggagcttctgcaatgaaagctatgcagaaagcaacaaacattgatgatgttgacaagacaatggatgagatcaatgaacaaactgagaacatgaaacagatccaagaagcattgtcggctccatttggggctaatgattttgatgaggatgaattggaagcagaacttgacgaactagaaggcgctgagctagaagagcaacttcttcagcctgttccaatccatgtgcctcaaggaaacaagcctgctcgtgctccagctcagaagcaacctactgctgaggaagatgaactcgctgccttacaagctgagatggctctctaagctgaagctagccttggaagatttcgattaagtggggagatttgtgtgtgcattatctaaaaacagaaagaaaagattttatgtatataaggatccgagtctaattgatcggaagattttttttttctttttcaatataattaacttattaaact

SEQ ID NO: 3776 - DNA, 1116 bp, Cucumis sativus
agttttgatttgatgaacggaaaccaataagtagattgccgcgtggagaagaaacagcgacttgaagagaaagggaactccaaatcttcgacctccgttttctggagcgtctgacaaaccctttctacaattctacttcaaatcttttcattgaatctttcgattcattctccgttttgtgaattccttttggattctcatctttctgtttcaatctccctggtttctcgatttttgaagatcgagagaggattccatttgctttgcatcgacaatgtttaacaggctttttggtaaacctaaacaagaagccaatgctttggctacgttagaaaagctaagcgagacacttgaaatgctggagaagaaagagaatgttcttgtgaagaaggcagctgcagaggtcgaaagagcaaaagaattcacaagagggaagaataaacgagcggctatacaatgtttgaagagaaaaaggctttatgaacagcaaatagagcagcttggaaatttccaattgcgcatccatgatcaaatgattatgttagaaggggcaaaagctacaacggagactgtagatgctctccgaacaggagcatctgcaatgaaggcaatgcagaaagcaacgaatattgatgatgtagacaagacgatggatgagatcaacgagcagactgagaatatgaaacagatacaggaagcgttatcagctccaattggtgctgcagctgatttcgatgaggatgaattggaggcagagcttgaagatctagaaagtgcggagttggaagagcaactgctgcaaccagcatcaacagctcctgctgcacctgtctcagtcccgggaggccgagttcctgcacgccctgctcctcaaaagagaactgctgaagaggacgaactcgctgctctgcaagctgagatggcactctaaacaggtaaaatggggatcacgacatgattgtgtgcatcatcatccaaagaaatccttggtatgagtgtttaaaattttatacgaattattagtattccttgaagcgagacagtgtatataaagttgactaaatgattggaattgtgattgaaacatttttatttatatactttccattttgcgga

SEQ ID NO: 3777 - DNA, 1416 bp, Arachis hypogaea
ggggatacgctctccttttcttttctccctccccactcgtagatctctctcttcctcttctcccttctcgcttcttctcaaacacccagacccccccctctctccaaaccctattttttcatcagggtcgatcgcttggtgaattggggtctcaattgacctttgttggatttaatttttcctcttagaggcttgagggtttcggtgtttcatctctatcgcaaccatgtttacccgaatttttggtaaacctaaacaggaggccaatactctaaccacattggacaagttaaccgagacccttgaaatgctagagaaaaaggagaaagtgctcgttaaaaaggcagcagcagaagttgaaaaagccaaagaattcaccaaggcaaagaataagagggcggcaatacaatgtttgaagaggaagaggctgtatgagcagcaaatagagcagcttggaaatttccagttgcgtattcatgaccagatgataatgttagaaggtgccaaggcaaccacagaaacagttgatgcgttgagagttggagcagctactatgaaggctatgcaaaaagcaacgaacattgatgatgttgacaagaccatggatgagatcaatgagcagactgagaacatgaaacaaattcaggaagcattgtcagctccaattggttcagctgctgattttgatgaggacgaattggaagcagaacttgaagagctagaaggtgctgagttggaagaacaacttcttcagcctgcaactacagctcccgcagctcctgtacatgtcccagctgggcggcaacctaatcgtcctttccctgcaaagcctactgctgaagaagatgaattggcagctttgcaggctgagatggctctttgagaaggcactgatatgcatgataagtggcccctaaagaatttcaaccagtgacatggaatattctgcctctccgtgatcatccgtatctgtgtaaaaatcattgaacagagaatgtatataaaggtgacaaatattgaaatgccctaaaaatatagtttgagtttgtcacccatttcgatgtcttattttaaaagaagttgaaaacccccactcttgtgttgtttttgtcatccattgatgcaattcggttaactatttcttttcgaacccagtccaattgacattgccattcagattgatttatatataggaaaattttcacatataccagccaatttattgatacagccgtatcccgtgtacggttcggtggctagtaaaatttttgtcctcttgcttgatgtgtattgacgaaaaaatccacaaaagggcaagaaaaaagacactaaataaagggtaataaatttatggctaaatgatgatttgtattggtaagccagtcacattagaataaatttggatggctgagagct

SEQ ID NO: 3778 - DNA, 997 bp, Helianthus annuus
actttaaacccatatcaaatccatcgaactcaatcgtttttccctttttcctctgatcatatcacttcaatccaactttagttcttcaataattttgaggtgttgaagatcgttactctgttgattcaattaaacgaaatttctatagaagcaatcatgctttcgcgcgtttttggaaaacctaagcaagaagctaatgcggtgacaacattagacaaattaaatgagacacttgaaatgctggagaagaaagagaaagtacttttgaagaaggcatctgcagaggtggagaaggccaaagagtatacaaaagcacataataaaagggcggcaatacaatgtttaaagaggaagaagctgtatgagcaacaagttgaacagcttgggaacttccagttacgtattcatgaccagatgattatgctagaaggtgcaaaagctaccacagagactgttgatgctttgagaaccggtgcagcagcaatgaaggccatgcaaaaggcaacaaatatcgatgatgttgacaagactatggatgagataaacgaacaaactgaaaatatgaagcaaattcaggaggcattggcaacaccactgggtgcagctgctgattttgatgaggatgaactggaagctgaacttgaggaactagaaggagctgagttggaggaacagcttctccagcctgccacaaccgcccctgctgctccggtgcatgtgccagctggcaagcaaccaacacgtccagctcctcgccaaaacaaagcggaggaagatgaacttgctgcattgcaagcagaaatggcactttaagaaaaggtcactggagatgtactcatacacttcaaaaaatggatgaactgtgtgttaaattatatcttgtacagttgtgattgtagaccaaataacaagctggctttgttgtattatacattgaagatcataagggactaatatactgtttcttgagattaatttcggctatatattacttatg

SEQ ID NO: 3779 - DNA, 1118 bp, Ambrosia trifida
tcctcacatcatccccaatcgtactcttcacttttccaactcatcgaatccaaatttcttcgatctttcatcattcttctaaacccctcttcaggtttaccttaatctttcattcaacttcgattgttaatcctcagatcgttccaggaaaaagaaaaaaagggttacaatgttttcaagaatgtttggtaaacctaagccagaagctaccactgtaacaaccttagacaaattaaatgagacacttgaaatgctagagaagaaagaaaaggtacttctgaagaaagctgctgctgaggttgaaaaggcgaaggaattcaccagagcaaaaaataaacgggcggcaatacaatgtttaaagcgaaaacgactttatgaacagcaaattgaacagcttggcaatttccaattgcgtattcatgatcagatgataatgcttgaaggtgcaaaagctactacggagactgtggatgccttgaggactggagctaatgcaatgaaggcaatgcaaaaggcagtgaatattgatgatgtcgacaagacaatggatgagataaatgagcaaacagagaacatgaaacaaattcaggaagcattatcagcacctattggtgctgcagctgattttgatgaggatgagttggaggctgaacttgaagagttagagggagctgagttggaagaacaacttctacagcctgccacaactgcacctgcagcaccagtgtatgtgccagctggaaaacaaccaacgcgtccagctccccgccagaacacggctgaggaagatgaacttgctgcattgcaggccgaaatggcactttgaagtttcaagtcccacctggaagaaattgtaaagatcggatgctcaaacattgttggtatcatatcaattcgttcacatcaatacgtattgtttgtgtgataatatcaactacttttatgttatgtggaacagaaaattatgcttttcccagtttttaagtttgttatcaagttcctaaaatatgtgttacttttgttgatctggttaataaaattttattagctttttgtaatatcacatacagtgtatttggtacctacttttatgaaaattcaggtatcggtaaaaagaa

SEQ ID NO: 3780 - DNA, 913 bp, Ambrosia trifida
agggttccagttctgtgatcatagatctaattacttgaagatcgttgctttattgattcaaccgaagcaagtttttgatagaaagatcaaacaatcatcatgcttactcgagtttttggaaaacctaagcaacaacctaatgctgtgacatcattagacaaactaaatgagacacttgaaatgctggaaaagaaagagaaagtacttttgaagaaggcttctgcagaggtggagaaagccaaggactatactaaagcaaagaacaaaagggcggcaatacaatgcttaaagagaaagaaactctatgaacagcaaattgaacaacttgggaacttccagttacgtattcatgaccagatgattatgctagaaggtgcaaaagctaccacggagactgtcgatgcgttgagaactggtgcatcagcaatgaaggccatgcagaaggcaacaaacattgatgatgtcgataagactatggatgagataaatgaacaaacggaaaatatgaagctaattcaggaggcattggcaacaccaatgggtgccgctgctgattttgatgaggatgaactcgaagctgaacttgaggaactagaaggagctgagttggaggaacagcttcttcaacctgccacaaccgctcctgctgctccagtgcacgtgccaactggcaggcaacaaacgcgtccagctcctcgccaaaacactgctgaggaagatgaacttgctgcattgcaagcagaaatggcactttaaagatggctggagatgtaactacaaaaacggcatgaagaaacagaaagaatgtagttgaacttatatcttagtaacagttgtagattagtaagaactaaataaataaatatagaaagttgggatcgaagggaaatatttagaagttgactgttaatta

SEQ ID NO: 3781 - DNA, 937 bp, Flaveria ramosissima
tatcaaattcatcgaactcaatctcttctcctttgttcctctgatcacatcacttgaatccaactccgattcttacaaaaattgaggtgttgaagattctctcactctgttgataagttgatttaacccaaggagaattttgtaagaagcaacaatgttttcgcgcgtttttggaaaacctaagcaagaagctaatgcggtaacaacattagacaagttaaacgagacacttgaaatgctggagaagaaagagaaggtacttttgaagaaggcttctgcagaggtggagaaggccaaagaatatactaaagcacataataaaagggcggcaatacaatgtttaaagagaaagaagctctatgagcagcaagttgaacagctggggaacttccagttacgtattcatgaccagatgattatgctagaaggtgccaaagctaccacagagactgttgatgctttgagaacaggtgcagcagcaatgaaggccatgcaaaaggcaacaaatattgatgatgttgacaagaccatggatgagattaatgaacaaactgaaaatatgaagcaaatacaggaggcattggctacaccattgggtgcagctgctgattttgatgaggatgaactggaagctgaacttgaagaattagaaggagctgagttggaggaacaacttctccaacctgcaacaaccgcccctgttgctccggtgcatgttccaactggcgggcaaccaacacgtccagctcctcaccaaaacaaagcagaggaagatgaacttgctgcattgcaagcagaaatggcactttaagaaagatcaccggagatgtactcaatacaccatgaaaaactgatgaactctttgttaaattatatgttgtaaagttgtgattttagatgaaataacaagctgggaatctggagaatgttgtaatat

SEQ ID NO: 3782 - DNA, 982 bp, Flaveria ramosissima
atatcgcattcatcgaactcaatcgcttttcctttgttcctctgatcacatcacttgaatccaactccgattcttacaaaatttgaggtgttgaagactctcactctgttgataagttgatttaacccaaggagaattttgtaagaagcaacaatgttttcgcgcgtttttggaaaacctaagcaagaagctaatgcggtaacaacattagacaagttaaacgagacacttgaaatgctggagaagaaagagaaagtacttttgaagaaggcttctgcagaggtggagaaggccaaagaatatactaaagcacataataaaagggcggcaatacaatgtttaaagaggaagaagctctatgaacagcaagttgaacagcttgggaacttccagttacgtattcatgaccagatgattatgctagaaggtgcaaaagctaccacagagactgttgatgctttaagaacaggtgcagcaacgatgaaggccatgcaaaaggcaacaaatattgatgatgttgacaagaccatggatgagattaatgaacaaactgaaaatatgaagcaaatacaggaagcattggctacaccattgggtgcagctgctgattttgatgaggatgaactggaagctgaacttgaagaattagaaggagctgagttggaggaacaacttctccaacctgcaacaacagcccctgctgctccggtgcatgttccaactggcaggcaaccaacacgtccagatccgcaccaaaacaaagcagaggaagatgaacttgctgcattgcaagcagaaatggcactttaagaaagatcaccggagatgtactcaatacaccatgaaaaactgatgaactctgtgttaaattatatgttgtaaagttgtgattttagatgaaataacaagctgtgaatctggagaatgttgtaatattcattgaagatcataaatgagtaatatactgttttgagttggttct

SEQ ID NO: 3783 - DNA, 1223 bp, Malus domestica
gcagcttcccttctcattccaacgcaacaccaacacgcctaagcaaatcggcagagccctctcgcccagtttacgcgggtctctctctctcctcccccttcttcttctccatcaaaaccctaacttccccaatccgatccgtcgtcttcccccaatttccaccggtgatttcgagaagatcgagagggtttcataatccgcgaagatttcaaccatgtttaccaggatttttgggaaacccagacaggaaaacagtgccctcaccaccttagacaagttgaatgagacgcttgaaatgcttgagaaaaaggagaaagtactgcaaaagaaggctgctggagaagttgatagggccaaggatttcaccagagcaaagaacaaaagggcggctatacaatgtttgaagaggaagcggttatatgagcagcaaatagagcagcttggaaatttccagttgcgtatccatgatcagatgataatgctagaaggtgcaaaagccacaactgaaactgtagatgccttgagaactggagctgctgcaatgaaggcaatgcaaaaagcaacgaacatagatgatgtggacaagactatggatgagattaatgagcaaacggagaacatgaaacagatacaggaagcattgtcaactccaattggtgcagttgctgattttgatgaggatgaattggaagcagaacttgaagagctggaaggtgcagagttggaggaacaacttcttcagccagcaacacaagctcctgcagcaccagtgcaggtcccagcaggaaggcaaccaactcgccctgctccccaaaggcgcactgaagaagaagatgaattggcagctttgcaggctgagatggcactttaagagtcgaggctgtttgcaggtattcattctccggtaggatgagtcgaggctatgtaaaggattggtctgattttataatggagatttctgctccgatcacacattctggatttctgtgtggcttcattattaaacagaatgtatataaaggtggcacaaaatgaaacagtcccctttgaaacttgtattctgctattcctcagatttttctccttttttttttcttttaagtttactttgggacatttgttcaatgttgttcttcgtctgtcatccggcatgccttaatcaaatagcttgttctattattgtgtgttagtattaccaagtcaataatatgaattttctgttc

SEQ ID NO: 3784 - DNA, 1195 bp, Malus domestica
cacgagggcagcttcccttctccttccaacgcaacaccaacacgcctaaagcaaatcggcagagccctctcgcccagtttacgcgggtctctctctctcctcccccttcttcttctccatcaaaaccctaacttccccaatccgatccgtcgtcttcccccaatttccaccggtgatttcgagaagatcgagagggtttcataatccgcgaagatttcaaccatgtttaccaggatttttgggaaacccagacaggaaaacagtgccctcaccaccttagacaagttgaatgagacgcttgaaatgcttgagaaaaaggagaaagtactgcaaaagaaggctgctggagaagttgatagggccaaggatttcaccagagcaaagaacaaaagggcggctatacaatgtttgaagaggaagcggttatatgagcagcaaatagagcagcttggaaatttccagttgcgtatccatgatcagatgataatgctagaaggtgcaaaagccacaactgaaactgtagatgccttgagaactggagctgctgcaatgaaggcaatgcaaaaagcaacgaacatagatgatgtggacaagactatggatgagattaatgagcaaacggagaacatgaaacagatacaggaagcattgtcaactccaattggtgcagttgctgattttgatgaggatgaattggaagcagaacttgaagagctggaaggtgcagagttggaggaacaacttcttcagccagcaacacaagctcctgcagcgccagtgcaggtcccagcaggaaggcaaccaactcgccctgctccccaaaggcgcactgaagaagaagatgaattggcagctttgcaggctgagatggcactttaagagtcgaggctgtttgcaggtattcattctccggtaggatgagtcgaggctatgtaaaggattggtctgattttataatggagatttctgctccgatcacacattctggatttctgtgtggcttcattattaaacagaatgtatataaaggtggcacaaaatgaaacagtcccctttgaaacttgtattctgctattcctcagatttttctcttcttttttttccttttaagtttactttgggacatttgttcaatgttgttcttcgtctgtcatccggcatgccttaatcaaatagcttgttctattaaaaaaaa

SEQ ID NO: 3785 - DNA, 1211 bp, Malus domestica
ccttctcctccttccaacacgacaccaacacgcctaagcaaattggcagagctctcacccactgtacgcgggtctctctttccccaccccttcttcttctccatcaaaaccctaatttctccaatccgatccgtcgtctctccccaatttccaccgtcgatttcgagaagatcgagagggtttgataatctgcagagatgtcaaccatgttcaccaggatttttgggaaacctaaacaggaaaacagtgccctaaccaccttagacaagttgaatgagacgctagaaatgcttgagaaaaaggagaaagtactacagaagaaggccgctgcagaagttgatagggccaaggatttcaccaaagcaaagaacaaaaaggcggctatacaatgtttgaagaggaagaggttatatgagcagcaaatagagcagcttggaaatttccagctgcgtatccatgatcagatgataatgctagaaggtgcaaaagccacaaccgaaactgtagatgccttgagaactggagctgctgcaatgaaggcaatgcaaaaagcaacgaacatagatgatgtggacaagactatggatgagattaatgagcagacagagaacatgaaacagatacaggaagcattgtcaactccaattggtgcagctgctgattttgatgaggatgaattggaagcagaacttgaagagctggaaggtgccgaattggaagaacaacttcttcagccagcaacacaagctcctgcagctccagtgcaggttccagctggaaggcaaccaactcgtcctgctccccaaaggcgcactgaagaagaagatgaattggctgctttgcaggctgagatggcgctttaagcagcagcaggtattcattcttatgagtcaaggctatgtcaaggattggtctgattctacaatggagatttctgttccgatcacgcatcgcaggtttctatgtggcttcttcattattaaagagaatgtatataaaagtggcataaattcaaacagagtcccctttgaaacttgtattctgcttttctcagatttttctttcttccttgttttctttcttttaagtttactttttgaacatttgttcaatgttcttgtggccttatatcaaatagcttgttctattattatgtgatattgtgaccaagtcaataataagaatattctcttggagcctataatagagag

SEQ ID NO: 3786 - DNA, 1191 bp, Malus domestica
atgcacgaggccttctcctccttccaacacgacaccaacacgcctaagcaaattggcagagctctcacccactgtacgcgggtctctctttccccaccccttcttcttctccatcaaaaccctaatttctccaatccgatccgtcgtctctccccaatttccaccgtcgatttcgagaagatcgagagggtttgataatctgcagagatgtcaaccatgttcaccaggatttttgggaaacctaaacaggaaaacagtgccctaaccaccttagacaagttgaatgagacgctagaaatgcttgagaaaaaggagaaagtactacagaagaaggccgctgcagaagttgatagggccaaggatttcaccaaagcaaagaacaaaaaggcggctatacaatgtttgaagaggaagaggttatatgagcagcaaatagagcagcttggaaatttccagctgcgtatccatgatcagatgataatgctagaaggtgcaaaagccacaaccgaaactgtagatgccttgagaactggagctgctgcaatgaaggcaatgcaaaaagcaacgaacatagatgatgtggacaagactatggatgagattaatgagcagacggagaacatgaaacagatacaggaagcattgtcaactccaattggtgcagctgctgattttgatgaggatgaattggaagcagaacttgaagagctggaaggtgccgaattggaagaacaacttcttcagccagcaacacaagctcctgcagctccagtgcaggtcccagctggaaggcaaccaactcgtcctgctccccaaaggcgcactgaagaagaagatgaattggctgctttgcaggctgagatggcgctttaagcagcagcaggtattcattcttatgagtcaaggctatgtcaaggattggtctgattctacaatggagatttctgttccgatcacgcatcgcaggtttctatgtggcttcttcattattaaagagaatgtatataaaagtggcataaattcaaacagggtcccctttgaaacttgtattctgcttttctcagatttttctctttcttccttgttttctttcttttaagtttactttttgaacatttgttcaatgttcttgtggccttatatcaaatagcttgttctattattatgtgatattgtgaccaactcaataat

SEQ ID NO: 3787 - DNA, 639 bp, Gossypium hirsutum
ggaaacctaagcaggaaacaaatgctctaaccacgttagataaattaaacgagacccttgaaatgttagagaaaaaagaaaaagtacttgcgaaaaaagcagctgcagaggttgaaaaggcgaaggaacttgcaaaagcaagaaacaagagagcggctgtacagtgcttgaagaggaagagactatatgaacagcaaatagaacagcttggaaacttccagcttcgtattcatgatcaaatgataatgttagaaggagccaaagccacaaccgagactgtagatgctttgagaactggagcatctgcaatgaaggcaatgcagaaagcaactaatatagatgatgttgacaaaacaatggatgagatcaatgaacaaaccgagaacatgaaacagattcaggatgcactttcaactcctattggagctgcagctgattttgatgaggatgaattggaagcagaactcgaagaacttgaaggtgctgagttggaggaacagcttctgcagccagcaacaactgctccagcagctccagtccaagtgcctgctggcagacaaccagctcgtcctgttcctcagaagcatactgctgaggaagatgaacttgctgcattgcaggctgagatggcactttaag

SEQ ID NO: 3788 - DNA, 758 bp, Nuphar advena
  misc_feature (48)..(48): n is a, c, g, or t
  misc_feature (239)..(239): n is a, c, g, or t
tcttccgttgacgacgctccgtctacggcagcgggtttagggcgaggnatcttgttgtggaggaatcatgtttaacagaatattcggcaagccgaaacaggagacgaatgcgctcaccacgcttgataagttgaatgagactcttgacatgctggagaaaaaagagaaagtacttcaaaagaaggcggctgcagaggttgagcgagcgaaggaatttactagagcaaaaaacaaacggnctgccatacaatgtttgaagaggaagaggatgtatgaagcacagattgagacacttggaaatttccagctgcggattcatgaccagatgatcttgctagaaggtgcaaaagctactacggaaacagttgatgcattgaggtcaggagcggcagcaatgaaagctatgcaaaaagcaacgaacatcgatgatgttgataagaccatggatgaaataaatgaacagactgaaaacatgaagcagatccaggaagcattatctgctccaattggtccagcagcagactttgatgaagatgaattggaagccgaactcgaggagctggagggagcagagttggaggaacagctgcttcagccagcaaccactgcccctgctgtcccagtacagtatgttcctgctggcaagcaaccagtgcgacctacacctcagaaaacatctgaagacgaggagcttgctgctttacaggcagagatggctctctagggaggtctgttataggtcaatggggctgggtgac

SEQ ID NO: 3789 - DNA, 1034 bp, Helianthus annuus
atcgcagggtttttaggaaaaacagggtaacgatgtttgcgcggatgtttggcaaacctaagcaagaggctaatgctgtaacaacgttagataagttaaatgagacgcttgaaatgctcgagaagaaagaaaaggtacttaataagaaagcttctgcggaggttgaaaaggcgaaggaattcactagagcaaaaaataaacgagcggcaatacaatgtttaaagagaaaaagactttatgaacagcaaattgaacagcttgggaattttcaattgcgtattcatgatcagatgataatgcttgaaggtgcaaaagctactacagagacagtggatgccttgagaaccggagctaaagcaatgaaggacatgcaaaaggcagtgaatattgatgatgtcgacaaaacaatggatgagattaatgagcaaacggagaacatgaaacaaattcaggaagcattggcaacacctattggtgcagcagctgattttgatgaggatgagttggaggctgaacttgaagagttagaaggagcagagttggaggagcagctcttacagccggccaccactgcacctgcggcaccggtttatgtgccagctggaaaacaaccaacacgtccagctcagcgccagaacaccgctgaggaagatgaacttgctgcattgcaagcagaaatggcgctttaaaggtgcgaatgcgggttggacgaaattgtaaagattggattttcaaacaatgaagatatgcgtattgtttgtgttataacatgatcaatgacttctgttgtattaggaactggaaagggacctttttttctagttttcacgtgtcggtgtcatgtggaaaatcatgggtacatgtttgatgttggttatctaagaatttttttcacataaaattgcaaaaaagttatctttgaaaaaccaaactttaaaaatttaatcctagcggccttctcggcccaatggactcaatactcgagaaagattatgtgtgcggcctcaattccaacacactggaggggccatctc

SEQ ID NO: 3790 - DNA, 1170 bp, Flaveria ramosissima
cgagtcgtcagtagacagtggtagtcaacgcacgagtacgatggggccgtcggttatttcagtttttcctacacctactgccacttacaatactcaaatacgttgttgggtaaagcgtgtgtcgacattggagataaccaatcagcctaagcaaaacccccatccaattaaccaagtccaccccaattgtattcacaatcggattccttcgatcttcatcaacaatcaaaacccctttacgattttacatcaatttctccttcgatttcgattcttcagtgtattgtctcacaaacctttgataaaagggttaacaaccatcacgataacacacccacttgttaattctcagatcgtagggtttcagagaacaaaagggtacaatgttggcgcgaatgtttggcaaacctaagcaagaagctaacgctgttacaacgttagacaaattgaacgagacacttgaaatgctcgagaagaaagaaaaagtacttctgaagaaagcttctgcagaggttgaaaaggcaaaggaattcactagagcaaaaaataaaagggctgcaatacaatgcttaaagagaaaaagactttatgaacagcaaattgaacagcttggcaattttcaactgcggattcatgatcagatgataatgcttgaaggtgcaaaagctaccacggagacagtggatgcattgagaactggagcaaaagcaatgaaggcaatgcaaaaggcagtgaatattgatgatgtcgacaaaacaatggatgaaataaatgagcaaacagagaacatgaaacaaattcaggaagcattgtcagcacctattggtgcagcagctgattttgatgaggatgagttggaggctgaacttgaagagttagaaggagctgagttggaggaacagcttctgcagccagccaccactgcacctgcagcaccagtgtatgtgccggctggaaaacaccgacacgtccagctcagcaccagaacaaagctgaggaagatgaacttgctgcattgcaggcagaaatggcactttaaagttcatcctggttgaaggatattgtaaagattggatattcaaacaatggagtatgcgtattgtttgtgtgattaacatgatcaacaactttatcgtattaagaacagaataggacctatattctaaggtt

SEQ ID NO: 3791 - DNA, 986 bp, Flaveria ramosissima
tgttcctctgatcatatcaattaatccaactgcaattcttaaaagatttgaggcgttgaagattgtcactctgttgattcaatcgaaggaagtcttctatagaaacaaccatgttttcgcgagtttttggaaaacctaagcaagaagctaatgccgtaacaacactagacaaattaaacgagacacttgaaatgctggaaaagaaagagaaagtacttttgaagaaggcttctgcagaggtggagaaggccaaggactatactaaagcaaagaacaaaagggacggcgatacaatgcttaaagagaaagaaactctatgaacaacaaattgaacagcttgggaacttccagttacgtattcatgaccagatgattatgctagaaggggcaaaagctactacagagactgttgatgctttgagaactggtgcagcagcaatgaaggccatgcagaaggcaacaaatattgatgatgttgacaagactatggatgagataaacgaacaaactgaaaatatgaagctaattcaggaggcattggcaacaccaatgggtgctgctgctgattttgatgaggatgaactggaagctgaacttgaagaactagaaggagctgagttggaggaacagcttcttcagcctgctacaaccgcccctgctgctccagtgcacgtgccagctggcaaacaaccaacacgtccagctcctcagaaaaacactgctgaggaagatgaacttgctgcattgcaagcagaaatggcactttaaagtcggagctctatatacacagattgcgggagatgtactcaaaagaccatggaaattgaagaactgtgttaaaattatattttgtacagttgtgattgtagtctaataaatatcaagttggatatgtggagtacgtaatcgaaggattgagtgttgtattatacttcaaatcatagaggaccgatacactggtttctagattaatgttgttattttcg

SEQ ID NO: 3792 - DNA, 883 bp, Arabidopsis lyrata
cttcgattaatctcatctctcaatcaatcaaagcttcgtatctcaaatccctcagtgtggttttaattaagcaagaatcatctgccaccatgtttatgaatcggctattcgggaaacccaagcaggagaccaatactctccaaacattagacaagctcagtgagactcttgagatgctagagaagaaggagaatgttcttatgaagaaagctaatggagaggttgagaaagctaaggaattctcccgggtgaagaacaaacgcgcggctatacaatgtttgaaaaggaagaggttatatgagcaacaagttgaacagctcgggaatttccagctccgtattcatgatcagatgattatgttagaaggtgcgaaagcaacaacagagactgtagatgctttgaggactggagcttctgcaatgaaagctatgcagaaagcaacaaacattgatgatgttgacaagacaatggatgagatcaacgagcaaactgagaacatgaaacagatccaagaagcattgtcggctccatttggaacagctgctgatttcgatgaggatgaattggaagcagaacttgaagaactagaaggcgccgagctagaagagcaacttcttcagcctgttccaatccatgtgcctcatggaaacaaacctaatcgtgctccagctcaaaagcaacctactgctgaggaagatgaacttgctgccttacaagctgatatggctctctaagctgaagctagccttggaagatttcaggtaagtggggagctttgtgtgtgcattattcaaaacagaaagaaagattttatgtatataaggatccgagtcaaattgatcggaagattttatttttttcaatataattaacttattaaact

SEQ ID NO: 3793 - DNA, 1094 bp, Orobanche aegyptiaca
acgcgatctaatatacgaacgcgactagcgatttttaccttttctgtataaatctgtgtaataattattcgcaaatccaatctgttaagtctccacgtatgaatcaaggctgattttctcatcggatcaaacttacagggtttagggcttccgattttgttttgattttcggtacttgattatatttcggaaaaattaatcatcgaccatgtttacgcgaattttcggaaagcccaagcaagagactaatgctctggcaacactggacaagttaaatgagacgcttgagatgcttgagaagaaagagaaagttctcttgaaaaaagcctcctcggaagttgagaaagcaaaggagtttactagagctaaaaataaaagagctgcaatacaatgtttaaagaggaaaaagctttatgagcaacaaattgaacagcttggaaatttccagttgcgcattcatgaccagatgataatgctagaaggggcaaaagctacaacagaaaccgttgatgctttgagaactggagcagctgcaatgaaagctatgcagaaggcaactaatattgatgacgtggacaagacaatggatgaaatcaacgagcagactgagaacatgaaacaaattcaagaagcactgtcaacaccaattggtgctgctgattttgatgaggatgaattggaggcagaacttgaagaactcgaaggagctgagctggaagagcagcttctgcaacctgcaacaacaactcctgctgctcctgttcgggtgcctgctggaaagcaaccagcatacaaggctgaagatgaggacgatgagcttgccgagttacagagggagatggcactttaaggagattatcagttcaaaattctgaagaaaacataaaaagtatttgctgtaccgtataacggagattatagcttcgagctgccgccccgttttcttaccaaatttcgtggatgtgtattttctggaacagtagaaaactgtatagatgacattaagtaaatttatatctaacttttggcatggaaacaagtgtgttctttaagcattattgggtactctactaaaaacaaaaatcatattttca

SEQ ID NO: 3794 - DNA, 997 bp, Salvia sclarea
ctactagaccttggctgtcactcagaatcatgatttccatccattcctaataatatttcttttgattgtttccgatttttacaaaaaaaaattaatcctttaattcatcaagaagcaaacctggttgattttcccatcggctgaatctgcagggtttaaagattcaattctgtttcatatcgctatagctggtgataaatcatcgacgatgtttactagaatttttggaaagcctaagcaagagacgaatgctctggcaacgttagataagttaaatgagactcttgagatgctggagaagaaagagaaagttctattgaagaaggctgctgctgaagttgaaagggccaaggagttcactcgagctaaaaataaaagggctgcaatacaatgtttgaagagaaaaaggctttatgaacaacaaattgaacagcttggaaatttccagttacgaattcatgatcagatgataatgctagagggagcaaaagctaccacggaaactgttgatgctttgagaacaggagcagctgcgatgaaggctatgcagaaggcaaccaatattgacgacgtggacaagacaatggatgaaatcaatgagcagactgaaaatatgaaacaaattcaagaagctctgtccacgcctattggtgcagcagctgattttgatgaggatgaattggaggcagagctcgaagaacttgaaggagctgagctggaggaacagctcttgcaacccgcaacaacagctcctgctgctcctgttcgagtgcctgctggaaggcaaccagtgaagaatgttgaagacgaggatgatgagctggccgaattgcacagagagatggccctttaaggaggtcattttccaatctatgcttactttggtcaattctatcactgtgatatgtcgttattatctatcagtcccaatctatatgtatgttaccttactagacactatctagtatctaggtaagcaacaatctgcttttgagct

SEQ ID NO: 3795 - DNA, 705 bp, Eutrema halophilum
atctcagtgtggtttgcgaattatcaatcaagaatcagcaatgttgaatcggctgttcgggaaaccaaagcaggagactaatactctccaaacattagacaagcttaacgagactcttgagatgttagagaagaaggagaatgttctcttgaaaaaagctgctggagaggttgagagagcgaaggaattctcccgggtgaagaacaaacgcgcggctatacaatgtttgaaaaggaagaggttatatgagcaacaagttgaacagcttgggaatttccagctccgtattcatgatcaaatgattatgttagaaggtgccaaagcaacaacagagactgtagatgctttgaggactggagcttctacaatgaaagctatgcaaaaagcaacaaacattgacgatgttgacaagacaatggatgagatcaacgagcaaactgataacatgaaacagatccaggaagcattgtcagctccatttggatatggtgctgatttcgatgaggatgaattggaagcagaacttgaagaactagaaggcgcggagctagaagagcaacttcttcagccaacaggacccgctcaaaacggtatacctcagaagcaacctgctcgtcctgcaactcagaagcaacaaaccgctgatgaagatgaactcgctgcattacaggctgagatggctctctaaaggtataaccttttcaa

SEQ ID NO: 3796 - DNA, 786 bp, Eutrema parvulum
tgtggttttacgagttatcaatcaaacaatcagcaatgttgaatcggctattcgggaaacccaagccggagactaatactctccagacattagacaagcttaatgagacacttgagatgctagagaagaaggaaaacgttcttcttaagaaagctgctggtgaggttgagagagcaaaggaattctcgcgggtgaagaacaaacgcgcggctatacaatgcttgaaaaggaagaggttatatgagcaacaagttgaacagcttgggaatttccagctccgtattcatgatcaaatgattatgttagaaggtgccaaagcaacaacagagactgtagatgctttgaggactggtgcttctgcaatgaaagctatgcagaaagcaacaaacattgacgatgttgacaagacaatggatgagatcaatgagcaaacagataacatgaaacagatccaggacgcattgtcggctccgtttggatcagctgctgatttcgatgaggatgaattggaagcagaacttgaagaactcgaaggcgcggagctagaagagcaacttcttcagccagtgagacctgttccaaaccttcctgaacgcaagcaacctgcaactcagaagcaacagaccgctgaggaagatgaactcgctgcattacaggctgagatggctctctaaaagcagaagctggtctcggaagatgaggtttgtgtgtgcattattttaaaacagaaaggaagattgtatgtatataaggatccgagtcaaattgatcggataaattattttt

SEQ ID NO: 3797 - DNA, 1093 bp, Catharanthus roseus
  misc_feature (695)..(698): n is a, c, g, or t
  misc_feature (700)..(700): n is a, c, g, or t
  misc_feature (702)..(702): n is a, c, g, or t
  misc_feature (705)..(708): n is a, c, g, or t
  misc_feature (710)..(710): n is a, c, g, or t
ggaattcgggacgaggaaaggaaggtccctagaccaatatccaatccttttcctcccagaactctcctccctttcttcttcatcggttcatggttcctgaaccggagccctaattctattattatcctatttttccccctctgggaattgttgatccatttaattgaaccgatcgatcgctgactttgaagccctaggtcctatttttcacgaggaaaagcaggagatcagtttttgtatctgcaaccgaataaaatgtttacccggatatttggcaagccaaagcaggagagtaatgctgtcgcgactctagataaattgaatgagacgttagagatgctggagaaaaaggagaaagtacttcaaaagaaggcatcagcagaggttgaaaaggccaaggaattcactagagcgaagaacaagagggccgccatccaatgtttgaagaggaaaaggctctacgaacaacagattgagcagcttggtaatttccagttgcgtatccatgatcagatgatcatgttagaaggagctaaagctacaacggaaactgttgatgccttgaggactggagcagctgcaatgaaagctatgcagaaagcaacaaatatcgatgatgtggataagacaatggatgaaataaatgaacagacggagaacatgaaacagatccaggaagctttgtctactccaannnntncngcnnnngnctttgatgaggatgaattagaggcagaacttgaagaattggaaggtgctgagttggaggaacagcttcttcagcctgcaacaacagcccctgcagcaccagtgcatgtacctgcaccagcaggtcggcaacaggctcggcctgctcctcagaagcaaacagctgaggaagatgaacttgcagcattgcaagcagaaatggcactttgagcagttcaacgcttttgttgattttaagtggtaatttagtcaatatttgcgtatgtgatttaaggttttagaggaccttgcagtcaaactcgtacatcttctgttaatgaaatttaggcatgttgatggaattatctttccaattacccttagtgtatattattattttctggcc

SEQ ID NO: 3798 - DNA, 907 bp, Ambrosia trifida
tcatccaatccaaaattcttcgtatctttcttctaaaacccctcttcaggtttaccttaatctttcattcaatttcgattttgcttgttaatcctcagatcgttccaggaaaagaaaaaaagggtacacaatgttttcaagaatgtttggtaaacctaagccagaagctaccactgtaacaaccttagaaaaattaaatgagacacttgaaatgctagagaagaaagaaaaggtacttctgaagaaagctgctgctgaggttgaaaaggcgaaggaattcaccagagcaaaaataaacgggcggcaatacaatgtttaaagcgaaaacgtctttatgaacagcaaattgaacagcttggcaatttccaattgcgtattcatgatcagatgataatgcttgaaggtgcaaaagctactacggagactgtggacgccttgaggactggagctaaagcaatgaaggcaatgcaaaaggcagtgaatatagatgatgtcgacaagacaatggatgagataaatgagcaaacagagaacatgaagcaaattcaggaagcattatcagcacctattggtgccgctgctgattttgatgaggatgagttggaggctgaacttgaagagttagagggagctgagttggaggaacaacttctacagcctgcaacaactgcacctgcagcaccagtgtatgtgccagctggaaaacaacaaacacgtccagctcctcgccagaacacagctgaggaagatgaacttgctgcattgcaggccgaaatggcactttaaagtttcgactcccacttggaagaaattgtaaagaccggatgctcaaacattgttggtatcatatcaattcgttcacatcaatacgtattgtttgtgtgataacatcaactactttatgtta

SEQ ID NO: 3799 - DNA, 1496 bp, Flaveria ramosissima
atttttcgttttttttatgttttacacccatgcaacacacgggtttgcgactacatttaaatattaatttttacgtcattttacaccctgccgcaaatcgggggtcataatactagttaatattatttaccatttataattattaaagttttaaaaatatagattattgcctttataacccttacaaacaacgttttaaagacttaaaatcaaggcaaataagctgcaaatacaccaaattaataagagtctcatagttcataagtagataactttgactttactgacgtggcattgtatgcaccactctttattcaacttctgctcctcactggatcctgttgcaatctgtggagggactgatcttgtagggcaagttaacaccgcattttccggggagactagcggcgtaatttccgctaacgccgcggtaagaggaagaagcactctttaaacaattacaaatggccttacggtcagccgtggttcgtgcttgattcctaagccctctgatcccattacaacaaacaggtggcggattcccaccatttcttaggtatccgaggcacggtgctacagcgcccaccacctgaccacatgtcaccgcctccacctttgctacaatcattgtttgcaacaacaccaccatgcacaacgccttaacatacatacttgtcatcgttagagtgacaattgatgggactaaatattttaaaagcaaatgctaatcgaatgtccccgcgtacggtgtacacaggttaccaactaccctttgatccccacgataatcacctccgcttgttaatcttcagattgtggggtttcgaggaaaagaagggttacgatgttttcgcgaatgtttggtaaacctaagccagaagctaacactgtaacgacgttagacaaattaaatgagacactagaaatgctagagaagaaagaaaaggtacttttgaagaaagctgctgcagaggtggaaagggcaaaggaattcactagagcaaaaaataaacgggcggcaatacagtgtttaaagcgaaaacgactctatgaacagcaaattgaacagcttggcaattttcagttgcgtattcatgatcagatgataatgcttgaaggtgcaaaagctacgacagagacccggtggatgccttgagaactggagctaaagcaatgaaggcaatgcaaaaggcagtgaatattgatgatgtcgacaagacaatggatgagataaatgagcaaacagagaacatgaaacaaattcaggaagcattatcagctcctattggtgcagctgctgatttcgatgaggatgagttggaggctgaacttgaagagttagaaggagctgagttggaggagcagcttctacagcctgccacaactgcacctgcagcaccagtgtatgtgccagctggaagccaaccatcacgtccagctcctcgcaagaataccgctgaggaagatgaacttgctgcattgcaggcagaaatggc

SEQ ID NO: 3800 - DNA, 1036 bp, Phaseolus coccineus
gcaaaccaaagctcagacaacccaaaaccaccgttctctgtttctccctttcccttctcttctccgatccaatccctaatccctaatctttctcactctcacttcaacatccaattttttcaacagggaagatcggttgaagaatcgaggatttcttcgctttcgaggcagtagagtttgaatcgaccgcaatcatgtttagccgcatgtttggtaaacctaaacaggagaccaatgctgttgccactttggacaagttaaacgagactcttgaaatgcttgagaaaaaggagaaagtgctccttaaaaaagtgtcagcagaagttgaaaaggccaaggagttcacaaaggggaagaacaaaagggcggcaatacaatgtctgaagcggaagaggttgtatgaacaacaaatagagcagcttggaaatttccagttgcgtattcatgaccagatgataatgttggaaggggctaaagccaccacagaaactgttgatgcgttaagaactggagctgctactatgaaagctatgcaaaaagcaacgaatattgatgatgttgacaagaccatggatgagatcaatgaacagactgagaacatgaaaatgattcaggatgcattatcagctccaattggtgcagctgctgattttgacgaggatgaattggaagcagaacttgaagaactggaaggtgctgagttggaagaacagcttcttcagccggcaactacaactcctgcagccccagtgcatgtcccagctgggcggcaacctactcgccctgttgctgcaaagccaactcctgaagaagatgaattggcagctttgcaggctgagatggcactttgagcagaattttgcaggcatttttgtgcatgaggactggtggcttcagtgaagaattgtaagatggaggtttctgtttatctttgtgaaattatggaacagaccagataatgtatataagggggcaattgaacatgaaagtggttcataaagaaaaacttactagttttattttggatgagttcgaa

SEQ ID NO: 3801 - DNA, 1150 bp, Castanea mollissima
ctcacttcgaagctttggaacccccacaaaatttctaccgtgttttccttgttctaatcggtcaagaatcattgatcaacctatttgatttttgatattgttgcagggtttaaaattgtttctgattttgttgttttcagaaatcagagagtgttttctaagcaccgaaacagatcaatcatgtttcagcgaatgttcggaaagcctaagcaggaaaccaacgccttaacaacgttggacaagttaaacgagacacttgaaatgctagagaaaaaggagaatgtccttttgaagaaggcttctgcagaggttgaaaaggctaaggaatttactagagcaaagaacaagaaggctgcaatacagtgtttaaagaagaagaagctttacgaacagcaaattgaacagcttggaaatttccaattgcgcattcatgatcagatgatattgttggaaggtgctaaagctacaacagaaactgttgatgcattgagaactggagcagctgccatgaagcaaatgcacaaggcaacgaatattgatgatgtggacaaaacaatggatgagatcaatgagcagactgagaacatgaaacagattcaggaggcactgtcagcacccattggtgcagcagccgattttgatgaggatgaattggaagccgaacttgaagaactggaaggtgctgagttggaggaacagcttcttcagcctgctactactgctcctgcagctccagtcaatgtcccggcaggcaggcaaccaacgcgccctgttgctcagaagaacaaagctgaggaagatgagcttgctgcattacaggcagagatggcactctaagagttggtattgcaaagtgggtgaatatcatttaaaggttgaagctgctgcataattgaggcttgaggctacatttccataagagaaatcgagaaattctccttatctactgtttgtgtatatggcttaaaatatatcaggttctatctataatttgtagtttacctcgttgttttccgaacaaatgtggcagattcctatcaaaaaaatatattctcgtagggttatgatatatttcatatatttaagaaataaatagtgtgtcatggcatgtacaaagctttccttattgctttaattgccaaaatcatgg

SEQ ID NO: 3802 - DNA, 1493 bp, Quercus alba
taccttccattttccaagctagcttttctgtaacgtcctacaagctatagtttctcttacaacaatcaaaaaagcaacaacacacaaaaccaacatagttctcttacatatcttccgacactcaacaaagactcgtccgtcacattaactcccttcacagcccgtcaccaaaacccacccacctctttcttcgataataccagtcttacccacccacgccaagtctctcccatatcgacacctttctcacttcgaagctttgaacccccacaaatttctaccattccttccgtgttcttgatcggtcaaaaatcactgatcaacctgtttgatttttgatactgttgcagcgttttaaattgtttctgattttgttgttttcagaaatcagagagtgttttctaagcaccgaaacagatcaatcatgtttcagcgaatgttcggaaagcctaagcaggaaaccaacgccttaacaacgttggacaagttaaacgagacacttgaaatgctagagaaaaaggagaatgtccttttgaagaaggcttctgcagaggttgaaaaggctaaggaatttactagagcaaagaacaagaaggctgcaatacagtgtttaaagaagaagaagctttacgaacagcaaattgaacagcttggaaatttccaattgcgcattcatgatcagatgatattgttggaaggtgctaaagctacaacagaaactgttgatgcattgagaactggagcagctgccatgaagcaaatgcacaaggcaacgaatattgatgatgtggacaaaacaatggatgagatcaatgagcagactgagaacatgaaacagattcaggaggcactgtcagcacccattggtgcagcagctgattttgatgaggatgaattggaagccgaacttgaagaactggaaggagctgagttggaggaacagcttcttcagcctgctactactgcccctgcagctccagtcaatgtcccggcaggcaggcaaccaacccgccctgttgctcagaagaacaaagctgaggaagatgagcttgctgcattacaggcagagatggcactctaagagttggtattgcaaagtgggtgaatatcatttaaaggttgaagctgctgcataattgaggcttgaggctacatttccacaagagaaatcgagaaattctcctcatctactgtttgtgtatatggcttaaagtatatcaggttctatctataatttgtagtttacctcgttgttttcagaacaaatgtggcagattcctatcaaaaattatattctcgtagggttgtgacatatttcatatatttaagaaataaatagtgtgtcatggcatgtacaaagctttccttattgctttaattgccaaaatcatggagtttgggaggtttggtccaccaccccccctccccccttttttttacttattccatgtagtctttgttttggcttattaagattaaagtacactttgtag

SEQ ID NO: 3803 - DNA, 926 bp, Helianthus annuus
gtttgcttcttctttgttcctctgatcatatcaatctattcaactgcaattcgtaaacgatttaaggaattgaagatcgtcactctgttgattcaaccgaagcaagtaatcatgtttactcgagtttttggaaaacctaagcaagaacctaatgccgtaacatcattagacaaattaaacgagacacttgaaatgctggaaaagaaagagaaagtgcttataaagaaggcttctgcagaggtggagaaagccaaggactatactaaagcaaagaacaaaagggcggcaatacaatgcttaaagaggaagaaactctatgaacagcaaattgaacagctggggaacttccagttacgtattcatgaccagatgatcatgctagaaggtgcaaaagctaccacagagactgttgatgcgttgagaactggtgcatcagcaatgaaggccatgcagaaggcaacaaatattgacgacgttgacaagaccatggatgagataaacgaacaaactgaaaatatgaagctaattcaggaggcattggcaacaccaatgggtgccgctgctgattttgatgaggatgaactggaagctgaacttgaggaactagaaggagctgagttggaggaacagcttcttcaacctgccacaaccgcccctgctgctccagtgcacgtgccagctggcaagcaaccaacacgtccagcacctcgccaaaacactgctgaggaagatgaacttgctgcgttgcaagcagaaatggcactttaaaagaggtctatttgcggatggctggagttttactcgaaacaccatgagaaacagaagaaatgtgttcagttatatcttgtacagttgtgattgtagactaataataataaatataaagttggagagtctggagcatgtaagtgaaagatttgagtgtt

SEQ ID NO: 3804 - DNA, 1044 bp, Juglans hindsii x Juglans regia
  misc_feature (103)..(103): n is a, c, g, or t
  misc_feature (169)..(169): n is a, c, g, or t
  misc_feature (293)..(293): n is a, c, g, or t
  misc_feature (722)..(722): n is a, c, g, or t
  misc_feature (1027)..(1029): n is a, c, g, or t
ggggacttcgactatttttctcgtcacaaaaactctctctctctctctctctctccgtcttctcgaccaccaacccccgagtcttttccagaactacctttcncacttccaagtttgaaccctacaggctcaaaattttttcatttttctcgttttccggcattagagngtgtttaccaatacacaaaacaaaccaatcatgtttcagcgagtgttcggtaaacctaagcaggagaccaacgcattaacaacgttggacaagttaaacgagacacttgaaatgctagagaaanaagagaatgtccttttgaagaaggcatctgcagaggtcgagaaggccaaggaatttactagagcaaagaacaaaaaagcggcaatacaatgtttaaagaagaagaagctttacgagcagcaaattgaacagcttggaaatttccaattgcgtattcatgatcagatgatattgttggaaggtgctaaagctacaacagaaactgttgatgcattgagaactggagcagctgctatgaaggccatgcacaaggcaacgaatattgatgatgtcgataagacaatggatgagatcaatgagcagactgagaacatgaaacagattcaggaggcactgtcagctcccattggtgcatctgcggattttgatgaggatgaattggaagcagagcttgaagaattggaaggagctgagttggaggaacagcttnttcagcctgctactactgctcctgcagctcctgtacatgtcccagcaggccggcaaccatcccgtccttttcctcggaagaacaccgctgaggaagacgagcttgctgcattacaggcagagatggcactctaagagttacagacgcatagtgggtaagtgctgtacgatggaagaagtttgacggcttcaaccctccccatgtgaaattgaaaaattctccatatcaactgtttgtatatatggctttaagtacattacattctatctagaatttgtaacctgatgtttcctaaacaaatcatnnnccaactttatttgga

SEQ ID NO: 3805 - DNA, 1259 bp, Artemisia annua
aaccaatacgcctaagcaaagcaaaaacaaaccaagtcagtcctctttaatcaatcacatcccattcattcattcattattcacttttctcatccaatccatttctcacatatttcatttccaatcactttgattattaatacccacttgttaaattatcccaaagattagatcaagatgtttcaaaggatgtttggcaaacctaagcaagaatctaacgctgttgttactttagacaaattaaatgagacgcttgaaatgctagagaagaaagaaaaagtacttctgaagaaagcttctgcagaggttgaaaaggcaaaggaatacactagagcgaaaaataaaagatcggcaatacagtgcttaaagcgaaaaagactttatgagcagcaaattgaacaacttggcaattttcaattacgtatccacgatcagatgataatgcttgaaggtgcaaaagccaccacagagactgtggatgccttgagaactggagctcaagcaatgaaggcaatgcaaaaggctgtgaatattgatgatgtggacaagacaatggacgagataaatgagcaaacagagaacatgaaacaaattgcagacgcattggcagcacccatcggcgcatcagctgattttgatgaggatgagctggaagctgaacttgaggagttagaaggagctgagttggaggaacagcttctacagccacctgcacagacaccgccacagtatgtgccacctggaagacaaccaacacgtccacctccccgcaagaacactgctgaggaagatgagcttgctgaattgcaggctgaaatggcactttcctagtttcaactcccagttggaagaatttgtaaagatcgaatattcaaacaatggagctgtgcgtatgtttatttattcacagaaacatgtattgtttttgtgataacatgatcaatgtctttcttattaggaaccaaaaaggattgccgttccttttttctatttttcatctgttggtgtgtgtcatatgggaattctgggttgtacgatgttgatgttggtaatttgagtttcttttttgttttgtttttaatagtagaaagtacagtactattactaatatttatggtgatacacatataacatctgttttctaataaaatgttacgatattgctaaatgatgtcacaatgacgacaacagcttgttcactatcagttgtgtatgatggttaacgcaagtaagctgccaatacagtcgtgtttagtgtg

SEQ ID NO: 3806 - DNA, 1010 bp, Utricularia gibba
gtggccgggtcgttggtatccattttgatcttgatcctgtgttacgatcttatatcaacgcgattgaatcgctgttgtgttgcaggatctgagggtcgcttttccctttattattattcttgtcggcgagaaagtggtcaccgatgttgaacaggttgtttgggaagcctaaacaggaggcgaatgctctccaaacgctcgataaattaaacgagactcttgagatgctcgagaaaaaagagaaggttcttttgaaaaaagctgcggacgaagttgaaagggccaaggagttcactagagctaaaaataaaactgctgcaataagatgtttgaagaggaagaagctttacgagcaacaaattgaacacctgggaaacttccagttacgcattcatgatcagatgattatgctggagggtgcaaaagctacaacagaaacagttgatgctttgagaactgcagcatctacaatgaaggctatgcagaaggcaactaatatcgatgatgttgacaagacaatggatgagatcaatgagcagaccgaaaatatgaaacaaattactgaagcactggctacaccgattggagcagcagctgattttgacgaggacgaattggaggcagaattagaagaactggaaggggccgaactagaggaacagcttctgcaacctgcaactaaagctccttctgctcccattcgacaaccaccaaagaaagaacgtgtggatgagcacgaggatgagcttgcggaattgcagagagagatggctctttaaggtcggtcccagagatcctataagaatacggagaataagctgctgtggatgatcccttcttcttgtatagcccgacatcaacaacttgattatgcttggattggtaagaagagtgcatgctttgtcgttcgttgttatatgcattattattattgtgagtatatctgtctctgacctttgtccaaaccaaatacatgatgtgtgttcaaactggaatgcctcttattttca

SEQ ID NO: 3807 - DNA, 1062 bp, Cichorium intybus
gacgcttggacgccatgcttttaacctcaatcacttcccaaatcccaactttacacccagatcaattcagttacttttcctttttccttttcttcctgtgatcatatcattcgaatccaactgtagatcataaaagatataaggtgttgaagatttccactttattgattttaccgaagctgatcttatatagaaacaatcatgcttacacgagtgtttggaaaacctaagaaagaaacttctaatgccgtagcaacattagacaaattaaacgagacacttgaaatgctggagaagaaagaaagagtacttttgaagaaggcttctgctgaggtggaaaaggctaaagactataccagagcaaagaacaaaaaggcggcaatacaatgtttaaagaggaagaaactctatgaacaacaaattgagcaacttggaaacttccaattacgtattcatgaccagatgatcatgttagaaggtgcaaaagctacaacagagaccgttgatgctttgagaactggtgcagctgcaatgaaggccatgcagaaggctacgaatattgatgatgttgacaagactatggatgaaataaatgaacaaactgaaaacatgaaacaaattcaagaagcattagcaacacccatgggtgcagctgctgattttgatgatgatgaactggaagctgaacttgaagaattagaaggagccgagttggaggaacaacttctccaacctgccaccaccgcccctgccgccacggttcatgttccggcagggcggcaaccactgcggcccgcacctcggcagaacaaagctgaggaagatgaacttgctgcattgcaagccgaaatggcactttaagaaaagtatttgcagggtaagggaaatgtattgatacatacaccatgaaaaactgaagaactgtgttgaattatgtctttgtacagtcgtgattgtagactaaataacaagttgggaattgggagtacgagtgttgtattatacattgcaaatcataaagaactaataagttatactgtaaaaaaagagggggcccggtac

SEQ ID NO: 3808 - DNA, 949 bp, Lactuca sativa
accatatcattcattgcttttctcctttgttcttctgatcatatcatttgaatccaactgtagatcataaaaagatttaaggcgttgaagattgccactttattgattttaccaaaggcgatcttatagagaaacaatcatgtttacacgagtgtttggaaagccaaagcaagaatcttctaatactgtaacatcattagacaaattaaatgagacacttgaaatgctggagaagaaagaaagagtgcttttgaagaaggcttctgcggaggtggagaaggccaaagactataccagagcaaagaacaaaaaggcggcaatacaatgtttaaagaggaagaaactctatgagcaacaagttgagcaacttggcaacttccaattgcgtatacatgaccagatgatcatgttagaaggtgcaaaagctaccacagaaaccgttgatgctttgagaactggtgcagcagcaatgaaggccatgcagaaagcaacgaatattgacgatgttgacaagactatggatgaaataaacgaacaaaccgaaaacatgaaactaattcaggaggcattggcaacacccatgggtgcagctgctgattttgatgatgacgaattagaagccgaacttgaagaactagaaggagccgagttggaggaacagcttctccaacctgccaccaccgctcctgccgctccggtgcaggttccggcagggcggcaaccaccacgccccgctcctcagaaaaacacagccgaggaagatgaacttgctgcattgcaagccgaaatggcactttaagaaaaggttacaggagatgtattgaaacatacaccatgaaaaaactgtgttaagttatttcttgtatagtttgtgattgtagactaaataacaagttggaattcgagtgttgtattatacattgaagatcataaagaacccacaacttat

SEQ ID NO: 3809 - DNA, 1067 bp, Fagopyrum esculentum
ttccgcttccttcttcgatctccgattctccgtcgctccctgtctctttcagttgcctcctgtggttggaacttgttagcccagtgactttcggtctctaaaagatcgattcgatccttttactctatttcaatcaaatttgatcatcaggattttggttcgtcttcaaggattcgacaatgtttactcggatgtttggtaaacctaaacaagaaaccagcactgttgccaccctcgataagatggcggagacactggaattgttagagaagaaagagagtgtcctttcgaaaaaggctgccgaggaggttgagaaggccaaggcttttaccagagcaaagaacaaaagagcggcaatacagtgtttgaagaggaaaagactttatgaacagcaaatcgagcaactaggaaatttccagttgcgcattcatgatcaaatgataatgttagaaggtgcgaaagctaccactgaaactgtggacgctttgagaaccggagcagctgcaatgaaggccatgcaaaaagcaacgaacattgatgatgttgataaaacaatggatgaaatcaatgagcagacggagaatatgaagcaaattcaagaggcactgtcagctccaattggtgcagccgctgattttgatgaggatgaattggaagctgaactagaagaacttgaaggtgctgaattggaagaacagcttcttcaacctatgtttcccacacctttgccgactgttaaagaccaatcaggcaaacaagctgctcgtcctactcctcagaggcaaacagccgaggaggatgaacttgcagcattgcaagcagaaatggcactttgaggtattaattgctacagaggactcatatatttgctgaattgcttcatgggattatttctacttgtctctgtattattacttatacttcatgcacttcagaatctgtacagagaagtttgaagatacaatcatttatctggtatatttttattgtcttcatcttgagatctgtttgcttgtgatcttctgtttatcagaattgcttgataagacacaatgatttttacaagt

SEQ ID NO: 3810 - DNA, 918 bp, Flaveria ramosissima
aacaatgtttacgcgattgtttaggaagcctaaacaagatgctaacgctgtaacgacgttagataaattgaatgagacacttgacatgctagagaagaaggagagtgtgctgttgaagaaagctgctgctgaggtagaaagggcgaaggagtttactagggctaaaaacaaaagggcggcaatacaatgtttaaagcgaaagaaactatatgaacagcaagttgaacaacttggaaattttcaattgcgtattcatgatcagatgataatgctagagggtgcaaaagctaccacagagactgtggatgctttaagaaccggtgctcaaacaatgaaggcaatgcagaaggcaatgaacattgatgatgttgacaaaacaatggatgaaataaatgagcaaaccgaggacatgaaacaaattcaggaagcattgtcaacacctattggtgcagcagctgattttgatgaggatgaattggaagccgaacttgaagaattagaaggagcagagctggaagaacaacttctccagcccgccacaactgctcatgcggtgccaatgtacgtccctgctggcaagcaaccagcacgtccagctcaacgccagaacacagctgaggaagatgaacttgctgcattgcaggcggaaatggcattataaacagtttcactttcatttggatatagatctggaagattacagtgcctttaatcattctccatggtggtcaagggatataacatggcaaatgacacgtaaagatatcaatatgatgacacgggatgatgattcttttcggtcttccttagtcatgctgatagtatttgctaccaggataatggatgtgaataagagaactattgaacagaatcatttcgttatgtttgacaacatttaaccgtgtattacacgagttg

SEQ ID NO: 3811 - DNA, 1139 bp, Flaveria ramosissima
ggaagcggatgacccaatttccttgtatcttcttccttccaaagtcatcatcattcaataacactttgtcatccacacatacattcatcctcaatacactttccattcattcaccatcttcttcgcaatcgatcgcattcaaaatcatcatttaattcttctgatcaccctcatacgtgctgactaccaggagcaaagagtctgactaacaatgcttacgcgattgttccgaaaacccaaacaagatgctaacgctgtaacgacgttagataaattgaatgagacacttgacatgctagagaagaaggagagtgtactgttgaagaaagctgctgctgaggtagaaagggcaaaggagtttactagggctaagaacaaaagggcggcaatacaatgtctaaagcgaaagaaactatatgaacagcaagttgaacaacttggaaattttcaattgcgtattcatgatcagatgataatgctagagggtgcaaaagctaccacagagactgtggatgctttaagaaccggtgctcaaacaatgaaggcaatgcagaaggcaatgaatattgatgatgttgataaaacaatggatgaaataaatgagcaaaccgaggacatgaaacaaattcaggaagcattgtcaacacctattggtgcagcagctgattttgatgaggatgaattggaagctgaacttgaagaattagaaggagcagagctagaagaacaacttctccagcccgccacaactgctcatgctgtgccactgtacgtccctgctggcaagcaaccagcacgtccagctcaacgccagaacacagctgaggaagatgaacttgctgcattgcaggcggagatggcattataaacagttccactttcatttggatttagattgtgaaaattgctgcgcctttaataattctccatggtggtcaagggatataacatggcgagtgacatgtaaagatataaatatgatttgaaatgagacaatggttcttttttcggcttccttagtcattctgatggtatttgctaccaggataatggatgtgaataagagaactattgaacagatcatttgtatgttggacatgaactaattgaagtatcggtatataagggttgtaaaaacg

SEQ ID NO: 3812 - DNA, 780 bp, Flaveria ramosissima
ttctttcattcaattaactattatgcctcacaaaccttagatacacaggttaccaactatcctttgattcccacgatactcaccccttcttgtcaatcttcagatcgtggggtttcgaggaaaagaagggttacaatgttttcgcgaatgtttggcaaacctaagcctgaagctaacactgtaacgacgttagacaaattaaatgagacacttgaaatgctagagaagaaagaaaaggtacttttgaagaaagctgctgctgaggttgaaagggcaaaggaattcaccagagcaaaaaataaacgggcggcgatacagtgtttaaagcgaaaaagactttatgaacagcaaattgaacagcttggcaattttcagttgcgtattcatgatcagatgatcatgcttgaaggtgcaaaagctaccacggagacagtggatgccttgagaactggagcaaaagcaatgaaggcaatgcaaaaggcagtgaatattgatgatgttgacaagacaatggatgagataaatgagcaaacagagaacatgaaacaaattcaggaagcattatcagctcctattggtgcagctgctgattttgatgaggatgagttggaggctgaacttgaagagttagaaggagctgagttggaagagcagcttctacagcctgccacaactgcacctgcagcaccagtgtatgtgccagctggaagccaaccatcacgtccagctcctcgcaagaacaccgctgaggaagatgaacttgctgcattgcaggcagaa

SEQ ID NO: 3813 - DNA, 968 bp, Centaurea maculosa
  misc_feature (56)..(56): n is a, c, g, or t
  misc_feature (90)..(90): n is a, c, g, or t
  misc_feature (397)..(397): n is a, c, g, or t
  misc_feature (811)..(811): n is a, c, g, or t
  misc_feature (844)..(844): n is a, c, g, or t
  misc_feature (906)..(906): n is a, c, g, or t
ggatcctggtcgcctctgtgtagaatatgtgcggttaaaaagaagtaaccaaaaangagggtcggttgcatatcgatgcgctggttttanccgatcgatcacttggaagtataaacccatatcaattcaattacttcttcttcttcgttcctaattcgaatccaactgtagaggatcataaaagatttaaggtgtagaagattttcgcagtattgattctactgaaggcgatcttattcgaaaaacaatcatgtttacgcgagtttttggaaaacctaagcaagaagctaatgcagtaacaacattagacaaattaaatgagacacttgaaatgctggagaagaaagagaaagtacttttgaagaaggcttctgctgaggtggagaaggctaaagantatactagagcgaagaacaaaagggcggcaattcaatgtttaaagaggaagaagctctatgaacaacaaattgaacagcttgggaactttcaattacgtgttcatgaccagatgattatgctcgaaggtgcaaaagctaccacagagactgttgatgctttgagaactggtgcagcagcaatgaaggccatgcagaaggcaacgaatattgatgatgttgacaagactatggatgagataaatgaacaaactgaaaatatgaaacaaattcaggaggcattggcaacccccattggtgcagctgcagattttgacgaggatgaactggaggctgaacttgaagaactggaaggagccgagttagaggaacagcttctccaacctgcgacaactgcccctgctgctccagtgcangctccagctggtaggcaaccaacccgcccagcncctcggcaaaacactgccgaggaagatgaacttgctgcattgcaggcagaaatggcactttnaaaaacagatcactagacatgtatcctccatacaccatgaaaaaaccgaagaagtgtgttat

SEQ ID NO: 3814 - DNA, 1130 bp, Sequoia sempervirens
ttttaattgaaaggagggctgtgatataaggaattatcaaaatgttcagcaggatttttgggcgtcccaagcaggacactagtactctttcaactctcgacaaactcaacgagactcttgagatgctcgagaagaaggaaaaagtactacaaaagaagattcaaggagaggtggaaaaggccaaggagttcactcgtgcaaagaataagagagcggcaatacaatgcttgaagagaaagcggctttatgaagtgcaagttgagcagcttggcaatttccagttaagaattcatgatcagatgatcatgttggaaggtgcaaaagctacaacagaaactgttgatgcattgcggactggagcatcagccatgaaagcaatgcagaaggcaactaatattgatgatgtggacaagacaatggatgagatcaacgaacaaactgagaacatgaaacagattcaggaggcattgtcgacgcctattggtgcagctgcagattttgatgaagatgaattagaagctgagcttgaagaattagagggtgcagaattggaggagcaactactgcaaccggccacaaccaccccagcaatgcctgcacaatatgttccagctggcaagcagcccacacgaccagcaccccagaaaatgcgtccacagaatacagccgaggaagacgaacttgctgcactgcaggcagagatggcaatgtaaagaaggcagtccatcaattcaagcaggttgtaagaacttttaatacataatacctgcttattagtgttcaatttggacattaatctactaatgaagctctgtatgagttcaataattgtcacgtttttgttattccatgatgttttatggagcagagagacctatggattatactaagattgttgttaatctcaatgaatatattctcatggggtgggttaggtatatgcaaaaaaattgtgattttaaatttctattttaaatatgaagtaatggttcatattgggttgctgtgggtatcaggtattgttggaggatgacaatttgaacaccatggttggttcacaactttccatggtgccatcctcttatgaatttgtaaaaaggaatgctgtattttacatttttagtgctgag

SEQ ID NO: 3815 - DNA, 1157 bp, Glycine max
gttcatctccacttttcttcaacaccatctttctctttctttttatttttatatttttgtcaattgttcgattcttttggtgttccagggagatcgattgataccgtcccgttgattttccaattcgacgaataagggtatcacatctcttaatcaaccatgtttacccgaatttttggtaaacctaaaccggaagtcaatactctaaccgctttagacgagttaaatgacaaacttgaaatgttagagaaaaaggagaaagtactcctaaaaaaggctgcagcagaagttgaaaaagccaaagaattcactagggcaaagaataaaagggcggcaatacaatgtttgaagaggaagaggctatatgaacagcaaatagagcaacttggcaatttccagttgcgtattcatgaccagatgataatgttggaaggtgccaaggctaccactgaaactgttgatgcattgagaactggagccgctgctatgagggctatgcaaaaagaaacgaatattgatgatgttgacaagactatggacgagatcaacgaacagacagagaacatgaaacaaattcaggaagcattgtctactccaatcggagcagctgctgactttgatgaggatgaattggaagcagaacttgaagagctagagggtgctgaattggaagaacagcttcttcagcctgcaactacagctccagctgctccagtgcatgttccagctgggtggcaacccactcgccctgtgtcttcgaagcccactgccgaggaagatgaattggcagctttgcaggctgagatggcactttgagcaagtcccttttctcagatgcgacactattgatttatgctatctattcattaatctgttctagtttgttggtattgcaattaaggtggcagttgagtgaatttgtgtgtgcaccagtttcatgttaaatatcaacctttgcacagttgagttcacttgtataataatagtttggaatgaattccctaaagttgcttgtcaggaaaagtttgacgatcttattttatgcagtttttattgattttgcagctggctttgattaggccagaactttacaggcattgatgttcattataagtggcctcttttaaaatcaaagagtgacacagagaattctgccc

SEQ ID NO: 3816 - DNA, 949 bp, Triphysaria pusilla
aaacacgcaaccaaacacgcctatactctctttccttttgacttccatcgatttaatcctaatctttgatcctgaagcatctgttcatccgattatcaggattgttaatatttgaagcagagaattaagatcgaacttgaactttgattgatcatatcaaagatgttttctcggattctaggcaaacctaagcaggagactaatgctctcgtcacccttgacaaattaaacgagacgcttgagatgcttgagaagaaggagggtgttcttcaaaagaaagcaactgcagaggttgagaaggccaaaacatatacaaaagctaagaacaagagagcggctatacagtgtttgaagaggaaaaaactctatgaggaacagattggacagctagcaaatttccagctgcgcatacacgatcagatgatactgttggaaggtgcaaaagctactactgaaactgtggatgccttgagaagtggagctgctgcaatgaaagcaatgcagaaagccacgaatattgatgacgtggacaagacaatggatgagattaatgagcaaacagagaacatgaagcagatacaagaagctctttcgacacctattggtgcagcggccgactttgatgaggatgaattggaggctgagctagaagaattggaaagtgcagagttggaggaacaacttcttcagcctgcaaccacagcccctgctgccccgttcaaggctggagctggcagagtccctactcggcccgttcctcagaaacgaaccgaggaggaggatgaacttgctgctttgcaagctgaaatggcgctttaagcagcctctttccattgtgttaaactgttaatgggaggacagtgtgtgaagaatgatgataaaatgtggagaatccaggagttgactttcatccacgctcgagagtttgttatacatctgctggttgtgt

SEQ ID NO: 3817 - DNA, 1118 bp, Triphysaria pusilla
gctacaaacaattcccacaaatttaagtctcctcgactcgaagaaatcaagctgattttctcatcggtttgaatctacagggtttcaattttgatttttcaatacttgattatagtttggaaaaataaataaccgacaatgtttacgcggattttcggtaagccaaagcaagagactaatgctctggcgacgctggataagttaaatgagactcttgagatgcttgagaagaaagagaaagtcctgttgaagaaagcttcctccgaagttgaaaaggcgaaggagtttactaaagttaaaaacaaaagagctgcaatacaatgcttaaagaggaaaaggctttatgagcaacaaattgaacaacttggaaatttccagctacgcattcatgaccagatgatcatgctagaaggggcaaaagctactactgaaactgttgatgctttgagaactggagcagctgcaatgaaagctatgcagaaggcaactaacattgatgacgtggacaagacaatggatgaaataaacgagcagactgaaaatatgaaacaaattcaagaagcactgtcagcaccaattggcgcagcagctgatttcgatgaggatgagttggaggcagagcttgaagagcttgaaggagctgagctggaggaacagcttctgcaacctgcaacaacagctcctgctgctcctgttcgagcacctgcaggaaggcaaccggtaatgaaggttggggatgatgatgatgagctggccgaattgcagagggagatggccctttaaggagatatcagttccaaaaactgaagaaactgtaaaaatgttggctgtactgtaatggagatcacagattgagctgctgccctcattcttcagaccaaatttcgcggatgtgcattttcctaaatataaaactgtatagatgatgacctcaattaatttcaatattcaactttgttttgcctgtgttttgtgcatgcatgcatattttctcattttaatgtggaatttggggtgtgttattttttacatattcataatatttgtttattcccggggattcgacgaaacaaatcttatttactggcattgcgacattgtgtttactaaaaaaaaaa

SEQ ID NO: 3818 - DNA, 1082 bp, Lippia dulcis
acttcaaattctcaaaattcaactacagcgtaaaattgaatcccataaggatttaccggaaaaaccaaggctggttattgtcgatcgaagctcgggttagtaagattgcataattgcaacgaagggtttaaggatttgttgcttcatttcgaggatatagtagtaattttggtatataaatcgtccacgatgtttacgcggatttttggaaagcccaagcaagagacaaatgctcttgcaacattagataagttgaacgagactcttgagatgctggagaaaaaagagaaggttctcttgaaaaaggctgctggagaaattgaaaaggccaaagaattcactaaagctaaaaataaagggctgctatacaatgtttgaaaaggaaaaggctttacgagcaacaaatagagcagctggggaattttcagttacgcattcatgatcagatgataatgctagagggagcaaaagctacaacagaaactgttgatgccctgagaactggagctgctgcaatgaaagccatgcagaaggctgtgaatatcgatgatgtggacaaaacaatggatgagatcaacgagcagactgaaaatatgaaactaattcaagaagcattgtcaacaccaatcggtgcagcagctgattttgatgaggatgaattggaagctgaactcgaagaacttgaaggagctgagctggaggaacagcttctgcaacctgcaacaacattccctgctgcccccattcgagtgcctgctggaaggcaaccagcaaacaaagttgaagatgaagatgacgaacttgctgaactacagagggaaatggccctttaatgagttgttgagtatggagtcgggaagaaatcatggtacgacgccatatgaaaggttattcatgggtgtgcattatctatctgaagattctgaacagagacccttgtaaggtttgtgtgctacgaccataactgcactattgtgaccatctgtgtttaagaaagttaatataatctctcttctcatttcaatcctcgatgatttcctcttggctaataattactcaatattgatagtgcaataaaaaga

SEQ ID NO: 3819 - DNA, 889 bp, Lippia dulcis
cagcgaaagtacatcgacgatgtttacaagaattttcggtaaagcccaagcaagagacgaatgctctggcaacgttagataagttaaatgagactcttgagatgctggagaaaaaagagaaagttctcttgaagaaggctgcttctgaagttgaaagggccaaggagttcactcgagctaaaaataaaaagggactgcaatacaatgtttgaagagaaaaaggctttatgaacaacaaattgaacagctgggaaatttccagttgcgaattcatgatcagatgatattgctagagggagcaaaagctaccacagaaactgtagatgctttgagaacaggagcagctgcaatgaaggctatgcagaaggcaaccaatattgatgatgtggacaagacaatggatgaaatcaacgagcagactgaaaacatgaaacaaatccaagaagctttgtccacgcctattggtgcagcagctgattttgatgaggatgaactggaggcagagctcgaagaactcgaaggagctgagctggaggaacagctcttgcaacctgcaacaacagctcctgcagctcctgttcgagtgcctgcaggaaggcaaccagcgaagaaggttgaaaacgatgatgatgagctagccgaattgcagagagagatggccctttaaggagattcaaactcccccaagtccagaggagctgtaaaattctttctgtataacggagagccgtagcttgagctgctgtgtccatattttccgatcaaatttcaatgtacgtttctttgtttggaaagaaacctgtatagattattatcaagaaaatttattcttcttcaatttgtgaggggggatgaagtgtgctgctgctactaaatttatgactttggc

SEQ ID NO: 3820 - DNA, 963 bp, Arnica chamissonis
ctcctttgttctctgatcatatcaatcaatttaactgcgattcttaaaagatttgaggcgttgaagcttgtcactctgttgattcaaccgaagaaagtcttgtatagaaacaaccatgtttaagcgagttcttggaaaacctaagcaagaagctaatgcggtaacatcattagacaaattaaacgagacacttgaaatgctggaaaagaaagagaaagtactcttgaagaaggcctctgcagaggtggagaaggccaaggattatactaaagcaaagaacaaaagggcggcaatacagtgcttaaagagaaagaaactctatgaacagcaaattgaacagctcgggaacttccaattacgtattcatgatcagatgattatgctagaaggtgcaaaagctactacagagactgttgatgctttgagaactggtgcagcagcaatgaaggccatgcacaaggcaacaaatattgatgatgttgacaagactatggatgagataaatgaacaaactgaaaatatgaagctaattcaggaggcattggcaacacctatgggtgctgctgctgattttgatgaggatgaactggaagctgaacttgaagaactagaaggagctgagttagaggaacagcttcttcaacctgccacaaccgcccctgctgctccagtgcatgtaccagctggcaagcaaccagcgcgtcctgctcctcgccaaaacactgctgaggaagatgaacttgctgcattgcaagcagaaatggcactttaaagaagtccatttgcagatggctggagatgtactgaaaacaccatgaagaagtgtgttaaatgatatgttgtacagttgtgattgtagactaataaataaataaatattaagttgggaatgtggagtatgttatggaaggattgagtgttgtattaaaatttaaatatcataaaggactagttatacacttt

SEQ ID NO: 3821 - DNA, 856 bp, Guizotia abyssinica
cgagtttttggaaaacctaagcaagaagctaatgcagtaacatcactagacaaattaaatgagacgcttgaaatgctggaaaagaaagagaaagtacttttgaagaaggggggggcagaggtggagaaagcgaaggaggatactaaagcaaagaataaaagagcggcaatacaatgcttaaagagaaagaaactctatgaacaacaaattgaacagcttgggaatttccagttacgtattcatgaccagatgattatgctagaaggtgccaaagctaccactgagactgttgatgctttgagaactggtgcagcagcaatgaaggccatgcagaaggcaacaaatattgatgatgttgataagactatggatgagataaatgaacaaactgaaaatatgaagctaattcaggaggcattggcaacaccaatgggtgctgctgctgattttgatgaggatgaactagaagctgaacttgaagaactagaaggagccgagttggaggaaaaacttcttcaacccggcacaaccggccctgctgctccagtgcacatgccagctggcagctaccaacacgtccagctccacgcaaaaacactgctgaggaagatgaacttgctgcattgcaagcagaaatggcactttaaagatgtcaatttgcagatggctggagatgtactcaaagcaacatgaaaaaagtgaagaagtgtgttaaactatatgttgtacagttgtgattgtagactaataaataaatatcaagttgggaatgtggagtacgtaatggaaagatcgactgttgtatttgtactttaaaactcataaaggactaatccactccagtgctttggagatt

SEQ ID NO: 3822 - DNA, 1360 bp, Cephalotaxus harringtonia
ctgtctaaatttgtcttccttaatttgttttcagttggattgtgttctgcggtcactgagaccgtcttctcttcttcacggttgcccttcctttgttctttctcccatccaatttatttctaagaagcagaggattccttatctactgaataagcgttgacatataaggaatcatcaaaatgttcagcagggtttttgggcgccccaagcaggacaccagtactcttacaacactcgacaaactcaatgagactctcgagatgcttgagaaaaaggaaaaagtcttgcaaaagaagattcaaggagaggttgagaaggccaaggagttcactcgagcaaagaataagagagcggcaatacaatgcttgaagagaaaacgactttatgaagtgcaagtcgagcagcttggcaatttccagctaagaattcatgatcagatgatcatgttggaaggtgcgaaagctacaacagaaaccgttgatgcattgcggactggagcagcagccatgaaagcaatgcagaaggcaactaacattgatgatgtggacaaaacaatggatgagatcaacgaacaaactgagaacatgaaacagattcaagaggcattgtcgacacctattggtgctgctgcagattttgatgaagatgagttagaagctgagcttgaagaattagagggagcagaactggaggagcaactactgcagcctgcaactacagccccagcaatgcctgcacaatatactccagctggcaaacagcccacccaaccagcaccccagagaatgcgtccgcagaatactgctgaggaagatgaactggctgcgctgcaggcagagatggctttgtaaaggaaacaatccatcaattctagcaggttgtaagactgtcaatatgtaatctctgcttaatagtgttcaatttggatatggagctactaatgaagtgcattacaagttcaataatcatcacatgtttaaattattcaatgatgatttgtggtgcagagagacctttggattgtactacgattgtggttattgtcaagaaatatattttcttttgtgggtgggttagttaagctaaaatatatgttctccaaaattttctgttttagattaaagttatggttcatacggggatcaggctttgttaaaggacgacaatttgaactccatcgttggttcaaaactttccatggtgctatcctcttataaatctataagaaggaatgctgtattttctatttttagcgctgagattgttcaaggcatcttggcatatgttattgtaatattatattgtttagcattttaagttggcttctagtaagtgttgcacagcctgagggtccatgtta

SEQ ID NO: 3823 - DNA, 1148 bp, Distylium racemosum
gactctcaggcgaagatcgttggcggtaccgcaattgcccttcattctttttccgatctcaagttaagggcagcgtaattccgcgattcttccataaaaagagggttttctgtgcagtaaaatttccctttgaagagggagggttaaaataagagattatcagaatgttcagcaggctttttgggcgccccaagcaggacactagtcctctcacaacacttgacaaactcaatgagactcttgagatgcttgagaagaaggaaaaggtcttgcaaaagaagatacaagcagaggttgaaagggccaaagagttcacgcgtgctaaaaataagagagcggcaatacaatgcttgaagaggaagaagctttatgaagtgcaagttgagcagcttggcaatttccaattaagaattcatgatcagatgattatgttggaaggtgcaaaagctacaacagaaactgtcgatgcattaaggactggagcctcagccatgaaagcaatgcagaaggcaactaatattgatgatgtggataagaccatggatgaaatcaatgaacagactgagaacatgaaacaaattcaagaagcattgtcaacacctatcggggcagctgcagattttgatgaagatgagttagaagctgagcttgaggaattagagggagcagaattggaggagcaacttcttcagcctgcaactactactccggcaatgcctacacaatatattccagctggaaaacaaccaacacgacctgcaccacagaaggcgcgcccacagaacacagctgaggaagatgagcttgcagcactgcaggcagagatggcattataaaggaggaatccatcaattgaagcaggttataagactgttaatatgtaatctctgctttatagtgttcaatttggacatgaagctactaatgaaaagatttgaagttgaatagtcaacacaagttttcattattcagtcatgatttgtggagcagagagataactttgtggtgaagatatttgtgagtggctagttaggcatggtaatatatttggtgtctaaattttaatatttagattaatggttcatagtgaattcctctggggacttgggtttgttggaggatgacaattatgattgattcaaaaatct

SEQ ID NO: 3824 - DNA, 1218 bp, Sciadopitys verticillata
aaatcatacggctttcctcatatcttccttcgtctgtttctgctctcacgcggagacctcaattgcccttccttgcttcttccgatccaatataattcaactccagtcaagaggagggttttcggtgcatcagaatccacttatcgaagaagggttgatataaggaattatcaaaatgttcagcaggctttttgggcgccccaaacaggacaccagtgctcttacaacactagacaaactcaatgagactcttgagatgcttgagaagaaggaaaaagttttgcaaaagaaaattcaaggagaggttgagaaggccaaggagttcactcgagcaaagaataagagagcggcaattcaatgcttgaagaggaaaaggctgtatgaagtgcaagttgagcagcttggaaatttccaactaagaattcatgatcagatgatcatgttggaaggtgcaaaagctacaacagaaactgttgatgcattgcggactggagcagcggcaatgaaagcaatgcagaaggcgaccaacattgatgatgtggacaagaccatggatgagatcaacgaacagactgagaacatgaaacaaattcaagaggcattgtcaacacctataggtgcagctgcggattttgatgaagatgagctagaagccgagcttgaggaattagagggagcagaattggaggagcaactcctacagcctgccactactgccccggcaatgcctgcacaatacattccatctggcaaacaacccacacaacccgcacctcagaaagctcgtccacagaatacagctgaggaagatgagcttgctgcactgcaggcagagatggcattgtaagggacacaatccatcaattcaagcaggctataagatgtataatctctgcctaatagcattcaatttgaaaaattcagtaagcatcacatatttttgctattccttgatgaattgtggagcagagagacttgtggattgtactaagattgtggttataatgtcaagtaagacaattttctgtggtgggttagttaggcttgctaatatatttgttctctaaatttctatatttagattgaagtaatgattcgtacaaagttactgtcaacaatcagatatggttggaggatggcaatttgaattccatggttggttcaaaacgtttcacagtgccatcctcttagaaatccataagaatactgtaatttgca

SEQ ID NO: 3825 - DNA, 1075 bp, Fagopyrum esculentum
gggatctttctagtttttgctatcgctctctcccatctctgcaatcgaattcgatcggcagggtttttgatcgtgttgaaggattcaacgatgttttctcgtctgtttggtaagcctaaacaaggggttagtgctgtcgaaactctcgataagttggcggaggcactggaattgctagagaaaaaagagcatgtccttaccaagaaggctgctgatgaggttgagaaggccaaggcttttactagagcaaagaacaaaagagctgcaatacagtgtttgaagagaaaaaggctttatgagcagcaagttgagcagctaggcaattttcagttgcgtcttcatgatcaaatgatactgttagaaggtgcaaaagctaccactgaaacagtggatgctttgagaactggagcggctgcaatgaaggccatgcagacagcaatgaacattgatgatgttgataaaacaatggatgaaatcaacgaacagactgagaatatgaagcaaattcaagaggcattgtcaactccaattggcgcagctgctgattttgatgaagatgagttagaagcggaactcgaagagctcgaaggtgctgaactggaggaggaacttcttcaacctatcacccaaacatccttaccttccactcaagtcccagccggcacacaaccagcacgtcctgttcctcagaggcgaactgctgaggaggatgaacttgaagctttgcaagcagaaatggctctttgaggtgattacactctgtttggatatatttattcaaaactcgcagaatcaagagacttacacctttctaatgcaacagattagcaaatttcttcacacaatctcgcaggtactgctgcacagattcgaacttgtgtaaagattttctggattgtttcgtggggataattgcaactgctcgtaccatgcttatctcttgtgtgcttaagagggttgtaaatagaagttgatgaaaagggtaaatgtggcgtctttctatgttgagatcaaaatatcttttgatttgtgttattatgtttctgtacttaaactcaaagatagttaccttgcc

SEQ ID NO: 3826 - DNA, 1264 bp, Podocarpus macrophillus
tttcgcttacgcggataaagtcgcgtctgtttcttcaggggagccggaattgtgctcgcccttctcgtttttagatcaaattcaagggctttttctctgtttttggagtaagacatatcaatatgttcagcaggctttttggacgtcccaaacaggacaccagcactcttacaacattagacaagctcaatgagactcttgagatgcttgagaagaaagaaaaagtcttgcaaaagaagattcaagcagaggtagagaaggccaaggagttcactcgagccaagaacaaaagagcggcaatacaatgcttgaagaggaagaggctttatgaagtgcaagttgagcagcttggcaatttccagctaagaattcatgatcagatgattatgttggaaggtgcaaaagccacgacagaaactgttgatgcattacgaactggagcatcagccatgaaagcaatgcagaaagcaactaatattgatgatgtggataagaccatggacgagatcaatgaacagactgagaatatgaaacaaatacaagaggcgttgtctacgccaattggtgctgcagcagatttcgatgaagatgagttagaagctgagcttgaggaattggagggagctgaattggaggagcaactcctgcaacctgccactactgccccagcaatgcccacacaaaaatacaatccagctggcaagcaaaccacacaaccagctccccaaaaggcacgtccacagcacactgctgaggaagatgagcttgctgcgctgcaggcagagatggcattataagggaacaatccacctatccaagcaatttcaagattgtcaatatgtaatctttgtttgtcagggttcattttggtcagctgctaatgcagaaattacaatttctataattattgcatattttcattattcatcaagatatttgtggagaagagagacctttggaatgtacacataatgattaatatggaggaagaatttgtcttctttgtgtgtattagacaaggcaatatatttttccctatacttatttagatttcggtaatggttcaagctgaatttctttggtccatcaggtttagttggaggatgaaaatttgtactacatgaatagttcaagcttccaaactttccttgtgccatcctcctatgaataagttatcctgtattttatggtttttgtgctgagattctatctgttgctgtcatgtgttattgtatagttatattattcgcgaatgaaaggtggc

SEQ ID NO: 3827 - DNA, 1296 bp, Taxus baccata
tgcgcggagatcgtctcttttccttccaatcgcccttccttcttctttccctgatctaatttattttcaagaagtaacagattccttatctattgaaggagggtcgatatataaggaataaccaaaatgttcagcaggatttttgggcgccccaagcaggacaccagtgctctttcaacacttgacaaactcaatgagactcttgagatgcttgagaaaaaggaaaggtcttgcaaaagaagattcaaggagaggttgagaaggccaaggagttcacacgagcaaagaataagagagcggcaatacaatgcttgaagagaaagcggctttatgaagtgcaagtagaacagcttggcaatttccagctaagaattcatgatcagatgatcatgttggaaggtgcaaaagctacaacagaaacagttgatgcattgcggactggagcagcagccatgaaagcaatgcagaaggcaactaacattgatgatgtggacaagacaatggatgagatcaacgaacaaacagagaacatgaaacagattcaagaggcattgtcgacacctattggtgctgctgcagattttgatgaagatgagctagaagctgagcttgaagaattagagggagcagaattggaggagcaactactgcagcctgccactactgcgccagcaatgcctgcacagtatactccagctggcaaacaacccacacgaccagcaccccagaaaatgcgtacacagaatacagctgaggaagatgaactcgctgcattgcaggcagagatggcgttataaaggagacaatccatcaattccatcaggttgtacgactgttaatatgtaatctctgcttataagtgttcagtttggacatggagctgctaatgatgctaatgaagtgcattacaagttcaataatcatcatatgttttcattatttaatgatgattagtgctgcagagagacctttggattttaatacaattgtggtttttgtggatatcctattttgggtgggtagataaagctaaatttttttctccgaatttgcctattttagatcaaaataatggttcgtactgggttgctgtgggggatcagattttgttggacgatgactatttgaaactccatgattggctcaaacctttccatggtgctatcctcttataaatctataagaaggaattctgtattttatagttttagtgctgagattgttcaaggtgcccttcgcatgtgttatgtactattatattgtttagcatttgaagttaacatctgatatgtcttg

SEQ ID NO: 3828 - DNA, 1055 bp, Fagopyrum esculentum
ggttttttttgatcgtgttgaaggattcaacgatgttttctcgtctgtttggtaagcctaaacaaggggttagtgctgtcgaaactctcgataagttggcggaggcactggaattgctagagaaaaaagagcatgtccttaccaagaaggctgctgatgaggttgagaaggccaaggcttttactagagcaaagaacaaaagagctgcaatacagtgtttgaagagaaaaaggctttatgagcagcaagttgagcagctaggcaattttcagttgcgtcttcatgatcaaatgatactgttagaaggtgcaaaagctaccactgaaacagtggatgctttgagaactggagcggctgcaatgaaggccatgcagacagcaatgaacattgatgatgttgataaaacaatggatgaaatcaacgaacagactgagaatatgaagcaaattcaagaggcattgtcaactccaattggcgcagctgctgattttgatgaagatgagttagaagcggaactcgaagagctcgaaggtgctgaactggaggaggaacttcttcaacctatcacccaaacatcttccactcaagtaccagccggcacacaaccagcacgtcctgttcctcagaggcgaactgctgaggaggatgaacttgaagctttgcaagcagaaatggctctttgaggtgattacactctgtttggatatatatattcaacactcgcagaatcaagagacttgcacttttccaatgcagcagttttacaaattacttcacacaatcttgcagcgactgctgcacatattcgaacttgtgtaaagttttgctggattgtctcccggggataattgctactgctcgtactcatctcttgtgtgcttaaggggttgtatatagaagttggtgaaaagggtaaatgtggtatctttctatgttgagctcaaaatgtgttcgatttgtgtttatgtttctgttcttcctgaaagacaaagatagttaccttgtcatttgttttcagcctggtggaattgagatcaacgactaaatagttaaaa

SEQ ID NO: 3829 - DNA, 920 bp, Brassica napus
cttcaacgccgtttctcattcttcatcgctctcgatataatctctcttcctcaatcattcaagcaagcaacctccgggcatcaatcaaaggtttcaaaggaagaagaatgtttaatcggctattcggtaaacccaaggtggagaccaatactctccatacattagacaagcttaatgagacacttgagatgctggagaagaaggagggtgttcttctcaagaaagctgctggagaggttgagagagccaaggaattctccaaggccaagaacaaacgcgcggcgatacaatgtttgaaaaggaagaggttatatgagcaacaagttgaacagcttggaaacttccagctccgtatccatgatcaaatgattatgttggaaggtgccaaagcaacaactgagactgtagatgctttgaggactggtgctgctactatgaaagctatgcagaaagctacaaacattgacgatgttgacaagacaatggatgagatcaatgagcaaaccgataacatgaaacagatccaggacgcattgtccgctccatttggctctgctgctgatttcgatgaggatgaattggaagcagaacttgaagaacttgaaggcttagagctagaggaccaacttcttcagccagcaagacccgttcctgaaggaaagcaacctgctcgtcctctacctcagaagcaacagtccgctcatgaagatgaactcgctgcactacaggctgagatggcactctaaggttaccttataaaaacaaacaacgggttctgtttactgcatcgtaagggtttgagtgtgcattaatttaaaaaaaaaagaaacagaaatgaaaaattgttatgtacattatacaaagtatccgagtcaaattgatcggatagattattttatatacaatttgacttataagcg

SEQ ID NO: 3830 - DNA, 792 bp, Brassica napus
tcatcgctctcgatataatctctcttcctcaatcattcaagcaagcaacctccgggcatcaatcaaaggtttcaaaggaagaagaatgtttaatcggctattcggtaaacccaaggtggagaccaatactctccacacattggacaagcttaatgagacacttgagatgctggagaagaaggagggtgttcttctcaagaaagctgctggagaggttgagagagccaaggaattctccaaggccaagaacaaacgcgcggcgatacagtgtttgaaaaggaagaggttgtatgagcaacaagttgaacagcttggcaacttccagctccgtattcatgatcaaatgattatgttggaaggtgctaaagcaacaactgagactgtagatgctttgaggactggtgctgctactatgaaagctatgcagaaagctacaaacattgacgatgttgacaagacgatggatgagatcaatgagcaaaccgataacatgaaacagatccaggacgcattgtccgctccctttggctctgctgctgatttcgatgaggatgaattggaagcagaacttgaagaacttgaaggcttagagctagaggaccaacttcttcagccagcaagacccgttcctgaaggaaagcaacctgctcgtcctctacctcagaagcaacagtccgctcatgaagatgaactcgctgcactacaggctgagatggcactctaaggttaccttataaaaacaaacaacgggttctgtttactgcatcgtaagggtttgagtgtgcattattt

SEQ ID NO: 3831 - DNA, 924 bp, Brassica napus
aaacttcaacgccgtttctcattcttcatcgctctcgatataatctctcttcctcaatcattcaagcaagcaacctccgggcatcaatcaaaggtttcaaaggaagaagaatgtttaatcggcttttcggtaaacccaaggtggagaccaatactctccacacattggacaagcttaatgagacacttgagatgctggagaagaaggagggtgttcttctcaagaaagctgctggagaggttgagagagccaaggaattctccaaggccaagaacaaacgcgcggcgatacagtgtttgaaaaggaagaggttgtatgagcaacaagttgaacagcttggcaacttccagctccgtattcatgatcaaatgattatgttggaaggtgccaaagcaacaacagagactgtagatgctttgaggactggtgctgctactatgaaagctatgcagaaagctacaaacattgacgatgtcgacaagacgatggatgagatcaatgagcaaaccgataacatgaaacagatccaggacgcattgtccgctccatttggctctgctgctgatttcgatgaggatgaattggaagcagagcttgaagaacttgaaggcttagagctagaggaccaacttcttcagccagcaagacccgttcctgaaggaaagcaaactgctcgtcctctacctcagaagcaacagtccgctcatgaagatgaactcgctgcactacaggctgagatggcactctaaggttaccttataaaaacaaacaacggcttctgtttactgcatcgtaagggtttgagtgtgcattatttaaaaaaagaaacagaaatgaaagattgttatgtacattattatacaaagtatccgagtcaaattgatcggatagattattttatatacaatttgacttataagcttt

SEQ ID NO: 3832 - DNA, 846 bp, Lippia dulcis
ccctcaaaagatccatattttccatacacgctgactaaattagcattccaatcttgctcataacgtcaattgctgattctggaaggatcctttcgattgaggagggttgttgaagagggggaaataccgtgatcggatcagaattttgacctgatcgagtcgaagatgttttctcgaattttggggaaaccgaagcaagagcccactgctcttgccaccctagacaaattaaacgagactcttgagatgcttgagaagaaggaaaatgtgctacaaaagaaggcatctgctgaggttgagaaggccaaacaatatacaaaagcaaagaacaagagagcggcgatacagtgtctaaagaggaaaaaactctatgaggaacagattgggcagctagccaattttcagttgcgcgtccatgatcagatgataatgctagaaggtgcaaaagctactactgaaacagtggacgccttgagaagtggagcatcagcaatgaaagcaatgcagaaagccacaaatattgatgatgtggacaagacgatggatgagataaacgagcaaacagagaacatgaagcagatacaggaagcccttgctacaccaattggtgcagcagcagactttgatgaggatgaattggaggctgagcttgaagaattagaaggggcagagttagaggatcagcttcttcaacctgctaccactgcccctgctgcttcggcaccggttccatcaggcagagtacctgctcgtcctgctgctcctcagagacgtacacaggaggaggaagaacttgcagctctgcaagctgaaatggcactttaagtgtctcttttgttaaagtgg

SEQ ID NO: 3833 - DNA, 1033 bp, Gossypium hirsutum
ggcttttcttttcagttttttttatttcacagatttctcaactccctaatccccaatttcttaatttttacagaatatcaggtgttttaattcgcggagaggtagctatgtttaaagggatttttggaaaaaccaagccggaaacaaatgctctaaccactttagacaagttaaatgagacccttgaaatgctagagaaaaaggaaagtgtgcttctgaaaaagactgctgcagaggttgaaaaggccaaggagtatgccaaagggagaaataagaaagcggctatacagtgcttgaagaggaagaaactgtatgaacagcaaatcgaacagcttgggaactttcagcttcgtgttcacgatcaaatgataatgttagaaggtgccaaagccacaactgaaacggtggatgcattgagaactggagcaactgcgatgaaggcgatgcagaaagcaactagcatagatgatgtggacaaaacaatggatgagatcaacgaacaaaccgagaacatgaaacagattcaggaagcactatcaactcctatcggagctgcggctgattttgatgaggatgaattggaagctgaactcgaagaacttgaaggtgctgaattggaagaacagcttctccagcctgcaacaactgccccggcagcaccagtacaggtgcctgctagcagtcaaccagctcgacccgttcctcaaaaacacacagccgaagaagatgaactcgctgcattgcaggctgagatggcactttaaggtaagtcattctaagttcagtttaactctatgggggaatcacatatagagctttaaaacatggctaaattacctgatagtgtaggtcaccattgcatccacaatgccataaacatttgtattattaaatcatcttgaaatttatgtgcatgaaactaaacgaatacccccccccatctgtattcataaccccccctttgcctaacaatttattagtccccacaaagttttaaaatatcattaaacactaatataaattatgttattta

SEQ ID NO: 3834 - DNA, 1169 bp, Triphysaria pusilla
acttcccatatgtgctttccatgtggactccaaagtccgaatcgacccaacatatgtacgctttagaaaaaacacttttccgaactaaataaacgcgcttaagcaactccgcctactctccttcatctcgaacgatttaattcttatcgctggtcctggttgattttccgattctcaggatcgaatttgaactttgattgatcaaatcaaagatgttttctcggattctaggcaaacctaagcaggagactaatgctctcgtcacccttgacaaattaaacgagactcttgagatgcttgagaagaaggagggcgttcttcaaaagaaagcatatgcagagattgagaaggccaaaacatacacaaaagctaagaacaagagagcggctatacagtgtttgaagaagaaaaaactctatgaggaacagattggacagcttgcaaatttccagctgcgcatacacgatcagatgatactgttagaaggtgcaaaagctactactgaaactgtggatgctttgagaagtggagctgctgcaatgaaagcaatgcagaaagccacgaatattgatgatgtggacaagacgatggatgagattaatgagcaaaccgagaacatgaagcagatacaggaagctctatcaacccctattggtgcagcagccgactttgatgaggatgaattggaggctgagctagaagaattagaaggtgcggagttggaggaacagcttcttcagcctgcgaccacagcccctgctgccccggtcaggactccatctggtggtgttcctactcgtccagttcctcggaaacggaccgaggaggaagacgaacttgctgctttgcaagcggaaatggcgctttaatcagcctctttcaactgtgttaatcgttaatgggaggaaagtgtgtggaggatgatgatgatataaggtggagaaaccagaaatcgggctttcatccacgtatgagggttttgttatatctgcttgctccataggttgtgtacataaaacacgctgtagtttctgttgggtgttgtattattgaggtatatgattatttgtttggccagagtgaacatttcatgttgttcacctttcacatataagcgtgcgtaaagactttgttgaggggctgtgggctggtcaaaacttgttaatatc

SEQ ID NO: 3835 - DNA, 1379 bp, Cryptomeria japonica
  misc_feature (46)..(46): n is a, c, g, or t
  misc_feature (749)..(749): n is a, c, g, or t
gccatatgccttagatagattttccgtcgattgcacactgcgctcncgcggagagcgtcttttttcttcacaatttccctcccttgtattttcacggtccaatttatttccaagaagccggattcgttctttattgaaaggaggctgtgatataaggaattatcaaaatgttcagcaggatttttgggcgtcccaagcaggacactagtactctttcaactctcgacaaactcaacgagactctggagatgctcgagaagaaggaaaaagtactgcaaaagaagattcaaggagaggtggaaaaggccaaagaattcactcgtgcaaagaataagagagcggcaatacaatgcttgaagagaaagcggctttatgaagtgcaagttgagcagcttggcaatttccagttaagaattcatgatcagatgatcatgttggaaggtgcaaaagctacaacagaaactgttgatgcattgcggactggagcatcagccatgaaagcaatgcaaaaggcaactaatattgatgatgtggacaagacaatggatgagatcaacgaacaaactgagaacatgaaacagattcaggaagcattgtcaacacctattggtgcagctgcagattttgatgaagatgaattagaagctgagcttgaagaattagagggtgcggagttggaggagcaactgctgcagcctgccacaaccaccccagcaatgcctgcacaatatattcctgctggcaagcancccacacaaccggcaccccagaaaatgcgtccacagaatacggctgaggaagatgagcttgccgctctgcaggcagagatggcaatgtaaaggtcacaatccatcaatacaagcaggttgtaagaacatttaatacataatatctgcttattagtgttcaatttggacattaatctactaatgaagttcaatatgggttcaataattgtcacatttttgttatttaatgatgttttctggagcagacagacgtatgaattgtactaagattgtggttaatgccaatgaatatattctcaaggggtgggttaggttatgcaaaaaaattgtgatcttaatttttctattttaaatatgaagtaatgtttcatattgggttgctgtgagcgtaaggttttgttggaggatgacaatttgatcaccatggttggctcacaactttccatggtgccatcctcttataaatttgtaaaaaggaatgctgtattttacatttttagtgctgagatcattcaagatgccttggcatgtgttattgtacaattatgttgttcagcatttttagttgacatctagtatgtcttgtacagcctgagcattcagattatttagttgatttttggctatttt

SEQ ID NO: 3836 - DNA, 1122 bp, Fagopyrum esculentum
aatccaatatcgtcaatctatctccccatctctctggggttagaaatccgaaggatatttctaggccctgagacagatcaattcggtcttcgtactccagctctctccactatctgcaatcgaattcgatcatcaggttttatcgcgtttcggattggacaacaatgtttactcggctatttggtaagcctaaacaggaggtcagcactgtcgctaccctcgataagttgtccgagacgctggaattgctagagaagaaagagaatgtcctttccaagaaggctgctgaggaggttgagaaggccaagggatttactagagcaaagaacaaaagagctgcaatacaatgtttaaagaggaagagactttatgagcagcaaattgagcagctaggaaatttccagttgcgcattcatgaccaaatgataatgttagaaggcgcaaaagctaccactgaaactgtggatgctttgagaaccggagcagctgcaatgaaggcaatgcagaaagcaacgaacatcgatgatgtggacaaaacaatggacgaaatcaatgagcaaacagagaacatgaaaatgattcaagaggcactagcaacaccaattggggcagctgctgattttgatgaggatgaattggaagcggaacttgaagaacttgaaggtgctgaactcgaagagcagcttcttcaacctattcagccctcgcctttacctccctctagaatccccgcacaaccaaatcgtcctcctccgagacaaacagctgaggatgatgaacttgctgcattacaagcagaaatggcactttgaagttggttatgtaaactctggcgaaaattgcttctgctcctaggcttgcgtatgtcttttatatccatgagaagctgtagatagaagggacatagaagcaacaatttatgtgatgtctcttcttgttgacctcaaaaatgtgttctatttgtgatatctattttcgggttttcttgaaacttgaaaggcaatgatactttcgaagtgtgaaaccatggctgcctcattgtcttgcattgcgaatttgcaacattttctaggtgaattgagatcaaagagtgtgtgaatggtaataacctcattagagttc

SEQ ID NO: 3837 - DNA, 1161 bp, Fagopyrum esculentum
gacgcttaagaaatccaatctcgtcaatctatctccccccatctctctggggttagaaatccgaaggatatttctaggccttgagacggatcaatttggtcttcgtactccagctctctcctctatctgcaatcgaattcgatcatcaggcttttgttatcgcgttcccggattcgacaacaatgtttacacggctatttggtaagcctaaacaggaggtcagcactgtcgctaccctcgataagttgtccgagacgctggaattgctagagaagaaagagaatgtcctttccaagaaggctgctgaggaggttgagaaggccaagggatttactagagcaaagaacaaaagagctgcaatacaatgtttaaagaggaagagactttatgagcagcaaattgagcagctaggaaatttccagttgcgcattcatgaccaaatgataatgttagaaggcgcaaaagctaccactgaaactgtggatgctttgagaaccggagcagctgcaatgaaagcaatgcagaaagcaacgaacatcgatgatgttgacaaaacaatggacgaaatcaatgagcaaacagagaacatgaaaatgattcaagaggcactagcaactccaattggtgcagctgctgattttgatgaggatgaattggaagcggaacttgaagaacttgaaggtgctgaactcgaagagcagcttcttcaacctattcacccctcgcctttacctccctctagaatcccagcacaaccaaatcgtcctcctccgagacaaacagctgaggatgatgaacttgctgcattacaagcagaaatggcactttgaggttatggaaagtctggcgaaaattgcttctgctcctaggcttgcgtatgtcttttatatccatgagaagctgtaaatagaagggccatagaagcaacaattaatgtgatgtctcttcttgttgacctcaaaaatgtgttctatttgtgatatcctttttcgggttttcttgaaaggcaatgatactttcgaagtgtgaaaccatggctgcctcattgtcttgcattgcaaatttgcaacattttctaggtgaattgagatcaaagagtgtgcggatggtcataacctcataatagttttaaagaacacatctctcttcactgactttaac

SEQ ID NO: 3838 - DNA, 814 bp, Cycas rumphii
gctcaattctatgtttattgacgtagattgatcgcttcgggctgtttcagaaacccttctgttgaagagcagatataaagaattaccaggatgttcagcaggctttttggacggcccaaacaggacccgagtcctctttcaaccctcgataagctcaatgagactcttgagatgctggagaaaaaagagaaagtcttgcaaaaaaaggctgctgtagaagttgagcgggcaaaggagtttactcgagcgaagaacaaaagagcggcaatacaatgtttgaagaggaaaaggttatatgaggcacaagttgagcagcttggaaatttccagttgcggattcatgatcagatgattatgttggaaggcgcaaaagctacaaccgagaccgtagatgcattgaggacgggagcatcagccatgaaagcaatgcagaaagcaacgaatattgatgatgtggacaagactatggatgagatcaatgagcaaactgaaaacatgaaacagattcaggaagccttgtctacgcctattggtgcagctgcagattttgatgacgatgaactggaagctgagctggaagaattggagggagccgaattggaggagcagctactacagcctgcccagaaagtcccaccagtgcaactacatgctcctccaggcaagcaaccaacacgccctttgccccagaaggggcaacaacagaatgcagctgaagaggatgagcttgctgcactgcaggcagagatggcattataacgagttattgtcaaatctttcaagttgttagcgcttgatttggtcagggagctgt

SEQ ID NO: 3839 - DNA, 1128 bp, Ipomoea nil
tgaagcccagactccagacacggtgaaaagcctcccaaaacccccactcacgccggtgtccgctggttccatcttccctgaagttctcctgatccatcttttatctgttcttataaaaaacgcacgcactgcaaattcacatatcttttttcacttcggtcgcgattctccactgattctgtaaccctaaattcagggatcctagactggtggaatagcgaagatgttttctcggatttttggcaaaccaaagcaggaaactaatgctctctcgactctagataaactgaacgagacactggagatgcttgagaagaaggagaaagtacttcaaaagaaggcctcttcagaagttgaaagggctaaagattttacaaaagcaaagaacaagagagcggctattcaatgtttgaaaaggaagaggctctatgagcagcaaattgagcagcttggaaatttccagttgcgcatccatgatcagatgataatgcttgaaggagcaaaagctacaaccgaaactgtagatgcccttagaactggggcagcggcaatgaaagcaatgcaaaaagccacgaatattgatgacgtggacaagacaatggatgagataaatgaacagactgagaacatgaaaatgattcaggaagcattatcaactccaatgagtgcagtggactttgatgaggatgaactggaagctgaacttgaagaattggaaggtgctgacttggaagaagaacttcttcaaccagcaaccactgcccctgccgcaccagtgcatgtcccagcaggcaaacaagcagcacgcccagttcctcataggaacaccgctgaggatgatgaacttgaagcattgcaaaaggaaatggcgctttgagctaaatccttacgatatcttgaccaccaggacgtagtacgctgggaatgatggcaggaacaaaaagggaaacctcctaccttggatggtcatgaactcttaatttcggttgtactatatccacattccatgatttgtgacaaaaaaattgccatcaattcattagttttggtcattatggagtgtttaaattactgtccaggtcaatatcctttgtacatgcatccgtctatcgtagtatgttctgccca

SEQ ID NO: 3840 - DNA, 936 bp, Cucurbita pepo
gggtttttagaatttagatctacggaaaccagtaagtagattgccgcgtggagacgaaacagcgacgtgaagagagcaggaactctaaatcttcgtcctccagtttctggagcgattgaggaagctttctacttcaaattctttcgattcatttctgcttctcatagttccgtctcaatctctctggtttatcgacttttgaagatcgagagaggattcttgttgcttagcgtcaacaatgtttaacaggctttttggtaaacctaaacaagaagccaatgcttcggctacgttagagaagctaagcgagacgcttgaaatgctggagaagaaagagaatgttcttgtaaagaaggcatctgcagaggttgaaaaagctaaagagttcacaagagtgaagaataaacgagcggccatacaatgtttgaagagaaagagactctacgaacagcaagtagagcagcttggaaattttcaattgcgtatccacgatcagatgatcatgttagaaggcgctaaagctacgacggaaactgtcgatgctttgagaacaggagcatcggcaatgaaggcaatgcagaaagcaacaaatattgatgatgtggacaaaacgatggatgagattaatgagcagacggagaatatgaaacagatacaggaagcgctatcaactccaattggtgccgcagctgacttcgacgaggatgaattggaggcggaacttgagagctggaaagtgcggagatggaagagcaattccccaaccggcgtcaacaactcctgttgcgcccgtttccgcccgtcaggccgatacctgcacgcctgtcttccgagcgaatgctgaagaagacgaactcgcagctctgcaagcggagatggccctctaatcagattgtgccatccgaaggaagctaacgatgggcgttcgttcaaatt

SEQ ID NO: 3841 - DNA, 1323 bp, Pteridium aquilinum
cgtacgtacgtacgtacgttaagtagtaatactactctctctctctctctctctctctctctctcgtctcgcggcgtctcgtcgtcgtccgtttcgttcgtctctctctcgtctctcgttcgtgtgtgtgtgtgtgtgtgtgtgtgtgtgtgcgctctcaggggatcgccatcctgatagatctctggaagactgttcagcaacaagcagaaagtctccttctgaagcgcctgcaaaatgttcagccggttgtttgggaagcctaagcaggagccaacgacgctcgctactctcgaaaagctcagcgagactttggagatgctagagaagaaggagatggtcctacagaaaaaaatctctatggaagttgagaaagcaaaagcttacaccaaagcaaagaataagagagctgcaatccaatgtctgaagaggaaaaaactttatgaagtgcaagttgagcaacttggaaacttccaattgcgcattcatgaccagatgatcttgttggaaggggcaaaggccacaactgaaactgttgatgctctgagaacaggcgcatcagctatgaaagccatgcacaaatctacgaatatcgatgatgtggacaagactatggatgagataaacgagcagactgagaatatgaagcaaatccaggaggctctgtcagcaccaattggagcagctgccgactttgatgaggatgaactggaggctgaattggaagagctggagggtgctgagctagaggagcaattacttcagccagcaactagtgctcctgtttcccaactaccgtcggtgcctgctcgaccctacaaggtgcctgcacaacccaatgctgaagaggatgaacttgcagcattacaggcagagatggccttgtgaagctggatgcctgaagtgtatgtgtttgggtggttgaagccgttacacaattaccagctgctgttcagatgttggcacttaatgcttgatatcttgtaaggtacttattaaggtgtgttaatagtcaggttcagggattgcccttgctttagtcaagtgtgattgctttgatatggatacatcatttcattacagaagatttattggtgctacctaggtgtgcttgatgtgctatttcgctattggaagtggccatccagtatgcaatatcctgttgtgcatgtgcaacatcattggaactcaaatctgagatccatgtgctggcataatttcttgtaaaaagcttttgatattctaaaagatcatgtgacttcattttctgctggagatcttttagcagtgtggaacatatgcaaatcagagggcgccatttgt

SEQ ID NO: 3842 - DNA, 802 bp, Glycyrrhiza uralensis
cttttctttccctttgcgcttcgcgtatctctccccgtctcgtctcaaaacctttttatcaatcctttttctctcttactccaaaccctaattatcaatcagggggagatcggggtcacaaattcgggtcccaattttactcctcgacgcactaagggatcggtgtttcaaaaatctcataatccaccaccatgtttacccggattttcggcaaacctaagcaggaagccaatgctctatcgacgttggacaagttaaatgagacgcttgaaatgctagagaaaaaggagaaagtgctccttaaaaaggctggggcagaagttgaaaaagccaaagaattcaccagggcaaagaacaaaagggcggcaatacaatgtttgaagaggaagaggctatatgaacagcaaatagaacagcttggaaacttccagttgcgtattcatgaccagatgataatgttggagggtgccaaggcaactacagaaacagtcgacgcattgagaactggagcatctgctatgaaggctatgcaaaaagcaacgaatattgatgatgttgacaagaccatggatgagatcaatgaacagacagagaacatgaaacagattcaggaagcattgtcagctccaattggtgcagctgctgactttgatgaggacgaattggaagcagaacttgaagagctagagggtgctgagttggaagaacagcttcttcagcctgcaactacagctccagcagccccagtgcatgtcccagctgggcggcaacctactcatcctgtgaatgcaaagcctactcc

SEQ ID NO: 3843 - DNA, 922 bp, Eucalyptus grandis
  misc_feature (615)..(615): n is a, c, g, or t
  misc_feature (645)..(645): n is a, c, g, or t
  misc_feature (726)..(726): n is a, c, g, or t
  misc_feature (741)..(741): n is a, c, g, or t
tctctctctctctctatcaacacgcctaagcaaacctccattatcatccctcccccaaaattcaaccctccccaccaccaccactgccgccgccgattcctctccaccggcccaccgcgtcgcgatcgccggatcccagcctcccgtttttccgatccctcggccggcgtccagctccgccgtcgatctcttccgaggacatcgcgaggattgtgttagggacgcgatcgatcgacaaccatgtttaaccggctcttcgggaaacctaagcaggagaccaacgctctcacgacgttggataagctgaacgagacacttgaaatgctggagaaaaaggagaaggttctcataaagaaggcatctcaagaggttgagaaagcgaaggagttcactagagcaaaaaataaaagggcggcaattcaatgcttgaagaggaagaggctgtatgaacagcaagttgagcagcttggaaatttccaacttcgaattcatgatcagatgataatgttggaaggagcaaaagcaacaactgagactgtggatgctctgagaactggagcagcagcaatgaaagcaatgcagaaggcgacaaatattgatgatgtggacaagacnatggatgagattaatgaacaaacggagaanatgaaacaaattcaagaggcattgtcaactcccattggtgcagccgctgactttgatgaggatgagcttgaggcagagctngaagaactggaaggngctgagttggaagagcagctccttcagcctgccacaacagctcctgctgctccagtgcatgtcccaactgggtcctggtccgcgtccagcccgccctgttccctcaaaggacagccgaggagggatgaacttgctgctttgcaagctgaagatggcacttttgagcaaggtcctgcctgcc

SEQ ID NO: 3844 - DNA, 1129 bp, Raphanus sativus
ggaagatatcaaaagagaaaatatcaatcattatatctcttaaccaagtagaaacaggagatcatctcatctcatattataaaaaagtattgataagcacttcaacgccgtttctccttctcctccgtctcttcatcatcatcgcaagcaatcaagcaaccttcgggcatcaaatctcgcctaggtgtttaatcaagaagaatgtttacacggctattcgggaaacccaaggaggagactaatactctccacacattaggcaagcttaatgagacacttgagatgctggagaagaaggaatctgttcttctcaagaaagctgctggagaggttgagagagccaaagaattctccaaggtcaagaacaaacgcgcggctatacaatgtttgaaaaggaagaggttatacgagcaacaagttgaacagcttggcaacttccagctccgtattcatgatcaaatgattatgttagaaggtgccaaagcaacaacagagactgtagatgctttgaggactggtgctgctgctatgaaagctatgcagaaagctacaaacattgacgatgttgacaagaccatggatgagatcaatgagcaaaccgataacatgaaacagatccaggacgcattgtccgctccatttggctccgccgctgatttcgatgaggatgaattggaagcagaacttgacgaacttgaaggcttagagctagaggaccaacttcttcagccagcaagaccacttcctgaaggaaagctacctgctcgtcctctacctcagaagaaacagactgctgatgaagaagatgaactcgctgcactacaggctgagatggcactataaacacacaaccaacgggttctatttttactgcagcggaagttggtgttggaagatggggtttgagtgtgcattattttaaaaaaaaaaacagaaacgaagattgttatgtatattaaagtatccgagtcaaattgatcggatacattattttatatacaatttgacttatataacttataagcttttatttatttttattttgaatgtttcttcacatttgctttttactctttgttcacgctatcttgtgctaacttcctctatacttggttacgacttgttacct

SEQ ID NO: 3845 - DNA, 1519 bp, Picea glauca
tgtgggaaggggcgaaagatggattatatggattgatgcgagcgttaaagaaaaataataatcacacgctttcatctattttcaaatgcgttacattatattcttcttcggtcatctcagtcgtgtaggcgatctcctcgggtcctcctagctctctctcccaattccaattgtttgctctccctttgattttgcttgggttcgacgcaagtccagttaagtcaagagggctgcgtttaattcgagagggttaatcggatcaaagggcgcataagaaattgtcatgatgttcagccggctttttgggcggccaaaagaggaggcgaatcctatttcaaccctcgacaaactcaatgagactctagagatgctcgagaagaaagaaaaggtcttgcaaaagaagatccaagcagaggttgagaaggcaagggagttcactcgagcaaagaacaaaaaagcggcaatacaatgcttgaagaggaagagactctatgaagtgcaaatagaacagcttggaaattaccagctaagaatccatgatcagatgatcatgttggaaggtgcaaaggcaacaacagaaactgttgctgcgttgaggactggagcatcagccatgaaagcaatgcagaaagcaacaaatattgatgatgtggataagaccatggatgagatcaatgaacagacagagaatatgaagcagattcaagaggccttggcaacacctattggtgcagctgcagattttgacgaggacgaactggaagctgagctggaagaattggagggagcagatttggaggagcaacttctccagcctgcagttactgccccagcagtgcaatatactccagctagtcaacaactcgcacggccaacacgccagcaggcacgtgaagaagatgagcttgctgcactgcaggcagagatggcattgtaaagggatttgtgcatcttatcaagctggtactataaatattgctgtgtaatctctgtttctagtgctgtttttggccagctgtcttggctatgcatgaaaaggattaaatgtccaataattgttgcagcttgttctcattaatcgatgattattcataaaacagaaggaccttttatctgtaatagattgtgatcgacattaaggatagatgtttgcatcgcaaggggttaattatgtatgctaatatttatgcgctagatttctattttagattttgatcatggtgcaatggagttgctgtggaaggtcctgtatggtggaagttttcacaatttaactgtttggtcaggcccaagattctcaaagtgccatcctgtaaggctatggatccatatgaaggaatactcattgttctatcatgtccttttatgaatttgattttgtagtgctgagattctgcaatgcatcttggcatttgtgttactgtataataatatcaactgtcactgctttttgtgtgaaagtctttgacagcctgtgtttctattcttatattagaagaaagattcttttggttgttta

SEQ ID NO: 3846 - DNA, 1500 bp, Pinus pinaster
aattacacgctttccttctattttcaaatgcgttagattataatcttcgtcggtcatctgagtcgtgtaggcgatctcctcgggtcctccttgctccctctcccaattccaattatttgctctccctttgcttttgcttgggttcaacgcaagtccagttaattcaagcagggttgcgtttgattcgagagggttaatcagatcaaagggcgcataagaaattagcatgatgttcagcagactttttgggcggccaaaagaggaggcgaatcctatttcgaccctcgataaactcaatgagactctagagatgcttgagaagaaagaaaaggtcttgcaaaagaagatccaagcagaggttgagaaggcaaaggagttcactcgagcaaagaacaaaaaagcggcaattcaatgcttgaaaaggaagagactctatgaagtgcaaatagaacagcttggaaattaccagctaagaatccatgatcagatgatcatgttggaaggtgcaaaggcaacaacagaaactgttgctgcattgaggactggagcatcagccatgaaagcaatgcagaaagcaacaaatattgatgatgtggataagaccatggatgagatcaatgaacagacagagaatatgaagcagatccaagaggccttggcaacacctattggtgcagctgcagattttgatgaggatgaactggaagctgagctggaagaattggaaggagcagagttggaggagcaacttctccagcctgcagttactgccccagcagcgcaatatactccagctagtcaacaacccattcgtccaacaccccagcaggcacgcccacataatacagctgaagaagatgagcttgctgcactgcaggcagaaatggcattgtaaagggatttgtggatctatgatgctggtactataaatatttcggtgtaatctctgtttctagtgctgtttttggccacctgtcttggctatgcatgaatgggattaaacgtgtcaaataattgttgcatcttgtcctcattaatcgatgattattcacaaaacagaaagacgttttatccataacagattacgatcaacactaaggaaagatgtttgctttgcaaggggttaattatgtatgctaatatttatactctagatttctattttagattttgatcatggtgcaatggagttgctgttggaagatcctgtattttggaggttcacaatttaactgtttggcggggctcaggattctcaaagtgtcgtcctgtaggccatggatccatatgaaggaatactccattattctgtcatgtccttttaggaattttgagtttgtagtgctgagattcttcactgcgtcttggcaatttgtgttactgtatcataatatcatctgtcactgcattttgtgtgaaagtctttcacagcctgtgcacttattcttatcattagaagtacgattcttggttgttttatggcccttaacgtttatgatc

SEQ ID NO: 3847 - DNA, 1151 bp, Vitis vinifera
atcagctccttccgttttccaaaatttcaattccaattcctctcgttgccacgctgcaggtctagcctttgtagttgtaaggaatttctgaggggtggtcggtgatcggtcaaaaatgttcagccgagtgttcaggaaaggtaaagagcaaagtcaaacaaatgcagtcgcaactctggacaagctaaacgagacacttgaaatgcttgagaaaaaagagagagttctcataaagaaagcctccgctgaggttgaaaaggctaaggaatatactaaagcaaagaacaaaagggctgctatacaatgtttgaagaggaagaggctgtatgaacagcaaattgagcagcttggaaatttccaattgcgcattcatgatcagatgatcctgctagaaggagcgaaagccacaactgagactgttgatgcattgagaactggagcagctgcaatgaagaccatgcacaaaacaacaaacattgatgacttggacaagacgatggatgaaatcaatgagcaaactgaaaacatgaaacagattcaggaagcactgtcaactcctattggttcagcagctgattttgatgaggatgagttggaagcggagcttgaggaactggaaggggccgaattagaggaacagcttcttcagccaactaccacagctcctgcagctccagttagtattccagctgctaggcagccagcacgtcctgctcctcagaagagcacagctgaggatgatgagctcgctgcattacaggcagaattggcactttaaagaggttcctttcatggagtaaaggtgacaacatcaagattaaccattactagaagccttctctgaggttgtaattccatcaacaggttaaaacttctaatcatggacttgctggtaagaagataatgtatatgcagaataacaagatagacatcactctcaaaaattatagctacatcccgtagctttcaataccgatttgctattgttactttttctctataatgcttgtaattgccacctaacaaataattagttcaggctttagaatggaaccatttctcgactgaattttaatattatcagcactgtaaatttatagtttaatcttagccaagctaatctttattgaattgggtggatgattttcctc

SEQ ID NO: 3848 - DNA, 1147 bp, Vitis vinifera
atcagctccttccgttttccaaaatttcaattccaattcctctcgttgccacgctgcagagcctttgtagttgtaaggaatttctgaggggtggtcggtgatcggtcaaaaatgttcagccgagtgttcaggaaaggtaaagagcaaagtcaaacaaatgcagtcgcaactctggacaagctaaacgagacacttgaaatgcttgagaaaaaagagagagttctcataaagaaagcctccgctgaggttgaaaaggctaaggaatatactaaagcaaagaacaaaagggctgctatacaatgtttgaagaggaagaggctgtatgaacagcaaattgagcagcttggaaatttccaattgcgcattcatgatcagatgatcctgctagaaggagcgaaagccacaactgagactgttgatgcattgagaactggagcagctgcaatgaagaccatgcacaaaacaacaaacattgatgacttggacaagacgatggatgaaatcaatgagcaaactgaaaacatgaaacagattcaggaagcactgtcaactcctattggttcagcagctgattttgatgaggatgagttggaagcggagcttgaggaactggaaggggccgaattagaggaacagcttcttcagccaactaccacagctcctgcagctccagttagtattccagctgctaggcagccagcacgtcctgctcctcagaagagcacagctgaggatgatgagctcgctgcattacaggcagaattggcactttaaagaggttcctttcatggagtaaaggtgacaacatcaagattaaccattactagaagccttctctgaggttgtaattccatcaacaggttaaaacttctaatcatggacttgctggtaagaagataatgtatatgcagaataacaagatagacatcactctcaaaaattatagctacatcccgtagctttcaataccgatttgctattgttactttttctctataatgcttgtaattgccacctaacaaataattagttcaggctttagaatggaaccatttctcgactgaattttaatattatcagcactgtaaatttatagtttaatcttagccaagctaatctttattgaattgggtggatgattttcctc

SEQ ID NO: 3849 - DNA, 1048 bp, Cedrus atlantica
gcgatcttctcgagtcctcctcgctttctactccagttccaattgtttgctctccccttgcttttgcttggcttcgacgcaagtccaggtccagtaaattcaagggctgcgtttgattcgagagggttaatcagatcaaagggcgcgcaaggaattaccatgatgtttagcaggctttttgggcggccaaaagaggaggcgaatcctatttcaaccctcgacaaactcaatgagactctagagatgctcgagaagaaggaaaaagtcttgcaaaagaagatccaagcagaggtcgagaaggcaaaagagtttactcgatcaaagaacaaaaaagcggcaatacaatgcttgaagaggaagagactctatgaagtgcaaatagaacagcttggaaattaccaactaagaatccatgatcagatgattatgttggaaggtgcaaaggcaacaacagaaactgttgccgcattgaggactggagcatcagccatgaaagcaatgcagaaagcaacaaatattgatgatgtggataagaccatggatgagatcaatgaacagacagagaatatgaagcagatccaagaagctttggcaacacctattggtgcagctgcagattttgatgaggatgaactggaagctgagttggaagaattggagggagcagagttggaggagcaacttctccagcctgcagttactgccccagcaccgaatccaactagtcaacaacccacacggacaacaccacagcggacacgtccacaaaatacagctgaagaagatgagcttgctgcactgcaggcagagatggctttgtaaagggatttgtccatcttttcaagctggtactataaatattgctgtatactctctgtttctagtgctgtttttggccagctgtcttggttatgcatgaaaaggactaaacgtccaataattgttgcaccttgttctcattaatcgatgattattcataaaacagaaagaccttttatctctaatagatcgagatcaacattaaggaaagatgtttctttgcaagggg

SEQ ID NO: 3850 - DNA, 990 bp, Silene vulgaris
agtattgaaggcgcaaaagctacgtatcaaattccgtgtattacaatcttacatacatcctttgcaaaagattcagctttgtattaattcccaggatcaattgaattgaattagtgagctgagcaagatgtttacgcgggtttttggtaaacctaaggaagctacaactagtgctgttgtcacacttgataaattaagcgagacgcttgaaatgttggagaaaaaagagcaggtgcttctgaagaaggcttctgctgaggttgaaaaagctaaagagttcactagagcaaagaataagcgtgctgccattacatgtctcaaaaggaagaggttgtatgaacagcaaatcgagcagcttggaaatatgcagttgcggattcatgatcagatgatattgcttgaaggagcaaaagcaacaacagagactgttgatgcattaaggtcaggtgcatccgcgatgaaggccatgcaaaaagcaacaaacatcgataatgtggataagacaatggatgagatcaatgaacaaactgagaatttgaaacaaatacaagaagctttatcagcacctattggggcatcagctgattttgatgaggatgaattggaagctgagcttgaggagctagaaggtgctgaattggaagaacaactcttacagccagctacaactgctcctgctgcaccggtgcatgttccaggtgggaagcaaccagcccgccatgcagctcacaataacactgctgaagaggatgagcttgctgcattgcaagctgagatggcactttgaaaaggaagacacgagatgatcccgagatacatgcagctgtacaataaagcttgagcttgtgattttgttgcgacactaatgttatgtacggagtatgtgttaacaatccagctttactctgtaataaccatctgtatagacggtggtgagatgcggctgtgatttcatagtcgtccattgagttattctggttgttgtacctt

SEQ ID NO: 3851 - DNA, 1453 bp, Cryptomeria japonica
gaagctgccatttcgtttttaaatccaggaagcaaccagagataggcgtagatcatctagactatacattctcgcatcagctcccgtaatctacatcagaatctcgtgctatatacgcagcagtaacagtcgaaaccctagcagaatgttcaaccggattttcggaaaacccaaacaggagccgacgcctctctcaactctcgacaagctcaatgagacccttgagatgctggaaaagaaagaaggagtgttgcaaaagagaattgcagcagagattgagaaagccaaggagtttacacgggcaaagaacaaaagagcggctatacaatgtttgaagagaaagagactttatgagctgcaagttgagcaattgggaaattttcaattacgtattcatgatcagatgattatgctggaaggtgcgaaagctacaacagagacagtggatgcactgagaacttcagctgctgccatgaaagcaatgcagaaagcaacgaacattgatgatgtggacaagaccatggatgagatcaatgaacagacagagaacatgaaacagattcaggaagcattatctacaccaattggtgctgctgcggattttgatgaggatgaacttgaggctgaattggaggaactggagggagcagagctcgaagagcaacttatgcaaccagccacaattgccccaactacaaaattgcctccaattccaggaaaacaacccacacaacctgcatctcagaaagctactccaagttctgctgaagaagatgaacttgctgctctgcaggcagagatggcactatagtgaggttttcatgaaacaaaatttcatatagggtcttggggttccaacttgttactggatgttttagttacaaagacagaaatggtcactgcacaagagttaaccagtgaattggtgtgctagatttgtgggtaaaacaagtatggcccttggcataaatttaaatgtttcagcatctgaaatgacacatctaaattagaaacattctggatggacagtgtcattagttatctttagtttagattatctgttaaatgcataattattagaagcatgcataagtgattgaaacgtggcttctgttttttgagactgtcattatgatctttttagatttagctctatattactgctagcatgtatataataatatcccctcattgggttgtactgatataagtacagatctatcgtccactatcatcagcatagatgagtcgtatggcatctttatggctggttatggtgtggagcattagatgtagataaaacaagataagataaaaagtgactcttcgggagaggattactgtctttgttgtacgcatgatttataaatattatatcaattgtggaggaagtgattacatattcaacacatttcggagagtactatataaaatttgtgttctaacagaaata

SEQ ID NO: 3852 - DNA, 1226 bp, Abies balsamea
atttttaaatccgtcactttatattcttcttcggtcattccagtcgtgtaggcgacgatctcctcgatttctctctcatttctaattgcttgctctccctttgcttttgcttgggttcgacgcaagtccagtcaagtcaagggctgcgtttgattcgagagggctaatcagatcaaagggcgcaaaaggatttgtcatgatgtttagcaggctttttgggcggccgaaagaggaggccaatcctatttcaaccctcgataaactcaatgagactctagagatgctcgagaagaaggaaaaagttttgcaaaagaagatccaagcagaggtcgataaggcaaaggagttcactcgagcaaagaacaaaaaagcggcaatacaatgcttgaagaggaagagactctatgaagtgcaaatagaacagcttggaaattaccagctaagaattcatgatcagatgatcatgttggaaggtgcaaaggcaacaacagaaactgttgctgcattgaggactggagcatcagccatgaaagcaatgcagaaagcgacaaatattgatgatgtggataagaccatggatgagatcaatgaacaaacagagaatatgaagcagatccaagaggcattgtcaacacctattggcgcagctgcagattttgacgaggatgaactggaagctgagctggaagaattggagggagcagagttggaggagcaacttctccagcctgcagttactgccccagctccacaatatactccacataatcaacaacccacacgaccaacgccgcagcaaacacgtccacataatacagctgaagaagatgaacttgctgcactgcaggcagagatggcattgtaaagggatttgtccatcttttaaagctggtactataaatattgccgtgtaatctgtttctagtgctgtttcgggccagctttcttggctatgcatggaaaggattaaatgtccaataattgttgcaccttgttctcattgatcgatgattattcataaaacagaaagaccttttatctgtaatagattgtggtcagcattaaggaaagctgttttctttgcaagggattaatgcatgcaactatttatgctctagatttctattttagattttgataatggtgcaagggagttgccgtggaagatactgtattgtggagtttcacaattttaactctttggatgggccgaagattcttaaaag

SEQ ID NO: 3853 - DNA, 907 bp, Pteridium aquilinum
attcccaatcaggcttgtagagcagctcgcttagcgctatcagatccgactcgctgcctcttcgggaaaccctaatcgcaacctgtgtttttcttctctttggcgtacaagatgttgaaccggctcttggaaacccaaacagggcccacaacactcgcaaccctcgacaagctcaatgagacgttggagatgcttgaaaagaaggagaaggttttgcagaaaaagattgctttggaagtagaaaaagcaaaagagtacacaaaagcaaagaataaacgagctgccattcaatgcttgaaaggaaaaagctttatgaggtgcaggtggagcagcttgggaacttccaattgcgtatacatgatcagatgattttgttggaaggtgccaaagccacgacagaaactgttgatgctttgagaacgggcgcagcagctatgaaagccatgcacaaatctacgaacattgatgatgttgacaagacgatggatgagattaatgaacagacggagaacatgaaacagatacaggaggctttggctacacctattggggcagctgctgattttgatgaggatgaattggaggcggaattggaagagttagaggaagcagagttggaggagcaattgcttcagccagcaaccactgctcctgcgtctcagttaccatcggtcccaccacaaaggctgcccgcccgacctcagaggacaccagctcaaactagtgctgaagatgatgagttggctgcactacaagctgagatggctttgtaaaatgttaccatatgaatacatcggtttgccatatgttatcctggattctcacatggctaaatttgcttacctttgagaaccagatgtgtacattcatgcactgctttttgggacttgtctgacatgaagcattc

SEQ ID NO: 3854 - DNA, 1583 bp, Pinus taeda
acgtgcgaccttggctgtcactcaggtattaaatagattgatgcgagcgttaaaaataatcacacgctttccttctattttcaaatgcgttagattataatcttcgtcggtcatctcagtcgtgtaggcgatctcctcgggtcctccttgctcgctctcccacttccaattatttgctctccctttgcttttgcttgggttcaacgcaagtccagttaattcaagcggggttgcgtttgattcgagagggttaatcagatcaaagggcgcataagaaattcgcatgatgttcagcagactctttggacggccaaaagaggaggcgaatcctatttcgaccctcgataaactcaatgagactctagagatgcttgagaagaaagaaaaggtcttgcaaaagaagatccaagcagaggttgagaaggcaaaggagttcactcgagcaaagaacaaaaaagcggcaatacaatgcttgaaaaggaagagactctatgaagtgcaaatagaacagcttggaaattaccagctaagaatccatgatcagatgatcatgttggaaggtgcaaaggcaacaacagaaactgttgctgcattgaggactggagcatcagccatgaaagcaatgcagaaagcaacaaatattgatgatgtggataagaccatggatgagatcaatgaacagacagagaatatgaagcagatccaagaggccttggcaacacctattggtgcagctgcagattttgatgaggatgaactggaagctgagctggaagaattggaaggagcagagttggaggagcaacttctccagcctgcagttactgccccagcagcgcaatatactccagctagtcaacgacccactcgtccaacaccccagcaggcacgtccacataatacagctgaagaagatgagcttgctgcactgcaggcagaaatggcattgtaaagggatttgtggatctatgatgctggtattataaatattgcggtgtaatctctgtttctagtgctgtttttggccacccgactcggctatgcatgaaaaggattaaacctgtcaaataattgttgcatctggttctcattaatcgatgattattcacaaaacagaaagacattttatccataatagattgcgatcaacagtaaggaaagatgtttgctttgcaaggggttaattatgtatgctaatatttatgctctagatttctattttagattttgatcatggtgcaatggagttgctgtggaagatcctgtattgtggaggttcacaatttaactgtttggccgggcccaggattctcaaagtgccgtcctgtaggccatggatccatatgaaggaatactccattattctatcatgtccttttacgaattgagtttgtagtgctgagattcttcactgcgtcttggcatttgtgttactgtatcataatgtcatctgtcactgcattttgtgtgaaagtctttcacagcctgtgcacctattcttatcattagaagtacgattcttggttgttttatggccctaacgtttatgatctatttaataataatgattatttcagaagatt

SEQ ID NO: 3855 - DNA, 1523 bp, Pseudotsuga menziesii
tgaaggcgtgaatatgtcgtattaaatggatcgatgcgagcgttagagaaatataatcatacgctttccatctaattttcaaatccgtttgaatatattcttgcttcggtcatctcagtcagtcgtgtaggcgatctcctcgagtcctcatatctctttctcacaattctaattgtttgctctccctttgcttttacttgggttcgacgcaagtcctttcaattcaagggctgcgtttgattcgagagggttaatcggatcaaagggtgcataagaaattctcatgatgttcagcaggcttttcggccggccaaaagaggagtcgaatcctatttcaaccctcgacaaactcaatgagactctagagatgcttgagaagaaagaaaaagtcttgcaaaagaagattcaatcagaggttgagaaggcaaaggacttcactcgagcaaagaacaaaaaagcggcaatacaatgcttgaagaggaagagactctatgaagtgcaaatagaacagcttggaaattaccagctaagaatccatgatcagatgatcatgttggaaggtgcaaaggcaacaacagaaactgttgctgcattgaggaccggggcatcagccatgaaagcaatgcagaaagctacaaatattgatgatgtggataagacaatggatgagatcaatgaacagacagagaatatgaagcagatccaagaggccctagcaacacctattggtgcagctgcagattttgatgaggacgaactggaggctgagctggaagagttggagggagcagagttggaggaacaacttctccagcctgcagttactgcaccagcagcacaatatattccagctggtcaacaacccacacggccaacaccccagcaggcacgtccacataatgcagctgaagaagatgagcttgctgcactgcaggcagagatggcgttgtaaatggatttctgcatcttttcaagctggtactataaatattgccgtgtaatctctgtttctagtgctgtttttgccagctgtattggctatgcatgaaaaggattaagtgtccaataattgttacaccttgttctcattaatagatgattattcataaaacagaaggaccttttatctataaatagattgtgatcaacattaagtaaagatgtctgatttgcaaggggttaattatgtatgctaatatttattctccagatttctattttagattttgataatggtgcaatggagttgctgtggaagatcctgtattgtggaggttcacaatttaactgtttagcgggcccaagattctcaaagtgctgtcctctaggcttatggatccatacgaaggaacattctattgtgtgccatcatgtccttctatgattttgattctgtagtgctgatatccttcaatgcgtcttggcatttgtgttactgtatattaatatcagcaatcactgcattgtgtgttaaagtctttcacagcccgtgttcttgttctcaatattagaatgatccttgt

SEQ ID NO: 3856 - DNA, 1101 bp, Musa acuminata
gggcagcggccggactttgtcggcctacctctcgtgtattcatctttaccctccttcgctggattctcgtcgaaggaatcccgtgcttcctactaccgttaccctcgaattctcggatcatctgtcgatcccatccacgatcgccctcaggtttgtcccttagaagccggtcaagatgttcagtaggctgtttggaaagcccaaggagcaaaccaatgccgtggccactctcgataaattaaatgaggaacgatgtttgaaagtaattccgtgtggtgctaccttcctcaagatttagacacttgagatgcttgagaaaaaggagaaagttctcttgaagaaggctgctgctgaagttgaaaaggctaaggagttcacaagagcaaagaataagagagctgctatacaatgcttgaagaggaagaggctttatgaacaacaagttgagcaacttggaaacttccagttgaggattcatgatcagatgataatgttggaaggtgcaaaagctacaacagaaactgttgacgctttgagaactggagcagcagcaatgaaagctatgcaaaaagcaactaatattgatgatgttgacaagaccatggacgagatcaatgaacagacagagaacatgaagcaaattcaggaagcattagccactcctattggagcagcagctgactttgatgaagatgagttggaagcagaactggaagagttggagggagccgagttggaggaacagcttcttcagcctgctacaactgctcctgctgcgccagttcatgttcctgctggtagagtacctgctcggcctgttccccagaaaaatactgccgaggaagacgaacttgcagcattgcaagctgagatggcaatgtagtgaggcactgtgatcttcacatctgccatgtgtctcggaagattaagacagcagctaatgacgatccaacctttctcttgagactgttctacccaatctctctgttgaaaagcacctgtaaaattcatgatcgaagtgtgattgatacctgtaaaatttctgttataatttggatgtgccatgacaggggatcttctctgttgatgctttatgcgccc

SEQ ID NO: 3857 - DNA, 805 bp, Solanum tuberosum
taaatttctacaaaatcatcgaccgattgatcaatttactcttcaatacttcaattttttcccaggaattgtataattttgaagttctttttgggaccccattgattcgggattgaggagtagttgattgattgtttggtgggttgaactgtgaagagttttgctgcaaccaattcctgtgcaaaatcgaaaatgtttaagcgattacttggaaaacccaaacaagaaacaaatgctctagcaacattagacaagttaaatgagacgcttgaaatgcttgagaaaaaggagtcagttttattgaagaaggctactgctgaggttgaaagagcgaaggaatttactagagcaaaaaataaaagggctgcaatacaatgtttgaaaagaaaaaggctctatgaacagcaagtcgaacagcttggaaatttccaattgcgtatccatgatcagatgatactgctagaaggtgcaaaagccacaacagaaaccgttgatgctcttagaactggagcagctgcaatgaaagccatgcagaaggcaacgaatattgacgatgttgacaaaacaatggatgaaatcaatgagcagactgagaacatgaaaatgattcaggaagcattatctacaccaattggtgcagctgctgattttgatgaagatgagttagaggcagaacttgaagaactggaaggagctgagttggaggaacactccttcagcctgctattactgccccttctgcacctattcatctgcctgctgggtagcaacaagtgcgtcctgctgcccacacagcagaacggaa

SEQ ID NO: 3858 - DNA, 646 bp, Cirsium arvense
cagtttcagtaataggtttcaagagttaacgatgtttacgagattgtttggaaaacctaaacaagaagctaacgcagtaacaacgttagacaagttaaatgagacacttgaaatgctagagaagaaagagaaggtacttctaaagaaagctgctgcagaggttgaaagggcaaaggaattcactagagcaaaaaataaaagggcggctattcaatgtctaaagcgaaagagactttatgaacagcaagttgaacaacttggaaattttcaattacgtattcatgatcagatgataatgatagagggtgcaaaagctaccacagagacggtggatgcattgagaactggagctcaagcaatgaaggccatgcagaaggcagtgaatattgatgatgtggacaaaacaatggatgaaataaacgagcaaaccgagaacatgaaacaaatccaggaagcgttgtcagcacctattggtgcagcagccgatttcgatgaggatgaattggaggctgaacttgaagaattagaaggagctgagttggaggaacaacttctccaacctgccacaactacccctacaacttcagtgtatgcacctgccggcaaacaaccaacacgtccagctccacggcagaataaagccgag

SEQ ID NO: 3859 - DNA, 688 bp, Allium cepa
aatctctcgatttctcctcgattgttttttgatttatttgatcatcgatcttgaaccctaacatcgattgacatagattcgcaatttcaatatgtttaatcggttgtttgggaaacctaaggagcagaccaatgctttggctactctcgacaaactcaatgagacacttgaaatgttagagaaaaaggaaaacgttctcttgaaaaaggctgctgctgaagttgagaaggcaaaggagttcacgaaagcaaaaaacagaagggctgcgatacagtgtttgaagaggaaaagactttatgagcagcaagttgagcaacttgggaattttcagctacgtatacatgatcagatgataatgttagaaggggcgaaagctacaacggagactgttgatgcattgagaacaggagcatctgcgatgaaagcaatgcaaaaggcaacgaacattgatgatgtagacaaaacaatggatgaaattaacgagcagactgagaatatgaaacaaattcaagaagcattatctaccccgattggagcagcagctgattttgatgaagatgaattagaagcagagctggaggaattggaaggagctgagttggaagagcagcttcttcagcctgctacttctgctcctgcttcttcagggtatgttcctccaggaaaacaacaaactcgacctgctgct

SEQ ID NO: 3860 - DNA, 1625 bp, Physcomitrella patens
agtgtgtgtgtttttttgaggggaccgggctgcaattgcagaggcagcgacggtggaagaagcgtgttgccgaatcccagtctcgcaaagcagcgttgcgtgtgtttagtcggtaccgtgatctacatgagtgagagagagacttcgattatagtaatcgcagcactttagtggggcaaggattgattgattgattcaagcagcaggcgcaggtgcccatcggattgatttattgattcattcagtagattgcagtgcactcacacaatttcaccatgttttcaaggctgttcgggaagcccaagcaggagccctctaccctgtccacactcgacaagcttaatgagaccttggagatgttggagaagaaggaaaaggtgttgcagaagaaaatagccatggagatagaaaaggctaaggaattcaccaggttgaagaataagagagctgcgattcagtgtttgaaacggaagagattgtatgaagtccaagtagaacaactgggcaacttccaattgcgtatccatgaccagatgattatgctggagggtgctaaggcaacgacagaaaccgtggatgctctgcgcagcggtgctgcagccatgaaagccatccagaaagccaccaatattgatgacgtagacaagacgatggacgagatcaacgagcagactgagaacatgaagcagatccaagaggcactctcaacaccaattggaacagcagctgatattgatgaggacgagctggaagctgagcttgaggacctcgaaggggctgacttggaagaacagctcattcagccgtctactcaccagcttccccaggctcaaacatacaagcctacttcagttcctacaaagagtcctcctacgacaaacactgaggaagatgaacttgcagcccttcaagctgaaatggcactttagaaacatatcacccctgccccctcatcgcattttggagtgtttttttggtctccacataagtttttgttcaggtttgtgtcagtattccaacttgataagcaagtgggctctgtctctagaacgctttgattgaaagtgaagatcacagtggaaactgaatcgctttccaagttccaggtgctaaccggatggcataacgtgctcgatagacacacagaagcgtgcatgtaactcggacgcttcttcggtcattggaaatggtgagatcacactcagaaggtaaataaggtgtgggcaaaagcatggaaagatgggtttgtatcacgaatttggcttatttaactggttcgctttcatttgcaccttcgaagagcagcaattgggctcttgccgactgctcttgctgttcctcctatcagcccgtgtaaaactgtatactgaaacattcttactttttatagatttttttttcatttagccacgtcggcatacaatgttacagcgggatccaccaacttacttcaaactgtgaattgagatagttttcaatgttcataatatacttaagtatccttcaaggaatatggatgttagtgaaattgaagctcatctagacttgcgctgttgccggtggcaactgttagacctttggtacaacctttgtcagttgatacaattaaatggttgcaaatttat

SEQ ID NO: 3861 - DNA, 727 bp, Acacia harpophylla
gaagttcccaacccccggtcactcctcctttcactttcatcgcagatccgttacccttcttgtcaacccccaatcgctgtatactatcccctctaaatctatctgcgcaatccgattctcgatcagaagggtatcgtgttttaactttctcataatcaaccatgtttacccgaatttttggtaaacctaaacaggaagccaatgctttaaccactttggataagttaaatgagacacttgaaatgttagagaaaaaggagaaagtacttattaaaaaggctgcagcagaggttgaaaaggctaaagagtttacaagggcaaaaaataaaagagcgactatacaatgtttgaagagaaagaggttatatgaacaacaagtagagcagctcggtaatttccaattgcgtattcatgaccagatgataatgttggaaggtgctaaggccaccacggaaacagtggatgcattgagaactggagcttctgctatgaaggctatgcaaaaggcaacgaatattgatgacgttgacaagaccatggatgagatcaatgaacagactgagaatatgaaacagattcaggaagcattgtcaactccaataggtgcagctgcagattttgacgaggatgaattagaagcagaacttgaagaattggagggtgctgagttggaggaacagcttcttcaaccctgcactacagctcctgcagcaccagtgcaggtccc

SEQ ID NO: 3862 - DNA, 790 bp, Petunia hybrida
gggggatcgggtcggcccggtacctttccaaaaatatcctctcctccctttcactttctcctaattttccccaaaacaaattcccgcggaaatcatatcctttcaagttgatcaatcgatcgtctactctcaactcttatctattacttaacaggagttctaattgaatcataatcagcagaaaagatgttttcgcggatttttggaaaaccaaaggaggaagctaatgctcttaccactcttgacaaattaaacgagactctggagatgcttgagaagaaggagaaagtacttcagaagaaggctactgcggaggttgagaaggcaaaagaatttaccagatcaaagaacaaaagagcggcaatacaatgtttgaagaggaaaaggctttatgagcagcaaattgagcagcttggcaatttccagcttcgcatccatgatcagatgataatgcttgaaggggcgaaagctacaacagaaactgttgatgctttaaggactggagcatctgcaatgaaagcaatgcagaaagcaaccaacattgatgatgttgacaagacaatggatgaaataaatgaacagaccgagaatatgaaacaaatacaggaggccttggctactccaattggtgcagcagctgactttgatgaggatgaattggaggcagaacttgaagagttggaaggtgctgaattggaagagcagcttcttcaaccagcaactacagcccctgctgcaccagtccatgtcccagcagggaggcaacctgctcggcctattcctcagaagc

SEQ ID NO: 3863 - DNA, 1314 bp, Marchantia polymorpha
  misc_feature (1235)..(1235): n is a, c, g, or t
  misc_feature (1307)..(1307): n is a, c, g, or t
gggagaaaggaggaagaggaggagggggatggcagatgatgatgagtgagaacgtgttgatgtctacgggttcttctgttcactgcctttgcttccgtgtcaccttttctctccctcctcgtcgtctgcgtcattgtagcagtctcgttccgatctgtgattttccctgatctccgatctggttccgctgaattggtttgctctctttcgcgagtgtacagtctgtgtgagttcgagtgtgacgagattttggtgtgtcgtgcaatcagcggcagcgagggttgggcaaggcaaattgtgggaggagtgaaggagcgttatattgagaaaactgtcgtttgcctccaggcgaggaagggtgaggatttgtagacgcagcagaagcaggagggcagacaagcagtcgagagaagtgtgggtgtaactaggcgttcaaaatgttcgctcggattttcgggaaaccgaaggaggaaccttcgacgctcagcacgctcgacaaactaaatgagactttggagatgctcgaaaagaaggaaaaggtcttgcagaagaaaatagctgtagagatagaaaaagctagagattacactcgggcgaagaataagagggctgcgatccagtgtttgaagaagaaaaagctttatgaggtccaggtggaacagcttggtaactttcagttgcgaattcacgatcagatgatcatgctggaaggggccaaggctactactgaaactgtcgatgctctaaggagtggtgcatcggctatgaaaaatatgcaaaaagccacaaacatagacgatgtcgataagactatggatgagatcaacgagcagactgagaatatgaagcaaattcaagaagctttatctactccaattggagctgctgctgattttgacgatgatgagctggaggccgagcttgaggaactcgaaggagccgaacttgaggaagcattgttgcaacccgcgactaccccagcaacgcagttaccaactgttcctactcaaagtcgtcctatgtcaacacctgcccagcgacagcctgcaaaaaccgaggatgatgagcttgcagccctacaagccgagatggctctatagtgagattctatttgcttatcaatgaaattcttcgcgttcacccttaggcagcggtaagcttgtatcattatagtgtttggacaatcgggaattcaaagttcccgggagccatgttaataccccattctatcgcangcgtagtagtttccactcatcattgctactggtaacctgcgatgtccacctgcgagtcttgtccggtcactngatcttg

SEQ ID NO: 3864 - DNA, 807 bp, Brassica rapa
  misc_feature (48)..(48): n is a, c, g, or t
tttcatccacacacacattaccaaaagacgcactacagaaccattccnttagaacacaacctgaaaagttgcaaaagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggacccttgagaaggccctctgctcctcctactctccgggagcctacacctccccaaaaacctgttactcctacgccgtcttcttcccctccaccaccgcagaaagctgtggctgttgacggtaagagcgtagtaacaaccgtggagtttcagaggcagaaagctaaagagcttcaggattactttaagcagaagaagcttgaagctgctggtcaaggccccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataataataataataataaaaaagagtgttgttggtgtatatgatcctttctctgattccttatgttcaatcttcttctccttgtttattcttcctcctgtatatgcatcccctaaagatctttaatacagagggcccttttgttgttcaaccacttttatctttcaaatgttataataagtatgatctatggaaaaaaaaaa

SEQ ID NO: 3865 - DNA, 794 bp, Brassica napus
gatccacacacacattaccaaaagacgcactacagaaccaattccattagaacacaacctgaaaagttgcaaaagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggtcccttgagaaggccctctgctcctcctactctccgggagcctacacctccccaaaaacctgttactcctacgccgtcttcttcccctccaccaccgcagaaagctgtggctgttgacggtaagagcgtagtaacaaccgtggagtttcagaggcagaaagctaaagagcttcaggattactttaagcagaagaagcttgaagctgctggtcaaggccccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataaaaaaaaaaagagtgttgttggtgtatatgatcctttctctgattccttatgttcaatcttcttctccttgtttattcttcctcctgtatatgcatcccctaaagatctttaatacagagggcccttttgttgttcaaccacttttatctttcaaatgttataataagtatgatctatggatctcgatt

SEQ ID NO: 3866 - DNA, 762 bp, Brassica oleracea
  misc_feature (201)..(202): n is a, c, g, or t
gactacagaaccattccattagaacacaacctgaaaatttgcagacaattcaaagttaaaagaaaggcattaaacaaaagatgtcattagcttcgccgattcaatgcatcagaattataaatccatcttcttcttcttcatcttctttgacgacttcgtcgtctttgagattctcaacgagtaagccatgtgtattcatcnncagatgttctcaggccgaaggtcccctgagaaggccctctgctcctcctactctccgggagccttcacccccccaaaaacctgtgcctcctatgccgtcttcttctcctccaccaccacagaaagctgtggctgttgacggtaagagcgtagtaactacggtggagtttcagaggcagaaagctaaagagcttcaggattactttaagcagaagaagcttgaagctgctggtcaaggtcccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataataataataaaaagagtgttgttggtgttatatagatatatgatcctttctctcattccctacgttcaatcttcttctccttgtttattcttcctcctgtatatgcatcccctaaagatcttttaatacagggcccttttgttgttcaaccc

SEQ ID NO: 3867 - DNA, 762 bp, Brassica napus
gagaacacaacctgaaaatttgcagacaattcaaagttaaaagaaaggcattaaacaaaagatgtcattagcttcgccgattcaatgcatcagaattataaatccatcttcttcttcttcatcttctttgacgacttcgtcgtctttgagattctcaacgagtaagccatgtgtattcatcatcagatgttctcaggccgaaggtcccctgagaaggccctctgctcctcctactctccgggagccttcacccccccaaaaacctgtgcctcctatgccgtcttcttctcctacaccaccacagaaagctgtggctgttgacggtaagagcgtagtaactacggtggagtttcagaggcagaaagctaaagagcttcaggattactttaagcagaagaagcttgaagctgctggtcaaggtcccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataataataataaaaagagtggtgttggtgttatatagatatatgatcctttctctcattccctatgttcaatcttcttctccttgtttattcttcctcctgtatatgcatcccctaaagatcttttaatacagggcccttttgttgttcaacgactttttctttaaaatgtta

SEQ ID NO: 3868 - DNA, 825 bp, Raphanus sativus
ggatccacacacacattaccaaaagacacactacagaacccattagaacacaacctgaagatttcagacaattcaaagttaaaaaaaaaaagccattaacggaagatgtcattagcttcaccgattcagtgcatcagaattataaatccatcatcttcatcatcttctttgacaacttcgtcgtctttgagattctcaacgagtaagccatgcgtcttcatcatcagatgttctcaggccgatggtcctttgagaaggccctcggctcctcctactctccgggaacctacacctccccaaaaacctgctcctcctacgccgtctacttctcctccaccaccaccaccgcagaaagctgtggctgttgatggtaagagtgtaaccacggtggagtttcagaggcaaaaagctaaagagcttcaggattactttaagcagaagaagcttgaagctgctggtcaaggtcccttttttggtttccaacccaaaaacgagatctccaatggaaggtgggctatgtttggttttgcggtggggatgctgacagagtatgcaacaggatcagaccttgtggaccaagttaaaatccttctctccaatttcggcattctagacttggaataataatgaaaaaaagagtgttgttggtgttatatagatatgatctttctctgattcccttatgttcaatcttcatctgcttgtttattattcttcctcctgtatatgctgcatctcttaagatcttttaaatacagggcccttttgttgttcaaccactttttatcttcaaatgttataaatatgatctatggatcgattcta

SEQ ID NO: 3869 - DNA, 794 bp, Raphanus sativus
acaacctgaaaatttgagacaattcaaagttaaaagaaaaaagccattatcggaagatgtcattagcttcaccgattcagtgcatcagaattataaatccatcttcttcatcttcatcatcttctttgacagcttcgtcgtctttgagattctcagcgagtaagccatgtgtcttcatcatcagatgttctcaggctgaaggtcccttgagaaggccctcggctcctcctactctcagggagcctatacctccccaaaaacctgctcctcctacgccgtctacttctcctccaccaccaccaccgcctccaccgcagaaagctgtggctgttgatggtaagagtgttaccacggtggagtttcaaaggcagaaagctaaagagcttcaggattactttaagcagaagaagcttgaagctgctggtcaaggtcccttttttggtttccagcccaaaaacgagatctccaatggaaggtgggctatgtttggttttgcggtggggatgctgacagagtatgcaacaggatcagaccttgtggaccaagttaaaatccttctctccaatttcggcattctagacttggaataataatgaaaaagagtgttgttggtgttatatagatatgatatttctctgattcccttatgttcaatcttcatctgcttgtttattattcttcctcctgtatatgctgcatctcttaagatctttaaatacagggcccttttgttgttcaaccactttttatcttcaaatgttataaatatgatctatggatcgattctaaaaatg

SEQ ID NO: 3870 - DNA, 747 bp, Brassica rapa
atgcacaatgccgagacttggccatatctcatccacacagagattgccaaaaacactaacagctcgacccatcaaacaattcttcaactaaaaaccccattaacgaaagatgtcattggcttcacctattcagtgtatcaggattcttaatccatcttcttcttcttccacaacttcgtcgtctttcagattctcaacgattaagccatgtgtcttcgtcatcagatgttctcaggcagaaggtccattgagaagaccctctgctcctcctactctccgcgagccttcacctccgcaaaagcctgttcctcctgtaccgtcttcttctcctcctccatccccgcccctgcagaaaacggtggctgttgatggtaagggtgtagttacggtggagtttcagagacagaaggccaaagagcttcaggaatactttaagcagaagaagcttgaagctgctggtcaaggtcccttctttggtttccaacccaaaaacgagatctccaatggaaggtgggctatgtttggtttcgcggttggaatgcttacagagtatgccacaggctcagaccttgtcgaccaagttaaaatccttctctccaacttcggaattatagacttggaataacaagagttttgttaattcgtcttcctctgtatgcatctctaaagatcttcaaatacatgagcatttgtgtattcaaccactttttatcttcaagtcatataattatgaactaaaaaaaaaaa

SEQ ID NO: 3871 - DNA, 1381 bp, Brassica napus
taactttttgttcttaatttttctttggtaattgatatgtgttatatgatctctagctagtcttctcagttggatttgaaacaaaggcattaaagtatattcatagtagtgaaactcatatttgggacacagagacagcaactacctaagtggctttttattcaaagtactacgtctaagtactttatagtttatatagtctcccttagaagcatcacgtttatggaagtatttgatttactcgctgtcgctacactctcattgccactggcatgcccatccttgttcttcttcttcttgtgctcattttgcttcttatgtttcttctctccattgttaatgaacgttcctaggccattaacacctttgtttgtctcgtgagtgttcttctggtgctgtcctaagagcttcccatgtccatggcccttgttagcctcgtggctcttgtgctctagaaacgtccctaagccgttctgacccttttgaccatttttacccttgaatagtccatcaagaaacccaccatggctacggtgattcatagtcggactatgcccatatactgggcggctatggctctggtcatatccctggtgatggttctgaccataaccctggcgactctggccttgagccacatcgtagtattctttttcacgtgtttcgtagtactgcattgtggtagagaagaagcgagttttatgcaactaaaaaccccattaacgaaagatgtcattggcttcacctattcagtgtatcaggattcttaatccatcttcttcctcttccacaacttcgtcgtctttcagattctcaacgattaagccatgtgtcttcgtcatcagatgttctcaggcagaaggtccattgagaagaccctctgctcctcctactctccgcgagccttcacctccgcaaaagcctgttcctcctgtaccgtcttcttctcctcctccatccccgcccctgcagaaaacggtggctgttgatggtaagggtgtagttacggtggagtttcagagacagaaggccaaagagcttcaggaatactttaagcagaagaagcttgaagctgctggtcaaggtcccttctttggtttccaacccaaaaacgagatctccaatggaaggtgggctatgtttggtttcgcggttggaatgcttacagagtatgccacaggctcagaccttgtcgaccaagttaaaatccttctctccaacttcggaattatagacttggaataacaagagttttgttaattcgtcttcctctgtatgcatctctaaagatcttcaaatacatgagcatttgtgtattcaaccactttttatcttccagtcatataattatgaactgtggatcgattcaaaaaaaaaaaaa

SEQ ID NO: 3872 - DNA, 784 bp, Raphanus sativus
gggagacttggccatgtctcatccacacaagcgtaataataccaaagacgctaaaacataacagcttcgaacatcagacaattcaactagcaaactccccattaacgaaagatgtcagtggcttcgccgattcaatgtattaggatccttaatccatattcttcttcttctacaacttcatcgtctttcagattctctacgagtaagccatgtgtcttcatcatcagatgttctcaggccgaaggtccattgagaaggccatctgctcctcctactctccgggagcctacacctccgcaaaaaactgttcctcctacttcttcttctcttcttcttctccaccgctgcagaaaacggtggctgttgatggtaagagtgtagttacggtggagtttcagaggcagaaggctaaagagcttcaggaatactttaagcagaagaagcttgaagctgctggtcaaggtcccttctttggtttccaacccaaaaacgaaatctccaatggaaggtgggctatgtttggttttgcggtggggatgcttacagagtatgcaacaggctcagaccttgtcgaccaagttaaaatccttctctccaatttcggcattatagacttggaataataaaagagtgttgttcttcttctcgtctctcaatcttctatcttgtttctcattcttccttcctgtatatgttatttctagatatcttaaatacattggaccatttgtgtattcaacctcttttatcttcaattagtaataataataatatcatctatgta

SEQ ID NO: 3873 - DNA, 895 bp, Eutrema parvulum
actcgccgtccacgcgcgtgggatgatatccaaactccaaagtgccatttgacaaaagccatttgtgcaaatgctgagacttggccatatctcatccacacagacatcaccaaaagacactacacaaccaaagaacacaacgagaaaattcagacaattcaagttaaagaaagccattaacgaaagatgtcagtggcttcgccgattcaatgtatcaggatccttaatccatcttcttcttcatcttcatcttcatcttctttgacaacatcgtcttctttcagattctcaacgactaagccatgtgtcttcatcatcagatgttctcagaccgaaggtccattgagaaggccatctgctcctcctactctccgtgagccttcgcctccgcaaaaacctgttcctcctacgccgtcttcttctcccccgccacctccgccgctgcagcaatcggtggctgttgatggcaagagtgtaactacggtggaatttcagaggcagaaggctaaagagcttcaagagtactttaagaagaagaagcttgaagctgctggtcaaggccccttttttggtttccaacccaaaaacgagatctccaatggaaggtgggctatgtttggtttcgccgttgggatgctcacagagtatgcaacaggatcagaccttgtcgaccaagttaaaatccttctatccaatttcggcattttagacttggattaataagagcattgtgttatatagatacccctttctctcttgtttcaatcttcatcttgttgttcattcttcttcctgtatatgtatctctaagatctttaaatacagggccatttgtgtattcaaccacttcatcttcaaatggtataatatgatctatgtatcgattctaaaaatg

SEQ ID NO: 3874 - DNA, 751 bp, Arabidopsis thaliana
catccacaaagacattaccaaaagacagaaccaaagcttcgaaaatcagacaattcaactaacaaaaaaatgtcagtagcttcaccgattcaatgtatcaggattctaaatccatcatcttcatcttcttcttcgacagcttcgtcgtcttttagattctcaacaacgactaagccatgtgtcttcatcatcagatgctctcagacagaaggtcctttaagaagaccatcggctcctcctactctccgggagcctcaaaaacctgttcctccatcacagccatcttcctctcctcctccttctccgccgccgcagaaagctgtagctgttgatgggaagagtgtaactacagtggagtttcagagacaaaaggctaaagagcttcaagagtactttaaacagaaaaagcttgaagctgctggtcaaggtcccttttttggtttccaacccaaaaatgagatctccaatggaaggtgggctatgtttggtttcgcagttggtatgctcacagagtatgcaacaggatcagaccttgttgatcaagttaagatccttctctcaaatttcggcattctagacttggaataataagagtgttgttgttatatatagacagatccttttctctcttctcttcgattcctcttcttgttgtttcttcttcttcttcctgtatatgtatctatataatacagggccatttgtgtattcaatcacttttatcttcaaatggtataaatacgatcttgta

SEQ ID NO: 3875 - DNA, 699 bp, Brassica napus
gatccacacagagattgccaaaaacactaacagctcgacccatcaaacaattcttcaactaaaaaccccattaacgaaagatgtcattggcttcacctattcagtgtatcaggattcttaatccatcttcttcctcttccacaacttcgtcgtctttcagattctcaacgattaagccatgtgtcttcgtcatcagatgttctcaggcagaaggtccattgagaagaccctctgctcctcctactctccgcgagccttcacctccgcaaaagcctgttcctcctgtaccgtcttcttctcctcctccatccccgcccctgcagaaaacggtggctgttgatggtaagggtgtagttacggtggagtttcagagacagaaggccaaagagcttcaggaatactttaagcagaagaagcttgaagctgctggtcaaggtcccttctttggtttccaaccaaaaacgagatctccaatggaaggtgggctatgtttggtttcgcggttggaatgcttacagagtatgccacaggctcagaccttgtcgaccaagttaaaatccttctctccaacttcggaattatagacttggagtaacaagagttttgttaattcgtcttcctctgtatgcatctctaaagatcttcaaatacatgagcatttgtgtattcaaccactttttatcttcaagtcatataatt

SEQ ID NO: 3876 - DNA, 904 bp, Arabidopsis lyrata
aaaaatttactcaatcatcatgacttggttttaggcttttagcttcaagtcaaacaagtagttaaaaactattaccacgcgccatcaacgcgcgtgggatgattccaaaagtaccatttgcgtttaagcttcagacttggccaaatcacatccacaaagacattaccaaaagacagaaccaaagcttcgaaaatcagacaattcaactaaacgaaaagatgtcagtagcttcaccgattcaatgtatcaggattctaaatccatcatcttcctcttcttcatcttcttcaacagcttcgtcgtcttttagattctcatcgacgactaagccatgtgtattcatcatcagatgttctcagacagaaggtcctttaagaaggccctcggctcctccaactctccgggagccgcaaaaacctgttcctccatcgcagccctcttccgctcctcctcctcctcccccgccgcagaaagctgtggctgttgatgggaagagtgtaactacggtggagtttcagagacagaaggctaaagagcttcaagagtactttaaacagaagaagcttgaagctgctggtcaaggtcctttttttggtttccaacccaaaaatgagatctccaatggaaggtgggcgatgtttggtttcgcagttggaatgctcacagagtatgcaacaggatcagaccttgttgatcaagttaagatccttctctcgaatttcggcattgtagacttggaataataagagtgttgttatatatagacagacccttttctctcttgtctcctattcctcttcttgtttattgttcttcctgtatatgtatctctaagatttttaaatacagggccatttgtgtatccaatcactttatcttcaaatggtataaatacgatcttgta

SEQ ID NO: 3877 - DNA, 889 bp, Eutrema halophilum
ttcacgcgccttctacgcgcgtgggatgattccaaagtaccatttgacaaatgcaaatgctgagacttggccatatctcatccacacagacattaccaaaagactttactacagaacagcttcgaacatcaaaacaattcttcaactaaagaaacccattaaacgaatgatgtcagtggcttcgccgattcaatgtatcaggattcttaatccatcttcttcttcttcttcttcatcttgttcctcaacaacttcgtcgtctttcagattctcagcgactaagccatgtgtattcgttatcagatgttctcagaccgaaggtcccttgagaagaccctcggctcctcctactctccgggagccttcgccatcgcagaaacctgttcctcctacgccgtcttcttctcctccgccacctcctccgcagatatcggtggctgttgatggtaagagtgcaattacggtggagtttcagagacagaaggctaaagagcttcaggattactttaagcagaagaagcttgaagcagctggtcaaggccccttttttggtttccaacctaaaaatgagatctctaatggaaggtgggctatgtttggtttcgcggttgggatgctgaccgagtatgcaacaggctcagaccttgtcgaccaagttaagattcttctctccaatttcggcattatagacttggaataataagagtgttgtgttatatagataccccctttctctcttgtcgccgatttctatgttcaatcttcatcttgttttgtattcttcttcttcctgtatatgtatcactaaagtctttaaatacagggccatttgtgtattcaacgactttttatcttcaaatgataagatatatgatctatgaatcgattc

SEQ ID NO: 3878 - DNA, 795 bp, Thellungiella halophila
ggcacagacattaccaaaagactttactacagaacagcttcgaacatcaaaacaattcttcaactaaagaaacccattaaacgaatgatgtcagtggcttcgccgattcaatgtatcaggattcttaatccatcttcttcttcttcttcttcatcttgttcctcaacaacttcgtcgtctttcagattctcagcgactaagccatgtgtattcgttatcagatgttctcagaccgaaggtcccttgagaagaccctcggctcctcctactctccgggagccttcgccatcgcagaaacctgttcctcctacgccgtcttcttctcctccgccacctcctccgcagatatcggtggctgttgatggtaagagtgcaattacggtggagtttcagagacagaaggctaaagagcttcaggattactttaagcagaagaagcttgaagcagctggtcaaggccccttttttggtttccaacctaaaaatgagatctctaatggaaggtgggctatgtttggtttcgcggttgggatgctgaccgagtatgcaacaggctcagaccttgtcgaccaagttaagattcttctctccaatttcggcattatagacttggaataataagagtgttgtgttatatagataccccctttctctcttgtcgccgatttctatgttcaatcttcatcttgttttgtattcttcttcttcctgtatatgtatcactaaagtctttaaatacagggccatttgtgtattcaacgactttttatcttcaaatgataagatatatgatct

SEQ ID NO: 3879 - DNA, 1508 bp, Brassica napus
gggccacctattattatcttctcattcattacatttctctcaccaacttaagttcctgtcctaaataccatttggtctttttttcctctagatctgtactgtccgttgattcatcatggcttcacataattactagttctgttctgtctgtgtgataattttggtaaggaaagaaaaaacgagggctgtaatcaattcgattgatttgaagatatggcaactttgaacccttttgatctgttgggtgacgacgcagaggatccgagccagatcgccgtctccatcgctgctgataagcccaagaaacctgcacctgtttccgctaagtcatctgctccgtcgaggcagcttcctcaacctgtgagagaggctaggagtgatgctccacgcggcggtggacgtggtggtggtggagaccgaggatctagccgtggtcgtggtggttacaaccgtgattttagaggcggtgatggtaacagtggaggatacaataagccctctgaggaaggaggggtttcaaagcctttctatgagaaacgtagtgtatatggcggtgctcctcgtggtggtggtcgacgtggtgaagctggtgaaggtgaacgtcctcgaaggacatacgagcgtcgtagtggaactggcagagggggtgacttcaaaagggaaggagctggtcgtggaaattggggaacaccaggagaagaagttcttgttgtggagactgaagaagttgctggtgctgagagtgagaagcctgctggtgatgaggttgctgctgatgctaagaaggagaacactgctgaagtcgaggagcagaaagagcctgaagataaggagatgactctggatgagtatgagaaaatacttgaggagaagaaaaagtctcttcagtctcagaccacctctgagaggaaagttgatactaaagtgtttgaatcaatgcaacaactctcaaacaagaagaagtctaacgatgaaatcttcatcaagctgggttctgataaggacaaacgcaaagatgacaaagaagagaaggctaagaaggctgtgagcattaatgagtttctgaaaccagctgagggtgagaactactaccgaggaggaggccgtggtggtggtcgtggaaggggacgtggtggtcgtgaccgtggagttggttctggtggtggatttgatggttaccgtagtgaagctgcgcctgccatcggagatactgctcagttcccatctcttgggggaaagtaagatccaaccttggacactcctgctgtctccttcagttttcctcatcatgactgaagtgtttcatgctgagtgtttgctggtctgttgttgtcaggtgtaaattgttagttgttgtcagtttttagagtttctgaaaacttatgcctgaccggtcttttttttttaacgtttggaccaataatacccttttctattttggttttaccacttagtctttatagttgtttgtgaaaagacagacagttctaatgttatatgctttgagt

SEQ ID NO: 3880 - DNA, 1674 bp, Eutrema parvulum
aaaaattgccacatttttttttcttttatttcatttctctctctcaccaacccaagcaagttcctatcgtaaaacccatttttcgtctccttcgtccaaacgttttatctacttctttagatctgttaatccatggcttcacttaataactagttgtgtcttgtctctgtctgatacttttgggggaaggaagaaactagggttgtaattacttgtattgattttaagaaatggcaactttgaacccttttgatctgttggatgacgatgctgaggatccaagccagctcgccgtctccatcgctgctgataagcctaagaaatctgcaccggtttcgggcgtgcctgctaagtcagctgctccatcgaagcagcttcctcctgctcaagctgtgagagaggctaggagtgatgctccacgcggtggtggacgtggtggtggtggagaccgtggctttagccgtggtcgtggtggacctggtggttacaaccgtgattttagaggcggtgatggtcctggaggtaacaatggatattcagggggatacagtaagccctctgaggaaggagacgtttcaaagtcgtcttatgagagacgtggtggtggatttggcggtcctcctcgtggtggtcgacgtggtggattcagcaatgaaggtggtgaaggtgaacgtcctcgaaggacatttgagcgtcgtagtggaactggcagagggggtgacttcaaacgtgaaggatctggtcgtggaaactggggaacaccaggagaagaagttcttgttggggagactgaagaagttgctggcgttgagactgagaaggatgctgtggagaagcctgctgctgatgctaacaaggagaatactgttgacatcgaggagcagaaagagcctgaggataaggaaatgactcttgatgagtatgagaaaatttttgaggagaagagaaaggcccttcaatctcagaccacctctgagaggaaagttgataccaaagtgtttgaatcaatgcaacaactctcaaacaagaagtctaacgatgaaatcttcatcaagttgggttctgagaaggacaaacgcaaagatgacaaagaagagaaggctaagaaggctgtgagcatcaatgagtttctaaaaccagcagagggtgagaactactaccgaggaggtcgtggtggccgtggacgtggtggtcgtgaccgtggaggtgtttcaaggggcggatttggtggtaaccgtggtgaagctgcgcctgccattggagatgctgctcagttcccatctcttgggggcaagtaagatccatccatgaaaacgtcaaaactcgtgcggtctcctttagttttcctcatctggttgaatacaagacagaaggatttcatgcgagggtttactgtttgccggtctgttgttgtcaggtgtaaatgtttagttgtcagtttttagattttctgcaaacttatgcctgaccggtttttctactttgaaacattacactcttttttggtttaccatttagtctttttagtcgttgttttgttgtttgtgaaacttctgtcagacagacaattctaatgttatcggttttttcttagttcattctattcgtgttcttagatgttacaaaaactgtaatactttgacaacgtactttaagattcgaaagtttattttc

SEQ ID NO: 3881 - DNA, 1534 bp, Brassica rapa
gggatcgtcgtctccttcgttccgaccttttgtctctctctttagacctgttagttaatccatggcttcacttagttgttactagttgtgtttgtcttctgtgtgatagtaagtatctgtaataactcgtatttgatttaaggaatggctactttgaacccttttgatctgttggatgacgatgctgaggatccgagccagctcgccgtctccatcgctgctgataagtccaggaagcctgcacctgtctcaggcttgcctgctaagtcaactcctccgtcttcgaagcagcctcctccttctcaagctgtgagagaggctaggagtgatgctccacgtggcggtggtggtggatttagccgtggtcgtggtggttacaaccgtggaggtaacaatggatattcagggggatacagtaagccctctgaggaaggagacgtttcaaagccttcttatgagagacgtggtggtggtggtgtaggtcctccgcgtggtggtagacgtggtgaagctggtgaaggtgaacgtcctcgaagggcatttgagcgtcgtagtggaactggcagagggggtgacttcaaacgtgaaggagctggtcgtggaaactggggaacaccaggagaagaagttcttgctgtcgagactgaagaagtagcagctggggttgaaaacgagaaggatgttgtggagaagcctgctgatgatgatgctaacaaggagaacactactgaagttgaggagcagaaagagcctgaggttaaggaaatgactctggatgagtatgagaaaatactcgaggagaagagaaaggcacttcaatctcagaacacctctgagaggaaagttgataccaaagtgtttgaatcaatgcaacaactctcaaacaagaagaagtctaacgatgaaatcttcatcaagttgggttcagacaaggacaaacgcaaagatgacaaagaagagaaggctaagaaggctgtgagcattaatgagtttctgaaaccagcggagggtgagaactactaccgaggaggtcgtggtggccgtggacgaggtggtcgtgtttcaagtggtggtggatttagtggtaaccgtagtgaagctgcgcctgccattgcggatactgctcagttcccatctcttgggggcaagtaaagagatccatccatgaacacacgtctgaaacacacactcatgcgggagtttcatgcgagagtcgtactgtttgcatgtatgttgtcagttgtaaatttttagttgtctgtcagtttttagattttctgcaaacttatgcctgaccgtttttttttcctttttttaattacttttgaaacattactcgcttttagtttaccacttctttgtcgttgttttgttgtttatgaaaacttgttttagacagccaagtctaatgttatcggttttgagtcttctttgagttcactctgtcatctctttcctcatgttcatagttctgtaatagacaaatattaaaaagattcaatagtttattttctattaacagttgtgtgattta

SEQ ID NO: 3882 - DNA, 1456 bp, Brassica napus
cagaagccaatcatacgcagacgaagcaccccctagagagagagagagagatcaacataagtctcagcttaagcacgttttggagattttcaccggaactcaaagctgtgaggatctttacttgaaagaagagagaacaaatatgcccaggtggatctgttgtggtgggcatagatcaggagattctgatatatcaaatgatgagaaacatctgaaaactcaatggcagcaacctgatgcaaataagacaagaccacaagctgttgcaaagcctgaggcgcccaaggaagcactccccattgaagttcctcccttgtctgtggaagaggttgaagaaaagactgacaatttcggatcaaagtcgctcattggtgagggatcttatggaagggtgtattatgctactcttagtgatggtaaagctgttgctttgaagaaactcgatgttgcccctgaagctgaaacaaacaccgagttcttgagtcaggtttcaatggtttcaagactgaagcatgacaacttcattcagctggtgggttattgcgtcgatgagaacctccgtgttcttgcttacgagtttgcaacgatgggatcactccacgacgtcctacacggtaggaagggagttcaaggcgcgcagccaggtccaacgctcgactggataacgagggtgaagatagccgttgaggcggctaggggtttagaataccttcacgagaaggttcagcctcctgtaatacacagagacgtgagatctagcaacgtgcttctctttgaagactatcaagcgaaagttgctgattttaatctctcgaatcaagctcctgataatgctgctcgtcttcactctacaagagtcttgggcacctttggctatcacgctccagaatatgctatgactggacagttgacacagaagagtgatgtgtatagctttggggttgtgcttcttgagcttttgacagggaggaaacctgtggatcacacaatgccacgtggccaacagagtcttgtaacctgggctacaccgagactaagtgaagacaaagtgaagcagtgtgttgatccaaagctaaaaggagagtatcctcctaaatcagtagctaagctagcagcggtggcggcattgtgtgtgcaatatgaatcagagtttagaccgaatatgagtatcgttgtgaaagctttgcagccacttctcaaacctccagcgccggcccctgtacctgagtcttgagtttttgcgttgttggattctttctttgttcatacaaagtttagtttgtattttggttggtgtgaaagggagggatactttgatattttgcacttgttttatgtctggattggagcaacaaaagatgtattgcgtttgctgttcttttgacatttccttagggatttatttgaatatttggtgtcaatgtatagtcaagagaccaaatgagaccaaatctga

SEQ ID NO: 3883 - DNA, 1160 bp, Brassica napus
aagtctcagcttaagcacgttttggagattcgaccggaaccaaaagctctgaggaaggatctttacttgaaagaagagaacaaatatgcccaggtggatctgttgtggtgggcatagacgaggagattctgatatatcaaatgatgaccatcatctcaaaactcaatggcagcaacctgatgcaaataagacaagaccacaagctgttgcaaagcctgaggcgcccaaggaagcactccccattgaagttcctcccttgtctgtggaagaggttgaagagaagactgacaatttcggatcaaagtcgctcattggtgagggatcttacggaagggtgtattacgctactcttagtgatggtaaagcagttgctttgaagaaactcgatgttgcccctgaagctgagacaaacaccgagttcttgagtcaggtttcaatggtttcaagactgaagcatgagaacttcattcagctggtgggttattgcgtcgatgagaacctccgtgttcttgcttacgagtttgcaacgatgggatcgctccacgacgtcctacacggtaggaagggagttcaaggcgcgcagccaggtccaacgctcgactggataacaagggtgaagatagccgttgaggcggctaggggtttagagtaccttcacgagaaggttcagcctcctgttatacacagagacgtgagatctagcaatgtgcttctctttgaagactatcaagcgaaagttgctgatttcaatctctcgaatcaagctcctgataatgcggctcgtcttcactctacaagagtcttgggcacctttggctatcacgctccagaatatgctatgacgggacagttgacacagaagagtgatgtgtatagctttggggttgtgcttcttgagcttttgacagggaggaaacctgtggatcacacaatgccacgtggccaacagagtcttgtaacctgggctacaccgagactgagtgaagataaagtgaagcagtgtgttgatccaaagctaaaaggagagtatcctcctaagtcagtagctaagctagcagcggtggcagcattgtgtgtgcaatatgaatcagagtttagaccgaatatgagtatcgttgtgaaagctttgcagccacttctcaaacctccagcgccggccc

SEQ ID NO: 3884 - DNA, 1414 bp, Brassica napus
aacaagcatgcacaggtggatctgttgtgggcgtagttcaggagattcggatgtatctaatgatgagcaacatctgaaaactcaatggcagcaatctcaagcagccaacaataagccaaaaccacaagctgttgcaaaacctgaggcgcccaaggaagctcttcccattgaagttcctctcttgtctgtggaagaggttaaagaaaagactgaaaattttggatcgaagtcacttattggtgaaggatcttacggaagggtgtattacgcaactctaagtgatggtaaagcagttgcattgaagaaactcgatgtagcccctgaagctgaaacaaacaccgagttcttgagtcaggtttccatggtttcaagactgaagcatgagaatttcattcagctggtcggctattgtgtcgatgagaacctccgtgttcttgcttatgagtttgcaacaatgggatcactgcacgacgttctacatggtaggaagggagtacaaggtgcacagccaggtccaacgcttgactggataacgagggtgaagatcgccgttgaggcagctaggggtttagaataccttcacgagaaggttcagcctcctgtcattcatagagacgtgagatctagcaatgtgcttctttttgaagactatcaagcaaaagttgctgatttcaatctctcaaatcaagctcctgacaatgctgcacgtcttcattctacaagagtcttgggcacctttggctatcacgctccagaatatgcaatgactggacagttgacacagaagagtgatgtgtatagctttggggttgtactactagagcttttgacagggaggaaacctgtggatcatacaatgccacgtggccaacaaagtcttgtaacctgggctacaccgagactcagtgaagacaaagtgaagcagtgtgttgatccaaagctaaaaggagaatatcctcctaaatcagtagctaagctagcagcggtggcagcattgtgtgtgcaatatgaatcagagtttagaccgaatatgagtatagttgtgaaagctttgcagccacttctcaaaactccagcgccagtcccagtaacggaaccctgagtttgtgcaagagagttggattccttgttcatacaaagttagaatctttttctgatttggggaagaaaactaaaacacaaaaagtaaaagatcatatatttatttgaggggatggaaattttagtttgcattttggtgtgaagggggacagattttttattttgcatatgtcaatgtccggatttgaaacaggcttttgtggctgtgcttgtcgtggaggagaacaatgatgtattgcatttgctgttcttttatttttctatatagataaaagggatcatttgaatatttgtatcgactctggtgacaact

SEQ ID NO: 3885 - DNA, 1410 bp, Eutrema parvulum
ggaactaaaacctgtgaggatctatatttgaagaagaaaacaaggatgcgcaggtggatctgttgtggacgtaaatcaggagattcgaatttatcaaatgatgagcaacatctgaaaagtcaatggcaatctgatgcaaatcataagaatccaacaccacaagctgttgcaaaacatgaagcacagaaggaagctcttcccattgaagttcctccgttgtctgtggaggaggttaaagaaaagactgacaattttggatcaaagtcactgattggtgagggatcttatggaagggtatattatgcaactctaaatgatgggaaggcagttgctttgaagaaacttgatgttgcccctgaagctgaaacaaacgctgagtttttgagtcaggtatccatggtttcaagactgaaacatgaaaatctcattcagctggttggttactgtgtcgatgagaacctccgtgttctttcttatgagtttgcaacgatgggatcactgcacgacgttctacatggtaggaagggagttcaaggtgcacagccaggtccaacactcgactggataacaagagtgaagatagccgttgaggcagctaggggtttagaataccttcacgaaaaggttcagcctcctgtaatacatagagacataagatctagcaatgtgcttctttttgaagactatcaagcaaaaattgctgattttaatctctcaaaccaagctcctgataatgctgcacgtcttcactctacaagagtcttgggcacctttggatatcacgctccagaatatgctatgactggacagttgacgcagaagagtgacgtgtatagctttggggttgtacttctagagcttttgacaggaaggaaacctgtggatcatacaatgccacgtggccaacaaagtcttgtaacctgggctacaccgagactcagtgaagataaagtgaagcagtgtgttgatccaaagctaaaaggagaatatcctcctaagtcagtagctaagctagcagcggtggctgcattgtgtgtgcaatacgagtctgagtttagaccgaatatgagtatagttgtgaaagctttgcagccactccttaaacctccagcgccagtcccggtaccggaatcctgagtttgtgtaacagagttggattctttgttcatacaaagtgagaatttcactctgatttgggggaaaagaagtataagaccatatttatgttgtttttttagggaatggaatgaatagttggcattttggtgtgagaggaggagagtactcaatattttgcatttgttatgtctggattcgaaaacaggcttttggctttgcttggcgtggtgaacaacgatgttgcatttgctgttcttttattttttccttatagataaataaggaaaagtt

SEQ ID NO: 3886 - DNA, 1398 bp, Arabidopsis lyrata
gtactaaaagctgtggaggatctatatttgaagaagagaacaaggatgcgcaggtggatctgttgtggggagaaaagaggagattcagatttatcaaatgaggaggtgcatctgaaaagtccatggcagcaatctgacgcaaatcaaaagaatcaaaaaccacaagctgttgcaaagcctgaggcgcagaaggaagcccttcccatcgaagttcctcccttgtcagtagatgaggttaaagaaaagactgataattttggatcaaagtctctgattggtgagggatcttatggaagggtatattatgcaacactaaatgatggcaaagcagttgctttgaagaaactcgatgttgcgcctgaagctgaaacaaattctgagttcttgagtcaggtttccatggtttctagactgaagcatgagaatctcattcaactggttggttattgtgttgatgaaaacctccgtgttcttgcttatgagtttgcaacaatgggatcactgcacgacattctccatggtaggaagggagttcaaggtgcgcagccaggtccaacacttgactggttaacaagggtgaagatagcagttgaggcagctaggggtttagaataccttcatgagaaggttcagcctcctgtgatacatagagacataagatctagcaatgtgctcctttttgaagactatcaagcaaaagttgctgatttcaatctctcaaatcaagctcctgataatgctgctcgtcttcactctacaagagtcttaggcacctttggctatcacgctccagaatatgctatgaccggacagttgacgcagaagagtgacgtgtatagctttggggttgttcttctagagcttttgacagggaggaaacctgtagatcatacaatgccacgtggccaacaaagtcttgtaacctgggctacaccaagactcagtgaagataaagtgaagcagtgtgttgatccaaagctaaaaggagaatatcctcctaaatcagtagcaaagctagcagcggtggcagcattgtgtgtacaatacgaatctgagttcagacccaacatgagtattgttgtaaaagctttgcagccacttctcaaaccaccagcaccagccccagtaccggaatcctgagtttgtgcgccttttaaataccaccgatatcttcttcgtgcaacagagttgggttctttgttcataccagtgagaattttactctgatttgggaaaaaacatagatatgatcttattattagttggcattttgattttggtgtgaaagaagagtagtgagtgtttcgcatttgttatgtgatgtattgtggaaagaggctttttacttgattggtgtggagaacaaagatgttttgcatttggtgttctttcgttttt

SEQ ID NO: 3887 - DNA, 1687 bp, Eutrema halophilum
gctttccttttggtttgccttccccgcgtttgcccatctgtcgtctctctctctacctctctctctctctccgtcttcatcaagcaaagctcctccttctccactcactcctctctctctctctctctcgctcatcttacatagagacagaggagacaatcatacgcagcgatcccctagaagagatctacacaagtctcagcttaaccacgttttgggaatcggaactaaaagcggcgagagtctataattgaagaagagaacaaggatgcgcaggtggatctgttgtggacgtaaaacaggagattcagatttgtcaaataatgaggaacatgtaaaaactcaatggcagcaatctgatgcaaatcataagaattcaaaaccacaagctgttacgaaacctgaggtgcagaaggaagctcttcccattgaggttcctcccttgtctgtggatgaggttaaagaaaagactgacaactttggatcaaagtcactgattggtgagggatcttatggaagggtatattatgcaactctaagtgatgggaaagcagttgctttgaaaaaacttgatgttgctcctgaagctgaaacaaatgccgagttcttgagtcaggtttccatggtttcaagactgaagcatgagaatctcattcaactggtcggttattgtgttgatgaaaaccttcgtgttcttgcttatgagtttgcaaccatgggatcactgcacgacgttcttcatggtaggaagggagttcaaggtgcacagccaggtccaacacttgactggataacgagggtgaaaatagccgttgaggcagctaggggtttagaataccttcatgagaaggttcagcctcctgtaattcatagagacataagatctagcaatgtgcttctttttgaagactaccaagcaaaagttgctgattttaatctctcaaatcaagctcctgataatgctgctcgtcttcactctacaagagtcttgggcacctttggctatcatgctccagaatatgccatgactggacagttgacgcagaagagtgacgtgtatagctttggggttgtacttctagagcttttgacagggaggaaacctgtggatcatacaatgccacgtggccaacaaagtcttgtaacctgggctacaccaagactcagtgaagataaagtgaagcagtgtgttgatccaaagctaaaaggagaatatcctcctaaatcagtagccaagctagcagcggtggcagcattgtgtgtgcaatacgaatctgaatttagaccgaatatgagtatagttgtgaaagctttgcagccacttctcaaagctccagcgccagcgccagcacctgaatcatgagtttgcactccttttagataccactggggcatctacagagttggattctttgttcatacaaatgagaatttgttcctctgatttgggaaagaagaaacagaaagtatgagatcatattttgtgttgttttttttaggggattatattattttttgtgttggcattttggtgtgaacggaggatattttgcatttgttatgtcagtattggaaacaggctttttgttttgcttggcgtggagaacaaatttgtattgcatttgctgttctttcgttttttatttccttatcgataataatttgagtattggttagactacatcat

SEQ ID NO: 3888 - DNA, 1590 bp, Raphanus sativus
  misc_feature (294)..(294): n is a, c, g, or t
  misc_feature (621)..(621): n is a, c, g, or t
  misc_feature (780)..(780): n is a, c, g, or t
  misc_feature (1011)..(1011): n is a, c, g, or t
  misc_feature (1570)..(1570): n is a, c, g, or t
ggcttcttcaccactcactcttctctctcatcacagcaggcaatcatacgcaagcaaccctgtgaaaagagagattgagcttaaacacgttttgtgcaaaacggaactaaaaaaaaagctctcctctgaagaagagaaacaagtatgcacaggtggatctgttgtgggcgtagttcaggagattcggatgtatcaaatgatgagcaacatctgaaaactcaaccgcagcaatctgatgcagcaaataataagccaaaaccacaagctgctgctgcaaagccagaggcgcccaangaagctcttcccgttgaagtccctcccttgtctgtggaagaggtcaaagaaaagactgacaactttggatcgaagtcacttattggtgagggttcttacggaagggtgtattacgcaactctaagtgatggtaaagctgttgctttgaagaaactcgatgttgcccctgaagctgaaacgaactccgagttcttgagtcaggtttccatggtttcaaggctgaagcatgagaatttcgttcagctggtcggttattgtgttgatgagaacctccgtgttcttgcttatgagtttgcaacaatgggatcactgcacgacgtcctacanggtaggaagggagttcaaggtgcacagccaggtccaacacttgactggataacgagggtgaagatagccgttgaggcagctaggggtttagaataccttcatgagaaggttcagcctcctgtcatacatagagacgtgagatctagcaatgtgcttctntttgaagactatcaagcaaaagttgctgatttcaatctctcaaatcaagctcctgacaacgctgctcgtcttcactctaccagagtcttgggcacctttggctatcacgctccagaatatgctatgactggacagttgacacagaagagtgatgtttatagctttggggttgtactgcttgagcttttgacagggaggaaacctgtggatcatacaatgccacgtggccancaaagtcttgtaacctgggctacaccgaggcttagtgaagacaaagtgaagcagtgtgttgatccaaagctaaaaggagaatatcctcctaaatcagtagccaagctggcagcggtggcagcattgtgtgtgcagtacgaatcagagtttagaccgaatatgagtatagttgtgaaagctttgcagccacttctcaaaactccagcaccagtcccagcagcggaatcatgagtctgtgcaacagagttggattcttttgttcatacaaagttataatctttctctgatttggggaagaaaacaaaaagtaaaagatcatatttatttgaggggatggaaattattagtttgcattttggtgtgaaaggagacaagactttttattttgcatgtgtcatgtctggattgaaacaaggctttttttgggctttgctttgtcgttggaggagaacaatgatgtattgcatttgctgttcttttgatttttctatatagataaaaaggggatcatttgaatattttggtcttgtctatattgacagctcttttaaggtttatntgattcgactattcaaatta

SEQ ID NO: 3889 - DNA, 1498 bp, Brassica napus
agacaatacaactactcctagctttgtaacgccggtacgaggaaggacgtacaaagactgtgtagaaggagtctgtgtatttgtaagaagaatgcgcaggtggatctgttgtgggcgtatatcaggaggagattcaggtttatcaaatgatgagcaacatctcaaaactcaatggcaacaacaacaacaacctgatgcagcaaatcaaaagctaagaccacaacctgctgcaaaacctgacgcgcccaaggaagctctccctattgaagtccctcccttgtctgtggaagaggttaaagagaagacagacaattttggatcgaagtcgctgattggtgagggatcttatggaagggtctattacgcaacgcttaacgatggtaaagcagtggctttgaagaaactcgacgttgcacctgaagctgaaacaaactccgagttcttgagtcaggtttctatggtttcgagactgaagcatgataacctcatccaactagtcggctactgcgtcgacgaggacctccgtgttcttgcttacgagttcgcaacgatgggatcgctccacgacgttctacacggtaggaaaggagttcaaggcgcgcagccaggtccgacgctcgactggataacgagggtgaagatagcagtcgaggcggctaggggtttagagtaccttcacgagaaggttcagcctcctgtgatacacagagacgtgagatccagcaacgtgcttctctttgaagactatcaagccaaaatcgctgatttcaatctctcgaatcaggctcctgataacgctgctcgtcttcactctacgagagtcttgggaacctttggctatcacgctccagaatatgctatgacgggacagttgacgcagaagagtgacgtgtatagctttggggttgtactgcttgagcttttgacagggaggaagcctgtggatcacacgatgccacgtggccagcaaagtcttgtaacatgggctacaccgagacttagtgaagacaaagtgaagcagtgtgttgatccaaagctaaaaggagagtatcctcctaaatcagtagctaagctagcagcggtggcagcgttgtgtgtgcaatacgaatctgagtttagaccgaatatgagtatagttgtgaaagctttgcagccgcttctcaaacctccagctccagcagccccaacacctgaatcctgagtttgtgttacagagttggatacctttgttcatacgaagtttttatctggtttggagaagagaaaacaaaaaatataatatttcatatctatgttgttttctttatggggtgggattttactagttggcattttggtggtgaccaggagatcacttaatagtttgcatttgtttatgtctggattggaaacaggctgttttgctttgcttgtcgtgatggagaacaactgtgtaattgcattcttgcttgttctattggtcttgtatttatattacgaacttaacttacgttaaacg

SEQ ID NO: 3890 - DNA, 1577 bp, Brassica napus
ctttgggcgactgcaggtaccggttccggattcccgcgtcgacccacgcgtccgcggacgcgtggggcaaagcaaaaggctcctccttttccactctctcatctctacatagaagagacaatcgaaccctcggcaattctcagcttaaccacgttttgggcaaaacacacagatttgactgacggtaaagaagccaagagctgaaaatcaggatgcgcaggtggatctgttgtgggcgtatatcaggtgattcagatttatcaaatgatgagcaacatctcaaaactcaatggcaacaacaacaacaacctgatgcagcaaaccaaaagctaaaaccacagcctgctacaaaacctgacgtccccaaagaagctcttcccattgaagtccctcccttgtctgtagaagaggttaaagagaagacagacaattttggatcaaagtcactgattggcgagggatcttacggaagggtgtattacgcaacgctaaacgatggtaaagcagtagctttgaagaaacttgacgttgcacctgaagctgaaacaaacgctgagttcttgagtcaggtttctatggtttcgagactgaagcatgataacctcatccaactagtcggctactgcgtcgacgaggacctccgtgttcttgcttacgagttcgcaacgatgggatcgctccacgacgttctacacggtaggaaaggagttcaaggcgcgcagccaggtccgacgctcgactggataacgagggtgaagatagcagtcgaggcggctaggggtttagagtaccttcacgagaaggttcagcctcctgtgatacacagagacgtgagatccagcaacgtgcttctctttgaagactatcaagccaaaatcgctgatttcaatctctcgaatcaggctcctgataacgctgctcgtcttcactctacgagagtcttgggaacctttggctatcacgctccagaatatgctatgacgggacagttgacgcagaagagtgacgtgtatagctttggggttgtactgcttgagcttttgacagggaggaagcctgtggatcacacgatgccacgtggccagcaaagtcttgtaacatgggctacaccgagacttagtgaagacaaagtgaagcagtgtgttgatccaaagctaaaaggagagtatcctcctaaatcagtagctaagctagcagcggtggcagcgttgtgtgtgcaatacgaatctgagtttagaccgaatatgagtatagttgtgaaagctttgcagccgcttctcaaacctccagctccagcagccccaacacctgaatcctgagtttgtgttacagagttggatacctttgttcatacgaagtttttatctggtttggagaagagaaaacaaaaaaatataatatttcatatctatgttgtttttctttatgggggtgggattttactagttggcattttggtggtgaccaggagatcacttaatagtttgcatttgtttatgtctggattggaaacaggctgttttgctttgcttgtcgtgatggagaacaactgtgtaattgcattcttgctgttctat

SEQ ID NO: 3891 - DNA, 1498 bp, Arabidopsis thaliana
agtttctggttttgactttactttgaagcttttttttttcagtactaagaagctgtggaggatctatatttgaaagaagagaacaaggatgcgtaggtggatctgttgtggggataaaaaaggagattcagatttatcaaatgaagaggtgcatttgaaaagtccatggcaaaattctgaggcaaatcaaaagaatcaaaaaccacaagctgttgtaaagcctgaggcgcagaaagaagctcttcccatcgaagttcctcccttgtctgtggatgaggttaaagaaaagactgacaattttggatctaagtctctgattggtgagggttcttatggaagggtatattatgcaactctaaatgatgggaaagcagttgctttgaagaaactcgatgttgcacctgaagctgaaacaaacaccgagttcctgaatcaggtttccatggtttcaagactaaaacatgagaatctcattcaactggttggttattgtgttgatgaaaacctccgtgttcttgcttatgagtttgcaacaatgggatcactgcacgacattctacatggtaggaagggagttcaaggagcacagccaggtccaacacttgactggttaacgagggtgaagatagctgttgaggcagctaggggtttagaataccttcatgagaaggttcagcctcctgtaatacatagagacataagatctagcaatgttctcctttttgaagactatcaagcaaaagttgcagattttaatctctcaaatcaagctcctgataatgctgctcgtcttcactctacgagagttttaggcacctttggctatcacgctccagaatatgctatgacaggacagttaacgcagaagagtgacgtgtatagctttggggttgttcttctagagcttttgacaggaaggaaacctgtagatcatacaatgccacgcggccaacagagtcttgtaacttgggctacaccgagactcagtgaagataaagtgaagcaatgtgttgatccaaagttaaaaggagaatatcctcctaaatcagtagccaagctagcagcggtggcagcattatgtgtgcaatacgaatctgagtttagaccaaatatgagtatagttgtaaaagctttgcagccacttctcaaaccaccagcaccagccccagccccagtaccggaatcctgagtttgtgcaccttttaaataccagccatcttcttcgtgcaatagagttgggttctttgttcatacaaagtgagaattatactctgatttgggaaaaacatagacatgatcttactattagttttcattttggtgttaaagaagagtgcttaatatttctcatttgttatgtgaggtattggaaacaggctttttttacttgattggcgtggagaacaaacatgttttgcatttggtgtcttttttttttgttctccttttctgaatatattgacaagctctgtttaagggtttctgaatccaccatttg

SEQ ID NO: 3892 - DNA, 1062 bp, Vitis vinifera
cgagtaacgctctgtacagcacatccaacttccatagatatttctctatataatgccaattcatccactccactccacactcacccccaaacccctctcctctttcattgcctttctcctttgtcattgtcttccttccagatttctcagggagggggtttgttcgaagcattggatcgccatggcgaaggtgtttgcgctgtttctcttggctcttctcgccatttccatgcttcacaccactgttttggcttcgcatggccatggcggtcaccactacgaccaaaagaactatggtccggggagtctgaagagcttccaatgcccgtcacagtgctcgaggaggtgcggcaagacacagtaccacaaaccttgcatgttcttctgtcagaaatgctgcaaaaagtgcctgtgcgttcccccagggtattatggtaataaagccgtctgcccatgctacaacaactggaagaccaaggaaggaggaccaaaatgcccctgatctgttcccttatttacccatatttatcatatagtgttgtagtagtactaagtactaactaatatatgagtatgtttaagtgttgtaggcctcttatggtcctgctggattttgcagtacctgggtgtttttggaaaatcgagaatgactcaagtgatggatcatgatgccatggagtcactccattggggtttgtcccttggatgagagtggctgatcgatttgttattttgtatgagaattttatatgtttagggtcttccatttatgaaatgtagtatgtttgtggcttttcctaaattccacctgccacggggccagctttacaaaaagagtagcatcatcatcatgagttgcacatggatctatccatgaagatttttccttttttctctttttattgggggccagctttaattatgatgacattgacccaaagattcaattcaagcacatcatagacccctgtttgagaaaatttagccacattgatgtgtgtgagtgagcacgtcttcctagtgcaaagaaaattgcttcttgtggaagcagctttgaacaaa

SEQ ID NO: 3893 - DNA, 778 bp, Vitis vinifera
cctctcctctttcattgcctttctcctttgtcattgtcttccttccagatttctcagggagggggtttgttcgaagcattggatcgccatggcgaaggtgtttgcgctgtttctcttggctcttctcgccatttccatgcttcacaccactgttttggcttcgcatggccatggcggtcaccactacgaccaaaagaactatggtccggggagtctgaagagcttccaatgcccgtcacagtgctcgaggaggtgcggcaagacacagtaccacaaaccttgcatgttcttctgtcagaaatgctgcaaaaagtgcctgtgcgttcccccagggtattatggtaataaagccgtctgcccatgctacaacaactggaagaccaaggaaggaggaccaaaatgcccctgatctgttcccttatttacccatatttatcatgtagtgttgtagtagtactaagtactaactaatatatgagtatgtttaagtgttgtaggcctcttatggtcctgctggattttgcagtacctgggtgtttttggaaaatcgagaatgactcaagtgatggatcatgatgccatggagtcactccattggggtttgtcccttggatgagagtggctgatcgatttgttattttgtatgagaattttatatgtttagggtcttccatttatgaaatgtagtatgtttgtggcttttcctaaattccacctgccacggggccagctttacaaaaagagtagcatcatcatcatgagttgcacatggatctat

SEQ ID NO: 3894 - DNA, 654 bp, Euphorbia peplus
cattcatcatcatcttcctcttaattcctgaggggtttggtttgatcttcagaaaacaccatggctaagtcttttgctctcttcttcctagctctcattgccatctcaatgcttcaaaccatggttatggcatctaatggccatggtggtcaccataacaatcaaaatggctatggaccagggagtttgaagagctaccaatgcccatcacaatgcacgaggagatgcggtcggactcagtaccacaagccatgcatgttcttctgtcagaagtgctgcaacaagtgcctatgtgttcctccggggtattatggtaataaagcagtgtgcccttgctacaacaactggaagaccaaggaaggaggacccaagtgcccttaaatatttaaatcgatcaaattaaattctatatggtatttatttattattaattaatgccatatactatatatgtacttttaatttatgcagcacttcactcactgattaaagagactgtgtgctgtttttgtcatttcaaggtatagctactccttttagggtcctaccctaaaatgtgaggggctcctctgctaattaaattgtatttccagtggattctatgttcttttaatatctatagtatttattaatcatatgggatatctgatccga

SEQ ID NO: 3895 - DNA, 595 bp, Medicago truncatula
gtggcatctcacaaaactctatgcaagttttcacatatcaaatccaataataaatattgatgataaatgtggtagttctcccaccctcatcaaaattctataaatgctcccactttcactttatgtattgttccattatcactttactcccctctctttaatcctcttgtggtccatttttgtgctacacacattttcctcttcttgaaacattgacattggccatggctagattagttgttgttttcatcttggtcctcattgcaatttccatgcttcaaacggtggtcatggcttctcatggacatggaggccatcactacaatgacaagaaaaaatatggacctggaagtcttaagagttaccaatgcccatctcaatgctcaaggagatgcaaaaatactcaatatcacaagccatgcatgttcttttgtcaaaagtgttgtaacaaatgcttgtgtgtgcccccggggtattatgggaacaaagctgtatgcccttgctacaacaattggaagactcaacaaggaggaccaaaatgcccttaagcttgttcttcatcaaattaaattaacaaatactataactaaactac

SEQ ID NO: 3896 - DNA, 777 bp, Arachis hypogaea
cgggggattaacacttaggtttttgtttttccccctacttgtgttgttggtttctcttacctttttttgtcttcattttgccatggctaagttctttgctgctttcatcttggctctcattgccatttcaatgctccaaactatggtcatggctgctaatgggcaaggaggccatttctatgacaacaagagccaatatggacctgggagtgtcaagagttaccaatgcccatcacaatgctcaaggaggtgtggcaagacccaataccacaagccctgcatgttcttttgtcagaagtgttgtaggaagtgcctttgtgttcctccggggtattatggtaacaaagctgtttgcccttgctacaacaactggaagaccaaggaaggaggaccaaaatgcccttaagcttcatcaaccacttgctttctagtttctatccaaatatcataattaattccctttgtgcccttttatcatactagcttaattattatactaagcttctctactatatttcatgtgttacttagccaaatggtagtagcccaaccttattagggagatatatcaaatactctttgatgtgttttagggtgaccctttttggtttatttggaaaaagaatgttttgatgtattttggggaaatccccttttgagttaatgtggtttcttttatatgttcgtatcactccttgaggctttgtattggcctttaatgagagtggctaatggctaatgttactatcatatgaatgaaatttcttatattatgtc

SEQ ID NO: 3897 - DNA, 604 bp, Pisum sativum
ttatcactctcctctcatctcttttggtccatttctgtgcttcacaagttggccatatagtacaatacacctagcccctcttcttcaaacatggccatggcaaaattacttggtgctttgatcttgatcctcattgcaatttccatgcttcaaacaatggttatggcttctcatggacatggaggccaccactacaatgacaagacaaaatatggacctggaagtcttaagagttaccaatgcccatctcaatgttcaagaaggtgcaaaatgacccaataccacaagccatgcatgtttttttgtcagaagtgctgtaataaatgcttgtgtgtgcctccggggtattatgggaataaagctatatgtccttgctacaacagttggaagactcaacaaggaggaccaaaatgcccttaagtttgattttcatccaatcaaattaacaaaattacatgttctttttagttctatgtgatgccttgttgaattgaggtgctttttatagtgtgtagctttattattttgatttggtaaaatctaatagggtgtttaagagactctatttaataagataagacttttattgttataacaaaaaaaa

SEQ ID NO: 3898 - DNA, 551 bp, Primula obconica
ttgtagcaaacatctccccatttttcttcttctcatttggtttgccactttcctacattcgctctatattaataaccttttttgtgaggaaaagggttagtagtgatcatggccaagtctgttgctctcttcctcttggttttacttgccatttccatgcttcagaccctggtttatgcttctcatggccatggtggtcatcacaaacataaaaaaggatatggaccgggtagtctaaagagcttccaatgcccatcggaatgctcgaggaggtgtggaaggacacagtaccacaagccgtgtatgttcttttgccaaaagtgctgctcaaagtgcctttgtgtgcctccgggctattatggtaataaagccctctgcccttgctacaacaactggaagaccaaggaaggtggccctaagtgcccctaattaaatcatcaattttcattaatattcttaagaaaacttactagcactatttatatttaatactacctaattaaaggtataatcaattatgtctacattggttatttcttgtaatggtgttg

SEQ ID NO: 3899 - DNA, 646 bp, Cyamopsis tetragonoloba
  misc_feature (570)..(570): n is a, c, g, or t
cacgaggcctctttgtatttttggcctcatcctgtgctgtgcttgatttacaaaaaatttggccaaatcaggaggggttccgatcgagatcagtgtgtgtgcatcaacaatggctagtgctagtgctaagttcttcgcagctttgctcctcgcactcattgcaatttccatgcttcaaactgtggtcatggcagctaatggtcaaggaggcaaagtgttagataacaagagcaattatggacctggcagtctcaagagctaccaatgcccatcacaatgctcgaggaggtgtgggaagacccaataccacaagccttgcatgtttttctgtcagaagtgctgcaggaaatgcctgtgtgtgcccccggggtattatggtaacaaagctgtgtgcccttgctacaacaactggaagaccaaggaaggaggccccaagtgcccttaagctttttcatcatcatcatcaacacttcacttactttaccttaccttatcataataattaatttccctttcttgtgcccccttgtcacactagcctactttaatttatttgttatgatcaagtgntatctggaaatgtttttcttgtgttttgggacgcccttgtgtttatgggctcctaatgctgtatcatcactcctta

SEQ ID NO: 3900 - DNA, 833 bp, Glycine max
gtcaccacacacccttcttcatctctctttgatacccttttgttctttttggtgctttaatttgcactagcaagggggttggttttatttctgtttgcttgcaacaatggctgtggctaataagttactttctgttttgatcattgccctcattgccatttccatgcttcaaacagtggttatggcatctcatggacatggaggccaccactacaatgacaagaaaaaatatggacctggcagtctcaaaagcttccaatgcccatcacaatgctcaaggaggtgtggcaagacccagtaccacaagccctgcatgtttttctgtcagaagtgttgtaggaagtgcctatgtgtgccaccggggtattatgggaacaaagcagtgtgcccttgctacaacaactggaagaccaaggaaggaggacccaaatgcccttaataaccttatgctatgttcttcatcaaattaacaaagatataatatagctttaatttattatatccatatcatataattttcttggtcctttctatgtcttaattaaccaaaaaatgtatgtccattttggtcttagtaatactttgttgtattgaagatgccttttggagatagtgtgtgtgtgggctcctctgcatcataccactccttattatggcattgttggcttttaaatgaagtgtgtctaatactgttgctgtcatctatggattttttttcttttttcttttttatcatgtatctatggaaattccatgaggctatgctatcatttctctttttcactttattgtatgaacaatggcaaacatattattatcatgtttaaatgtca

SEQ ID NO: 3901 - DNA, 363 bp, Prunus persica
tttgccattttaggagaggcctgtctctgtagcaatggccatggctaagttttttgctgccttgatgttggcactccttgccatctccatgcttcaaaccacggttatggcaaataatggacatggaggtcatcacggtggcaataatgcatatggacctgggagcctcaagagctaccaatgcccatcacaatgctcgaggagatgcggccagacccaataccacaagccctgcatgttcttctgtcagaaatgctgcaaaaagtgtctgtgtgtgcccccagggtattatgggaacaaaggtgtgtgcccttgctacaacaactggaagacccagcaaggaggacccaagtgcccttgatt

SEQ ID NO: 3902 - DNA, 718 bp, Saccharum officinarum
accaattcagcacccgcggcaaggagttcacgcccatggcgagcaccaacatggcgtcggccacctcgcggttcatgctggctgctggcgtacccaccgccggcagcggcagcggcatcaagcggccgcgtcagcttcgcgtcggcgcccaaccggctgggcgggaggctcgtggtccgggccgacccggaggcagcggctgaaccggcggaaggggagggcgccgtggccaccaagcccaaggccgagaagccgccgccgatcgggcccaagaggggcgccaaggtgaagatcctgaggagggagtcctactggtacaacggcatcggcaacgtcgtcaccgtcgatcaggaccccaacacccgctacccggtggtggtgcggttcaacaaggtgaactacgccggcgtgtccaccaacaactacgccttggacgagatccaggaggtgaaatgagtgatcgaggccggccgcctcaaggtcaagggctccacgccctagctcccgtgtgatttgtagttgtgaaatgaggctgtgaagctgcatgctgtggtagctagcgtcacaacatcgatctcatgtgtaatagcttataatctccataatcatcatgtaattgcttgcttcattcaccgtggactcaataatctcttgctctaaatttgcggtattcttttttcttgtgattctgtacccgcacataaatctttttatggcc

SEQ ID NO: 3903 - DNA, 790 bp, Zea mays
gcagccggccagtggggggcatggaccgcgtggcgccctgcgcaccaggctggggataatccgcgcaatgcaatttgaggccattacgcccttggctcgtacgtacttactcactctccccccacccgcgccaggccagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtcttagaggtgaaatgagtggggccggccggctcaagggctccgcgctagctaccgtgtgattgatttgtagtagttgtgaaatgaggctgtgaagctgcatgctgtgctggctagcgtcacaacatcgatcctatgtgtaatagcataatccacataatcatatcatgtaattgcttgcttcattcaccgtgtactcaataatctctcttgctctct

SEQ ID NO: 3904 - DNA, 781 bp, Sorghum bicolor
tcgcccgtggcgccctgccgcgccggctggggataatccggggcatgcaatttgaggccattacaccaccgggccctcactctctcttccccggccatccgcgccagacgaactcagcacccgcgcgcagcaaggagagtccacacgcccatggccagcaccaacatggcgtcggccacctcgcggttcatgctggccgctggcgtgcccaccgccggcagcggcagcggcagcagcggccgcgtcagcttcgcgccggcgcccaaccagctgggcaggaggctcgtggtccgggctgacccggaagctccggctgaaccggcggaaggggagggcgccgtggccaccaagcccaaggccgagaagccgccgccgatcgggcccaagaggggcaccaaggtgaagatcctgaggagggagtcctactggtacaacgggatcggcaacgtcgtcaccgtcgatcaggaccccaacactcgctacccggtggtggtgcggttcaacaaggtgaactacgccggcgtgtccaccaacaactacgccttggacgaggtccaggaggtgaatgaacaaaagtgaggccggctcaaggggctccccggcccgcgcgcgctagctagctcccgtgtgatgatttgtagttgtgaaatgaggctgtgaagctgcatgctgtgctagctagcgtcacaaacatcgatcttatgtgtaatagcttaatctccataatcatcatgtaattgcttgcttcattcaccgtggactcaataatctctcttgctct

SEQ ID NO: 3905 - DNA, 977 bp, Sorghum bicolor
ggccagtggcgggaatcgcccgtggcgccctgccgcgccggctggggataatccggggcatgcaatttgaggccattacaccaccgggcctttggctcgtactacaccacctcaccctcactctctcttccccggccatccgcgccagacgaactcagcacccgcgcgcagcaaggagagtccacacgcccatggccagcaccaacatggcgtcggccacctcgcggttcatgctggccgctggcgtgcccaccgccggcagcggcagcggcagcagcggccgcgtcagcttcgcgccggcgcccaaccagctgggcaggaggctcgtggtccgggctgacccggaagctccggctgaaccggcggaaggggagggcgccgtggccaccaagcccaaggccgagaagccgccgccgatcgggcccaagaggggcaccaaggtgaagatcctgaggagggagtcctactggtacaacgggatcggcaacgtcgtcaccgtcgatcaggaccccaacactcgctacccggtggtggtgcggttcaacaaggtgaactacgccggcgtgtccaccaacaactacgccttggacgaggtccaggaggtgaatgaacaaaagtgaggccggctcaaggggctccccggcccgcgcgcgctagctagctcccgtgtgatgatttgtagttgtgaaatgaggctgtgaagctgcatgctgtgctagctagcgtcacaaacatcgatcttatgtgtaatagcttaatctccataatcatcatgtaattgcttgcttcattcaccgtggactcaataatctctcttgctctaaaattatattgctgtattctttttttttgttcttgtgattttgtatgcatgcacataaatctctctctggcaccatatatatttgtggctctgctaaaaactcacttgtgcagtcatatgctagctatttaattatatataccggagttcatac

SEQ ID NO: 3906 - DNA, 1562 bp, Setaria italica
cacggataagatatgccatgtggcgggcggccagtgggtggaatcgacggggggcgaccgccgcgccggctggggataatccgcgcccatgcaatttgaggccattacacctcaccctctcatcactctctctccatccgacgccgaggtcgcgacacacctgagcagggagcgcgtgccagtgccaccacccatggcgagcaccaacatggcctcggccacctcgcggttcatgctggctgccggcgtgcccgccaccggcatcagcggcaacggcagcggccgcgtcagcttcgcgccggtaccaaacaggctgggcaggaggctcgtggtgcgggccgaggaggaggccgcggcaccggccgagcccgcggcggaaggggagggcgccgtggccaccaagaccaaggccgagaagccgccgccgatcgggcccaagaggggcgccaaggtgaagatcctgaggagggagtcctactggtacaacgggattggcaacgtcgtcacagttgatcaggaccccaacacccgctacccggtggttgtgcggttcaacaaggtgaactacgccggcgtgtccaccaacaactacgccctggacgagatccaggaggtgaaatgagagaggctggctcaagggcctccgtgctcccctgtggttggtagttgcgaaatgagggatgtgaagctgctgtggtagcgtcacaacatcttgtgtgtgatagcttaatctctgtaatcattatgtaattgctttgctgcttgcttcaccgtggactaaataatctcctgcccttaaattgttgtattcttttcttgtcattttgtacatgctcataaacctcttccctatagcaccgtttgcacgatgctggaaactcaattcatagtagctgtaagggttcgtacaccatctcaggctttggctttggtagagcttggtgaccagcgttcagtattaaagaccatggtacaaattgagcgatattacaacaccaccaaattactcctccagtttttacatctgctagtttcagctttcacatagcaataaaaaaaaatatagcaacctactctaagatgtgtgtgacagcattaattactgccttctggaacaggtcaagcccgagacttgaaaattttcaaatgctgccaaaccactaacattgagtttgaggtagttcagagtgttcttcacaagttcctgttacacctgccagaatgttcagactctgaagaccctgcccctcatggatgtctctcttcaaaagtaggcataaacaaagatccgccactcatccgaatcaaaactgctatcaaaactgaaagcttcacacatgcgcactgatccattggtaacgttatccagactaaagttagggacttcataccagaaattagcaatcgtcgctatacccgaggcccatagacagcctacaagtcattgcctggtcaaatcatgtatcatccttgctggaatgcttagtcgcaatatagtctaatcacggagtcagcaccagcagtgaacaaccaaggctgttttggatggaacttgcagtcta

SEQ ID NO: 3907 - DNA, 1894 bp, Setaria italica
cagaggctcacctagtcatcttgatcgctaatggatcaacaaaatgggcataaaaaaataatatgaaggattaactcgcacagggattctatggtaccgtatccaatttctatgactcaaaagttcagtaaagcacgggagtccgaatgcaaacgaacactagtagttcattacaagactaggacgttattatctcaccatatactttagcagaatgccaaaagcagcacatgcattgcatggcaacatgatggatctcacactacccccctaatcgagcaagtcggatatcgatttcttcttaacaaacggatcagtagctgtaatcaaagtcgccacagcattgttggggaaaatgttgtcagccttcatcctctctttgaacccataagcaggggcctttgcatgtagatatgcatggagcagcaattggtactgcctgatcctcccagtgtagccaatctgccgcagcttatggaacactctctccatccgacgccgaggtcgcgacacacctgagcagggagcgcgtgccagtgccaccacccatggcgagcaccaacatggcctcggccacctcgcggttcatgctggctgccggcgtgcccgccaccggcatcagcggcaacggcagcggccgcgtcagcttcgcgccggtaccaaacaggctgggcaggaggctcgtggtgcgggccgaggaggaggccgcggcaccggccgagcccgcggcggaaggggagggcgccgtggccaccaagaccaaggccgagaagccgccgccgatcgggcccaagaggggcgccaaggtgaagatcctgaggagggagtcctactggtacaacgggattggcaacgtcgtcacagttgatcaggaccccaacacccgctacccggtggttgtgcggttcaacaaggtgaactacgccggcgtgtccaccaacaactacgccctggacgagatccaggaggtgaaatgagagaggctggctcaagggcctccgtgctcccctgtggttggtagttgcgaaatgagggatgtgaagctgctcacaacatcttgtgtgtgatagcttaatctctgtaatcattatgtaattgctttgctgcttgcttcaccgtggactaaataatctcttgcccttaaattgttgtattcttttcttgtcattttgtacatgctcataaacctcttccctagcaccgtttgcacgatgctggaaactcaattcatagtagctataagggttcgtacaccatctcaggctttggctttggtagagcttggtgaccagcgttcagtattaaagaccatggtacaaattgagcgatattacaacaccaccaaattactcctccagtttttacatctgctagtttcagctttcacatagcaataaaaaaaaatatagcaacctactctaagatgtgtgacagcattaattactaccttctagaacaggtcaagcccgagacttgaaaattttcaaatgctgccaagccactaacattgagtttgaggtagttcaggttcttgttacacctgccagaatgttcagactctgaagaccctgcccctcatggatgtctctcttcaaaagtaggcataaacaaagatccgccactcatccgaatcaaaactgctatcaaaactgaaggcttcacacatgcgcactgatccattggtaacgttatccagactaaagttagggacttcataccagaaattagcaatcgtcgctatacctgaggcccatagacagcctacaagtcatattgcctggtcaaatcatgaataatccttgcaggaatgcttagtcgcaatatagtctaatcacggagtcagcaccagcagtgaacaaccaaggttgttttggatggaacttgcagtccaaaa

SEQ ID NO: 3908 - DNA, 792 bp, Pennisetum glaucum
ccatccaaggcgagctcgcgagtcgcgacacacacacctcagcagcagggagcgcgcgcgtgtgccagtgccaccaatccatggcgagcaccaacatggcgtcggccacctcgcggttcatgctggccgccggcgtgcccgccgccggcatgagcggcaacggcagcggccgcgtcagcttcgcggcggtgcccaacaggctgggaaagaggctcgtggtgcgagccgaggaggaggccgccgctgagccggcgcccgcggcggaagcggagggcggcgtggccaccaagaccaaggccgacaagccgccgccgatcgggcccaagaggggcgccaaggtgaagatcctgaggagggagtcctactggtacaacgggattggcaacgtcgtcacggttgatcaggacccaaacacccgctacccggtggtggtgcggttcaacaaggtgaactacgccggcgtgtccaccaacaactacgccttggacgagatccaggaggtgaaatgagtcaggctggctgcctctcaaagggcctccgtgctcccgtgtgtggtcggtagttgtgaaatgaggatgtgaagctgctgtggtggcatcacaatatcttgtgcgtgtgtgatagctaaaatctctgtaaccattatgtaattgctttgctgcttgcttcacagtggactcaataatctcctgcccttgaattgttgtactcttttcttgtgattttgtacatgcatgcacataaaccttgatcttcccaagcaccgtttgcagttttgcacgatgctggaaa

SEQ ID NO: 3909 - DNA, 862 bp, Cenchrus ciliaris
gttccccccgggggtcaaggaatcgccgctttttaattcatttttctttccataccaaagggaaggttcccgagttcgccacacaccacccgcttaagaaccaccagggaagttagcaggggcgcggcgggtgtcccagcagtccccccacccccccatggggagcaccaaacatggggtcggcccacctcccggttcatgctggccgccggcgtgccggccccgggcatgagcgccgccagcggcggcgtgagcttcgcggcggtgcccaccaccaacaggctggaaaggaggctcgtggtccggcccgaggaggagccccccgccgagccggcgcccgcggcggaagcggaggccggcgtggccaccaagaccaaggccgagaagccgccgccgatcgggcccaagaggggcgccaaggtcaagatcctgaggagggagtcctactggtacaacgggattggcaacgtcgtcacagttgatcaggaccccaacactcgctacccggtggtggtgcggttcaacaaggtgaactacgccggcgtgtccaccaacaactacgccttggacgagatccaggaggtgaaatgagtgaggctggctggctggctggctcaagggcctccacgctctccagtctggtcggtagttgtgaaatgagggatgtgaagctgctgtggtagcgtcacaacatcttgtgtgtgggtgtgtgatagctaaaatctctgtaaccattatgtaattgctttgctgcttgcttcaccgtggactcaataatctcctgccctttaaattgctgtactcttttcttgtgattttgtacatgcacataaacctccatcttccctagcaccgtttttgc

SEQ ID NO: 3910 - DNA, 1447 bp, Trigonella foenum-graecum
cggccggggtctttacaaaacttccttttactaattttccctctttttttgcctttattgataaaatttaatgtgcattaattaaagaaacaaattttgaacatgaaaaagcaaatttacatgcaatatttagaaaaggcgttaactcctaggataacataaatgacactataaaatgtgacaaaaactaaagtctagtattcacatattgcttccatagttacaaatttgagagagaaagaaaaactgaattaatcaagctagctagcactccaatggccactgttgttgttcatagccaaacatctcctgttcaagatgctgaggctcttcgacttgctttcaaaggatggggtgctgataacaaggccatcatagcaattttgggtcatagaaatgttcatcaaaggcaagaaattagaaaggcttatgaggagcttttcgaagaggatctcatcaaacgtcttgagtcagagatctctggcgactttgagagagctgtgtaccggtggatgttggaacctgcagaccgcgatgctgttttgatcaatgtagcaatcaggaatggcaacaaagactatcatgtggttgctgaaatttcttctgtgctatcaactgaagagctcttggcagtgaggcgcgcctatcataatcgctacaagcgttccatcgaagaagatgtgtctgctcacaccactggtcatcttcgccagcttttggttggattggtgagctcatttaggtatgagggagatgagatcaatccaaaattagcacaaactgaagctaatattattcatgaaagtgtcaaggaaaagaaaggtaacaatgaagaagtcattaggattcttactacaaggagcaagactcaacttgttgcaactttcaaccgctatagagatgagcatggtatctccattagcaagaaattgcttgatcaaacatctgatgacttccaaaagacattgcacacagctattcgttgcatcaatgatcataagaagtactatgagaaggttttgcgcaatgcaatcaaaaaatttggaaccgatgaggatggactcagccgcgtgattgtcacaagggctgaaaaggatctgagggacatcaaagagctctactacaagagaaacagtgttcatcttgaagatgcagtctccaaagaaacctcaggagactacaagaagttcatcctcactcttttggggaaacatgattaaattacttgctataaagggcatatgaataatgagtttggcttatgttggcttctggttgtgtgatttcattaggttaattttcaaataagaaactgttttgttaaggtcttgtatctgctttactggttgcttttggtgacttgaacttctatcttgtgttgtttcctttggaatatgattttattatgaaattatattgggttatgttggtatgctattttacttca

SEQ ID NO: 3911 - DNA, 1240 bp, Cicer arietinum
gaatcacatatagctttccacagttacaaagttgagagagaaattaaggaaaacttaatcaactaactaatcaaggtagcactctaatggccaccattgttgttcataatcaagcatctcctgctgaagatgctgaagctcttcgacttgctttcaaaggatggggtgctgatgacaagaccatcatagcaatattgggtcatagaaatgtttatcaaaggcaacaaattagaaaagcttatgaagaactttttcaagaggatctcatcaaacgtcttgagtcagaaatttccggtgactttgagagagctgtgtaccgttggatgttggagcctgcagaccgtgatgctgttttgatcaatgtagcagttaggaatggcagcaaagactatcatgttgttgctgaaattgcttctgtgctatcagctgaagagctcttagcagtgaggcgcgcctatcataaccgctacaagcgttccatcgaagaagatgtggccgctcacaccactggtcatcttcgtcagcttttggttggattggtgagctcatttaggtatgagggagatgaaatcaatgcaaaattagcacaaaatgaagctaatattattcatgaaagtgtcaaggaaaagaaaggcaacaatgaagaagaagtcattaggattctcactacaaggagcaagactcaacttgtggcaactttcaatcgctatagagatgatcatggaacatccattagtaagaaattgttggatcaaacatttgatgacttccacaaggcattgcacacagttatccgttgcatcaatgaccatacaaagtactatgagaaggttttgcgcaatgcaatcaaaaaatttggaacagatgaggatggactcaaccgtgtgattgtcacaagggctgagaaggatttaagggatatcaaagagctttactacaagagaaatagtgttcatcttgaagatgcagtctccaaggaaatttcaggagactacaagaagttcatcctcactcttttgggaaaacaagactaaaattcacttgctataagggtatatctataatgtgtttgagttatgttggcatgttgttatgatttcattaggttattttccaaataagattgtgttttgttaaggtcttatctcttgtgttgtttcctttgggatatcttttttatatttggaccaatcgaatgtataatggaatgaattgagttaaaataaaatgattttatgct

SEQ ID NO: 3912 - DNA, 1227 bp, Cyamopsis tetragonoloba
cacgaggcagagctgagagtgaaattaaggacaacaatggctacacttgttgtttataaccaaacttctcctgctcaagatgctgaggcgctccgacacgctttcaaaggatggggagctgatgacaaggccattatagcaatactgggtcacagaaatgttcatcagaggcagcaaatcagaaaagcttatgcggagcttttcaatgaggatctcatcaaacgccttgagtctgaaatctctggtgactttgagagagctgtgtaccgttggatgttggagcctgcagagcgtgatgctgttttggcgaatgtagcaataaggaatgggaacaaagatttccatgtcattgctgaaatcgcttctgtcctctcagctgaagagctcttggctgtgaggcgtgcttatcacgttcgctacaagcgctctttggaagaagatgtggcagctaacacaaccagccatcttcgccagcttttggttggattggtaagctcatttaggtatgaaggtgatgagatcaatgcaaaattggctcaaagtgaagcaaatattcttcatgaaattgtaaaggagaagaaagggaactatgaagaagtgataaggatccttacaacaaggagcaagactcaacttgtggcaactttcaaccgctacagagatgagcatggcatttccattagtaagaaattgttggatcaagcacctgatgactttcacaaggtgctgcacacagctattcgttgcatcaatgaccacaagaagtactatgaaaaggttctgcgcaactcaatgaaaaaacttggaacggatgaggatggactgagccgcgtggtggtgacaagggctgagaaggatttgaaggaaatcaaagaactctactacaagagaaacagtgttcatcttgaagatgctgtctccaaggaaatctctggggactacaagaaattcatcctcactctcttgggaaaacaagactgaactacttggtcttagagcatttctagtaataagtttgtgttattttgatttctgtttgttatttcattaggttatatttctagtaagaatctgtgttttactcatgagtattatctctagtatccttgatagtttacatgtgacaactttgaaattttatccttttatggtgtttcatttgggttattctggtatgctgttcttaattagttcacttaaaattaatatcaacatctatttataata

SEQ ID NO: 3913 - DNA, 1545 bp, Glycine max
gaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcaatggccacccttgttgttcataaccaaacttcttctgctcaagatgctgaggctctccaacaggctttcaaaggatggggggctgatgacaaggccattatagcaatactgggtcacagaaatgttcatcagaggcaagaaatcagaaaagcttatgaggagatttaccaagaggatctcatcaaacgccttgagtccgagatctctggtgactttgagagagctatgtaccggtggatgttgcagcctgcggatcgtgatgctgttttggtgaatgtggcaatcaagaatggcaccaaagactaccatgtgattgcagagattgcttgtgtcctatcagctgaagagctcttggcagtgaggcgggcctaccaccgccgctacaagtgttccttggaggaagatgtggcagctaacaccaccggcaatcttcgccagcttttggttggattggtgacctcatataggtatgagggtgatgagatcaatgtaaaattttcacaaactgaagctaatgttcttcatgaatctgtcaaggagaagaaaggcaacagtgaagaagtcatcaggatccttactacaagaagcaaaactcaacttgtggcaactttcaaccgctacagagatgaacatggaatttccatcagtaagaaattgttggatcaaacatctgatgacttccacaaggtgttgcacactgctattcgctgcatcaatgaccataagaagtactatgagaaggttttgcgcaatgcagtcaagaagtttggaactgacgaggatggactaagccgtgtgattgttacaagggctgagaaggatctgaaggacatcaaagagctctactacaagagaaacagtgttcaccttgaggatgaagtgtccaaggaaacttctggggactacaagaagttcctcctcactctcttggggaaataagactaagttaagaacttgctctaagggcatcttagtaatgggtttttgttaattatgtcattggtttctggtttgtgcgatttcattatgttagttttccagtaagagtttgttatatctggttaagtttttgagacaacaagaactcgtgtcttgtttgagggcatgcgtgccatttcttagggttgtgttggtacttggcatgctcttattagaggacctctatgctgcgtgtttcctttggattatgctattacctcacctggtttgcttttaatgaaaggttgataacaaatttatatgtacttgaattcttcattttaaa

SEQ ID NO: 3914 - DNA, 1225 bp, Cajanus cajan
caccataatatagaaaatatatccaactatggctacccttattgctcctagccaccattcccgagttgaggacgccgaagccctccgaaatgctttcaaaggatgggggtctgatgggaaggccattatagcaatactgggtcacagaaatgttcatcagaggcaggaaatcagaaaagcttatgaggagatttaccaagaggatctcatcaaacgccttgagtctgagatttctggggactttgagagagctgtgtatcggtggatgttggggcctgcagatcgtgatgctgttattgtgaatgtagcaatcaagaatgggagcaaagagtaccctgtgattgcagagattgcttgtgtgctatcagctgaagagctcttggcactgaggcgtgcatatcacaaccgctacaagcgttccttggaagaagatgtcgcagctcacaccactggccatcttcgccagcttttggttggattggtgagctcatataggtacgagggtgatgagatcaatgtgaaattggcacaaactgaagctaatattcttcatgaaactgtcaaggagaagaaaggaaactatgaagaagccatcaggatccttactacaagaagcaagactcaacttgtggccactttcaaccgctacagagatgagcatggaatttccatcagtaagaaattgttggatcatgcatctgatgacctcctcaaagtgttgcacactgctattcgctgcatcaatgaccataagaagtactatgagaaggttttgcgcaatgcaatgaagaaatttggaactgatgaggaaggtgtgagccgtgtgattgttacaagggctgagaaggatctgaaggacatcaaagagctatactacaagagaaacagtgttcaccttgaggatgaagtgtccaaagagacctcaggggactacaagaagttcatcctcgctttgttggggaaacatgactaaagaacatgctctaagggcatacctagtgatgggtttctggttgtgattttcgttttcaatttccaataagatcgaatatgtttttaagggtcctgtctctagcttgagacaacttggaacttgtgtcttatttgagggcatgtgtcatgtttcattagggttatgttggtatttggaatttgctcttatatatatgagggcatctgtttctttttgggtcatgtttggtttgcttttaatgaaaggttaata

SEQ ID NO: 3915 - DNA, 1274 bp, Arachis hypogaea
gggtggaagttaaactcatcatcataaattcagaagcagcaacaaaatattaaactatggcaactcttattgctcccagcaaccattcctcagctgaagatgctgaagctctccaaaaagcattcaaaggatggggagctgatgataagacaattatagcaattcttggacacagaaatgttcatcagaggcagcaaatcagaaaagcttatgaagagcttcaccaagaggatctcattaagcgactcgaatccgagatctctggtgactttgagagagctatgtatcgttggatgttggaacctgctgatcgagatgctgttctagcgaatgtagcaatcagaaatgggaagaaagattttcatgtaattgcggaaatcgcttgtgttttatcggctgaagagcttttggcagtgaggcgtgcctatcgccaccgctacaagcgttccttggaagaagatgtggctgctaacaccactggccaccttcgccagcttttggttggattagtaagctcatataggtatgagggtgatgagataaatgcaagacttgcacagagtgaagccaatattctccatgaaactgtgaaagagaagaaaggaaactatgaagaagccattaggattcttactacaagaagcaagactcagcttgttgctactttcaaccgctacagagatgagcatgccatttccatcagcaagaaattgctagacaatcaagcttctgatgatttctacaaggcattgcacactgcaattcgttgcatcaatgaccacaaaaagtactatgaaaaggttctgcgcaacgcgataaaaaaggttgggaccgacgaggatgcgctgagccgagtcgtggtgacaagggctgagaaggatcttagggacatcaaagaactgtattacaagagaaacagtgttcatcttgaggatgctgttgccaaagaacttcaggggactacaagaagttccttctcacattgttgggaaaacaggactgaaaatattaacacttctaattaattaattaagggtttgtgtgtgttggtttttagttcctgttgatttggtttcagttgcttttggttctctagcatgcatgagtctgtttttagagtatttgtctcttttattgtcctttgtttgttgtagttgtgaacttaagttaataaaattctatgtttagtagtttatggaatgctattattgcaatttatcacttggattaaaaatcagtcaccaaattaattatcgtaaaaaagaaaaacaaaa

SEQ ID NO: 3916 - DNA, 1030 bp, Lotus japonicus
cggtctactggacattgctagttaagattaagcgagaaaaggaaaggttaaccaaacactgcaatggccactcttgttgctcctaaccaaatttctgctgctgaagatgctcaggctctgagacaggctttcaaaggatggggagctgatgacaaggccataatagcaatactgggtcatagaaatgtttatcagaggcaggaaatcagaaaagcttatgaggagcttttccaagaggatctcatcaagcgccttgaatctgagatctctggtgactttgagagagctatgttccggtggatgttggaacctgcagaccgtgatgctgttttggccaatgtagcaatcaggaatggcaacaaagactaccatgcggttgctgaaattgcttgtgtcctatcagctgaggaactcttggcggtgaggcgtgcctatcacaaccgctacaagcgttccttggaagaagatgtggctgctcataccactggccttcatcgccagcatttggctggattggtgacctcatttaggtatgagggtgatgagatcaatgcaaaattggcacaaactgaagctaacattcttcatgaagctgtccaggagaagaaaggaatctatgaagaagtcatcaggatccttaccaccaggagcagacacaacttgtggcaactttcaaccgctacaaagatgagcatggcatctccatcagtaagaaattgttggatgaaacatctgatgacttcagaaacatgcacacagctattcgttgcatcacgaccataagaaatactacgagaaggttctgcgcaatgcgatcaagaaatttggaactgatgaggatggactgagccgtgtgatcgtgacaagggctgagaaggatctgagggagattcaagaactctactacaagagaaacagtgttcaccttgaagatgcaatctccaaggaaatctcaggggactacaagaagttcatcctcactgtgttgggaaaacaagactaaagtgcttgctatgggggcatatctagt

SEQ ID NO: 3917 - DNA, 1253 bp, Vigna unguiculata
  misc_feature (262)..(262): n is a, c, g, or t
  misc_feature (265)..(265): n is a, c, g, or t
ggacatcacacactcacagtttcagagagtgagaaaaaggtttagagttattattccaatggccactcttgttcttcatcatcaaacttctcctgctcaagatgctgaggctcttcatcaagctttcaaaggatggggttctgatggcaaggcaattatagcaatactgggtcacagaaatgttcatcagagacaggaaatcagaagggcttatgaagagatctaccaagagaatctcatcaaacgccttgagtcagagatntcnggtgattttgagagagctgtgtatcgttggatgttggagcctgcagatcgtgatgctgttttgatgaatgtagcaataaaaaatggtccaaaagagtataatgtgatcgcagagattgctagtgttctttcagccaaagaactcttagctgtgaggtgtgcttaccatgatcgctacaaacgttctttggaagaagatgtggcagcacacaccactggtcaccttcgtcagcttttggttggattggtgagttcatataggtatgagggtgatgagatcaatgtaaaattggcacagactgaagctaatattctccatgaatcaatcaaggagaagaaaaccaactatgaagaagttaccagaattcttaccacaagaagcaaaactcaacttgttgcaactttcaaccgctacagagatgaacatggaatttccatcagtaagaaattggtggatcagtcatctgatgattttgtgaaggtattgcacacagtgattcgttgcgtcaatgaccataaaaagtactatgagaaggttttgcgcaatgcaataaaaaagtttggaactgatgaagatgggttgactcgtgtgattgtaacaagagctgagaaagatttgaaggacatcaaagaggtgtactacaagaggaacagtgttcatcttgaagatgctgtgtcaaaggaaatctcaggagactacaagaggttcatgctcgcacttctggggaaccaagactaaagaacttgccctaattaagggcatacctagaaatgagtttctgatatgttgctttctgcttctgttgtttcatcattattaggttagtttccctttaagagttctctctctagttcagtttgtgtcttgtttaaggggcatatgtgtgccttttgtttgagttatgtgttggtacttattatgctgtttcctttgagcattcctttgagttatgttctctgttacttgatttaataaaagcttattatca

SEQ ID NO: 3918 - DNA, 1255 bp, Phaseolus coccineus
tggccggggacacacacactttcatagctttcatagtttgagagagtaagtaatagagcaatactctaatggccactcttgttcttcatcatcaaacttctcctgctgaagatgctgaagttcttcaccaagctttcaaaggatggggttctgatggcaaggccattatagcaatactgggtcacagaaatgttcatcagagacaggagatcagaaaggcttatgaagagatttaccaagagaatctcatcaaacgacttgagtctgagatctctggtgattttgagagagctgtgtatcggtggatgttggaggctgcagatcgtgatgctgttttgattaatgtagcaatcaagaatggtcctaaagagtaccatgtgattgcagagatttccagtgttctttcagccaaagaactcttggcagtgagatctgcttatcatgatcgctacaaacgttccatggaagaagatgtagcagctcacaccacaggccatcttcgtcagcttttggttgggttggtgagttcgtataggtatgagggtgatgacatccatgcaaaattggcacaaactgaagctaatattcttcatgaatcaattaaggagaagaaagccaaccatgaagaagttatcagaattcttaccaccagaagcaaaactcaacttgtagcaaccttcaaccgctacagagatgagcatggaatttccatcactaagaaattggtggatcagtcatctgatgattttgtcaaggtattgcacacagtgattcgctgcatcaatgaccccaggaaatactatgagaaggttctgcgcaatgcaatgaaaaaatttggaactgatgaggatgggttgactcgtgtgattgtgacaagggctgagaaagatttgaaggatataaaggagatctactacaaaaggaacagtgttcatcttgaagatgatgtctccaaggaaatctcaggagactacaagaggttcatcctcactctcctggggaaccaagattagagaacttgccctagggaaatcagtttctgcttctgttctttcatcattaggtcaatttccagtaatagttctcttataagagttctctctctagtttcagttttgtgtcttgtttgagggcatatgtgccttttctgagttcatcttggtgcttgtcatgctcttgtttgagagcatctctctatgctgtttcctttgagttatgttgtttgtttcttgctttaataaaaacttattatcaa

SEQ ID NO: 3919 - DNA, 1227 bp, Phaseolus coccineus
gtttgagagagtaagtaagaacaatacttcaatggccactcttgttcttcatcatcaaacttctcctgctgaagatgctgaagttcttcatcaagctttcaaaggatggggttctgatggcaaggccattatagcaatactgggtcacagaaatgttcatcagagacaggagatcagaaaggcttatgaagagatttaccaagagaatctcatcaaacgtcttgagtctgagatctctggtgattttgagagagctgtgtatcggtggatgttggaggctgcagatcgtgatgctgttttgattaatgtagcaatcaagaacggtcctaaagagtaccatgtgattgcagagatttccagtgttctttcagccaaagaactcttggcagtgaggtctgcttatcatgatcgctacaaacgttccatggaagaagatgtagcagctcacaccactggccatcttcgtcagcttttggtggggttggtgagttcatacaggtatgagggtgatgacatccatgcaaaattggcacaaactgaagctaatattcttcatgaatcaattaaggagaagaaagccaaccatgaagaagttatcagaattcttaccaccagaagcaaaactcaacttgtagcaaccttcaaccgctacagagatgagcatggaatttccatcactaagaaattggtggatcagtcatctgatgattttgtcaaggtattgcacacagtgattcgctgcatcaatgaccccaggaaatactatgagaaggttctgcgcaatgcaatgaaaaaatttggaactgatgaggatgggttgactcgtgtgattgtgacaagggctgagaaagatttgaaggatataaaggagatctactacaaaaggaacagtgttcatcttgaagatgatgtctccaaggaaatctcaggagactacaagaggttcatcctcactctcctggggaaccaagattagagaacttgccctagggaaatcagtttctgcttctgttctttcatcattaggtcaatttccagtaatagttctcttatgagagttctctctctagtttaagttttgtgtcttgtttgagggcatatgtgccttttctgagttcatgttgctacttgtcatcatgctcttgtttgagagcactctagctatgatgtttcctttgagttatgttgtttgtttcttgctttaataaaaacttattatcaaattta

SEQ ID NO: 3920 - DNA, 1399 bp, Trigonella foenum-graecum
taatatactaatcttcacatgaaagtaacgttcaaatgtgatgatgtgtgtgtgaggcgataacaccaaagaaagccattggcattatatattaagtaggtgataaaaccaactccaatatatcacacacaaatctaaatcttgttgagagagaaaggaagattaattttgagtaatagtttttgctatggctacccttgttacaataaaatcatctccggtggaagatgctgaggctctccaaaaggcttttaaaggatgggggactgatgagaagagtgtgattacaatattgggtcacagaaatgtttatcagagacaacaaatcagaaaatcttatcaagaaatttaccaagaggatatcctcaaacgccttgaatccgaactctctggtgactttgagaaagctgtgtaccgttggatgctggaaccggctgagcgtgatgctgttttggcgaatgtagccatcaaggatggaaacaaaggttaccatgttattattgaaattgtttctgttctttctcctgaagaggtgttggcaatgagacgtgcctatcacaaccgttacaagcattctttagaagaagatgtagctgctcataccaccggccatcttcgccagctattggttggattggtgagctcatttcgatatggtggtaatgagatcaatccaaaattggcaaaaactgaagctgatattcttcatgaatcaattaaggagaaaaaaggaaaccatgaagaagccattagaatccttactacaaggagcaagactcagcttttagcaactttcaaccgttacagagatgaccatggaatttctataactaagaaactgttggataatgcttctgatgattttcacaaggcattgcacaccactattcgatgcatcaatgaccataagaagtactatgaaaagattctgcgtagtgcgttgaaaaaggttggaacggatgaggacggactaactcgtgtggtggtcacaagggctgagaaggatctgagggacattaaagaggtgtattataagagaaacagtgttcaccttgaggatgcagtggccaaggaaatttcaggggactacaagaaattcatccttaccttgttggggaaacaagattgaaataattgctctatctaaggcttatatataaatagtaataatgggatttcgatatgttggtttctttcttatggtggtgtggtttggttaatttctctatttatatcatgttttcatgagtcatggctctgtgagagatattatgtactttgattttaataaattacaagttgaataaatggtggaattagaaaattcaatggtcaaaattacatgatactgtgtatgatcttacgtccaaggccaagatttataagacctccatttcac

SEQ ID NO: 3921 - DNA, 1223 bp, Lotus japonicus
ggatagctgtctaggttacattatatgttgaagagctaggaaactatactcaaacataaccaaaacttgaaaaaataggaagatataatcaaatatggccacacttattgctaccactcagcattcacctgttgcagatgcagaagctcttcgaaatgcttttcaaggatgggggactgatgagaagactgtgatagcaatattgggtcatagaagtgttcatcagaggcagcaaatcagaaaggcttatgaggagctttaccaagaggatatcatcaaacgcctcgagtcggagctctctggtgacattgagaaagctgtgtatcgctggatgctggaacctaccgatcgcgatgctgttctagccaatgtggccatcaagagtggcggcaaagggtacaatgtgattgtggaaattgctactgtcctttcacctgaagaggtcttggctgttaggcgcgcctatcacaaccgctacaagcgttccttagaagaagatgtagctgctcacaccaccggtgatcttcgccagctattggttgggttggtgagctcatttaggtatggaggagatgagatcaatgcaagattggcaaaaactgaagctgatattcttcatgaatctatcaagcagaaaaagggcaacaatgaagaagccatcacgatccttaccacaaggagcaagacccaacttgtggccactttcaaccgctacagagatgaccatggcatttccataactaagaaattgttggacaatgcatctgatgacttccataaggcattgcatacggctattcgctgcatcaatgaccaccagaagtactatgaaaaggttctgcgcaatgcactgaaaagggttggaagtgatgaggatggactgacccgcgtggtggtgacaagggctgagaaggacctgaaggaaatcaaagagctgtactataagaggaacagtgttcatcttgaggatgcagtggccaaggaactctcaggggactacaagaagttcatcctcaccttgttggggaagcaagattgaagtaattaattggtcttgctaagggaaagtcttgtcatggattctggttatgttggtttcttgtagattggtctggttaatttccctatttagagtgtgttttcatgagtcctgtcttgtttatcatctgttttgtgagactatataaacttctgtcttaattaatgactatatttgatgttta

SEQ ID NO: 3922 - DNA, 1282 bp, Glycine max
tctcctatatcacatatttcttcagcacttatagtgtagtgagagagaaattaaggaagagcttaattgagtgcttctatcatagaagttctatggctacccttgttgctccaaaccaaaaatctccggttgaagacgttgaggctctacataaggctttcaaaggatgggggactgatgagaagaccgttatagcaatattgggtcacagaaatgttcatcagaggcaacaaatcagaaagatttatgaggaaatttaccaagaggacctcatcaaacgcctagagtctgagctctctggtgactttgagagagctgtgtaccgttggatgctggaacctgcagatcgtgatgctgttttggccaatgttgccatcaagaatggcagcaaaggttaccatgtgattgtggaaattgcttgtgtgctttcagctgaagaggtcttggcagtgaagcgtgcctatcacaaccgttacaagagatctttggaagaagatgtagctactaataccactggtgacattcgccagctgttggttgggttggtgaccgcatataggtatggtggagatgagatcaatgcaaaattggccaaaactgaagctgatattcttcatgaatctatcaaggagaaaaagggcaaccatgaagaagccatcaggatccttactacaaggagcaagacccaacttctggcaactttcaaccgctacagagatgaccatggcgcttctataactaagaaattgttggataatgcatccactgactttcagaaggcattgcacactgctattagatgtatcaatgaccacaaaaagtactatgaaaaggttctgcgcaacgctctaaaaaatgttggaactgatgaggatgcactgacccgtgtggtggtctcaagggctgagaaggacctcagggacatcaaagagcgatattataagagaaacagtgttcaccttgaggatgcagtggccaaggaaatctcaggggactacaagaaattcatcctcactctgttggggaaggaagattgatgtgattgctctctagctaaggacatatcttatagtatttggttatgctggtttcttgtgctgtgatttggttaatttccctactttgagtatgcttttatgagtgctgtatctcactatctattatctttgttgtgagacagtgtgtacttctgttttaaattactgtttttgatgtatgattaatacaataaactttaaataaaaaagacgttgtagatattacaaaaggttatacttagatc

SEQ ID NO: 3923 - DNA, 1220 bp, Vigna unguiculata
ggataccaaacccctttctgaggaaatcataatcaacaatggctaccctcattgcccccatcactttttcacctggtgcagatgcagaggctcttaacaaagctttcaaaggatggggaactgatgaaaaaactgttattgcaatattgggtcacagaaatgtttatcagaggcaacaaatcagaaaggtttatgaagaaatgtaccaagaagacctcatcaaacgcctagagtctgaactaactggtgactttgagagatcagtgtaccgttggatgctggaacctgcagatcgtgatgctgttttggccaatgtggcaatcaaggatggaagcaagggctatcatgtgattgtggagattgcttgtgtgctttcatctgaagagcttttggcagctagacgtgcctatcaccaccgttacaaacgatctttggaagaagatgtagctgctaatacctccggcgatcttcgccagctgttggttgggttggtgacctcatataggtatggtggtgatgagatcaatgcaagattggcaaaaactgaatctgatattcttcattcatctatcaaagagaagaagggaaaccatgaagaagccatcaggatccttaccacaaggagcaagactcaacttcttgcaactttcaaccgctacagagatgatcatggcgcttccataactaagaaattgttggatgatgcatctgatgatttcaggaaggcattgcacactgctattagatgcatcaatgaccacaaaaagtactatgaaaaggttctgcgcaatgcaatgaaaagggttggaactgatgaggatgcactcacccgtgtggtggtttcaagagcagagaaggatctgaggaacattgcagagctttattacaagagaaacagtgttcatcttgaggatgcagtggccaaagaaatctcaggggactacaagaaattcatcctcactttgttggggaaggatgtttgaagtgattgcactcgacaacaacattgaaacatttcttgtatctgctattgttgttggtttattgtgcatgatttggttaatttcccaattctgagtgtgcttttatcagttatgtatctgttgtctttgttatgtcagagtgtaaacttctgtgtaagatgtgtaagatctctgtttgtgatgtttgagtactataataaattttgagaaaattatgctaaaaatataaaggaaaaa

SEQ ID NO: 3924 - DNA, 1178 bp, Glycine max
aatgtactaaacaccatagtgaggaaagcataatcaaatcaaccatggctacccttattgctcccatcaccttttcacctggtttagatgcagaagctcttagaaaagctttccaaggatgggggaccgatgagaaaaccgttattgcaatactgggtcatagaaatgttcatcagaggcaacaaatcagaaaggtttatgaggaaatttaccaagaggacctcattaaacgcctggagtctgagctctctggtgactttgagagagctgtgtaccgttggatgctggaacctgcagatcgtgatgctgttttggccaatgttgccatcaagaatggcagcaaaggttaccatgtgattgtggaaattgcttgtgtgctttcagctgacgaggtcttggcagtgaagcgtgcctatcacaaccgttacaagagatctttggaagaagatgtggctactaataccactggtgatattcgccagctgttggttgggttggtgacagcatataggtatgatggtgatgaggtcaatgcaaaattggccaaaactgaagctgatattcttcatgaatctatcaaggagaaaaagggcaaccatgaagaagccatcaggatcctcaccacaaggagcaagacacaacttctggcaactttcaaccgctacagagatgaccatggcgcttccataactaagaaattgttggataatgcatctactgacttccagaaagcattgcacactgctattagatgtatcaatgaccacaaaaagtactatgaaaaggttctgcgcaatgcgataaaaggggttggaactgatgaggatgcactcacccgtgtggtggtctcaagggctgagaaggacctcagggacatcaaagagctttattataagagaaatagtgttcaccttgaggatgcagtggccaaggaaatctcaggggactacaagaaattcatcctcactctgttggggaaggaagattgaagtgattgctctagccaaggacatgtctttagtttgcttatgttggattcgtgtgctgtgatttggttaatttccctatttagagtgtgttttttatgagttctgtatctttgttgtgagagtgtgtacttctgttttaaattactgttgttgatatttgattagtataataaactttaaatatgtaat

SEQ ID NO: 3925 - DNA, 1192 bp, Phaseolus coccineus
tggccggggatacccaacacctttctgaggaaacaataatcaacaatggctaccctcattgctcccatcactttttcacctggtgcagatgcagaagatcttcacaaagcttttaaaggatggggaactgatgagaaaactgttattgcaatattgggtcacagaaatgtttatcagaggcaacaaatcagaaagatttatgaagaaatttaccaagaagaactcctcaaacgcctagagtctgaactaactggtgactttgagagatcagtgtaccgttggatgctggaacctgcagatcgtgatgctgttttggccaatgtggcaatcaagagtggtagcaagggctatcatgtgattgtggaaattgcttgtgtgctttcatctgaggagcttttggcagctaggcgtgcctatcacaaccgttacaaacgatctttggaagaagatgtagctactcatacctctggtgatcttcgccagctgttggttgggttggtgacctcatataggtatggtggtgatgagattaatgcaagattggcaaagactgaagctgatattcttcattcatctatcaaggagaaaaaaggcaaccatgaagaagccattaggatccttaccacaaggagcaagactcaacttctggcaactttcaaccgctacagagatgatcatggcacttccataactaagtaaatttgtttggtacgatgcatctgatgatttcaggaaggcattgcacactgctattagatgtaccaatgaccacaaaaagtactatgaaaaggttctgcgcaatgcaatgaaaaaggttggaactgatgaggattgtcactcactcgtgtggtggtttcaagagcagagaaagacttgaggaacattgcagagatctattacaagagaaacagtgttcatcttgaggatgcagtggccaaggaaatctcaggggactacaagaaattcatcctcactttgttggggaaggatgtttgaagtgattgttctagccaagaacattgaaacatattttgtatctgtttatgttgttggtttcttggcctatgatttggttaattttccaattctgagtgtgcttttatcagtcatgtgtctattgtctttaatgtgtacttctgtttaacattactacttgcgatgtttgagcactataataaagtttgagaaaatt

SEQ ID NO: 3926 - DNA, 1397 bp, Trigonella foenum-graecum
attacttctctataattttcgctccctttatcacagccacaccgccttcacccctctttctccaaaacccctcttttctttctctgctagggttagggttttactcctttcaagatcttcaagaatcctcttctcgttgagttcattccggatctcgatctatggatatgcgtaagagaggaagacccgaacatggatttaacaacaatggtggattcaagagatccagacaagaaatggagtccttatcaactggtgtaggaagcaaatcgaagccatgtaccaagtttttcagcacttctggctgcccatttggtgagagctgccacttcttgcaccatgttcctggcggttataatgctgtttcccagatgatgaatctaacacctgcagcacctcctgcacccagaaatgttgcagccccacgaaatgcacatgcacccaatgggtctgcgcaatctgccgttaaaagccgcatatgcagcaagtttaatactgcagaaggctgcaaatttggtgacaaatgccatttcgcccacggagaatgggaacttgggaagcctgtagctccatcatttgatgatcatcgtcacatgggaccacccaatgcaggccggtttgggggtcatcggatggagcctcctcctgttccagctgccagctttggtgccaatgccactgccaaaatcagtgttgaagcttccttggctggagcgatcattggtaagggtggtgtgaactcaaaacagatctgtcgtcaaactggtgccaaacttgcaattcgagatcatgaatctgacccaaatctcagaaacattgaacttgagggaacttttgaacaaattaaggatgctagtaacatggtgaaggatttactgttgaccctgcaaatgtctgcaccacctaaaacaaaccaaggcggtcatggagcccctggccatcatggaaacaacttgaaaacaaaactgtgtgagaattttgcaaaaggatcttgcacttttggagacagatgtcattttgcacatggagctgctgaactgcgtaaatgaaaactttaccttaatgaagcggtgcattgtcgtgtcagacaggctatttttatttttattattattattgctgtgcattgctacttagggtactgacaggacttctgatgttaagagttttgttgtttgtttcctttaaatagcaacattagcttttcaatttttcctttattatgaatcaaatctctcccttctcattgttgactgtacttgtagcaatagtgttttgttttctcatgccctacattgatcatatttcctgttttatgaatttggtgttgcggataaagtgtatttagagaatttcaatggggagtcttttatttaataaggatctcaacttatcaa

SEQ ID NO: 3927 - DNA, 1418 bp, Glycine max
ccgctctccttgctccaaaaccccttattcagggtcaccgctgttagggttagggttagggttagggtttttccgcacattctttctctagcaatcttcttctaccactttcccctcattctctctcttagtctcttcaattgtaagttttttgcgctagggtttcctctgctatctcttgtactcgaagctcgtccctttttccggatctcgatctatggatatccgcaagaggggaagacccgaacccggcttcagcttaaatggtggattcaagaaatccaagcaagaaatggagtccttatcaactggtgtaggaagcaaatcgaagccatgtaccaagtttttcagcactgctggttgcccattcggtgagggctgccacttcctgcactatgttcccggtggttataatgcagttgcccatatgatgaatctaacacctgcagcacctcttccaccaacaagaaatgttgcagctctgcctcatgtacctaatgggtctgcaccatctgccgttaagacccgcatatgcaacaagtttaatactgctgaaggttgcaaatttggtgacaaatgccattttgctcatggtgaatgggaacttggcaaacacattgctccatcatttgatgatcatcgtgccatgggaccccctggagcaggtcgtcttgctggtcgaatggagcctcctggtcctgccgcaagttttggtgccaattccacagcgaagatcagcgtagaagcttccctggctggagctatcattgggaagggtggtgtgaactcaaaacagatctgccgccaaactggagccaaactttcaattcgagagcatgaatctgacccaaatcttagaaacattgaacttgagggaagttttgagcaaatcaaggaagcaagtaacatggtaaaggatttacttttgaccctgcaaatgtctgcaccacctaaaacaaccccgggtgttcctggtgcacctgcctctcatggaagcaattttaagacgaagctgtgtgagaattttgcaaaagggtcttgcacgtttggagatagatgtcactttgcacatggagcttctgaattgcgtaaatcaggagtatgaactttcttagtgaggcacattagccggggttattattattgttgtgcattgctactttagcagtactgacaggacttctgaagttagttttgttgttgagtcgctttacataactttttttgttttccgatttcaatttttgcttatatcatgaaactggtgtttaggttactccatttagtccccaataattctattaaaatagtgtggttttagttccttttgtagatactaaaagtgaaaaaaattagttataaaaaaaagtcaataaaattttattaaggactaaaacaaataaaatagcgatatcttc

SEQ ID NO: 3928 - DNA, 1269 bp, Glycine max
gcttgctccaaaaccccttattagggtcaccgctgtttgggttagggttagggtttctccacacattctttatctaccaatcttcttccactactttcccttcgttccctctcactctcttcatttgtaagctttttgcgctagggttttctctgcaatctcttgtactcgaagttcgttccttcttccggatctcaatctatggatatccgcaagaggggaagacacgaaaccggcttcagcttaaatggaggattcaagagatccaagcaagaaatggagtccttatcaactggtgtaggaagcaaatcgaagccatgtaccaagtttttcagcactgctggttgcccatttggtgagggctgccacttcttgcactatgttcccggtggttataatgcagttgcccatatgatgaatttaacacctgcagcacctcctccaccatcaagaaatgttgcagctctgcctcatgtacctaatgggtctgcaccatctgccgttaagacccgcatatgcaacaagtttaatactgctgaaggttgcaaatttggtgacaaatgccattttgctcatggtgaatgggaacttggcaaacacattgctccatcatttgatgatcatcatgccatgggaccccctggagcaggtcgtcttgctggtcgaatggagcctccgggtcctgccgcaagttttggtgccaattccacagcgaagatcagcgtagaagcttccctggctggagctatcattgggaagggtggtgtgaactcaaaacagatctgccgccaaactggagccaaactttcaattcgagagcatgaatctgacccaaatcttagaaacattgaacttgagggaagttttgagcaaatcaaggaagcaagtaacatggtaaaggatttacttttgaccctgcaaatgtctgcaccacctaaaacaaccccgggtgttcctggtgcacctgcctctcatggaagcaattttaagacgaagctgtgtgagaattttgcaaaagggtcttgcacgtttggagatagatgtcactttgcacatggagcttctgaattgcgtaaatcaggagtatgaactttcttagtgaggcacattagccggggttattattattgttgtgcattgctactttagcagtactgacagtactttcgatgttagttttgttgttgagttgttttaggtcccaattgggatgtttgggatgatttttttttttcagttttgaaattattaaaaaccaaacttagttta

SEQ ID NO: 3929 - DNA, 1335 bp, Glycine max
tgagcctattattatttccctctctccttgctccttgctccaaaaccccttcttcagggtcaccgctgtcagggttagggtttttccaccttctttatttaccaatcttcttctactaccacttttccctcgttccctctcttagtctcttcaattgtaagctttttgcgctagggtttcctctgcaatctcttgtacttgaagctcgttccttcttccggatctcgatctatggatacccgcaagaggggaagacccgaacccggcttcagcttaaatggcggattcaagaaatccaagcaagaaatggagtccttatcaactggtgtaggaagcaaatcgaagccatgtaccaagtttttcagcactgctggttgcccatttggtgagggctgccacttcttgcactatgttcccggtggttataatgcagttgcccatatgatgaatctaacacctgcagcacctccagcatcaagaaatgttgcagctctgcctcctgtaccaaatggttccgcaccacctgccgttaagacccgcatatgcaacaagtttaatactgctgaaggttgcaaatttggtgacaaatgccattttgctcatggtgaatgggagcttggcaagcatattgctccatcatttgatgaccatcgcaccatgggacccactggagtaggtcgtcttgctggtcgaatggagccccctcctggccctgctgcaagttttggggccaatgccacagccaagatcagcgtagaagcttccctggctggagctatcattgggaagggtggcgtgaactcaaaacagatctgccgccaaactggagccaaactttcaattcgagagcatgaatctgacccaaatcttagaaacattgaacttgagggaagttttgagcaaatcaaagaagcaagtaacatggtaaaggatttacttttgaccctgcaaatgtctgcaccacctaaaacaaccccaggtgttcctggcgcacctgcctctcatggaagcaattttaagacgaagctgtgtgagaattttacaaaagggtcttgcacgtttggagatagatgtcactttgcacatggagctgctgaattgcgtaaatcaggagtatgaactttcttagtcaggcacattagctagggttatgattattgttgttgtgcattgctactgacaggacttctgatgttagttttgttgttgagttgctttacataacttgttttatttccgatttcaactctcgcttatatcatgaaactggtgttttctctaggctaccccatttggtcccaaataatgctatgaaaatagtgtgattttagttcc

SEQ ID NO: 3930 - DNA, 1054 bp, Zea mays
ctcgctcggcaccgcaaacaaacagaatccacaagggaggcagaggcagacccgacccgaatcaccgccgtcgtcgtcgttgagaagagacaaagtggaggagtaggccatgtccaacgtgcccacctccctccgcgattcctccctcaccgtcttccgcctcgccatctccagctccgacccctggcccttctcttcctgcctgtaaccaccatcagcccccggccggccggcttcttcgtcctccttcctgatcgagcaaccaccacaagcaagcaaaaagaacaccgagctccttcctggtgaccatcatgcccggcaggcatcatcatcatcagcagcagcagcagctggcggcggtggcgcccaaggggtgcgtgacggtgcgcgtgggcctggagggcgaggagcagcgccggttcgcggtcccgctgggccacctcaagcacccgctcttcggcgcgctgctggaggaggccgagcgcgagtacggcttccggcaccagggcgccctcgccatcccctgccgcgtcgaccgcttcgtccaggtggagcacctcatcggccaggacctccgcgggaccagctgcgcccagcacctcgtggacctcgacggcgccctggcaagcggcggcggagcgcaccaccaccaccagcaccaccacctgcacctgccgcgcttcgttggctgcttccgcgcctgatcgacggcgggccgcgcgtcgagcgaggtggttgcttgctttggttgattaactagcactttggtttggctcgtcgtccttttcccccttctctctcccgccgttgcatgctttatttgtgagggttgatcgatacgaatacgtattggtttgaagctagcttggtttggtggcgagagacatgggatgggacatccaggtgttgacgatgacggaaaatttgtgatgatggtcgatctcaagtgtaaagatctagagaggatgatgttcatcatcatttaattaaccttagcttttctttttttcctttgcttgtactatacgtacgccaatatacactttgctaatac

SEQ ID NO: 3931 - DNA, 1015 bp, Setaria italica
tcttgacatcgcagctctctcgatcgcaagctccaccgcaaggcgaacccaccccgtatcgtagtcgagaagaagaagacaaagtggagtaggccatgtccaacgtgcccacctccctccgcgactcctccctcaccgtcttccgcctcgccatctccagctccgacccctggcccttctcttcctcctgcctctagccacgagcctccccctcagcttagcctcctcttcttgaatcttgatcagcaaccaaccgagcagctccttctcgatctggcctgcctggcggccatcatcatgcacggcaagcagcagcagcagcagcagcagatggtgccggtggcgcccaaggggtgcgtgacggtgcgggtgggcgcggagggggaggagcagcgccgcttcgccgtcccgcttggccacctcaagcacccgctcttcggcgcgctgctggaggaggccgagcgcgagtacggcttccgccaccagggcgccatcgccatcccctgccgcgtcgaccgcttcgtccaggtcgagcacctcatcgaccaggacctccacggcagctgcgcgcagcacctcgtcgacctcgacagcgccgccgccccgccgcaccaccaccaccaccaccaccaccaccacctgcacctgccgcgcttcgtcggctgcttccgcgcctgatcaatcggtcgaggtgtctcctttgtgctggttgattagctttcggtttggctcgtcctccgttctctctcgccttggtttgtgggggttgatgatgcgattggtttgaagctttgtggcgagaagagagcccatggagggcgatgcatctagatgttgacgatgacgaaaaattgtgatgatgaacacaatcaattgtaaagatctagagagatcctgttgatctttagccttagcttttttttctttcctttgcttatacgtcaatatatactttgctataatatgctctgcgaaagtggttttgttcgtgtaaattataaagattaattttctg

SEQ ID NO: 3932 - DNA, 1475 bp, Saccharum officinarum
gcgtgccaattccccaccccaccctagcctgtcccgccccaaaacccttgcggcgtcgcactcacgctagcaaccaaccccaggaccctcctctccggcggcggccggcgcgcgcgcgagggagatggaccgccctgccggcgcatcgtaccagcgcttcccccgcgttcggatccgcgacctcaaggacgactacgccaagttcgagctccgcgacaccgacgccagcatggcgaatgccctccgccgcgtcatgatcgctgaggtcccaaccgtcgccatcgatctcgtcgagatcgaggttaactcctccgtcctcaacgacgagttcatcgcccaccgcctggggctcatcccgctcacctccgccgccgccatgcaaatgcgcttctctcgggactgcgacgcttgcgacggcgacggctcctgcgagtactgctccgtcgagtttcacctcgccgcgcgcgccaccgactccgaccagacgctcgaggtcacatccaacgacctgaggtccatggatcccaaggtctgcccagtcgaccaagcacgcgcctaccagcaggcgctcggtggcaccgacccctttggagcgaatacctcgaacgaaaataggggcatacttattgtaaagctgcgccgggggcaagaactaaggcttcgtgccattgctaggaaaggaattggcaaggaccatgccaaatggtcaccagctgctaccgtgactttcatgtatgagcctgacatacgtatcaatgaagaactaatggaaacattgacagtggaagagagaaaaagcttgatcgaaagcagccctacaaaagtatttaagcttgattctgctaatcaggtggtggtggacaatgctgaggcatacacctatgatgatgaggtgatcaagcacgctgaggccatgggaaagccaggcttaattgagatcaacgcgaaggaggacagcttcatcttcacggtagaaacaaccggtgccatcacggcctacgagctgatcatgaacgcaatcacggtcctgaggcagaagttggatgctgtccgccttcaggacgatgatggtgaccttggcgagctcggcgcccaccttggcgggccttaggagctttgcaagaactgccctcagtgtctatgtaggccttatctaactgccatgctagtcgaacagtctgataaccctatggtgtctaagctccagattatggatttccaaatatccagtactgaattgcagtccctgtttgggctgtgtgacctctgcaccgtggctttgcagcatcgatttagttattatgctcgttttcgaacctgtagttatttatgggaggtggtacttgtttgccgtgatgttttcttgtgcgtctgattgatgtggtgcgtagtgttccactggtttgtgaggtgaatgcagatttatttgctggttccccaggcctagaatgatatgctgtatgcaagacaaccct

SEQ ID NO: 3933 - DNA, 1589 bp, Zea mays
aaatcgcaaatatcttcttaccccaacgtcgcccaaaaacccttgcggcgtcgcactcacactagcgaccaacccccaaccccagaccttcctctccggcggcggccggcgcgcgcgcgagggagatggaccgcccttccggcacatcgtaccagcgcttcccccgcgttcggatccgcgagctcaaggacgactacgccaagttcgaactccgcgacaccgacgctagcatggccaacgccctccgccgcgtcatgatcgccgaagtcccaactgtcgccatcgatctcgtagagatcgaggttaactcctccgtcctcaacgacgagttcatcgcccaccgtctggggctcatcccgctcacctccgccgccgccatgcaaatgcgcttctctcgggactgcgacgcttgcgacggcgacggctcctgcgagtactgctccgtcgagtttcacctctccgtgcacgccaccgactccgaccagacgctcgaggtcacatccaacgacctgagatccatggaccccaaggtctgcccagtcgaccaagcacgcgcctaccagcacgcgctcggaggcaccgacccctttggagccaatgcctcgaacgaaaacaggggcatacttattgtaaagctgcgtcgggggcaagaactaaggcttcgtgccatagctaggaaaggaattggcaaggaccatgccaaatggtcaccagctgctaccgtgactttcatgtatgagcctgacatacgtatcaatgaagaactaatggaaacattgacggtggaagagagaataagcttgattgaaagcagccctacaaaagtatttgagcttgattctgccaatcaggtggtggtgaaaaacgcggaggcatacacctacgacgacgaggtgatcaagcacgccgaggccatcgggaagccaggcttggtggagatcaccgccaaggaggacagcttcgtcttcaccgtagaaacaaccggcgccatcacagcctacgagctgatcatgaacgccatcacggtgctgaggcagaagctggatgccgtccgccttcaggacgacgacggcgaccttggcgagctcggcgcccaccttggtgggccttaggagctttgagcaagaaggaatcgccctgtggccttcctccctcccacctgcctacgtaggcctatctaactgctgtgcgtgctagtcgatcgatcgaaaccgaacggttctgataaaccttatggtgtctaaagctccagatttatggattgccaaacacccagcaccgaattccagtttgatttccttgcccgccttgttttcgtgcgggtgacatctgcgccgtgaatttgcatgcttgcgcgtcttgttattgctctgtggtgtgtgtactatctaacttttgtgtgtgtgaggtgaatgcagagttatttgcaggttccccaggccgggcccagattgatatgctgaatgcaaggcagcatttgatgaggtacatgtagtacgtagtacatactagtaccgatattgcctgcagggattgatccccaaaacagtacagctgtaaatttatgtgctgaaatttggtgatttctt

SEQ ID NO: 3934 - DNA, 1746 bp, Oryza sativa
tccctcggcctatagtgttgggtttgggtgttggtttttccccaaatcaaaaaccctcccgtcccatcccctccttgtgtagttgtgttgtttgcggcgaaaccctaggattgtctccggcggcggcggcggaaggatcatggagcgggcggcaggcggcgtgtcgtaccagcggttcccgcgggtgcggatccgcgagctgaaggacgactacgccaagttcgagctccgcgacaccgacgccagcatggccaacgccctccgccgcgtcatgatcgccgaggtccccaccgtcgccatcgacctcgtcgagatcgaggtcaactcctccgtcctcaacgacgagttcatcgcccaccgcctcggcctcatccccctcacctccgccgccgccatggccatgcgcttctcccgcgactgcgacgcctgcgacggcgacggctcctgcgagtactgctccgtcgagttccacctcgccgcccgcgccaccgactccgaccagaccctcgaggtcacctccaacgacctccgctccaccgaccccaaggtctgccccgtcgaccaggctagggcctaccagcacgccctcggcggaactgaacccttcgacaccgccgctgctgctgaccagaggggcatactaattgtaaagctgcgtcggggccaagagctcaggctccgagcaattgctaggaagggaattggcaaggaccatgccaagtggtcccccgccgctactgtgactttcatgtatgagcctgaaatacgtatcaatgaagaactcatggaaacattgacactcgaggaaaaacgaaatttggtggagagtagccctacaaaagtgttcaacattgatcccaacactcaacaggtggtagttgaggatgcagaggcatatacatatgatgatgaggtcatcaagaaagcagatgccatgggaaagcccggattgatagagatcaatgccaaggaggacagctttatcttcactgttgaaacaactggcgctatcacagcttatgagctgatcatgaacgctatcacggtcttgaggcaaaagttagatgctgttcgtctacaagatgacgatgctgaccttggcgagcttggtgcccaccttgttggaggctaagcgcagagctgcttgtcttgtgttacccacaaagtaggtttctctaactatcgtgctagaggcaaaacatgatggtttcttcgtttggatcaatctagtacatgtaatctccctgatctgtgccattaaatctgtgctggaactttgtgtggacgcaccagactactgttcaatttgatggcaaatcgacacaccagccagctcatctctgggacaaatgtggagctgctagtaatactgaatgctgttcacctgtgatgtgtctttgggacttgcagcccgtcgttttgattggcctacggtatatgctacggcttgctgtgttgaatgctgggttttgtgcaggtctccccagattcatatgctcaatgcaatgtggcgtttaatgctgtacatctccaggttaattgctgaatagtggtggtactagatggtttgatggattcgctgagcgagatgcgtggagttaagcgcgcgtgcatgtggatcagtactacgatcttgatggatgtaccaaatgatttggtaatgtactgatattttggacctaaatgttggatctttcctgcttcttgcatactagtatcagtgtatgtgtgtatgcgcggtgtgac

SEQ ID NO: 3935 - DNA, 1220 bp, Panicum virgatum
cactgatccaccccaaaacccttgcggcggcgttgcgctcccatcagctaccaaccccagaccccccttcttctccggctgcggagcggggggttcggcgcgagggagcgagatggaccgtccggcggccggcgcgtcgtaccagcgcttcccccgcgtccggatccgcgagctcagggacgactacgccaagttcgagctccgcgacaccgacgccagcatagccaacgccctccgccgcgtcatgatcgccgaggtccccacggtggccatcgacctcgtcgagatcgaggtcaactcctccgtcctcaacgacgagttcatcgcgcaccgcctgggcctcattcccctcacctccgccgccgccatgcaaatgcgcttctcccgggactgcgacgcctgcgacggcgacggctcctgcgagcactgctccgtcgagttccttctctccgcgcgtgccaccgactccgaccagacgctcgaggtcacatccaacgacctgaggtccgccgaccccaaggtctgccccgtcgaccaggcgcgcgcctaccagcaggcgctcaacgccgacttcgagtccaccgccggggagcacaggggaatacttattgtaaagctgcgccgggggcaagaactgaggcttcgtgccattgctaggaaaggaatcggcaaggaccatgccaaatggtcaccagctgctactgtgactttcatgtatgagcctgacatacatatcaatgaagaactcatggatacattgacgcttgatgagaaaataagttgggtcgaaagcagccctacaaaagtatttaaccttgatcctattaccaaacaggtaacggtgtgtgatgctgaggcatacacctatgacgacgaggtgatcaagaaggcggaggccatggggaagccaggcctggtggagatcaacgcgaaggaggacagcttcatcttcactgtggaaacaaccggtgccatcacagcctacgagctgatcatgaacgctatcacggtcctgcggcagaagctggatgctgtccgcctccaggacgacgacggcgaccttggtgagctcggcgcccaccttggcggaccttaagcatcttcctcccctccccattgtagtaggctgatctaactgccctgctagtcgaacagcctgatgcccctctaaattgtccagactgtatttccgaaacgtccagtacgatgttgtggacttg

SEQ ID NO: 3936 - DNA, 1364 bp, Cenchrus ciliaris
  misc_feature (152)..(152): n is a, c, g, or t
  misc_feature (1296)..(1296): n is a, c, g, or t
cggcgttgcgctcccatccgcaactaacccagatccccttttccggcggcggagcggggttcggcgcgcgcgccgagggagcgagcgagatggaccatccggcggccggcgcttcgtaccagcggttcccccgcgtccggatccgcgaactnaaggacgactacgccaagttcgagctccgtgacaccgacgccagcatagccaacgccctccgccgcgtcatgatcgccgaggtccccaccgtcgccatcgacctcgtcgagatcgaggtcaactcctccgtcctcaacgacgagttcatcgcgcaccgcctggggctcatccccctcacctccgccgccgccatgcaaatgcgcttctcccgggactgcgacgcctgcgacggcgacggctcctgcgagtactgctccgtcgagttcaacctctccgcgcgcgccaccgactccgaccagacgctcgaggtcacctccaacgacctaacgtccggcgaccccaaggtctgctccgtcgaccaggcacgcgcctaccagtcggcgcttagcggcaacgtcttcgaccccaacaacgagaggggaattcttattgtaaagctgcgtcggggccaagaattgaggcttcgtgccattgctaggaaaggaattggcaaggaccatgccaaatggtcaccagctgctaccgtgactttcatgtatgagcctgacatacgtatcaatgaagaacttatggatacattgacttttgatgagaaaagaagctgggttgaaagcagtcctacaaaagtatttgagcttagtgctaatggaaaggtgacagtgtgtgatgccgaggcatacacctacgatgatgaggtgatcaagaaggcggaggccatgggaaagccaggcttggtggagatcaacgcaaaggaggacagcttcatcttcaccgtggaaacaactggcgccatcacagcctatgagctgatcatgaacgcgatcacggtcctgcggcagaagctggacgccatccgcctccaggacgatgacggcgaccttggcgagctcggcgcccaccttggcgggccgtaagagctgccttccctgcccccaatgtagtctctaactgccgtgctagtcgaacaggctgatgccccctctgtttatccaaaccatctggtagcctctgcgctccccttgtttctgctttgacctatgtgtctgtgccggagcttttcagcatggatctggttacgcttaatcatgtgccactaagtgaaatcgacacatgaattaggccttgtttgggtattagagtatnggagtagagtggagagattgaggtgaaaattggttcattattatctcaatccacttcattccacctca

SEQ ID NO: 3937 - DNA, 2123 bp, Pennisetum glaucum
aaccaaccccagatccccttctccgtcgccgaagcgggtttcggcgcgcgcgcgcgcgcgcgagggagcgagcgagatggaccgtccggcggccggcgcgtcgtaccagcggttcccccgcgtccggatccgcgaactcaaggaagattacgccaagttcgagctccgtgacaccgacgccagcatagccaacgccctccgccgcgtcatgatcgccgaggtccccaccgtcgccatcgacctcgtcgagatcgaggtcaactcctccgtcctcaatgatgagttcatcgcgcaccgcctggggctcatccccctcacctccgccgccgccatgcaaatgcgcttctcccgggactgcgacgcctgcgacggcgacggctcctgcgagtactgctccgtcgaattcaacctctccgcgcgcgccaccgactccgaccagacgctcgaggtcacctccaacgacctgacgtccaccgaccccaaggtctgctccgtcgaccaggcacgcgcctaccagttggcgcttagcggcaacggctacgaccccaacaacgagaggggaatacttattgtaaagttgcgtcggggccaagaattgaggcttcgtgccattgctaggaaaggaattggcaaggaccatgccaaatggtcaccagctgccaccgtgactttcatgtatgagcctgacatacgtatcaatgaagaacttatggatacattgacttttgatgagaaaagaagctgggttgagagcagtcctacaaaagtatttgaacttagtgctaatggaaaggtgacggtgtgcgatggcgaggcatacacctacgacgatgaggtgatcaagaaggcagaggccatgggaaagccaggcttggtggagatcaacgcaaaggaggacagcttcatcttcactgtggaaactactggtgccatcacagcctatgagctgatcatgaatgcgatcacggtcctgcggcagaagctggacgccgtccgcctccaggatgatgacggcgaccttggcgagctcggcgctcaccttggcgggccttaattgcttgctcccctgtccgcagtctcatctaactgccgtgctagtcgaacagcctgatgccctgctgtttttagtctctccagagtccagactgtattttcaaaccatttatctgggtaccctctgtgctctccttgtttctgctagacctatgtgtctgcctgagcttctcagcacatggatctggttacgtttgatcatgcgccactaaaggcttgtttgggaaatggaggattcaagtggatggaagaggattgaaggggattttgggaaattttgacttataatggaaattcctccaccccaatgcccttcattcccgttcattccactaatttccaaacaagccctaaatgacaatcaacttcgctccttgtattgagtcttcctggacgaaaatgcagctgccatcatgtttgagctaacaataacaatgccaaaactgaggtaggggtgtgagagctcgcaatgatacggccacgttcaggaaaaatgaagatcgtgggcgtattcagagaaagttgggaggtccaatccatcccttgcaatgctcctgtcttcgtcagttacacttaaatcttgcaatatatcatctgtgttttgaagcttccggatgtaaccaattagaagaagcttcacaggctctgtttcaatcttgtcgaagaaatcaagaaattctactgccatcactctttctactgtctgctgtgaaaagtcccacccggtacatatgatcaccttagaaaatccatgcactttggacttgacccaacccaaataaattcctgctatttggtcaggaatacattcataggtgtgctcatctgaaactaccctatgaagattgttcagaattctatcacctatttgagcagttgaaagtaagggatcaatgggcaaaacaccttgaatgcgatcttcgaatggaggaagaccccacagctcaggatcgaagtccaaaagtgaatagaggatgacatctgcaatatggtagtgcttcctctgactttgaagtgatggtacagcaatggcctttgccccagaagccttggcacccttgactccaacg

SEQ ID NO: 3938 - DNA, 1354 bp, Setaria italica
gcggcgttgcgctcccaccagcaaccaactgcagacactcttctccggcggcggagcgggagttcggcgcgcgcccgagggagcgagcgagatggaccgtcctgcggccggctcgtcgtaccagcgcttcccccgcgtccggatccgcgaactcaaggacgactacgccaagttcgagctccgtgacaccgacgccagcatagccaacgccctccgccgcgtcatgatcgctgaggtccccaccgtcgccatcgacctcgtcgagatcgaggtcaactcctccgtcctcaacgacgagttcatcgcgcaccgcctggggctcatccccctcacctccgccgccgccatgcaaatgcgcttctccagggactgcgacgcctgcgacggtgacggctcctgcgagtactgctccgtcgagttcaacctctccgcgcgcgccaccgactccgaccagacgctcgaggtcacctccaacgacctgaggtccgctgaccccaaggtctgccccgtcgaccaggcacgcgcctaccagctggcgctcagcggcaacgactacgaccccaacgccgagaggggaatacttattgtaaagctgcgtcggggccaagaattgaggcttcgtgccattgctaggaaaggaattggcaaggaccatgccaaatggtcaccagctgctaccgtgactttcatgtatgagcctgacatacttatcaatgaagaacttatggatacattgacttttgatgagaaaagaagctgggtcgaaagcagtcctacaaaagtatttgaccttagtgctaatggaaaggtgacggtgtgtgacgccgaggcatacacctacgacgacgaggtgatcaagaaggcggaggccatgggaaagccaggcttagtggagatcaacgcaaaggaggacagcttcatcttcaccgtggaaacaactggtgccatcacagcctatgagctgatcatgaacgcgatcacggtcctgcggcagaagctggacgccatcggcctccaggacgatgacggcgaccttggcgagcttggcgcccacctcggcgggccttaagtgctccctcccctgtcccccatgtaggctcatctaactgccgtgctagtcgaatagcttgatgccccctctgtttttccgagtctccagactatggatttccaaaccatttggtgctgcggtgttatagcctctgcgctccccttgtttctgcttctgacctttgtgtctgtgccggagcttttcagcatggatctggttacgtttaatcatgcgccattaagagaaatcgacacatgaattatgtggaacaaaaatgcaggggtgggtggtaatgtcgtgcgg

SEQ ID NO: 3939 - DNA, 1381 bp, Setaria italica
ccccacccaccccaccccaaaaccctcgcggcgttgcgctcccaccagcaaccaactgcagacactcttctccggcggcggagcgggagttcggcgcgcgcccgagggagcgagcgagatggaccgtcctgcggccggctcgtcgtaccagcgcttcccccgcgtccggatccgcgaactcaaggacgactacgccaagttcgagctccgtgacaccgacgccagcatagccaacgccctccgccgcgtcatgatcgctgaggtccccaccgtcgccatcgacctcgtcgagatcgaggtcaactcctccgtcctcaacgacgagttcatcgcgcaccgcctggggctcatccccctcacctccgccgccgccatgcaaatgcgcttctccagggactgcgacgcctgcgacggtgacggctcctgcgagtactgctccgtcgagttcaacctctccgcgcgcgccaccgactccgaccagacgctcgaggtcacctccaacgacctgaggtccgctgaccccaaggtctgccccgtcgaccaggcacgcgcctaccagctggcgctcagcggcaacgactacgaccccaacgccgagaggggaatacttattgtaaagctgcgtcggggccaagaattgaggcttcgtgccattgctaggaaaggaattggcaaggaccatgccaaatggtcaccagctgctaccgtgactttcatgtatgagcctgacatacttatcaatgaagaacttatggatacattgacttttgatgagaaaagaagctgggtcgaaagcagtcctacaaaagtatttgaccttagtgctaatggaaaggtgacggtgtgtgacgccgaggcatacacctacgacgacgaggtgatcaagaaggcggaggccatgggaaagccaggcttagtggagatcaacgcaaaggaggacagcttcatcttcaccgtggaaacaactggtgccatcacagcctatgagctgatcatgaacgcgatcacggtcctgcggcagaagctggacgccatcggcctccaggacgatgacggcgaccttggcgagcttggcgcccacctcggcgggccttaagtgctccctcccctgtcccccatgtaggctcatctaactgccgtgctagtcgaatagcctgatgccccctctgtttttccgagtctccagactatggatttccaaaccatttggtgctgcggtgttatagcctctgcgctccccttgtttctgcttctgacctttgtgtctgtgccggagcttttcagcatggatctggttacgtttaatcatgcgccattaagagaaatcgacacatgaattatgtggaacaaaaatgcaggggtgggtggtaatgtcgtgcgg

SEQ ID NO: 3940 - DNA, 1308 bp, Leymus cinereus x Leymus triticoides
  misc_feature (91)..(91): n is a, c, g, or t
  misc_feature (241)..(241): n is a, c, g, or t
  misc_feature (583)..(583): n is a, c, g, or t
  misc_feature (1152)..(1152): n is a, c, g, or t
  misc_feature (1260)..(1260): n is a, c, g, or t
aatctgccgcccgacccaaaacccttgcggcgacccgccccatctccggcggccaagcggaatggagcgcccggcggcaggcgcctcgtancagcgctttccgcgcgtgcggatccgcgagctcaaggacgagtacgccaagttcgagctccgcgacaccgacgcgagcatggccaacgccctccgccgcgtcatgatcgccgaggtccccaccgtcgccatcgacctcgtcgagatcganagcaactcctccgtcctcaacgacgagttcatcgcgcaccgcctcggcctcatcccgctcacctcctccgccgccatgtccatgcgcttctcccgcgactgcgacgcctgtgacggggacggctcctgcgagtactgctccgttgagttccacctcgctgcccgcgctaccgactccggacagacgctcgaggtcacctccaccaaggacctccgctccaccgaccccaaggtctgccctgtcgaccaggcaagggaattacagcaggccctcggcaacggcgacatgtacgagcccgatgctgccggtgaccacaggggcatattaattgtaaagctgcgncgtgggcaagagctgcgtcttcgagcaattgccaggaagggaattggaaaggaccatgccaaatggtctccagctgctactgtgaccttcatgtatgagcctgatatacgtattaatcaagaactcatggagacacttacacttgaggaaaaacaaagctgggtggagagcagccctacaaaagtatttgacattgatcctgtcacccaacaggtgatgattgtggacccagaggcatacacatatgacgatgaggtgatcaagaaagcagaggccatggggaagccaggattggtagagatcaacgccaaggaggacagctttgtgttcactgtggaaacaacgggcgccatcacagcctatgagttgattatgaacgctatcacggtcctgaggcagaagctggacgcggttcgcctgcaagacgatgacggcgatcttggcgagcttggcgcccaccttatcggaggctaaaccgcttgtctgggaaagaaatcgccagccgtatctttctttcttccgtatctaggctcgtctcgtgtaaccagcgtgtttgtggcaagaggtantggatgcttcctttgatatccagcaccaaaactctacgataatcatcatcgttgtatccctctgtttatgccctgacctctgccggaactctgtacgtgcaaaaaaantgggcgctgaagcttagccgcactgtggaacaagagaatagctcgtag

SEQ ID NO: 3941 - DNA, 1445 bp, Triticum aestivum
ttgctccgtttcccccaaatctgccgcacgacccaaacaaaacccttgcggcggcgccccaccccatctccggcggccaagcggaatggagcgctcggcggcgggcgcctcgtaccagcgcttcccgcgcgtgcggatccgcgagctcaaggacgagtacgccaagttcgagctcaaggacaccgacgcgagcatggccaacgccctccgccgcgtcatgatcgccgaggtccccaccgtcgccatcgacctcgtcgagatcgagagcaactcctccgtcctcaacgacgagttcctcgcgcaccgcctcggcctcatcccgctcacctcctccgccgccatgtccatgcgcttctcccgcgactgcgacgcctgcgacggggacggctcctgcgagtactgctccgtcgagttccacctcgccgcccgcgccaccgactccggccagacgctcgaggtcacctccaccaaggacctccgctccaccgaccccaaggtctgccctgtcgaccagcaaagggagtaccagcaggccctcggcaacgtcgacgcctacgagcccgatgctgccggtgaccacaggggcatattaattgtaaagctgcgccgtgggcaagagctgcgtcttcgagcaattgccaggaagggaattggaaaggaccatgccaaatggtctccagctgctactgtgaccttcatgtatgagcctgacatacgtattaaccaagaactcatggagacacttacacttgaggaaaaacaaagctgggtggagagcagccctacaaaagtatttgacattgatcctgtcacccaacaggtgacgattgtggacccagaggcctacacatatgacgatgaggtgatcaagaaagcagaggccatggggaagccaggattggtagagatcaacgccaaggaggacagctttgtgttcactgtggagacaacgggggccatcacagcctatgagctgattatgaacgctatcacggtcctgaggcagaagctggacgccgttcgcctgcaagacgatgacggcgatcttggcgagctcggcgcccaccttatcggaggctaaccaccgcttgtctgggaaagaagtcgccagcggtatctttgtttctccgtatctaggctcgtctcgtctaactggcttgcctgtggcaagaggtagtggatgcttcctttgatatccagcaccagaactctacggtaatcgcctttgtatccctctgtttatgccctgacctctgccggaactctgtacgtgcaaaaaaccatgggcgctgaagcttagccgcactgtggaacaagagaatagctggtagcccatgattggccgtgccgtgcggtggtgatacggcgtggtgtcttgaatgcagagttattcgcaggtctcccgcccccatacccagattcataagctttgtgtgggattaatg

SEQ ID NO: 3942 - DNA, 1292 bp, Hordeum vulgare
cgtttcccccaaatccgccgcccgacccaacaaaacccttgcggcggcgacccaccccatctccggcggccaggcggaatggagcgctctgcggcgggcgcctcgtaccagcgcttcccgcgcgtgcggatccgcgagctcaaggacgagtacgccaagttcgagctcaaggacaccgacgcgagcatggccaacgccctccgtcgcgtcatgatcgccgaggtccccaccgtcgccatcgacctcgtcgagatcgagagcaactcctccgtcctcaacgacgagttcctcgcgcaccgcctcggcctcatcccgctcacctcctccggcgccatgtccatgcgcttctcccgcgactgcgacgcctgtgacggggacggctcctgcgagcactgctccgtcgagttccacctcgctgcccgcgccaccgactccggccagacgctcgaggtcacctccaccaaggacctccgctccaccgaccccaaggtctgccctgtcgaccagcaaagggaataccagcaggccctcggcaatgtcgacgcctacgagcccgatgctgccggtgaccacagaggcatattaattgtaaagctgcgccgtgggcaagagctgcgtcttcgagcaattgccaggaagggaattggaaaggaccatgccaaatggtctccagctgctactgtgaccttcatgtatgagcctgatatacgtattaatcaagaactcatggagacactcacacttgaggaaaaacaaagctgggtggagagcagccctacaaaagtatttgacattgatcctgtcacccaacaggtgacgattgtggacgcagaggcatacacatatgacgatgaggtgatcaagaaagcagaggccatggggaagccaggattggtagagatcaacgccaaggaggacagctttgtgttcactgtggaaacaacaggcgccatcacagcctacgagctgattatgaatgctatcacggtcctgaggcagaagctggacgccgttcgcctgcaagatgatgacggtgatcttttggacctcggtgcccaccttaccggaggctaaccgctttgtctgggaaagaaatgggcagccgtatctttctttcttccgtgtctaggcccgtctcgtctaactagcgtgtttgtggcaagaggtgatggatgcttcctttgatatccagtaccaaaactctacggtaatcgtctttgtatccctctgtttatgtcctgacctctgccggaactctgtatgtgcaacccccaaaaaaaagaaaaatgggc

SEQ ID NO: 3943 - DNA, 1370 bp, Brachypodium distachyon
tcccccaaatctgccacccaacccgaaacccaaacccttgcgccgacctaggcaatctcccgtagtggcggccggcgtgcaagcgggatggatcgttcggcggcaggcgtctcgtaccagaggttcccccgcgtgcggatccgcgagctcaaggacgactacgccaagttcgagctccgcgacaccgacgcgagcatggccaacgccctccgccgcgtcatgatcgccgaggtccccactgtcgccatcgacctcgtagagatcgagagcaactcctccgtcctcaacgacgagttcatcgcgcaccgcctcggactcatcccgctcacctcctccggcgccatgggcatgcgcttctcccgcgactgcgacgcctgcgacggggacggctcgtgcgagcactgctccgtcgagttccacctcgccgcccgcgccaccgacgcgaacaagacgctcgaggtcacctccaatgacctccgctccaccgaccccaaggtatgcccggttgaccaggcaatggcataccagcaggccataggcaccgccgacccctacgacacttctactgcatcagaccacaggggcatactaattgtaaagctgcgtcgtggacaagagctgcgtcttcgagcaattgctaggaagggaattgcaaaggaccatgccaagtggtccccagctgctacggtgacattcatgtatgagcctgatatacgtattaatgaagaactcatggagacgcttactcttgaggaaaaaacaagctgggtggagagcagccctactaaagtatttgacattgaccctaacacccaacaggtggtggttgtggatcgggaggcatatacatatgatgatgaggtgatcaagaaggctgaggccatggggaagccaggactgatagagatcagcgcaaaggaagacagctttgtgttcactgtggaaacaaccggcgccatcacagcatatgagcttattatcaatgctatcacggtgttaaggcagaaactggatgctgttcgcctgcaagaagaagatggtgattttaccggtctcgacgcccacctcggtgtagcctagacccccaattccatggaaagaatcgtcggtagtatcttaaacccgtgtgtaggctcgtcttgctagcttgttagtgtcaaagaactttggatcttcaaatggatatcaactgcctaaactctctgctggaactgttgtgttcccctagctgagaaaaatcatggacacacattagctagctctactgtggaacaattggattgctagctgctagataatctatgtgcgctgttaccccgtgattaattatcttcggccgtgctggaaatacggttttggcgagttgaatg

SEQ ID NO: 3944 - DNA, 1756 bp, Zea mays
atgttttaaactgctacgcctacaacacgcctccccagtcaacacagctcagctcagctcggctagcgagctcctcgctcggctctactagctagtgtgttgggacttgggagctaggcggggttgattgcgattgggggaggcgggagtaggtgatgtacggcgcgccgttgcccaaggacctgaacctgccagcagccctgccgcagccgaccaggacgccaccgcagcagcagatgggctccccgggactgctgcggtacaggtcagcgccgagcacgctgctcggcgaggtgatgtgtggtggtgatcaggacttccccgcggctggcggcgcagggcacggaccaccggaccacgccgccgcggacaacgtcctcgcgcgctttctcgccgggcaccactccgagacccgcgactgcaagcctccccgccccgccgccgccgctcacttcatggacgaagctgccgtcgcgtccatggccgcctcacagcagcagcagctcatgtaccagtcgcagcaggagcagcagatggccgccatggaggggctgtaccgcaacgtcagctccggcggcacggagcacggtgcagccgttggcgctggtaacaacagcctgatccgccagagcagctcccccgccggcttcctcaaccacttgaacatggacaacgggtacgggagcatgctccgggtgggcatgggcggcggcgggttcaggaacggcgtcagcgacgcgcggctcaaggggcagctgagcttctcgtcccggcaggggtcggtgatgtcgcagatctcggaggtgggcagcgaggagctcgacggaggcggcggcagcggcagccccgaggcggccggcagcaacgccagcggcgcggcgcgtgggtacagcggcatcccggggtacccgatgggcggcctcgcgtccggcgcctggccggacgaggcgtcgccgtcgccgacgtccggcgcgaagcgcccccgcgactccggccccgcgctgcagcagccgctggcgccgcagctcagcctgcccagcggaaagaacaagggcggcagggcggcctcggcggagatggcggcgatcgagaagttcctccagttccaggacgccgtcccctgcaagatccgcgccaagcgcgggtgcgccacccacccgcgcagcatcgccgagcgggtgaggaggacgaagatcagcgagcggatacggaagctgcaggagctcgtgcccaacatggaaaagcaaaccaacactgccgacatgctggatctggccgtggactacatcaaggatcttcagaagcaggtcaaggtactgaacgacggccgcgccagctgcacctgctccgccggcgagctgcagggccagttcacccgttaaaaaggagccgcgccacctttttctcaggggggccagttcagctcgcatagttgcgttacgttacatggtgaggactgatcgaggaggtatatattggaattgagacgatagtagctagtctgtacatgcaacaagttcattagcaggcagagtaggcctcgcatgttagtgatagctgcgtcagttaatgtacgtttagattgcacatgtattcatcttgatttacatgtgttagagtagtttagtgtggattttagtttaaatttcacattaatccacttcaacatacattaaccgatgtgggtatatatgaccatctaattagaatctttatatacacatgtatttactcaatccacatgattagcctgtcc

SEQ ID NO: 3945 - DNA, 1777 bp, Zea mays
caccgacccccttcgctggtccctgcctggttctggctgccttcttccccctcccgtccgatcggtttcaccattcacggattcacccgtctgcgcgctccaaccgccgcagttcgtactggcgcggtggacagggagctagctaggcggggttgattgcagttggggaggcgggagtgtgtgtgtgatgtacggcgcgccggtgcccaaggacctcaacctaccagcagccctgccgcagccgaccagggccggtgcgaggacgccaccgcagcagcagcagcagatgagctccgcggggctgctgcgctacaggtcggcgccgagcacgctgctcggcgaggtgatgtgcggggatcaggacttccccgcgacggatggcggcggagggcacggaccaccggaccacgccgccacggacaacgtcctcgcgctctttctcgccgggcaccactcagaggcccgggactgcaagcctccccgccccgccgcggccgctcacttcatggacgaagctgccgcctcgcaacagcagcagctcatgtaccagtcgcagcagcagcagcagatggccgccatggaggggctgtaccacaacgtcagctccggtggcacggagcacggtgcgggcgttggcgctggtaataacagcctgatccgccagagcagctcccccgccggcttcctcaccaacgggtacggcggcatgctccgtgcgggcatgggcatggccggcggcttcaggaacggcgtcagcgacgcgcggctcaaggggcagctgagcttcccgtcccggcaggggtcggtgatgtcgcagatctcggaggtgggcagcgaggagctcgacggcggaggcggcggcagccccgaggcggccggcagcaacgccagcggcgcgccgcgcggctacgtcggcatcccggggtacccgatgggcggcggcacgtccggcgcctggtcggacgagccgtcgccgtcgccgacgtccggcgcgaagcgccgcccccgcgactccggtcccgcgccgcagaacgtgcagcagcaaccgctggcgccgcagctcagcctgcccagcggcggcaagccggcctcggcggagatggcggcgatcgagaagttcctgcagttccaggacgccgtcccctgcaagatccgcgccaagcgcgggtgcgccacccacccgcgcagcatcgccgagcgggtgaggaggacgaagatcagcgagcggatacggaagctgcaggagctcgtgcccaacatggaaaagcaaaccaacactgccgacatgctggatctggctgtggactacatcaaggatcttcagaagcaggtcaaggtgctgaacgacggccgcgccaactgcacctgctccggcggcggcaagctgcaggacccgttcaccagttagaaggagcagcagccggcgcgcgcgtagcagtgcgcggccatgcatggcccgccgcaaggccggcctgactgacgcctccgtgccggccggcggctaagctcgcttcgagcgctcctcctcgattggagtaagagtcgtcgaagtatagtagtatcagtgtacgtgttcggctttacatagttaactgaatgagtagtacgtagtctgttatacatgcaagttcattagcaggcaggccccacgtacgtataccagtgacacagctgcgtcagttatctgtggctcttgcagcatgtgtgtctctgtcatcgtttgcacttactgctcggatcctacgcgacacgtacatgcatatgtacgcatgcatgc

SEQ ID NO: 3946 - DNA, 2018 bp, Setaria italica
aaactgctacacccacacgcctccccagtcaaacagctcagctcggctagctaactcctcttatctacaccgtccacgacgcgcgccccgatccctgcttcccttccccccttcttccttctcccgcccgatcggtttcaccattcaccctccgccgcagtgagtacgattgcgtcgtgctcctccgagttacgcggattgtactggtggagagacagaggcgaaggaggtgggattaattgcaattggggaggcggggtgggtgatgtacggctcgccggtgcccaaggacctcaacctgccagcagcccagccgcagccgaccaggacgccgccaccgccgcagatgagctccccgggcctgctgcggtacaggtcggcgccgagcacgctgctcggcgaggtgatgtgcggggatcaggagttccccggcgcggcagggcacggcccggaccacgcggccgcggacagcgtcctcgcccgctttcttgccgggcaccaccccgagatcccggactgcaagcctccccgccccgtcgcggccgcccacttcatggaggacgccgcgtccatggccgcctcccagcagcagcagcagctcatgtaccagtcgcagcagcagatggccgctatggaggggctctatcgcagcgtcagctccggctgcacggagcccggcgccaccgtgggcgccggcaacagcctgctccgccagagcagctcccccgccggcttcctgaaccatctcaacatggacaacgggtacgggaacatgctccgggcgggcatggccggcgccggcgggttcaggaacggcgtcagcgacgcgcggctcaaggggcagctgagcttctcgtcccggcaggggtcggtgatgtcgcagatctccgaggtgggcagcgaggagctcgacggcggcagcagccccgaggctgccggcagcaacggcgcgccgcgcagctacagcggcatcccaggcgggtacccgatgggcgcctggccggacgagtcgtctccgacgtcgtccggcgccaagcgcccccgcgactccggcggccccgcgccgcagaacgggcagcggcagccgctggcgccgcagctcagcgtgcccggcggcagcaacggcaccgggaagccggcgtcggcggagatggcggcgatcgagaagttcctgcagttccaggacgccgtcccctgcaagatccgcgccaagcgcgggtgcgccacccacccccgcagcatcgccgagagggtgaggaggacgaagatcagcgagcggatacggaagctgcaggagctcgtgcccaacatggaaaagcaaaccaacactgccgacatgttggatctggccgtggactacatcaaggatcttcagaagcaggtcaaggtgctgaacgacggccgcatcagctgcacctgctccgccggcaagctgctgcagaaccagttcgccagctgaaaagagacaccggcctttcaggattcagcgtgagatgcagcggccgcaaaggcctggccggaggagaagcctctgcaccggcagctcgctcatcctcttcctttcggtcctacaggtgtagactgtacttgtcagcatatatgaagaggtgaagccgtaaaaaattgacaagggaagtgagattagtgtgtacatgcaaggtcattaacaggcagggcccccacatgttagagatagtagctgcaggcccatcagttagttggttcttgctataaaggtggtgaaatgggaaatgtacaggcgcttgtctcgtcttcttcgtttgtctctgttattacgctgcacgtacatgatgcatgcacccaaccaagatgcagcgcatgagtgcaactatgcaagcgtccgcccgcctgcccgcctggcagcgagtgtcgtccaatgcatttcccgttatggcaacgcctgcctgcggcgttatttaacagcaacctactcgagtgctgaccaacgtcctcagtctctctctctctctcggccaaaattgaatttccaagggacc

SEQ ID NO: 3947 - DNA, 614 bp, Setaria italica
cgcaggccgaacacgccgccgccgccggctacctccctaccgccgccttctcctgtcttcctccgccggatcctccacccgccgctcctacctcggtttagtgggcgtggagcaggagtcgattggagtggggatccttccgctcgtggattgattttgtcatttgctcttctcggcgcaccaggtggcggcgcggattttttgtccaaaactccggccacatggacaacgtcgagtctgcccctgactcgccagcgcaggcgccgccgtcctccgcctcgtctctccccaaggagcaatcgcaggtggagttggagctgaggcttctccaggctctcgagttctaccctccgtccaaactcaaaggtgttcatcgtcactttgttctctatggcctcatggaatatttgagaaaaagccttgaccgtcaattctctgctgatgaggttttgcaactattggaccgtttctttaacctagaaatgctgaaaccagaggatgatgagaaggacaacttcagccaaggggaagaattttccttgccagagagctttttcaacaaggaagaataatagcaagtaactcataaatgcttcacaatgtcgtcgaaggta

SEQ ID NO: 3948 - DNA, 854 bp, Setaria italica
agtggggatccgtccgctcgtggattgattttgtcatttgctcttctcggcgcaccaggtggcggcgcagattttttgtccaaaactccggccacatggacaacgtcgagtctgcccctgactcgccagcgcaggcgccgccgtcctccgcctcgtctctccccaaggagcaatcgcaggtggagttggagctgaggcttctccaggctctcgagttctaccctccgtccaaactcaaaggtgttcatcgtcactttgttctctatggcctcatggaatatttgagaaaaagccttgaccgtcaattctctgctgatgaggttttgcaactattggaccgtttctttaacctagaaatgctgaaaccagaggatgatgagaaggacaacttcagccaaggggaagaattttccttgccagagagctttttcaacaaggaagaataatagcaagtaactcataacatgcttcacaatgtcgtcgaaggtactttgagtatcttctggaagagaaatcaggatggtggttccttgtgattcccacttcctggtagtcgttgtctaggacatccgttgctagtagacacatttgctcagatgtgttcatgtttactgacttgtatagcttttgttgactctagggtatccaatcaatggaactgcgcggttggttccattaagcatttttcctagccttgccttctaacacagacagttgcctgatactcactgaaaggcaacttttagtattgcccttgatatttcttacgggcgtagtttcaactccattgtggaatgcttattctagtcattgatgtgctcgacttgttctacacgggcttgggccaaaatttt

SEQ ID NO: 3949 - DNA, 886 bp, Zea mays
tctcggtccaaccgtccacacctcgggaccatttccttcgttcggtcgtttccctactatcctcctcgcgttcatctcgcccgtacgccgacgctgccgcctggctcgcaccgcccgccggcagtgcctcagtccagatcaagcccctcttcccagatcgggtcctagttgggctaccgcagccctacgccaggtgccgagtccctcgccgatttcttcggcggcgaagagtgcccaccagatccgcccctgatggacaacgtcgagtctgcccctgactcgccggcgcaggcgccgccgtcatccgcctcttctctccccaaggagcaatcgcaggtggaattggagctgaggctgcttcaggctcttgagttctaccctccatcaaaactcaaaggcgttcaccggcattttgttctctatggcctcatggaatatttgcgaaaaagccttgaccgacagttctcttctgacgaagttctacaactcttggaccgcttctttaacctagaaatgctgaaaccagaggatgatgagaaggataacttccgtcagggcgaagaattttcgttgccagagagttttctcaacaaggaagaataatatctagtaacctcgtactttgggtgtcctctggaagagaaatcagaaggctggttcttagtgattccctatttcttgtagcattgtcatctggaacatcggctgcggggagacactgaacactgaagtaaagaaacacatttcctaagctgtggttgtctttactgactgtacagctagcttttgtagactagtgtaatcgaaaataggttgaactgtgtggttgcctggagcgtgaacaaaaagcaaggaggggcaattacaaaagctgctgctgttttac

SEQ ID NO: 3950 - DNA, 785 bp, Saccharum officinarum
ccacggcaccacctcccacccgtctccctcctcgcgttcctttcgtccgtacgctgccgccgccgccgccctacaccaggtgccgaggccctcgccgatctcttagccggcgaagagtgcccaccagatccgcccctgatggacaacgtcgagtctgcccctgactcgccggcgcaggcgccgccgtcatccgcctcttctctccccaaggaacaatcgcaggtggagttggagttgaggctgcttcaggctctcgagttctaccctccatcaaaactcaaaggcattcatcggcactttgttctctatggcctcatggaatatttgcgaaaaagccttgaccgacaattctcttctgatgaagttttacaactcttggaccgcttctttaacctagaaatgctgaaaccagaggatgatgaaaaggacaacttcaatcagggggaagaattttccttgccagagaattttctcaacaaggaagaataataacaagtaacttggtaatgtcataggaggtactttgggcgtcctctggaagagagatcagaacgccggttcttagttattcacactttttctagtagcattgtcgtccagaacatcagttgcgaggagacacagaacactgaagtaaagaaacacatttgctaagctgtggttgtgtttactgactgtacagcttttgttgactagtgtaatcgattgaattgtgtggttgcctggagggtgaacataaagcaaggagtggcgattacaaacttctgtgatcatgactataggtg

SEQ ID NO: 3951 - DNA, 958 bp, Panicum virgatum
  misc_feature (732)..(732): n is a, c, g, or t
  misc_feature (752)..(752): n is a, c, g, or t
  misc_feature (853)..(853): n is a, c, g, or t
  misc_feature (918)..(918): n is a, c, g, or t
  misc_feature (936)..(937): n is a, c, g, or t
  misc_feature (942)..(943): n is a, c, g, or t
  misc_feature (946)..(946): n is a, c, g, or t
  misc_feature (953)..(953): n is a, c, g, or t
gggtggcggagttggaagatgatgtctcttccgcacgcacccggcctcggcgaatccaacgcgacgagcagcagggcgcaggccgagcacgccgccgccggctccctccctaccgccacttcccccctcttttctccgccggatcctccaaccgccgttcccacctcggtgtagcggtggtgcggcaggagtcgattggagtggagatccctccggtcgtggattgatttcgtcctttgttcttctcggcgcaacaggtgacggcgcgggtttttgttcaaaattcctgccgcatggacaacgtcgagtccgcccctgactccccggtgcaggcgccgccgtcctccgcctcgtctctccctaaggagcaatcgcaggtggagttggagctgaggcttctccaggctctcgagttctatcctccgtccaaactcaaaggcgttcatcgtcactttgttctctatggcctcatggaatatttgagaaaatgccttgatcgtcaattctcttctgatgaggttttgcaactattggatcgtttctttaacctagaaatgctgaaaccagaggacgatgaaaaggacaacttcagtcaagggggagaattttccttgccagagagctttctcaacaaggaagaataacagcaagtagctcataacatgcttcacaatgtcatcgaaggtgctttgagtgtcctctggaaaagaaatcagggagctggttcttagngactcccacttcctagtagntgtcgtctaggccatccgttggtagtaggcatccgcactgaagttgtgttttgttcagttgtgttcgtgtttactgacttgtacagcttttgttgactctnggatatccaatcaatggagttgtgcggtagcttcgattaagcattacccttgccttctaacacangcagaaaagcaacgcctnnatatnnctngtacagnttttg

SEQ ID NO: 3952 - DNA, 490 bp, Pennisetum glaucum
gccctacgaggcggcgaccttgcggccgggctacctgcgacgggcgacgcaccagccaccaggttcccgccttccaggactacccaaggtttgaatcctgggtctgccactgcctgtcacatggacaacgtggagtctgcacctgactcgccggcgcacgcgccgccgtcctccgcctcgtctctccccaaggagcaatcgcaggtggagttggagctgaggcttctccaggctctcgagttctaccctccatccaaactcaaaggtgttcatcgtcactttgttctctatggcctcatggaatatttgagaaaaagccttgaccgccaattctctgctgatgagattttgcaacttttggaccgtttctttaacctagaatgctgaaccggaggatgatgagaaggacaacttcagtcaaggggaagagttttccttgccagagagttttttcaacaaggaagaataataccgagcaactcatagcatg

SEQ ID NO: 3953 - DNA, 723 bp, Oryza sativa
gtctcccatagcctgcgtggtccagcttcccctcccctcgggtttccggcgtgctagggctcggccgcggtggcgaaggcgaaagggagctcggggatggaggcggccgccgacgaggagcaggaggggatctccgcccagtcgccggcccaggcgccgccctcctccgcctcgtcccttcccaaggagcaatcgcaggtggagctggagctgcgggtgcttcaggctctcgagttctaccctccgtccaaactgaaaggcattcatcgtcactttgttatctatggtctaatggaatacttgagaaaaagtcttgatagacaattctctgctgatgaagttttacaactactggaccgattcttcaacctagaaatgctgaagccagaggacgacgagaaggataacttcactcaaggagaagaattttccttacctgaaagtttctttaacaaggacgaatgatagcccagtaaccctgcagcgcaacatccttcgtaatttaacagaggggactacgaatcttatgatgtttccaatgattctcttgcgtagacatctcttgacggcacacttcgaactgaaagaacacattttgctcggccgtgtctttgtgttagtgcttactgtgacttgtacagcttctgttgacttaggatatgcagtcaatggtacgggatctcagtacccgttaactatcagtgccgtttcttcgctctacta

SEQ ID NO: 3954 - DNA, 660 bp, Brachypodium distachyon
atctatactgggcacacggcgcacggtgttccactcgagcccaacccatcgtgtattcgtgtccctccccgttccgaattcgcggacgcgcaaggtctcggggacatggaggcggccgccgacgaggagcaggaggggctgtccgcgcaggcaccgccttcctcagcatcctcccttcccaaggagcaatcgcaggtggagctggagctgaggctgcttcaggctctcgagttctaccctccgtccaaactgaaaggcattcatcgtcactttgttctctatggcctcatggaatacttgagaaaaagccttgacagacaattctctgccgatgaagttctgcaactactggaccgcttcttcaacctagaaatgctgaaaccagacgacgatgagaaggacagcttcagccaagcggaattctccttgccagacaagtttttcaagaaggaaaagaaggaagaatgagagctagctctgttcttttgggcgattcccccttgcaggatgtagttcttgaccctgaaatctcgtgctggagtctttagcgttcaatgacttgtatatacagccttttgttggtggctcgggattgcgcatccaagtttcagtcaaccgtgtatttctcttcgattcctttcagtactttgtaatttgtat

SEQ ID NO: 3955 - DNA, 635 bp, Glycine max
acacgcacacgccaacgcacacgccacgcacaacacaatctcagctccagccttcttcttcttttcttttttttctctcccttccgcacccaagagagagaaagacgctgctagagaagaagaatatggcgggtgctgctcccaaacaattgttcggattcggagttgtggcgatgctcgccactctcattcttgctctctttatgcccgccgctgttcaggctcaatccgcatcccctgcacctgcacctactagcgacgggacctcccttgatcaagggatagcatatgtgttgatgctgctggctctggtactcacatacatcatccattcgccctaaatttcctccaccttctgaacttagagcagaaagggatatgggtgtttgatagggggttgttgtgtctgttatgattaacaagtttcgtacattgtgtagcaagaagtggaaaatgtaatattgctatgatacttttgttacaagagtaggtggtatgtttattttcccagttaagaaagtggtctgtgccatttagttgctagtggctagtggttgtggttagtaccaggttacagagttagctattattgtcgatgcatttcttagtaatacaataattatcttgcttttggc

SEQ ID NO: 3956 - DNA, 498 bp, Cajanus cajan
ctctctcttgtgcgtttcaagttccagagagagagaaagagaaatgcagggtcccaaatattccttcggattcggagttgtggccatgcttgccactctcattctcgcacttttcttaatgcccgccgctgttcatgctcaaattcaagctcctgcacctgcccctaccagcgatgggccatctcttgatcaagggatagcttatgtgttgatgctgctggctcttgtactcacatatatcatccacacggccgaaatccccctccagctcctgagtttgttatcgtgaacaagttcgcacattgagacaaaaagggggaaatgtaatatgaaattgatgttagaatagtgggtgttgtgtttattattccagttaagaaaagtggtacgtgacagtggctactggttctggtggtgcttgaaaccaggttacaggctttgtcaatgttttcctcttagtaatataatgattatcttgctttttggcgtaatgaaacc

SEQ ID NO: 3957 - DNA, 611 bp, Vigna unguiculata
attgaaaagaaaatttaaaagctgtaaagagctttataaactagggttttgagttgcgattgtcctctgccacagatagaatcatagaagagaaagccgccgccactcttgcctctctttcctactaccaatttccggatggaatctcaggtgaagcacgctcttgttgttaaagttatgggccgtacagggtctagaggtcaggtgactcaggttagagtgaagtttttggatgatcaaaacaggcacatcatgaggaatgtgaaaggacctgtgagagaaggagacattctcaccctacttgagtccgaaagagaagcaagaaggttgcgctagaggagctcccaatggtttgcctcaggacttaaactgaacatttatgtttgttttttgtggtaattagtggtagtcgagtgttaatcatctggacataaattgtgcgcttataatgtttgtttaatgttctggtactgtgcttgtggatgagttttagattaatgaagcttttttacgtgttgagatgtggttggtgatgctttgatataattgtgaatgcagtatactttttgttttactttagtggtattaatggatgttctgtttttcgttca

SEQ ID NO: 3958 - DNA, 469 bp, Vigna unguiculata
ctctggactcgtgaaagtgttagcaaaaccctagccacttccttcacttgtcttctatctcaggatggagtctcaagtgaagcatgctcttgttgttaaagttatgggtcgtactggatccagagggcaagtgacccaggttagagtgaagtttttggatgatcagaatcgtcacatcatgaggaatgtgaaaggacctgtgagagaaggagacattctcaccctactcgaatctgagagggaagcaagaagattgcgctagatggtttacatcaaaaaacagtgatttgatttttgtggtagttagtggatgccaaaggttatatctttttgttttggatctgtttccattcgaattatggtctgaattttgttgttttttaatctaagtttcaagattgaagtatgattatcttaacatatgaaatatgtattagtatatgatttggcttccattagtagctagcta

SEQ ID NO: 3959 - DNA, 515 bp, Vigna unguiculata
ggcctctggtctcgtgaaagtgttagcaagcattccaaaaccctagccactttcttcactcgtcttctatttcaggatggagtctcaggtgaagcatgctcttgttgttaaagttatgggtcgtactggatccagagggcaggtgactcaggttagagtgaagtttttggatgatcagaatcgtcacatcatgaggaatgtgaaaggacctgtgagagaaggagacattctcaccctactcgaatctgagagggaagcaagaagattgcgctagatgttttacatcaaaacagtgattttatttttgtggtagttagcggacgtcaaaggttatgtcagcctatctttttgttttggatctgtttccattcaaattatggtctgaattttgttgttttaaatctaagtttcaagattgaagtatggttgtcttaatatatgaattatggattcttatatgatttggcttccattaatagttagctattcctactgcatcattttctgttctgttc

SEQ ID NO: 3960 - DNA, 532 bp, Phaseolus coccineus
gactctggttagcaagcatcgcaaaaccctagcctactttcttcactcgtcttctatttcaggatggactctcaggtgaagcatgctcttgttgtcaaagttatgggtcgtactggatccagagggcaggtgacccaggttagagtgaagtttttggatgatcagaatcgtcacatcatgaggaatgtgaaaggacctgttagagaaggagacattctcaccctcctcgaatctgagagggaagcaagaagattgcgctagatggtttaaatcgaaacagtggcttgatttttgtggtagttaggggatgccaaaggttatatcagcctatcttgatgttttggatctattttcattcgaattatggactgaattttgttgtttttagtctaagttttaagattgaagtatgattggcttgatatatgtatcatggtttgaattttggattatatgatttggcttctattagtagctagctattcctgctgcatcattttctgttgaataatggtctacaagtaaattaaaa

SEQ ID NO: 3961 - DNA, 475 bp, Phaseolus coccineus
cactttgagtacgcggggactctggttagcaagcatcgcaaaaccctagcctactttcttcactcgtcttctatttcaggatggactctcaggtgaagcatgctcttgttgtcaaagttatgggtcgtactggatccagagggcaggtgacccaggttagagtgaagtttttggatgatcagaatcgtcacatcatgaggaatgtgaaaggacctgttagagaaggagacattctcaccctcctcgaatccgagagggaagcaagaagattgcgctagatggtttaaatcgaaacagtggcttgatttttgtggtagttagtggatgccaaaggttatatcagcctatcttgatgttttggatctatttttattcgaattatggactgaattttgttgtttttagtctaagttttaagattgaagtatgattggcttgatatatgcaaaaaaaacaataataaaggactcttgtt

SEQ ID NO: 3962 - DNA, 491 bp, Cyamopsis tetragonoloba
cacgagggcgagttcgaagaaagagagagagcagccgctgcatcctactcttctcacattataacaagatggaatcccaggtgaagcatgctcttgttgtcaaagtcatgggtcgcactggatctagaggacaggtgactcaggtcagagttaagtttttggatgatcagaaccgtttcatcatgaggaatgtgaagggaccagtgagagaaggagacatcctcaccctactggagtctgagagagaagcaagaaggttgcgctaaagggtccttcattggtttggcttggggttcagtgaaactttgctgtttttgtgttagttaggagatgccagatgctattgtcctagatttaatattactctcatattatgacttgagttttgatgttattgagattggcaggttttgggtataattgtttttgacttctatatgatgtttttcttgctctattggtcttattgaaatgttagtggttacttttat

SEQ ID NO: 3963 - DNA, 482 bp, Glycyrrhiza uralensis
tgccctttggtttcttcggctttcagcttctgccgcttcaaaactcagagaaaccctgcgagaccaccacagcgagcgacaacacccgttatcaggatggaatctcaggtgaagcatgctattgttgtcaaagtgatgggtcgtactgggtctagaggacaggtgactcaggtcagagtgaagtttttggatgatcagaaccgacacatcatgaggaacgtgaaaggaccagtgagggagggagacattctcaccctacttgagtctgaaagagaagcaagaaggttgcgctagaggaagaactctcaaatggtttggctcatggatttaatgaagcattgttgtttttgtggtagttttgtggctcaggaactctcaatggtttggctcaatgttatgtcatggacttaaattatgcacacttgagcttttctatggcttagttttgattaaatttgtactttgactctatataatgcttt

SEQ ID NO: 3964 - DNA, 537 bp, Glycyrrhiza uralensis
gctcgttcatctctgcaagttagaagagaaagagagagcagccgctacctagcttcctcttcccttcgctctagtttcaggatggaatctcaggtgaagcatgccattgttgtcaaagttatgggtcgtaccggatctagaggacaggtgactcaggtcagagtgaagtttttggatgatcagaatcgtcacatcatgaggaacgtgaaaggaccagtgagagagggagacattctcaccctactcgagtctgaaagagaagcaagaagattgcgatagaggaacccaaactctcaatggtttggttcagggatttaatgaagcattgctgtttttgtggttgttagcggatgccaaacttatgccatggacttaaattatgcacctattatgacttgagcttttgtatggctttagttttgattaaatttgtgctttgactctatatgttgttttttcctgctttgaccgtgttcagatgtagttcgtggtgttactttgatataattatgaaaatgcttatgatttaaaaaaaaa

SEQ ID NO: 3965 - DNA, 655 bp, Cajanus cajan
tttgcgagtttgaagagagagtagccgctaccctagcttcctcttcagcttttctaacttcaggatggagtcccaggtgaagcatgctattgttgtgaaggtcatgggtcgtacagggtctagagggcaggtgactcaggttagagttaagtttttggatgatcagaaccgtcacatcatgaggaatgtgaagggacccgtgagagaaggagacattctcaccctactcgagtctgagagagaagcaagaagattgcgctagagggttttttcatggtgtctcaggattcagtgaagcaatgctgtttttgtggtagttagcagacgtcatattttattattctggatctatattatactcgtattgtgacttgagttttgatgttattgagttgccggagttttcagtaaaattatgttttgaattttatatactgctctatcttttctgttctgttttcagtaaaattatgttttgaattttaacaaagtttaagaaataaaaaatgtatctgagttgataccaagcttaatcgaattcccgcggccgatatggtggccgggagcatggagttagggccattagcccaaatgaatctataacattcttgccagtgtttaaaagtgtgaatgggaaaccgtagtacaataggtt

SEQ ID NO: 3966 - DNA, 574 bp, Cajanus cajan
tcctgaaagtgtaagcaggcatcccaaaaccctagcctgcgttcttcactcgttttctacatcaggatggagtctcaggtgaagcatgctattgtcgtcaaagttatggggcgtactggatccagaggacaggtgacccaggtcagagtgaagtttttagatgatcagaaccgacacataatgaggaatgtgaaaggaccagtgagagagggagacattctcaccctacttgagtctgaaagggaagcgagaaggttgcgctagatggttttttgtttttagtttgtcacaagtttaatcaaaacagcgattttcttctttattctggtagttagtggatgccaaaggttatagcacccctatcttgttgtcttggttctattttcattcgtattatgacttgaattttggatgttttgagtttgagcatcaagattgaagtatgcgtttcgattaatatatgatttggcttctatatggtgctgttcctctgctacatctcgggtttaaatggcggtgactgcttatctttgcaaactgaaaaatgttggtggtagttgaggagttaaccaac

SEQ ID NO: 3967 - DNA, 496 bp, Vigna unguiculata
tgaaagctgcggctgcgacccctagcctcttcctctttcttaatatcaggatggaatctcaggtgaagcatgctattgttgtgaaggttatgggccgaactgggtccagagggcaggtgactcaggttagagtgaagtttttggatgatcagaatcgtcacatcatgaggaatgtgaagggaccagtgagagagggagacattctcacccttcttgagtctgagagagaagcaaggagattgcgctagagtctttttgattgtttgattcagtgttcatgtgaaacaatgctgtttttttgtggtagttagcaatgccatattttattgtcctgaatctgttattacactgtgacactctatttttgatgttattgagctggcagagttttgagtaaaattgtggtttgggttttatgtactgcttttcattttatgttccttttgcaatggatgtgatcaatccaatataatttttggcaaaaaagaaaaaaaaa

SEQ ID NO: 3968 - DNA, 525 bp, Cucurbita pepo
gatttgtccgccgcttcataaactctgcccgtgagatttcgaatccgaactctgcaaaatccttcgccgccggttcctctccaatctcatcacctctattcatttaagaaatggaatcccaaatcaaacacgctttggtggtcaaagtaatgggtagaactggatcaagagggcaagtgacacaagtgagagttaagtttctcgacgatcagaatcgatacatcatgaggaatgtcaagggacctgtgagggaaggtgacattcttactctactagagtctgagagagaagccaggaggttgcgttgatgatgccatgttcccggttctcgtgttacagttaccgatgattttccttctcatcataatacaactcgaatgatgtttgctatccattttcgcatgttttcagaaatctggttttggttactggcatgttgtctcaaaccttagatgttaaggtagaatgtttgaactggatgagaattaattttatttagtaaatagtacaaatcattattataac

SEQ ID NO: 3969 - DNA, 435 bp, Cucurbita pepo
ccctagccaagttcatccctcccccgctgccgctcaatctttttcgtcgatcttcttccttctcttgctctcaggaatggaatcacagatcaaacatgctctggtggtgaaagtaatgggtagaactggatcaagagggcaggtgactcaagtaagagtcaagtttcttgatgatcagaatcgttacattatgaggaacgtcaagggaccagtcagggaaggcgatattcttaccctactcgagtccgagagggaagctaggaggttgcgttgatggagaacgatttctgttgctgtcatcatattgttacctctgttttaagtgtggatttcagtgactagtttgtttcaagaccctttgatgaggtaatttaattgagttttgatgctaccaagtttttctcatgcaaaattgtggatttttgctcattgctt

SEQ ID NO: 3970 - DNA, 531 bp, Cucurbita pepo
gggattctgaatccgaactctgcaaaatcgttggccgctggtatctctcagatcgtacctctattcatttaagaaatggaatcccagatcaaacatgctttggtggtcaaagtaatgggccgaactggatcaagagggcaggtgactcaagtgagagtcaagtttctcgacgatcagaatcgttacatcatgaggaatgtcaagggacctgtaagggaaggtgacattcttacccttctggagtctgagagagaagcaaggagattgcgttgaggacatcgtcccgatcttggttctctgtgttgcagctactggtgatttgattatccttctcattacacactctagatatagaatgatgtctcttatcaattttccctctcttggttactggcatgttatctcagtagttcgattctagggtagaatgtttgaactttatttggattgtcaaacaattttagtattctaatttagggtttctacgtaaaggccttcttattgactttatttgtattaaattactggttg

SEQ ID NO: 3971 - DNA, 563 bp, Trigonella foenum-graecum
aagaaagtacatgtgtatttatgatcacccccttccatatttactagaaaagggctatgattataatgagagaggcctttagtgggaaatacccaattccatcggaaaatcagaaaccaaatccaagatggaatcacagattaagcacgccgttgttgtcaaggttatgggtcgtactggatctagaggacaagtcactcaagttagagtcaagtttttggacgatcagaatcgtcacatcatgaggaatgtgaagggaccagttagggagggagacatccttaccctactcgagtccgagagagaagctagaagactccgatagaaagcaactatctcaatggtttggtgcacggttcaatgaaataatgctggttctgtaatagttagctctgaaaaatgttgtgttgaattaaattatctatgttttgtttggctgaaattttgagtaaaataatgttgagactctattatgttattcatgttttatttgctctgttgaaactttagttatttgttataatgaaaggcttgtgatttggtaaaaaaaagaaaaaaacaaa

SEQ ID NO: 3972 - DNA, 580 bp, Phaseolus coccineus
ggaccggaacgcagtggtatcaacgtcagagtgcccatttatggccggggattcttctctgcgagtttgaagagagttgcggctgctaccctagccttctcccctctctcaatatcgtatcaggatggactctcaggtgaagcatgctatcgttgtcaaggttatgggccgtactgggtctagagggcaggtgactcaggttagagtaaagtttttggatgatcagaaccgtcatatcatgaggaacgtaaagggaccagtgagagaaggagacattcttacccttctagagtctgagagagaagcaaggaggttgcgctagagtctcttaattgtttgattcagttttcaagtgaaacaatgctgttttttttgtgatagttacctatgtcatattttactgtcctggatctatgttattattataattgcattgtgacttttagttttgatgtttattgagccagcagagttttgagttctgcatttatgttcgatttgcaatggatgtggtcaatccaatataattttgagtattcttgttacctaaaaatattactgtaatttttataaaaaaaaa

SEQ ID NO: 3973 - DNA, 514 bp, Castanea mollissima
tcaagaactccgaagagagcgcagctacaaaatcatctagttctagccttccctcccttactcagctcagttcaggatggaatctcaggtgaagcacgcagttgtggtgaaagttatgggtcggactggatccagaggtcaggtgactcaggtcagagtcaagtttcttgatgatcagaaccggttcattatgaggaatgttaagggaccagtgagggaaggtgacatccttaccttgcttgagtctgagagagaagccagaaggttgcgttgatggacttgttggtttcacctcctatcctctcagttttggcagctcacgcagtacttgcttagttgctttcatgatgtggtagttagttaatggctttaatgttgttgttggcatctttgtcaccatgttgtttttagtttatatttctgaaattaagtataacaacctgaattttgagatgaaatatttgtattggatgcttcaatctttaatatttgaaagactaagtttggtttgaca

SEQ ID NO: 3974 - DNA, 527 bp, Cicer arietinum
ttggtatcaacgcagagtacgcggggagggtttagaaaatttcttctcgcagctcgtttgtgttccctagcaatccatctaccaccccgattttcgcattctaaatcttaacaaccacaccaaagatggagtcgcagattaagcatgctgttgtagtgaaggttatgggtcgtactggatctagaggacaggttactcaagttagagtgaagtttttggatgatcagaatcgtcacatcatgaggaatgttaaaggaccagttagagaaggtgacattctcaccttgcttgagtctgagagagaagctagaagacttcgctagaagagtaattgggttccacttttaattaactattgtttgtttatgataaatctgtgtttaattatattatcatctatgcttttgttttgttgagttcttcgagtaaaatcgttcaatcactctgtattatgttttgcatgccttcattgctgtattgaaacatatttatttcttattttgacatatttattgcaaatacttacg

SEQ ID NO: 3975 - DNA, 454 bp, Lotus japonicus
gttcgctcattcatctccgaagcaagaagaagagaaagcagccgcatccccagcctcctcctcttcctctctgctcacaaattagggatggaatctcaggtgaagcatgctatcgtggtcaaaattatgggccgtactgggtctaggggtcaagtgactcaagtcagagtcaagtttttggatgaccagaatcgtcacatcatgaggaacgtcaaaggaccagtcagggaaggtgacatcctcacccttctcgagtctgagagagaagcaagaaggttgcgctagaggagctctcatgctttggttcaggatttgacgaaccgtttttgttttgttttagctagttgatgctacttgttcgtgtcatgatcttaatttatgcatctattattacttgaatttcatgtctacacttcatgttgttgaattttgagtaaatctgtgctttgactat

SEQ ID NO: 3976 - DNA, 502 bp, Lotus japonicus
ggatggaatctcaggtgaagcatgctatcgtggtcaaaattatgggccgtactgggtctaggggtcaagtgactcaagtcagagtcaagtttttggatgaccagaatcgtcacatcatgaggaacgtcaaaggaccagtcagggaaggtgacatcctcacccttctcgagtctgagagagaagcaagaaggttgcgctagaggagctctcatgctttggttcaggatttgacgaaccgtttttgttttgttttagctagttgatgctacttgttcgtgtcatgatcttaatttatgcatctattattacttgaatttcatgtctacacttcatgttgttgaattttgagtaaatctgtgctttgactataagttttgtccttctatattggccgcatgagaccttgagcccatatgtttaaaccttattaaaagtgtgaaaattttctggactagttagtggttactttgatataattattcaaaatggcggtgatttgtaa

SEQ ID NO: 3977 - DNA, 500 bp, Medicago truncatula
ccatacgcagcagcttccagggtttcatcgcaatcaattctccaacgccgattcatcatttttcttcttaggaaccagcttcaagatggaatcacagattaagcatgctgtggttgtgaaagttatgggtcgtacgggatccagaggacaagtcactcaggttagagtgaagtttttggacgatcagaaccgtcacatcatgaggaatgtcaagggaccagttagggagggagacatccttaccctccttgagtccgagagagaagcaagaagactccgatagaagcgtaactatctcaatgttttggcgcacaattcaatgaagaagtgctggatctgtaatagttagctctgaaaatctttatgttgaactagtgttttgttttgcttgctgagtttttttattaaaattgtgttgagactttattatgttcatgtttatttgctgagttgagacttagtaatttgctataattaatgaaaggcttatgattatgatt

SEQ ID NO: 3978 - DNA, 561 bp, Medicago truncatula
ggggagggttttcatttccatacgcagctagcttcttcgcaatcaatctccaacgccgattctgcactttccattttagcaaccaacttcaagatggaatcacagattaagcatgctgttgttgtgaaagttatgggtcgtactggatccaggggacaagtcactcaggttagagtgaagtttttggatgatcagaatcgtcacatcatgaggaatgtgaagggaccagttagggagggagacatccttaccctcctcgagtctgagagagaagcaagaagactccgatagaagagtctcgatgttttgctgcacaactcaatgaacaatgcttgttttgtaatagttagctcttaaaacttgtgttggattagtgttttgttttgctgagattctattatcttaatgttttatttactgatttgagactttgttatttgttttaattaatgaagggcttttgattaattgtgctgtgacttagatataaaatctggtatatgttgttcaatatgtcaggtatgtatgctgtcttgtttatacaatggaatatccaagtct

SEQ ID NO: 3979 - DNA, 532 bp, Quercus alba
gcgtggtcgcggccgaggtacgcggggaaggcaagaactccgaagagagcgcagctacaaaatcatcttgttctagccttccctccctcactcagctcagctcaggatggaatctcaggtgaagcacgcagtcgtggtgaaagttatgggtcggactggatccagaggtcaggtgactcaggtcagagtcaagtttctggatgatcagaatcggttcattatgaggaatgttaagggaccagtgagggaaggtgacatccttaccttgctcgagtctgagagagaagccagaaggttgcgttgatgggctcgttggtttcacctcctatcctctcagttttggcagctcaggcagtactgctttcatgatgtgttagttagttaatggctttattgttgttgttgacatgttgccactatgtggtttttagtttatatttctgaaattaagtataacaacttgaattttgagatgaaatgtttgtattggatgcttcaatcttcaatatttgaaagactaagtttggtttga

SEQ ID NO: 3980 - DNA, 510 bp, Quercus alba
gcaagaactccgaagagagcgcagctacaaaatcttctagttctagccttccctccctcgctcagctcagcaatcagctcagaggatggaatctcaggtgaagcatgctgtcgtggtgaaagttatgggccggactggatccagaggtcaggtgactcaggtcagagtcaagtttctggatgatcagaaccggttcattatgaggaatgttaagggaccagtgagggaaggtgacatccttaccttgctcgagtctgagagagaagccagaaggttgcgttgatgggctcattggtttcacatcctatcctctcagttttggtgactcatgcattactgctttcatgatgttggtagttagttaatggctttattgttgttgacttgttgtcacaatgttgtttctagtttatatttctgaaattaagtataacaacttgaattttgagatgaaatatttgtatgggatgcttcaatcttcaatatttgaaagactaagtttggtttgac

SEQ ID NO: 3981 - DNA, 473 bp, Rosa hybrid cultivar
aaagccgcctcctctcctccagaccctcgtctcgaatctcagcatggaatcgactgtgaagcacgccctggtggtgaaggtgatgggccggaccggatccagaggtcaggtgacccaagtccgagtcaagtttctcgacgaccagaaccggttcatcatgaggaacgtcaagggaccggtccgggagggcgacatcctcaccctgctcgagtccgagagagaagcaagaaggttgcgttgatgggtcttggtctccgtcttcaaagctatgttctttgctttttactgggtttatgttttgtggtgttgattagcgagaaagactggttcttgtagtgttttggaaattgggttatgagcttttgacgttttgagttatgaatccgagacttgatttcgttttgatttggttgtgattgtaagatttataatgtgcacacgctcatgccttattctgatgatcatgatctgct

SEQ ID NO: 3982 - DNA, 628 bp, Fragaria vesca
caagtgtctatattaaaatccatctcagacaaaaaccctacttgttcaacccctcgtcctgttcaatctccaaagccagccgcctcctcctccttcacaaatctcagcatggaatcgactgtgaagcacgcgttggttgtgaaagtgatgggacgcaccggatccagaggacaggtgacccaagtccgagtcaagtttctcgacgaccagaaccggttcatcatgaggaacgtcaagggaccggtccgggagggcgacatcctcaccctgctcgagtccgagagggaagcaagaaggttgcgttgatgggtcttcgtctttgtcttcaaccatggaaaaaagctatgttctttgcttgtttactgggtttatgttttgtcgtgttgattagtgagaaacaatggttgttgtagtgttatggaaatcgggttatgagtttttgacattatgagttatgaaatcgagaacttgatttggttttgatttgggttcttattgtttaagatttctgttgtgcacttgtgccttatttgatgatcttggtctcccaatttatatggtttctctttgtttgctgaatattatgccttctcaactttaacggcattgtttttctcctattggagaa

SEQ ID NO: 3983 - DNA, 563 bp, Fragaria vesca
cttcttttcttctctcctgctgccgcggcgagaccttctcattttctctctctctctattcggaagcatcagagtcgcacccatttcaggatcggagaatggaatccacagtgaagcatgctcttgtggtgaaggtcatgggccggactgggtctaggggacaggttactcaagtgagagtcaagttcttggatgatcagaatcgtttcatcatgaggaatgtcaagggaccagtgagggagggagatatccttaccttgcttgagtctgagagggaagccagaaggttgcggtgattttatgttggtctcctacctctgttttgttgaagtgcgcacgactgttatttctgttggtctatggcagttgtgctgttgttggtgttactttatgatatttcttgccgttagtagcaacgtctgagacttattttgtcatgaaatttctatctgtctgattaatacttgaattatcctattttatattgatgactctttcagctaatgttaagtttggaggcgcattagtctttttataagttgcattagacaatcatctcctat

SEQ ID NO: 3984 - DNA, 448 bp, Juglans hindsii x Juglans regia
  misc_feature (129)..(129): n is a, c, g, or t
  misc_feature (153)..(153): n is a, c, g, or t
aggatggaatctcaagtgaagcatgctgtggtggtgaaagttatgggtcggactggatcaagaggtcaggtgactcaggtgagagtcaagtttctggatgatcagaaccggttcattatgaggaatgtnaagggaccagtgagggaaggtganatccttactctgctagagtccgagagagaagcaagaaggttgcgttgataggcttattggtcaggaatccgttcctctcagttttggtgactcttatatgaatgcttgcttctcgtagtcggtcaatggctctcaaagctagagtataaaaaaaaaaaaaaaaaatcgtatcagcatagttgttttgatttatattgaattctgagtggaatgtttattcatgatgcttaaatctgttatcttggatagaccaagttttgcttacatatttggtatgaagttttgcattttagag

SEQ ID NO: 3985 - DNA, 470 bp, Cucurbita pepo
aaatgctaggtattttttccctccatttgctttggtcgatcctgcagtccggcggcttgtcttcaattctcacgtcctctttcgtgtaaggaatggaatcgcagatcaagcatgctgtggtggtcaaagtgatgggtagaactggatcaagagggcaggtgactcaagttagagtcaagtttcttgatgatcagaatcgttacattatgaggaatgtcaagggaccagtgagggaaggagacattcttaccctgttggagtcagagagggaagctagaagattgcgttgatggggatcaagttcccagttctccggtttgcagttgctaaatgttatttatcatatcatacctacaaatagaatgctttacatcatttttccctattgaagtgtgattttagtgactagcttctccaaggctttgcttccatggcagaatatgtgaactggatgagtaatttaattgagt

SEQ ID NO: 3986 - DNA, 536 bp, Cucurbita pepo
ggggttttgtcgtctatttgtccgtcacaagtctttctttcctcgtattcgtcttccatctcttgctctcaggtgtgtttgggtaggaatggagtcacagatcaagcatgctgtggtagtgaaagtaatgggtagaactggatccagagggcaggttactcaagtgagagtcaaatttcttgatgatcagaatcgttacattatgaggaatgtaaagggacctgtcagggaaggcgatattcttaccctactcgagtctgagagggaagctagacggttgcgttgatggagaattgcagttgcttccattgattttgcctctttgtaagtgtggatccttctgttctggggatgaatgtgtgaactgggtttggtaatttaattgagttttgatgatatcagctgtgtgatccacactagtaggcttgtcattgatgattctttgtcttcttttcatatattgcttatccatcacctaatactctatttggcagcacactttgcacttgcatttataaatattataatctttatgt

SEQ ID NO: 3987 - DNA, 498 bp, Cucurbita pepo
tcagaagccctagttatgatacgcatttttctcctccccatttgcattggtcgattctgcagtccggcggcttgtctactattcttcgtagttttctctgatctcatcctccctcgtttaaaatggaatcgcagatcaagcatgctgtggtggtcaaagtgatgggtagaactggatcaagagggcaggtgactcaagtgagagtcaagtttctcgatgatcaaaatcgttatattatgaggaatgtcaagggaccagtgagggaaggagacattcttaccctgctggagtctgagagggaagctagaaggttgcgttgatgggggactctgccaaggtcccagttctccgatttgcaattgttgaatgtagaatggctgttttcattttcccctatttgtgtgattctagtgattagtgtgtccaagacatttggttctaaggcagaatacgtgaactggatgagttattgaatggagttttgaaagcatcaatttt

SEQ ID NO: 3988 - DNA, 370 bp, Cucurbita pepo
ccgcacaagcttcttcctcgatcgtcttccatctcttgctctcaggaatggagtcacagatcaagcatgctgtggtagtgaaagtaatgggtagaactggatccagagggcaggttactcaagtgagagtcaaatttcttgatgatcagaatcgttacattatgaggaatgtaaagggacctgtcagggaaggcgatattcttaccctactcgagtctgagagggaagctagacggttgcgttgatggagaattgcagttgcttccattgattttgcctctttgtaagtgtggatccttctgttctggggatgaatgtgtgaactgggtttggtaatttattgagttttgatgatatcagctgtgtgatc

SEQ ID NO: 3989 - DNA, 481 bp, Cucurbita pepo
tagtaatgcaaatgctaggtatttttccctccatttgctttggtcgactctgcagtccggcggcttgtcttcaattctcacgtcctctttcgtgtaaggaatggaatcgcagatcaagcatgctgtggtggtcaaagtgatgggtagaaccggatcaagagggcaggtgactcaagttagagtcaagtttcttgatgatcagaatcgttacattatgaggaatgtcaagggaccggtgagggaaggagacattcttaccctgttggagtctgagagggaagctagaagattgcgttgatggggatcaagttcccagttctccggtttgcagttgctaaatgttatttatcatatcatacctacaaatagaatgctttacatcatttttccctattgaagtgtgattttagtgactagcttctccaaggctttgcttccatggcagaatatgtgaactggatgagtaatttaattgagtatt

SEQ ID NO: 3990 - DNA, 491 bp, Fagopyrum esculentum
attgattgctctaatctttgctctccgcggctgctagggttttcataaatctcccaagccatggattctcaaattaagcacgcactagtggtgaaggttatgggccgtacaggttctcgtggtcaggtgacgcaagtcagggttaagttcttggacgaccagaaccggttcatcatgaggaacgtcaagggacctgtcagagagggtgacattctcacccttctcgagtccgagagagaagccaggagacttcgttgatcggtttgtttggcgaatttcatgcttcaattgcaagtttgcctactacattttgcttcgaatagggctttggtacttctaatgatgaattttcaatgttgagattttggtttattaattatatgtaatggatatcggatcttttctcatcattgcttatcgtggaagttatagcttgtgatattgtttgaatttgcctgtcaatgacagatgaattggaactacttttgact

SEQ ID NO: 3991 - DNA, 479 bp, Fagopyrum esculentum
agctctgaatttacaagtccctccaattcagcagctgctaggtttttcgaccaagcttcttgtaccgatcaggcatggattcccagatcaagcacgctcttgtggttaaggtgatgggccgtactggctctcgaggtcaagttacccaggttagagttaagttcctcgacgaccagaaccgtttcatcatgagaaacgtcaagggacccgttagagaaggtgacatcctcacccttcttgagtccgagagagaagctaggagacttcgttgatctgttccttctgaatcgaatgagttttcttcgtttcagataagttgtgttattttcatttcatgttttcttctttgagattttcggttagggattggaggattattttgttgtgatgtggattatacaatgaagtttgttttattgtcgaaagttacatcttttgcgttatatatctttctatctaaaaagaaaacaaaactctgt

SEQ ID NO: 3992 - DNA, 390 bp, Fagopyrum esculentum
aggtttttcgatcagacatggattcccagatcaagcacgctcttgtggttaaggtgatgggccgtactggctctcgaggtcaagttacccaggttagagttaagttcctcgacgaccagaaccgtttcatcatgagaaacgtcaagggacccgttagagaaggtgacattctcacccttcttgagtccgagagagaagctaggagacttcgttgatttgttcgttctgaatcgaatgagttttcttcgtttcagataagttgtgttattttctgttgatgttttcttctttgagattatcggttcttagggattgaatgattgtttttttttgtggtgtggattatacaatgaagttagttttatgtttgaaatttacatcttttgcgtt

SEQ ID NO: 3993 - DNA, 425 bp, Fagopyrum esculentum
tttcgtcaatcacctaagccatggattctcaaattaagcacgcactagtggtgaaggttatgggtcgtacaggttctcgtggtcaggtgacgcaagttagggttaagttcttggacgaccagaaccgattcattatgaggaacgtcaagggacctgttagagagggtgacattcttacccttctcgagtctgagagagaagccaggagacttcgttgatcagtttgtttggcgaatctcatgcttcaattgcaagtttgcctactccattttgtttagggttttggtacttctaatgatgaattttcaatcttgagattttggtttattaatgatatgtaatggatgttggatcttttctcattatgtcttatcgtggaaattatagcttgtgatattgtttgaatttgcctgttgatgacagat

SEQ ID NO: 3994 - DNA, 536 bp, Fagopyrum esculentum
gggaccaagcttttttgtaccgacgatcaggtcctcttcaatcctctgttcgtacttttctctggttgctgcatatatttagaattttaaatttccacattgcagaaatggattcccagatcaagcacgctctggttgttaaggtgatggggcgtactggctctcgaggtcaagttacgcaggttagggttaaattccttgacgaccagaaccgtttcatcatgagaaacgtcaagggacccgttagagaaggtgacatcctcacacttcttgagtccgagagagaagctaggagacttcgttgatctgttcgttctgagatgattgagttttcttggtttcagataagttgttttaatttgagttgatgttttcttctttgagattttcgggattgcttttgtgatgtgaatcatacagagaagttagttccagatccttcctagttcctgtcgatgtttggttaatcttattgaaatgtcatctacataaagttatattcagaaatagattgctgtgaacattcctcgtattag

SEQ ID NO: 3995 - DNA, 537 bp, Linum usitatissimum
gcttgcaaaattgccgagagaaaagccctagtagcagctgcagcagccagccgttagcttccatagctctcgtctcgtcggagcttcttcttgcaattgaaggatggaatcccagaccaagcatgctttggtggtgaaggtgatgggccgtactggatcgaggggtcaagtgactcaagtcagggtcaagttcctcgatgaccctaaccgtttcatcatgaggaatgtcaagggacccgtgagagaaggtgacatccttaccttgctcgagtctgagagagaggccaggagacttcgttgaaactgctcttgggtggccctgcttttttgttgtttcggattgtatctagtgatgtctaccggtaccgaatcccattgtagtttattacccgttttgatgttctactgaatcgattttgctgtcaaaagacttgagctttcaattgtggaattggtgatgttcggattgtttccaagtatacttctttctgaagtatgaattaccttaaagtctgtctgcataatgatatttgttac

SEQ ID NO: 3996 - DNA, 656 bp, Humulus lupulus
acggccggggtccccctaaaaaaaatagactttatactaagcctcttttctttcccgaaaaaatatatatgtactatataaagtatgtgaaacaaaccctagacactaggacggtctccccaactctctgagctctcactcaccagactgaagcaagtggtggctagcactttctctctctttaactcgacgacgaccacacacggacgagaatggaatcgcagataaaacatgctgtggtggtgaaagtaatgggcaggacaggatcaaggggacaagtgactcaggtgagagtcaagtttctggatgatcaaaatcgtttcatcatgaggaatgtcaagggacctgttagggaaggagatattctcaccttgctcgagtccgagagggaggcaagaaggttgcgttgatcatcatcatcttcatcatcatcatcatcatgtttcttcatgaccatgaatgattcacttcatttttcaaccttttgtattcgtaatgcttgacttgaattgatcccaaactttgttacttaattttttttggtcttgggtggtacatttcaagagcaacattgggtttttggtgaagtttagagttgttgcgttgatcgtcatcatcatgtttcttcatgaccatgaatgattcacttcattttt

SEQ ID NO: 3997 - DNA, 624 bp, Tripterygium wilfordii
ctagtttctacacaacgactgcgaagaggaagcggccgtctgtctctctgcactgattacgctctctctcggtctttctcttaggatggattcccaaatcaagcatgccttggttgttaaggttatgggccgaacaggttcaagggggcaggttacccaggtgagagttaagtttctggatgatcagaatcggtttatcatgaggaatgtgaagggaccagtcagggaaggggatatcctcactctactcgagtctgagagggaagctagaaggctccgttgatccgttgcccatgttgttggaaacttttgctcctcactgaaaatgtgtgccgtgttagttactggttttgcggatattatgagtacgccatagtagttttaattttcaggtataagacacttatttcttatgaatgggttgcatgtaatggatgtttcagtttgatattgtgtttcagaaatacctatatttgccgccttatttggattgctgcatactttatgaggtgcaattggtaattaaaggttttacaaatgttctccagagatacgtattacaattcttactatttagaagaaaattagtaaattaataaattactaggacctaagttttaaaaa

SEQ ID NO: 3998 - DNA, 451 bp, Citrullus lanatus
tgtgtttgtgcaggcatggaatcccagatcaagcatgctgtggtggtgaaagtgatgggtagaactggatcaagggggcaagtgactcaagtgagagttaagtttctagatgatcaaaatcgttacattatgaggaatgtcaagggaccagtgagggaaggagatattcttaccctgttggagtctgagagggaagctagaagattgcgttgatggggattctttcaaggtcccagttttccagtttgcagttgctgaaagttatccttttagttttaatcttacctacaaatagaatggctgttatcatttttccctattttatgtgtggtctttagtgacaaccgtgtccaagacatttttggctctaagccagaatacgtgaactggatgagtaatttttgagttttgaaacgatcaatttcttctcttatttggagtttctgtaaaa

SEQ ID NO: 3999 - DNA, 497 bp, Citrullus lanatus
gaaagagagattattagaaacgtaaaccctagccgagccaatccctcccgcattgccgcacaatcttcttcctcgatcttcttcattctcttgctctcaggtttgtttgtgtaggaatggaatcacagatcaaacatgctgtggtggtgaaagtaatgggtagaactggatcaagagggcaggtgactcaagtgagagtcaagtttcttgatgatcagaatcgttacattatgaggaatgtcaagggaccagtcagggaaggcgatattcttacactactcgagtccgagagggaggctagaaggttgcgttgatgcaaaattttctgttggtgccatcatatttttccttctttaagtgtggattttagtggctagtttgtttcaagacatttgattctgtggctgaatttagaacaagatgaggtaatttaactgagttttgaaaaattgtggatttttttacctattgcttaatgggaaggaaattttttattt

SEQ ID NO: 4000 - DNA, 425 bp, Citrullus lanatus
aggaatggaatcacagatcaaacatgctgtggtggtgaaagtaatgggtagaactggatcaagagggcaggtgactcaagtgagagtcaagtttcttgatgatcagaatcgttacattatgaggaatgtcaagggaccagtcagggaaggcgatattcttaccctactcgagtccgagagagaagctagaaggttgcgttgatggaaaattctctgttgttgccgtcatattttttcctattttaagtgaattttagtgactagtttgtttcaagacctttgattttggggctgaatttgtgaactagatgaggtaatttaattgagttttggtgatagcaagttttctcatgaaaaattgtggatttcttttttcttattgcttaatgggaaggaatgttttttttttcctgttatttttgtca

SEQ ID NO: 4001 - DNA, 667 bp, Citrullus lanatus
gttcgtttgatattacttcaaaatacacttacgataactcaaaatcagttcaatatttaatttaacactgttaaacacagttttcatactattaaaattgattttgaaggattaaaagctttttgaagtgatttaaactagtttaaaatggttataatttatataaccgagtatcctagtaatctttcaatgagaccgtctactaaaatggttataatctaattgtaagattgcttttattatttggtttgtttgtgtaggaatggaatcacagatcaaacatgctgtggtggtgaaagtaatgggtagaactggatcaagagggcaggtgactcaagtgagagtcaagtttcttgatgatcagaatcgttacattatgaggaatgtcaagggaccagtcagggaaggcgatattcttaccctactcgagtccgagagagaagctagaaggttgcgttgatggaaaattctctgttgttgccgtcatattttttcctattttaagtgaattttagtgactagtttgtttcaagacctttgattttggggctgaatttgtgaactagatgaggtaatttaattgagttttggtgatagcaagttttctcatgaaaaattgtggatttcttttttcttattgcttaatgggaaggaatgtttttttttt

SEQ ID NO: 4002 - DNA, 419 bp, Citrullus lanatus
gtgtttgtgcaggcatggaatcccagatcaagcatgctgtggtggtgaaagtgatgggtagaactggatcaagggggcaagtgactcaagtgagagttaagtttctagatgatcaaaatcgttacattatgaggaatgtcaagggaccagtgagggaaggagatattcttaccctgttggagtctgagagggaagctagaagattgcgttgatggggattctttcaaggtcccagttttccagtttgcagttgctgaaagtagaatggctgttatcatttttccctattttatgtgtggtctttagtgacaaccgtgtccaagacatttttggctctaagccagaatacgtgaactggatgagtaatttttgagttttgaaacgatcaatttcttctcttatttggagtttctgtaaaa

SEQ ID NO: 4003 - DNA, 461 bp, Acacia harpophylla
gtggttattggtgagatcagagcagcgccgctcgcactttgctgatttttgcattcttcgcctatagtcggatcaggatggagtctcaggtgaagcatgctgtggttgttaaagttatgggtcgtactggttccagagggcaggtgactcaggttagagtcaagtttttggatgaccacaacaggtatatcatgaggaatgtgaaaggaccagtgagagaaggagacattctcacccttctcgagtctgaaagagaagcaaggagattgcgctagagagagtcattctctgtgtttattctgtgctatggatgttatcgtgataatgactttttttgtgtggtggtgggcaccaattataattggtagttattgttgtcataaaatgtctttcctatgatgactgcagttttgttacctcatctttaagcttttaatatcgaaatgaaacattcgagtttt

SEQ ID NO: 4004 - DNA, 475 bp, Cucumis sativus
gggcgccgtctctacaaattccacagatcgttctctccggcctttctctcgtgtttgaggaatggaatctcaaatcaagcatgctgttgtggtcaaagtaatgggtagaactggatctagaggtcaagtgactcaagtgagagttaagtttcttgatgatcaaaatcgttacattatgaggaatgtcaagggaccagtgagggaaggtgacattcttactctgttggagtctgagagggaagctagaagattgcgttagatcaaacccacacttcaccaatttgcagttgctgaatgttatgttttaacttcaaaatagtattgctcttatcatttttttcctcttttatgtgtgattttagtgacattatggttctaagccagaatacgagtactttaattgagttttgaaaccatttatttcaaaattttgtggctatatgccaactgctcaatattattggtgtttttttgg

SEQ ID NO: 4005 - DNA, 576 bp, Cucumis sativus
ccaaagtatttcctttccccccccccttccatttgtgttgccggcggcgtgtcttcaaattctactgagttctctccgccctcattctttctccctcgtttaaggaatggaatcccaaatcaagcatgctgttgtggtcaaagtaatgggtagaactggatctagaggtcaagtgactcaagtgagagttaagtttcttgatgatcaaaatcgttacattatgaggaatgtcaagggaccagtgagggaaggtgacattcttactctgttggagtctgagagggaagctagaagattgcgttagatcaaacccccacttcaccaatttgcagttgctgaatgttatgtttatcccctttttagttttgtcttcaaaatagaatggctcgtatcattttcacctcttttatgtgtggctttagtgatattttggttctaagccagaatacctgaactgaatgagtactttaattgagttttgaaaccatctatttcaaagttttgtggctgtttgccaactgctcaatatttcttttggaattcttagcatttagttgtatgcttgctttcttgttt

SEQ ID NO: 4006 - DNA, 202 bp, Cucumis sativus
aaatggaatcccagatcaaacacgctgtggtggtaaaagttatggggcgaactggatcaagagggcaggtgactcaagtgagagtcaagtttcttgacgatcagaatcgttacatcatgaggaatgtcaagggacctgtgagggaaggtgacattcttacccttctggagtctgagagagaagccaggaggttgcgttgatg

SEQ ID NO: 4007 - DNA, 589 bp, Panax ginseng
ccacactttgcatatcaatttcgaacagcagcttctgttctctctcggcctatctcttaacaaattcagcaggttcagaatggagtctcagcttaagcatgccctcgtggtgaaagtgatgggtcgcacaggatccaggggtcaggtgactcaggtgagggtgaaattccttgatgaccagaaccggtttatcatgagaaacgtgaagggcccagtcagggagggtgatgttctcaccttgctcgagtccgagagggaggcaagaaggctgcgctgatgtgtctacatgtgttcccctttatgttttatgcttcaggttttgggcagctagctctgggcttatttttagtgtgcaactttttattcagtttcctatttttggctttccatatatgggtagtttgaaaatttgtgaaatgctgttttaaatgtgttggatttaaatttatgcttcactaatgagcatattatccatttcttgatgaaatgtcttaataggaggatttggtaatagataacattgctttgggtaatttaacttttgaataatgatacctatatattcggaatacattttagttatacaccg

SEQ ID NO: 4008 - DNA, 441 bp, Lotus japonicus
aatcacctcattctcttccgtttgaagaagcgagagcagccgctaccctaaccccatcgtcctctctgctagcaacaggatggagtctcaggtgaagcatgctattgttgtcaaaattatgggtcgtactggatccagaggtcaggtcactcaagtcagagttaagtttttggatgaccagaatcgtcacatcatgaggaacgtgaaaggtccagtgagggaagacattctcacccttcttgagtctgaaagagaagccagaaggttgcgctagaggagctcatgttttggtttaggattcaatgaagcattgctgttttgctttagttagctgatgccaaatgttcgtgtcatgaacttaattatgcatctattatgacttgaatttgttgtctacactttatattgttgggattttgagtaaatttgtgctttgactct

SEQ ID NO: 4009 - DNA, 551 bp, Lotus japonicus
ggctcaatcaccgcattctcttccgtttgaagaagcgagagctcgcagccgctaccctaaccccatcgtcctctctgctagcaacaggatggagtctcaggtgaagcatgctattgttgtcaaaattatgggtcgtactggacccagaggtcaggtcactcaagtcagagttaagtttttggatgaccagaatcgtcacatcatgaggaacgtgaaaggtccagtgagggaaggggacattctcacccttcttgagtctgaaagagaagccagaaggttgcgctagaggagctctcatgttttggtttaggattcaatgaagcattgctgtttttactttagttagctgatgccaaatgttcgtgtcatgaacttaaattatgcatctattatgacttgaatttgttgtctacactttatattgttgggattttgagtaaatttgtgctttgactcttatttttttcttctctattggccattgagatgttcagctggtacgaatttttgtatttgtttgaaaagttttttactagttggtcgttgctttg

SEQ ID NO: 4010 - DNA, 477 bp, Cucumis melo
tctccatttgcgtttatcaaattatctggcgccgtctctacaaattccactgatcgatttctctccggcctttctctcgcgtttgaggaatggaatcccaaatcaagcatgctgttgtggtcaaagtaatgggtagaactggatctagagggcaagtgactcaagtgagagttaagtttcttgatgatcaaaatcgttacattatgaggaatgtcaagggaccagtgagggaaggtgacattcttaccctgttggagtctgagagggaagctagaagattgcgttagatcaaacccacacttcaccaatttgcagttgctgaattttatgttttaacttcaaaatagaattgctcttatcattttttcctcctttatgtgtggttttagtgacattttggttctaagccagaatacgagtactttaattgagttttgaaaccatttatttcaaaattttgtggctatttgccaactg

SEQ ID NO: 4011 - DNA, 673 bp, Cucumis melo
tgccaaagtattttctttccctcccttcttccatttgtgtggccggcgccgtgtctacaaattctacagagttctccccgggctcattttctctcccccgtttaaggaatggaatcccaaatcaagcatgctgttgtggtcaaagtaatgggtagaactggatcaagagggcaagtgactcaagtgagagttaagtttcttgatgatcaaaatcgttacattatgaggaatgtcaagggaccagtgagggaaggtgacattcttaccctgttggagtctgagagggaagctagaagattgcgttagatcaaacccccacttcaccaatttgcagttgctgaatgttatgtttatccccgttttagttttatcttcaaaatagaatggctcttatcatttttttctcttttatgtgtggtttcagtggcattttggttctaagccagaataccttaactggacgagtactttaattgagttttgaaaccatctatttcaaagttttgtggctgtttgctaactctcaatatttcttttggaattcttagcatttagtgtatgcttgctttcttgtttcgtagtggttagaattgttgtttgtcatgttttaatttgaaaacaattagatgtgtaaaaccagacattaacaagattttgaatgacggtgtgtttt

SEQ ID NO: 4012 - DNA, 508 bp, Momordica charantia
atctcgcgcctcacagaactctcaatctcacctcgctctcttgcctctcagcccgtcgccgccgtctgtcgtcgtttgccgttcgtccgccgccagtctctctcgtcttcgcctcgaggatggaatctcagattaaacatgctgtggtggtgaaagtaatgggtagaactggatcaagggggcaggtaactcaagttagagtcaaatttcttgatgatcaaaatcgttacatcatgaggaatgtgaagggaccagtgagggaaggcgatattctgaccctgctggagtctgagagagaagctaggagattgcgttgatgggattctgatactgttatgatcccagttttcaatttcagggttgcccttactcaatcttatccctttatcatatagtcttctagcatgcggctgttttcgttctacccattttggaaatggcctttaaagttaaggttgaatattgaacagaatgttatataatctatttgagttgctaaatttctgga

SEQ ID NO: 4013 - DNA, 459 bp, Momordica charantia
ccggtgagttttcaaatccgattctgcgaaatccttcgccgccggtttctgtagaatctaagaaatggaatcccagatcaagcacgctgtggtggtgaaagtaatgggtaggactggatcaagagggcaggtgactcaagtgagagttaagtttctcgacgatcagaaccgttacatcatgaggaatgtgaagggacctgtgagggaaggtgacatcctcaccctgctagagtctgagagggaagccaggagattgcgttgatgatactacgatcccggttatccgtgttgcagtacctgatggttatcctgttttctcatacactctaggaacagaatgatggctgttttcgatttttgctcgtttgaaaagtctggttttgattattggcatgtctgagacctcttagattctaaggtagaatgtttgaactggatgagattatttacttgaattgt

SEQ ID NO: 4014 - DNA, 675 bp, Vitis vinifera
atgatttggcaggtatatatgggattcaatgctgtttattgctttcatggtttccaagatgggttcctctcctccgaagccgccgtaagtgctccaagcctctcttcttctcgtcgtcttctctcttcgcagtgcaaaatggaatctggggtgaagcatgctgtggtggtgaaagttatgggtcgaactggctcaaggggtcaggtgacacaggtgagagtgaagtttttggatgaccagaacaggtttattatgaggaatgtgaagggacctgtcagagaaggagacatcctcactctgctcgagtctgagagggaggccagaaggttgcgttgatggggtcatctttggctccatttccatgttttgataggtatcttatgagttttccagtttcaagcttgtagttttgggtttttcaaattaaaattctgtttgaggacgggttttagttttatgtttggaatgaattggcttaatcgaactccatgttttttaatgatgcaacttctagctcatagaatggagcaagatgttgtttcatgtggttgtgagcatttgagtgtaagcattccccaatcacatttggacaaataatcataatcaatggatatgttatttctgattttctttttgacttaaccaactcaaattcaacccaaaccgagagaaatg

SEQ ID NO: 4015 - DNA, 902 bp, Cyamopsis tetragonoloba
gtagtcactaactacatctcaatagggccaacagagaggaaaatcatcatatagaagttaaagcgcataactcaactcagcaatatcaataacatcaaaactcaagtcacaatacgagaataacacagattctgggtaacaacatttctcatctcctaactaccacaaaatcagagaagtttcacaagcaaacgatagagaccctctagcgcaaccttcttgcttctctttcagactcaagtagggtgagaacatccccttctctcacgggtcccttcacattcctcatgatgaaacggttctgatcatccaaaaacttcactctaacctgagtcacctgccctctagatccggtacgacccatgactttgacaacaacagcatgcttcacctgagattccatcctgtattcaggtaagggaaagggaagcgaggttcagcctggttcatagatctttgtgaagaaggaggtttacaacactcgccccaagatgcagaacgaagaaggacagaccactgagctttacattcccaggaagtgctctgctaccaacagattgataacttccaaggaccacgcttcggttcagattaacattggtcatttggatgagaatggtgtctacaatggccatttctccacttttgccctctgcggcttcattcgtgcacagggcgatgcagacagtgcactagaccgtttgtggcagaagaagaaagttgaaactaagcagcagtagaagtgctcacttgcacagtagtttgttatgtgtcttgagttctaccttttctagagatatttgagagtattatgatctgttttgcaatattttgttttgtatttcctccggtaacttcaactaccgttactttttgactatgtgacagccctttgaaaagta

SEQ ID NO: 4016 - DNA, 570 bp, Vitis vinifera
ctccgaagccgccgtaagtgctccaagcctctcttcttctcgtcgtcttctctcttcgcagtgcaaaatggaatctggggtgaagcatgctgtggtggtgaaagttatgggtcgaactggctcaagaggtcaggtgacccaggtgagggtgaagtttttggatgaccagaacaggtttattatgaggaatgtgaagggacctgtcagagaaggagacatcctcactctgctcgagtctgagagggaggccagaaggttgcgttgatggggtcatctttggctccatttccatgttttgataggtatcttatgagttttccagtttcaagcttgtagttttgggtttttcaaattaaaattctgtttgaggacgggttttagttttatgtttggaatgaattggcttaatcgaactccatgttttttaatgatgcaacttctagctcatagaatggagcaagatgttgtttcatgtggttgtgagcatttgagtgtaagcattccccaatcacatttggacaaataatcataatcaatggatatgttatttctgattttctttttgactta

SEQ ID NO: 4017 - DNA, 452 bp, Tripterygium wilfordii
gctttctcccagtcgctcaggatggattcccaaatcaagtcatgctttggtggttaaggtaatgggtccgaacaggttcaagaggccaggtcacccaggtgagagttaagtttcttgatgatcagaatcggtttatcatgaggaatgtgaaaggaccagtccgggaaggcgatatcctcactctgctggagtcggagagggaagctagaaggctccgatgatctagtgttgttggagactttttgctctccctaaaaatgtgcggttatcagttttgagggtgtcatactctatagtagttttaatttttcagggataagacactcatctctttataatactgtgtttcagtgtaatattgtgtttcagaaattctcaagtttgccttgttatttgaattgttgcatcctttatgtggtgcatttggtggttaaggttttatgtttgatgaa

SEQ ID NO: 4018 - DNA, 457 bp, Phaseolus coccineus
  misc_feature (395)..(395): n is a, c, g, or t
  misc_feature (426)..(426): n is a, c, g, or t
gactctggttagcaagcatcgcaaaaccctagcctactttcttcactcgtcttctatttcaggatggactctcaggtgaagcatgctcttgttgtcaaagttatgggtcgtactggatccagagggcaggtgacccaggttagagtgaagtttttggatgatcagaatcgtcacatcatgaggaatgtgaaaggacctgttagagaaggagacattctcaccctcctcgaatccgagagggaagcaagaagattgcgctatatggtttaaatcgaaacagtggcttgatttttgtggtagttagtggatgccaaaggttatatcagcctatcttgatgttttggatctatttttattcgaattatggactgaattttgttgattttactctaagntttaagattgaagtatgattggcttgatatntgctccaaaaacattaataatggactcttgt

SEQ ID NO: 4019 - DNA, 883 bp, Ambrosia trifida
ttccaagatcacaaatggcaactgctgtcatgtcttctcttcctcaattcactggcttaaaggccacttcatcatcatcttcccctgttcaaagcatggtatcattgaaaccaatgaaacccaagggaaagggagctttaggtgttcgatgcgatttcattggttcatctacaaatctgataatggtgacatcaaccaccttgatgttgtttgctggccgattcgggctggcaccgtcagcaaacaggaaggcgaccgcagggctaaagcttgaagtgagggattcagggcttcaaaccggcgaccctgctggcttcacacttgctgacacgttggcgtgtgggaccgttggtcacattattggtgttggtgttgttttaggcctcaagaacattggtgccatctaaacttgttgtttgaaaacagattatcatgttaataacatttgcgtaatcgacttcgtttttcatactccaaatttagtccattcaaaagaaacaaatacagatttaagtaatcccaaacctgctactagtatcaaaatgcaacgatgacgaaaatcagcaagtcataaagcaaaaattaaaagagacggtttacataatcaacgcaacctcctggcctccctctcagactcgagcaaggtaagaacatcaccctctctgactggtcccttaacatttctcatgatgaaccggttctggtcatccaaaaacttcactctcacttgtgtcacctgtcctcttgaacccgtccttcccatcaccttaacgacgactgcatgcttgatttgagactccatctttcactttcttgcggccgacgagtacaggtggcgcttgtggtcgttgatgctccaaatagcgaatgcaagagaatgaat

SEQ ID NO: 4020 - DNA, 422 bp, Phaseolus coccineus
ggattttggttagcaagcatcgcaaacccctagcctactttcttcactcgttttgtatttcaggagggactctcaggtgaagcatgcttttgttgtcaaagttatgggtcgtactggatccagagggcaggtgacccaggttagagtgaagtttttggatgatcagaatcgtcccatcatgaggaatgtgaaaggccctgttagagaaggagacattctcaccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttg

SEQ ID NO: 4021 - DNA, 2259 bp, Mesembryanthemum crystallinum
gaatgaagaaaattatgagataatattcatgaagaaaattatgagataatattaaccactacaaaagaaagctacagtatattttattttactgaagtgactaaattttcattctcaatcttttcgaaccaataccaccaatccaataaatagtttccacattcaattattaaagcataatttcaggtggaatgcataaaatgaagatatgataagtaaacaaaacatcaagctggtgtagatagcttgtcggagacactcaacgaagtctccttgcctctcgttcagattcgaggagagtgagcatgtctccctctcggacgggtcctttaacgttcctcatgatgaaacggttttggtcatccaagaacttcactctcacttgggtaacctgtcccctagatcctgtacggcccatgcatttcacgacaagagcatgcttgatctgagactccatccttgattagagctttgagcagccgatgcgctagagagagaaagcagattaagaggagagagaaacgcctcgtgccgaattcggcacgaggctctgctttctctctctaaacctctctgctttctctctcctctgcaattcttcaacagatctcagattacttcaaccatggttaccattaagtgcgtcaaggcccgacagatctacgacagtcgtggtaaccccactgttgaggctgatattcatcttgatgatggaacttacgctagagctgctgtccccagtggtgcatccaccggagtttacgaagcacttgagctcagggatggaggtaaagactacatgggaaagggtgtttacaaggctgttaagaacgtaaacgagattattggccctgcattggttggcaaggacccaactcagcagaccgctatcgacaacttcatggttcaacaacttgatggaaccgtgaacgagtggggttggtgcaagcaaaaattgggagcaaatgctatcttggctgtttcccttgctgtctgcaaagctggagcccaggtcaagaaaattcctttgtaccagcacatcgcggagattgctggaaacaagaatatggttttgccagtaccagccttcaacgtcatcaatggtggatctcatgctggaaacaagcttgcgatgcaggagttcatgattcttcccaccggagcttcttcattcaaagaagcaatgaagatgggcagcgaagtataccacaatttgaagagtgtgatcaagaagaagtatggtcaagacgcaaccaatgttggagatgagggtggctttgctcccaacatccaggagaacaaggagggtcttgagttgctcaagacagccattgagaaagccggatacaccggcaaagtggttatcggaatggatgttgccgcatccgagttctacaaggaagacaaatcctatgacttgaacttcaaggaagagaacaatgacggttcacagaggatctctggcgaagccctcaaggatctttacaaatcatttgtagccgagtaccccatagtgtccattgaggacccatttgaccaggatgactgggaacactatgccaagatgaccgcagaatgtggagagaaagtacagatcgttggagatgatcttttggtcaccaaccccaagagggtaaaaaaggctatcgacgagaactcctgcaatgcacttcttctcaaggttaaccaaattgggtctgtcacagagagtatcgaagctgtgaagatgtccaagaaagctggatggggtgtgatggctagccaccgcagtggtgaaaccgaggacactttcattgctgacctttcagtgggtttgtctacgggccaaatcaagaccggagctccatgcagatctgagcgtcttgccaaatacaaccagctcttgcgtattgaagaggagctcggtgacaaggctgtttacgctggagcaaacttccgccgccctgttgagccctactaaggcatagatttctcagtccgaggttctactggtttttgaggcgaagcgttttcggaacctttgtttcctgcccttcaataagagacctttttttaggagtcttgcacaataactcttttttgttgaaagttttgtgaaccagtagtactggtacgtactacccaaggccaaaggttttcgcaagtgttggatgttttgagctttagcattattaattatgattccagagaatgaatgtttttttggcttgagttactcttaccaaattttagctattgcaatatgcactcttgctcgtt

SEQ ID NO: 4022 - DNA, 476 bp, Cajanus cajan
tttgcgagtttgaagagagagtagccgctaccctagcttcctcttcagcttttctaacttcaggatggagtcccaggtgaagcatgctattgttgtgaaggtcatgggtcgtacagggtctagagggcaggtgactcaggttagagttaagttttggatgatcagaaccgtcacatcatggggaatgtgaagggcccgtgagagaaggagacattctcaccctactcgagtctgagagagaagcaagaagattgcgctagtagggttttttcatggtgtctcaggattcagtgaagcaatgcttgtttttgtggttagttagcagacgtcattatttttattattctggatctatattatactcgtattgtgacttgagttttgatgttattgagttgccggagttttcagtaaaattatgttttgaattttatatactgctctatcttttctgttctgttttcagtaaaattatg

SEQ ID NO: 4023 - DNA, 339 bp, Ambrosia trifida
ctctaaaatttagaagcagctgcagccgttcatacccaggtattgaaagatggagtcacaaatcaagcacgcagtggtggtgaaggtgatggggagaactggatcaagaggtcaagtgacccaggtcagggttaagtttcttgatgaccagaaccgttttattatgaggaacgttaagggacctgttagagaaggtgatgttcttaccttgcttgagtccgaaagagaggccagaaggttgcgttaattttattatatgatgattttataagttattgtttcaagttttatgctgtgcgttactcgtttttgagacatatttgagtacaagatttggta

SEQ ID NO: 4024 - DNA, 469 bp, Ambrosia trifida
tcattcatctgtagcagccgcacctcagcttcgtgatttgttaatcaatctctataatatcaccagcttgtgaaagatggaatctcagatcaagcacgcagttgtggtgaaggtgatgggcagaactggttccagggggcaagtcactcaggtgagagtgaagtttcttgatgaccagaaccgttttatcatgaggaacgtgaaaggaccggtcagggaaggtgatgttcttacattgcttgagtctgagagggaggccaggaggttgcgttgatttcagtatcattttgtcatcatcattatcagtcatcacagatccactggttcagtttttgttctctttttggtgttatttttgctgtttgttatgatgttttgctttcgagaagatatgagtagtgtaatatgtgtttcaaggtgaaatttcatcgttgttatcgttacattttgaacggttaattgattcagt

SEQ ID NO: 4025 - DNA, 334 bp, Ambrosia trifida
gtctaaaatttagaagcagctgcagccgttcatacccaggtattgaaagatggagtcacagatcaagcacgcagtggtggtgaaggtgatggggagaactggatcaagaggtcaagtgacccaggtcagggttaagtttcttgatgaccagaaccgttttattatgaggaacgttaagggacctgttagagaaggtgatgttcttaccttgcttgagtccgagagagaggccagaaggttgcgttgattttacatgtttttatgtgatgattttataagttattgtttcaagtttttatgctgtgcgttactcgttttgagacatatttgagta

SEQ ID NO: 4026 - DNA, 278 bp, Ambrosia trifida
tcattcatctgtagcagccgcacctcagcttcgtgatttgttaatcaagctctataattcaactagctcgtgaaagatggaatctcagatcaagcacgcagttgtggtgaaggtgatgggcagaactggttccaggggacaggttactcaggtcagagtgaagtttctcgatgaccagaaccgttttatcatgaggaacgtgaaaggaccggtcagggaaggtgatgttcttacattgctcgagtccgagagggaggccaggaggttgcgttgatttc

SEQ ID NO: 4027 - DNA, 584 bp, Amorphophallus konjac
ccccgcatcctctgttgcgccgcccgcttcctccctctctggctctgcctccggaagaaatccatcgacacgaatggacagtcaggtgaagcttgctgttgtggtcaaggtgatggggcgaactgggtccagggggcaagtgacccaggtcagggtcaagttcctggacgaccagaaccgtctcattatgaggaacgtgaagggacccgtgagggagggagacatcctcaccctgctcgagtccgaaagggaagccaggaggttgcgctgatccgctcatgtgaggggggtggtacctgatggatttttgctacgcttatgttatagttattttgtcctgttcatcatgttttcaagggtacgtgggatttcttatttgcaggtagcatcttaaatatggcacattttggatcaaaacttccgttgttatgtgtgatgtagggcagcagtggatcagaatttgattgaactttattgttatttttgctgttatgcccatatggcttgaatcctacttgtgttgtttcggttttgttcctctctttttatgtagatctcgtctgattgcaatgcaatatcacata

SEQ ID NO: 4028 - DNA, 586 bp, Amorphophallus konjac
agggtttgcgccgcttttgtgtggtgtttcttcggccgcctctgcgaacagctcccagctcacgctcgagagggggatcgtcgaagctttctgatcaggatggattcccaagtgaagcttgcagttgttgtcaaggtgatggggcgtacgggatcgagagggcaggtcacacaggtcagggtcaagttcttggatgaccagaatcgtcttatcatgagaaatgtgaaggggcccgtcagggaaggtgacatccttaccctgctcgagtctgaaagggaagctaggagactgcgctgatcaccagggttttgctccctataaggggttctgtctttatcgacatttggtagcttctactttctaattaggatttccttaggttggtttgcaaagccgagttgaaggtgactatccgacttagattcgtactgactctttcatctcagtctaactcaaatagtctgagttgatgtgagtcacgtcgagtagacaaactatacttttgaccctatggaagaaagttcattgtttgaaattcataggtgtaatgcacatttgctgtgggattgaaaacctcattcttaac

SEQ ID NO: 4029 - DNA, 452 bp, Arnica chamissonis
ttaggggttttggggtgttttttatttcaccttgtaatcttcgatttcggaatttcgttgtataatgccagcatttaatcaagaatatagaagatcagccggcttcaaagcttgatgcaaagctctaagtttccaggaagtttcagagcagctgccttcaaggctaaaggaagtgaaacatggagtctcaaatcaagcatgcagttgtggttaaggtaatggggaggactggttcaagaggtcaggtgacacaagtgagagtgaagtttttggatgaccaaaatcgatttatcatgagaaatgtgaagggaccggtgagagagggtgatgttcttaccttgctcgagtctgagagggaggcccggaggttgcgttgatcacgcaaccttctcttttaattttcaattttcacttttaagacttgtctgatgttcaccattgtaatttgatct

SEQ ID NO: 4030 - DNA, 1904 bp, Cannabis sativa
ctatttcctttcattcaagcttcaacgttgccggttctctcagccgccgccctttctcaaaaccgagctgcaggtgagttctgtattttgattatctatataatctgtatctaaatctattttgatgtttttgttttgaataataattctgttatagtgttatgatgaagaattgatgattgatactgacaaaatcaaaatttgtatatcattcttttctctgtagcttcatgtttttcttagtttgtctctttaggctgataatttaattatctttctctaagtacattgatttcggtgttaatctgtttcgctgacggataaagtgaaggaatattgttagcatgtagtgatttttcaactcatagtgttgaaaagctgtattttagtttgaaatgtgaatcaaaattatgttcttcatggtgggttttgtgtgtttgtcgatggagatcttaattcctgctgtcttggtttttttgctgatggaatatagttaagttagtagtgactagttatgtgtatctcaaaatatgtatatatagtttgaaaaattggtgttacgaatttatcccgttcaaccatatttctgcatttaggctatattttccagcgaccatctctgcaggagatgagagctgagattctcattgaaagctctcattggtagtttcactttgggttctttcttgttgatcatctttctaagaactaaatgatattgaccctatcatgtgtccatttacgtttttttaacatttgatttagtagtggctatattttttgatggcatcttaggaatcttgtttgtgtgaattttttttcttccgtaaatttaatgttttccaaaagccctattaagtgatagtgcatccatgacttgtgtaaaggagtttggttttttttttctttctttttcatgggaactgtcttatttagtttcatgtgcttaatgtcttatctttcttagaaacagcggatttaaattattgattgatagtcttttctgataattggaatcaaatgaaaggttctgttttgtaattcttgtcttccaattttctttgtaggaagatggattctcaggtgaagcatgctgtggtggtgaaaattatgggccgaactggttcaagaggacaggtgactcaagtgagagtcaagtttctcgatgaccagaaccggttcatcatgaggaacgtcaagggaccagtcagggaaggtgacattctcaccttgctcgagtccgagagggaagctaggaggttgcgttgatgggaatctgtcctcatgttgatttcttgctctttctttttgcagtcttgttttggtttgatacaaatttaattttattttagtgaatgggagggggagaccataatcagtccatgtgagtttagttctatgttttggtactactgttattagcatctcggagttttgatttattaaggtgaaatcgatttgtgagctctgaaatgttttgaattgtcaaaatgtggagaaagcatttttctttttttaaaaaatcaaatagataggctttgctttctttacaagtgtaattcccatctttgcttttctattttcttatggctgctaattcttttttgttattttggttgattaaatttggaagtacactagctaaagacttaagaaccatggtaaaaatatttttcaaatatatggtttataaaattgtttttactttttaatttagaataaaatttgtaaaagttttgaaaataaaaaaaaattacttttaaaattttcttaaatagaatttttttttttcttaattaatactttggattttgatctcaacttgaactttgggacctagacgagatggtaagtatactcacgggttcggttactcgcccctaatgggtgggggttgacttttg

SEQ ID NO: 4031 - DNA, 697 bp, Cannabis sativa
aacctatttcctttcatttaagctttaacgttgccggttctctcagccgccgccctttctcaaagccgagctgaaggaagatggattctcaggtgaagcatgctgtggtggtgaaaattatgggccgaactggttcaagaggacaggtgactcaagtgagagtcaagtttctcgatgaccagaaccggttcatcatgaggaacgtcaagggaccagtcagggaaggtgacattctcaccttgctcgagtccgagagggaagctaggaggttgcgttgatgggaatctgtcctcatgttgctttcttgttctttccttttgcagtcttgttttggtttgatacaaatttaattttgttttagtgaatgggagggggagaccataatcagtccatgtgagtttagtttatgttttggtaatactgttattagcatctcagagttttgatttattaaggtaaaatcgaattgtgagttctgaaatgttttgaattgtcaaaatgtggagaaaacattttaggaattctacaatgcactctcctaaaaaaattgtatcgatacacctctatttagttcaacatttgaaaaaaaaattatagtcaattttttatggtcgggtatgttgtagttatttagcacattcggtcaaattttaaaaagttaaaatgttgaaaatagaattcaaataatttgttgcac

SEQ ID NO: 4032 - DNA, 427 bp, Cirsium arvense
attctgaaagtttgcaagcagcagccgctctatcgatctctcaggtggtagtgaaagatggagtctcagatcaagcacgcagtagtggtgaaagtgatggggagaactggatcgagagggcaggtgacgcaagtgagggtgaagtttctggatgaccagaaccgtttcatcatgagaaatgtcaagggaccagtcagagaaggtgatgttcttaccttgctcgagtccgagagggaggccagaaggttgcgttgatttcaatccattttctatgttttgaatttatttttttctgttattcgtttttgagacttgtttgagtgccaagacttggtaaaatgttaaatgtatgaccttatggtagcaggtttctcttccagcttaatgacatttgctgtcagattttgaatggagatttcagtaattc

SEQ ID NO: 4033 - DNA, 450 bp, Cirsium arvense
gggtttttttcgatttctcaatcgcatcaatcgattcagagcagccgcacttcatcctctcgtggattgtgtatcgatcttttgagttactgtagcgattgaaagatggagtctcagatcaagcacgccgttgtggtgaaagtgatgggaagaaccggatccagagggcaggtgacgcaagtgagagtgaagtttctcgatgatcagaaccgtttcattatgaggaacgttaaaggacccgttagagaaggtgatgttcttactttgctcgaatcagagagggaggcaaggaggttgcgttgatttcatcttcttatcgtcttcacaaatctggttcaaatttaacatttatggcgttacttttgaggcatgtttgatttttaaacttcgtgatgctacatgttcgattttgataagatatgatttagagtaatttgtgtttcgatctca

SEQ ID NO: 4034 - DNA, 445 bp, Cirsium arvense
tgaaagatggagtctcagatcaagcacgcagttgtggtgaaggtgatgggaagaaccggatccaggggacaggttactcaagtcagggtgaagtttctcgacgatcagaaccgtttcattatgaggaacgttaaaggaccggtcagagaaggtgatgttcttaccttgctcgaatccgagagggaggccagaaggttgcgttgatttcgccttcttcacgaaacctctggttctatttttaacattattcgtcgttacttcagagccatgtttgagtttggaacttcgtgattgctacatgtttgttttgattttgataagatatgatttagagtaattttgtgtttgaggtccaaaatttcatctccatttggtgtttttcttatatcatttactttttgaatggatagttgattcaatggtagaggaattgcatattgccttt

SEQ ID NO: 4035 - DNA, 642 bp, Cirsium arvense
tagtcgtcattctgaaaatttgcaaccagcggcagccgctctatcgatctcccgtacgccagctagtgaaagatggagtctcagatcaagcacgcagttgtggtgaaagtgatggggagaactggatccagaggacaggtgacgcaagtgagagtgaaatttctcgatgaccagaaccgtttcatcatgagaaacgttaagggacccgtcagagagggtgatgttcttaccttgctcgagtctgagagggaggctagaaggttgcgttgatttcaatcattattcacaagttcgtgtttcaaattttctattatgtggtactcgtttttgagacttgtttgacttggtaatgtattgtttacaagtaaacttttgatctatctagtcatggtagaaggttttgaatggaggtttcgtcgtttctgcaaaaaagaaaaaagtaccgactgcgactctgcgttgaagtcaaatgtgtataaagatgcaaatcacaagcctgaaatggttttggcactaacagagtttgaggccttatgtggatttattagcttcgaggagcttgaggctgtacttgaaagtgttcctgagataatggaagtggttggtggtgcatatgctgacgaagttttacttgtcaatgag

SEQ ID NO: 4036 - DNA, 413 bp, Cirsium arvense
attctgaaagttttcaagcagcagccgctctatcgatttctcaggtagtagtgaaagatggagtctcagatcaagcacgcagttgtggtgaaagtgatggggagaactggatcgagaggtcaggtgacgcaagtgagggtgaagtttctggatgaccagaaccgtttcatcatgagaaatgtcaagggaccagtcagggaaggtgatgttcttaccttgctcgagtccgagagggaggcaagaaggttgcgttgatttcacctattttctatgttttcaatttattttttctgttatgtggaactcgtttttgagacttggtaaaatgttaaatgtatgaccttatggtagcaggtttctcttccagcttatgacatttgctgtcagattttgaatggagatttcagtaattc

SEQ ID NO: 4037 - DNA, 519 bp, Citrus clementina
ccaataaatctagggtttttcgctccattgcaagaactgctgaaagaaattagcagccgcttctgtcaccttctctctcttctcgcctcttcgctcagaatggattctcagattaagcacgctgtggtggtgaaagtcatgggccgcactggttcaagaggacaggttactcaagtgagagtcaagtttttagacgatcagaaccgattcatcatgaggaatgtgaagggacccgttagagaaggtgatatcctcactttgctcgagtctgagagagaagctaggaggctccgttgaagagtccatctctggtcatactatctcaaactttttgttggaaactagggttcattactgttgtttttagtaggctagtgattggcaatgttatgagtttcacaacttattttgaaggttttcatattaagactgggttttgagccatgaattatatgttttgggatgtttaatatcgttctcattgaaatggagttaaatttgctttaaataattcttgtt

SEQ ID NO: 4038 - DNA, 503 bp, Cucurbita pepo
cgcacaagcttcttccttgatcgtcttccatctcttgctctcaggtgtgtttgggtaggaatggagtcacagatcaagcatgctgtggtagtgaaagtaatgggtagaactggatccagagggcaggttactcaagtgagagtcaaatttattgatgatcagaatcgttacattatgaggaatgtaaagggacctgtcagggaaggcgatattcttaccctactcgagtctgagagggaagctagacggttgcgttgatggagaattgcagttgcttccattgattttgcctctttgtaagtgtggatccttttgttctggggatgaatgtgtgaactgggtttggtaatttaattgagttttgatgatatcagctgtgtgatccacactagtagggcttgtcattgatgattctttgtcttcttttcatatattgcttatccatcacctaatactctatttggcagcacactttgcacttgcatttataatattataatctt

SEQ ID NO: 4039 - DNA, 465 bp, Cucurbita pepo
ccgcacaagcttcttccttgatcgtcttccatctcttgctctcaggaatggagtcacagatcaagcatgctgtggtagtgaaagtaatgggtagaactggatccagagggcaggttactcaagtgagagtcaaatttattgatgatcagaatcgttacattatgaggaatgtaaagggacctgtcagggaaggcgatattcttaccctactcgagtctgagagggaagctagacggttgcgttgatggagaattgcagttgcttccattgattttgcctctttgtaagtgtggatcctttgttctgggatgaatgtgtgaactgggttggtattattgagtttgatgatatcagctgtgtgatccacactataggcttgtcattgatgattctttgtcttcttttctatatattgcttatccatcacctaatactctatttggcagcacactttgcacttgcatt

SEQ ID NO: 4040 - DNA, 594 bp, Euonymus alatus
tataactctaaaactagggttaggttttcctctcaacaactgcaacgaagaagaagcggcagcctctctctctgtactgtttccgctctctcccagtctctcagtatggattcccaaatcaagcatgctttggtggttaaggttatgggccggacaggttcaagggggcaggtcacccaggtgagagttaagttcattgatgatcagaatcggtttatcatgaggaatgtgaagggaccagtcagggagggcgatatcctcactctgctggagtctgagagggaagctagaagactccgttgatggatccacctttttagctcttatcaattggtgattggagtttgctcctcactgaaaatgtgtgttttgttggttaccagttttgcgaatgtcgtgagtactctagtagtttaattttttcctgggataaggcactcatttcttaagaaacggtcgcatgttatggatgtttcaatttaatattatgtttcagaagtacttgagtttgccttcttgtttggattgcctcatcctgaggaggtgcaattggtggttgaaggttttatatttgatgaaatggatttagaatca

SEQ ID NO: 4041 - DNA, 518 bp, Humulus lupulus
aaaagcctcctaaactcattttttttcattcaagcttcaacgtttccggttcgctcagccgccgcctctccgcgaacgacgaccagtttttgaagcgggagaatggattctcaggtgaagcacgctgtggtggtgaaaattatgggccgaactggttcaagaggacaggtgactcaagtgagagtcaagtttcttgatgaccagaaccggttcatcatgaggaacgtcaagggaccagtcagggaaggtgacattctcaccttgctcgagtccgagagggaagctaggaggttgcgttgatggggatctttcctcgtgttgctttcttgctctttctttttgcagtcttgttttgctcagatacaaatttaactttgtgttagtgaatgggagggggagaccataatcagtccatgtctagtttagttttatgtttggtattactgttattagcatctcagagttttgatttattaaggtaaaatctattcgtggaacctgaaatgttttgaattgtc

SEQ ID NO: 4042 - DNA, 685 bp, Humulus lupulus
tttctcgctcattatatttcattgaagcttctacgttaccggttccctcagccgcctctcctctccacgaacgccgagcagttttttgaagcagtaggaggatggattctcaggtgaagcacgccgtggtggtgaaaattatgggccgaactggttcaagaggacaggtgactcaagtgagagttaagtttcttgatgaccagaaccggttcatcatgaggaacgtcaagggaccagtcagggaaggtgacattctcaccttgctagagtccgagagggaagctaggaggttgcgttgagggggatctttcctcgtgttgctttcttgctctttctttttgcagtcctgtttcgctcggatacaaatttatctgtcagtttagtgaatggaagggggagaccataatcagtccatgtctgtttagttttatgtttgggacttactgttattagcatctcaaaattttgataatttcgatttattatggtgaaatcaatgtgtggattctgaaatgctttgaattgtcagtgtgaaaaaagaactttctttttttaatcaaattgataggctttgccttctttacaattgccttcctcattttggcctctttagatgggtgctaaaaaaatgtttattttggttgattaaattgtacgtattctacaaaagattatatagaaccat

SEQ ID NO: 4043 - DNA, 407 bp, Humulus lupulus
ttcgctcagccgccgcctctccgcgaacgccgaccagtttttgaagcgggagaatggattctcaggtgaagcacgctgtggtggtgaaaattatgggccgaactggttcaagaggacaggtgactcaagtgagagtcaagtttcttgatgaccagaaccggttcatcatgaggaacgtcaagggaccagtcagggaaggtgacattctcaccttgctcgagtccgagagggaagctaggaggttgcgttgatggggatctttcctcgtgttgctttcttgctctttctttttgcagtcttgttttgctcagatacaaatttaactttgtgttagtgaatgggagggggagaccataatcagtccatgtctagtttagtttattgtttggtattactgttattagcat

SEQ ID NO: 4044 - DNA, 519 bp, Citrus sinensis
ccaacaaatctagggtttttcgctccgttgcaagaactgctgaaagaaattagcagccgcttctgtcaccttctctctcttctcgcctcttcgctcagaatggattctcagattaagcacgctgtggtggtgaaagtcatgggccgcactggttcaagaggacaggttactcaagtgagagtcaagtttttagatgatcagaaccgattcatcatgaggaatgtgaagggacccgttagagaaggtgatatcctcactttgctcgagtctgagagagaagctaggaggctccgttgaagagtccatctctggtcatactatctcaaactttttgttggaaactagggttcattactgttgtttttagtaggctagtgattggcaatgttatgagtttcacaacttattttgaaggttttcatattaagactgggttttgagccatgaattatatgttttgggatgtttaatatcgttctctttgaaatggagttaaatttgctttaaataattcttgtt

SEQ ID NO: 4045 - DNA, 701 bp, Sarracenia psittacina
caaccttcttgtcctcccctctcggattcgaggagggtaagaacgtgccttcccatcccagttcccaaacaaaagccctataatataatcgaattagggtttcgcctttcccattcgatcgcaaaccaaagcagcttctctccagccgccgctcatcctctctttctgcctctcattatctacgatttagttcgaatggagtctcagatcaagcatgctattgtggtgaaagttatgggtcgcacaggctcgagggggcaggtgactcaggtgagagtcaagtttgttgatgatcaaaacaggcatatcatgaggaatgtaaagggccctgtgagggaaggagacgttcttaccctcctcgaatccgagagggaggcaagaaggttgcgttaagtgctttacattcgttcctaatcattttacccccccaggttttgatttgcttcctatttaactttgcacttctttcacacacaatgcttcaataactatatttagattcaagaatgttgtatctgggtggtggagttcactgaaatgcttgaagttctttatttattttgggtgtttgttaaaagacaattttagtatggttggattttgttagatgctttcccatggtatggttggattttgtagatgctttcggttcatctatatgcttgagaggctattaagttgtttatttatttgtgggtgtt

SEQ ID NO: 4046 - DNA, 643 bp, Sarracenia psittacina
tcgtctgcgccaactctcctccctcccccgtcgttgtctctaaagtcaagaatggagtctcagatcaagcatgccattgtggtgaaagttatgggtcgcacaggatcaagggggcaggtgacgcaagtgagagtcaaatttgttgatgatcagaacaggcatatcatgaggaatgttaagggcccggtcagggaaggggatgtgctcaccttgctcgagtctgagagggaggctagaaggttgcgttgatctctttgcatcccttcaggttttaacaaagtcttctttgtgctttgttatctatatgttatatttatgccgctgtgtcttgggatgggtattggggacttatccaatgctattaatttttttatcttttctttttctttgtgtggttgaaaaacacaatttatttggtcgagttttgtcaagtgtttgaatagtttatgctttgggagacagtaatatgatctgagccatgttatttatttgtggaatttctgtttagcatccgctttgttcctggatctacaagtagctattagaagctgtaacccataataaggttactgcttggcgaaaacaataccagtgagagaggaatgtttgattaagcggattggattatatatacatggaatta

SEQ ID NO: 4047 - DNA, 640 bp, Sarracenia psittacina
atcgtctgcgccaactctcctccctcccccgtcgttgtctctgaagtcaagaatggagtctcagatcaagcatgccattgtggtgaaagttatgggtcgcacaggatcaagggggcaggtgacgcaagtgagagtcaaatttgttgatgatcagaacaggcatatcatgaggaatgttaagggcccggtcagggaaggggatgtgctcaccttgctcgagtctgagagggaggctagaaggttgcgttgatctctttgcatcccttcaggttttaacaaagtcttctttgtgctttgttatctatacgttatatttatgccgctgtgtcttgggatgggtattggggacttatccaatgctattaatttttttatcttttctttttccttgtgtggttgaaaaacacaatttatttggtcgagttttgtcaagtgtttgaatagtttatgctttgggagacagtactatgatctgagccatgttatttatttgtggaatttctgtttagcatccgctttgttcctggatctacaaagtagctattaaaagccgtaacccataataaggttactgcttggtgaagacaataccagtgagagagaggaatgtttgattaagcggattggattatatatacat

SEQ ID NO: 4048 - DNA, 576 bp, Sarracenia psittacina
aaagcagcttctctccagccgccgctcatcctctctttctgcctctcattatctacgatttagttcgaatggagtctcagatcaagcatgctattgtggtgaaagtaatgggtcgcacaggctcgagggggcaggtgactcaggtgagagtcaagtttgttgatgatcaaaacaggcatatcatgaggaatgtaaagggccccgtgagggaaggagacgttcttaccctccttgaatccgagagggaggcaagaaggttgcgttaagtgctttacattcgttcctaatcattttactcccccaggttttgatttgcttcctatttaactttgcacttctttcacacacaatgcttcaataactatatttagattcaagaatgttgtatctggtggtggagttcactgaaatgcttgaagttctttatttattttgggtgtttgataaaagacaattttagtatggttggattttgttagatgctttcccatggtatggttggattttgtagatgctttcggttcatctatatgcttgagaggtctattaagttgtttatttatttagtgggtgttt

SEQ ID NO: 4049 - DNA, 351 bp, Scabiosa columbaria
cgcctctttactccctttcttctcttcgctttgctgcaaactggtcgttcaactgcaatcgctctcctttgaagaatggaatcacaaatcaagcatgctattgttgtgaaggtaatgggtcgaactggatccaggggtcaagtgacccaggtgagagtgaagtttcttgatgaccagaaccgtttcatcatgaggaatgtcaagggccctgttagagagggtgatgttctaaccctgctagagtccgagagggaggcaaggaggttgcgttgaacccacctatactacatttatgctcttgtggttgaattgcttattagattgaattaatgtaactgagattgtggttcc

SEQ ID NO: 4050 - DNA, 348 bp, Scabiosa columbaria
ttttgactgttaatagccacagcaagcgaggaggtcctcacatctgatcgttttcacttttcgaatttcagtcctttaaaccagaatggaatcacagattaaacacgcaattgtggtgaaagttatggggagaactggatccagaggacaggtgactcaggtgagagtgaaatttctcgatgaccagaaccggttcatcatgaggaacgttaaaggaccagttagggagggtgatgttctcacccttctcgagtcggagagggaagcaagaaggctccgttgattcgaatgtttctttggcatttttcctttaaatgtctggtgttgtcagatacttgtttattttcc

SEQ ID NO: 4051 - DNA, 374 bp, Scabiosa columbaria
atcctcctttattgcattcgcctcttttctccttctccattctcaagctctctctgtgcttttgcagcattcaagcaggtcttcaactttcttcgctctcctttcaagaatggaatcacaaatcaagcatgctattgttgtgaaggtaatgggtcgaactgggtccaggggtcaagtgacccaggtgagagtcaagtttcttgatgaccagaaccgtttcatcatgaggaatgttaagggccctgttagggagggtgatgttctaaccctgctcgaatctgagagagaggcaaggaggttgcggtgaaaccaacctatacatctatgccttagagctttattttgcttatttaggctgaattaatgttatctag

SEQ ID NO: 4052 - DNA, 631 bp, Valeriana officinalis
tgctgctcatactctcattctctcctctttcattcttccagatcgatttgctgccctaactcgctttcagaatggaatcacagatcaagcatgctatagttgtgaaggtaatgggtcgaaccggatccaggggtcaggttactcaagtcagagtcaagtttcttgatgaccagaaccgtttcatcatgaggaatgttaagggacccgtcagagaaggtgatgttctgacattgctcgagtccgagagggaggctagaaggttgcgttgaagcaatctcatcgtattacatctatatgcgtgcggtggttttgtgggactgaaattcggttcttttttgaaattttgctaaagacttgttatgtgtttttaatgttgttatgctttgaatgtttgagatattattagtatgatgatattttagttgtgctttgttggaatcttttatcgagtatattctgtcttaaggtgtagaagaagactcgaacaaacatgattaaaagtggtagaaaataatatgaagtgcttgggagtaacggtcgatatggctagagagagagatttggagggagcgaatacgggtggatgtcatttgatacttatttaactattaatttatagtattatgatttt

SEQ ID NO: 4053 - DNA, 496 bp, Artemisia annua
aagcagtgatatcaacgcagtactccgacggggattcctttgcattttggagcttcaaccagcagcagcagcatcagcatcatatcataactctacggcaaggaagtgaaagatggaatctcaaatcaagcatgcggttgttgttaaagtgatgggcaggactggctcaaggggacaagttactcaagtgagagtgaagtttttggatgatcagaatcgatttatcatgagaaacgtcaagggaccagtgagagagggtgatgttcttaccctgctcgagtctgagagggaggccaggagacttcgttgatttctatgtcgttacttgcatttattatgtaaaactttcttttatgtttcaactttgctggatctagttttagacttttctgagttttacctaatgattaaatgccagactctgataagagtttcttgatgcagtactaaaattttcctgttacttgtgtgcttattaaattaatggattttgtgt

SEQ ID NO: 4054 - DNA, 430 bp, Brassica juncea
ccgatctcgctacataagcagccgctaccctgcgctctgctccgaccctcgtgttctcttagccaaggcctgatcagaatggattcccaaattaagcatgccgtggtggtgaaagttatgggaaggacaggatcaagaggtcaggtgactcaagtgagagtcaagtttttggatgatcagaaccgttacattatgaggaacgtgaagggaccggtcagggagggagatattctcaccctgctcgagtctgaaagagaagcaaggagacttcgttgattatccttttatcttgtgtgacattgttatcgatgttttgtggtattagctagttttttattttctgctgagttttgtttttacttttgaaagtggccaatctcatacctagacttggattttggtgagaatggttttacatggatgatttgcc

SEQ ID NO: 4055 - DNA, 425 bp, Phaseolus coccineus
ggactttggttagcaagcatcgcaaaaccctagcctactttcttcactcgttttttatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgata

SEQ ID NO: 4056 - DNA, 425 bp, Phaseolus coccineus
  misc_feature (6)..(6): n is a, c, g, or t
ggactntggttagcaagcatcgcaaaaccctagcctactttcttcactcgtcttctatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgata

SEQ ID NO: 4057 - DNA, 425 bp, Phaseolus coccineus
ggattttggttagcaagcatcgcaaaaccctagcctactttcttcactcgttttttatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccaggggcttgatttttgtggtagttagtggatgccaaaggttatatcaccctatcttgatgtttgggatctatttttattcgaattatggacggaattttgttgtttttagtctaagttttaagattgaagtatgattggcttgata

SEQ ID NO: 4058 - DNA, 424 bp, Phaseolus coccineus
ggattttggttagcaagcatcgcaaaaccctagcctactttcttcactcgttttttatttcaggatggactctcaggtgaagcatgctcttgttgtcaaagttatgggtcgtactggatccagagggcaggtgacccaggttagagtgaagtttttggatgatcagaatcgtcccatcatgaggaatgtgaaaggccctgttagagaaggagacattttccccctcctcgaatccgagagggaagcaagaagattgcgctagatggtttaaatcgaaacagtggcttgatttttgtggtagttagtggatgccaaaggttatatcagcctatcttgatgttttggatctatttttattcgaattatggacggaattttgttgtttttagtttaagttttaagattgaagtatgattggcttgat

SEQ ID NO: 4059 - DNA, 425 bp, Phaseolus coccineus
  misc_feature (391)..(391): n is a, c, g, or t
ggactctggttagcaagcatcgcaaaaccctagcctactttcttcactcgttttttatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgttttggatctatttttattcgaattatggactgaattttgttgtttttagtntaagttttaagattgaagtatgattggcttgata

SEQ ID NO: 4060 - DNA, 425 bp, Phaseolus coccineus
ggactttggttagcaagcatcgcaaaaccctagcctactttcttcactcgtcttttatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggactgaattttgttgtttttagtctaagttttaagattgaagtatgattggcttgata

SEQ ID NO: 4061 - DNA, 694 bp, Theobroma cacao
agtatgataatccgacggtcccaacatgcccaatcaaggaccaaccagccagcaatgatgcacctcaactacaccacgcataaattcccaaagccctaaagcaaatcctgaagtgaccataatacccaggttaagaaaccaaatccatgaacataacagtcttttccaaagacttgtcaatataaaccccaagtctagggcttttctctcaaaccagaaattcgctacagaagcagccgctaccctgcgctctgctccgaccctcgtgttctcttagccaaggcctgatcagaatggattcccaaattaagcatgccgtggtggtgaaagttatgggaaggacaggatcaagaggtcaggtgactcaagtgagagtcaagtttttggatgatcagaaccgttacattatgaggaacgtgaagggaccggtcagggagggagatattctcaccctgctcgagtctgaaagagaagcaaggagacttcgttgattatccttttatcttgtgtgacattgttatcgatgttttgtggtattagctagttttttattttctgctgagttttgtttttacttttgaaagtggccaatctcatacctagacttggattttggtgagaatggttttacatggatgatttgtcctaaatctttaattatgttgttgaatgaactaagttggttttgagatta

SEQ ID NO: 4062 - DNA, 487 bp, Centaurea maculosa
gcgggggagcgactatttataccttctagggttcttaccatctccactagtcgtcttctgaagtttgcagcagcagccgttctatcgatctctcaggtagtagtagtgaaagatggagtctcagattaagcacgcagtagtggtgaaagtgatggggagaactggatcgagagggcaggtgacgcaagttagggttaagtttctggatgaccagaaccgtttcatcatgagaaatgtcaagggaccagtcagagaaggtgatgttcttaccttgctcgagtctgaaagggaggccagaaggttgcgttgatttgatttctcacttattttcagacttgtttcaaatttatatttctctgttatgtggaactcgtttttgagacttgtttggtaaaatgttaaatgtatgacattatggtagcagatatctcttccagcttatggcatttgctgtcagattttgaatggagatttcagtaattcccta

SEQ ID NO: 4063 - DNA, 477 bp, Centaurea maculosa
accgcgcttcttcacctcttgcattctgtgtatcgatctccaaagttcctcgattgaaagatggagtcccagatcaagcatgcagttgtggtgaaggtgatgggaagaaccggatccaggggacaggttactcaagttagggtgaagtttctggatgatcagaaccgtttcattatgaggaacgttaaaggaccggtcagagaaggtgatgttcttaccttgctcgaatccgagagggaggccaggaggctgcgctgatttcgccttcttcgcaaaacctctggttctatttttaacattattcgtcgttacttcagagccatgtttgaatttggaacttcgtgattgctacatgtttgttttgattttgataagatatgatttagagtaattttgtgtttgaggtccaaaatttcatttctgtttggtgtttttcttatatcatttactttttgaatggatagttgatccaatgac

SEQ ID NO: 4064 - DNA, 420 bp, Cichorium intybus
gagcttccaccatcgccggtactcgttgggcgcgcatacgcaaggttgaaatttgaaagatggagtctcagatcaagcatgcagtggttgttaaagtgatgggtcggactggttcaagagggcaggttacacaagtgagagtgaagtttctggatgatcagaatcgatttatcatgagaaacgtgaagggaccagtgagagagggtgatgttcttaccttgctcgagtctgagagggaggccaggaggcttcgttgattttcattgctcatgtaaaaccttttgtttccatttcaaattttggtggatctattttattaagactttactttagtttcttattggtcaaatctctagtggaatttaatcttaatggctactttgggattgcttgaatttatagttattgcaactttcttct

SEQ ID NO: 4065 - DNA, 497 bp, Citrus sinensis
gctccgttgcaagaactgctgaaagaaattagcagccgcttctgtcaccttctctctcttctcgcctcttcgctcagaatggattctcagattaagcacgctgtggtggtgaaagtcatgggccgcactggttcaagaggacaggttactcaagtgagagtcaagtttttagatgatcagaaccgattcatcatgaggaatgtgaagggacccgttagagaaggtgatatcctcactttgctcgagtctgagagagaagctaggaggctccgttgaagagtccatctctggtcatactatctcaaactttttgttggaaactagggttcattactgttgtttttagtaggctagtgattggcaatgttatgagtttcacaacttattttgaaggttttcatattaagactgggttttgagccatgaattatatgttttgggatgtttaatatcgttctctttgaaatggagttaaatttgctttaaaaaaaaaaaaa

SEQ ID NO: 4066 - DNA, 592 bp, Cynara scolymus
  misc_feature (342)..(342): n is a, c, g, or t
gcggggatgtcgtcattctgaaatttgcagcagcagccgctctatcgatctcacgtacgcaagctagtgaaagatggagtctcagatcaagcacgcagtggtggtgaaagtgatggggagaactggatccagagggcaggtgacacaagtgagagtgaaatttctcgatgaccagaaccgtttcatcatgagaaacgtcaagggacctgtcagagagggtgatgttcttaccttgctcgagtctgagagggaggctagaaggttgcgttgatttcacctattttctatattcacaagttcgtgtttcaatttttctgttatgtggtactcgtttttgagacntgtttgagtgcgagacttggtaatgttaaatgtatgacatttgcgtttacaagtaaacttttgatctgtctagttatggtagaaggttttacttccagcttatgacctgtgtcgtcagattttgaatggagatttcatcaattctgcaattgtttatgatgagctcagctgcacaccatatgtacagaattctccaagatgcacatgtcattgacactttttcacaaagccaattacttcagaattgtag

SEQ ID NO: 4067 - DNA, 475 bp, Taraxacum officinale
cggggacaatcttttattcgatcagagcagccatccaacaatctctaagatcacagtgaattaaagatggagtcccagatcaaacacgcggttgtggtgaaagtgatgggaagaactggatcaaggggacaagtcacgcaggtgagagtgaagtttctcgatgaccagaatcgtttcattatgagaaacgttaagggacccgtcagagagggcgatgttcttacattgctcgagtcggagagggaggctaggaggttgcgttgatttcttcactgcattatcgtcttcaaaaacactggtttaatttgaacttttgaggtttgtttatgtttaagacttggttctgagaagatatgattagagtaatctgtgttttatgagttttgtatcattactcttttagtagagaatcgattcaatggtagatcattaatttgggatcattggttctataaagctgttacttcgtattcca

SEQ ID NO: 4068 - DNA, 484 bp, Taraxacum officinale
gcgggggtgataccagtcttctgaagttcgaacgtgcagctgctctctcgatttctcgccttcaccagctagggaagtatggagtctcagatcaagcacgccgtggtggtgaaagtgatgggaagaactggatccagaggtcaggtgacacaagtgagagtaaagtttctggatgaccagaaccgttttatcatgagaaacgtcaagggacccgtcagagaaggcgatgttcttaccttgctcgagtccgagagggaggccagaaggcttcgttgatttccttacctattttctatatttgtaagcccttcgttttgatttcaatattatgcgaaactcgtttttgagacttgtttgagtgcgcaaaaacttgggaatgttcattctggtatttgagtttagaattaaacttttgatccgccatgttagggttcgaggttcttcgttgccagatttggattattcatctattgcgtaattgtta

SEQ ID NO: 4069 - DNA, 381 bp, Gerbera hybrid cultivar
gcgtctctcgggcacgcgtaaccaagcaagggagagatggagtcacagatcaagcatgcagttgtggttaaagtgatggggaggactggttcaagagggcaggtgacacaagtgagagtgaagtttctggatgatcagaatcgatttatcatgagaaacgtgaagggaccagttagagagggtgatgttcttaccttgctcgagtctgagagggaggctaggaggttgcgatgattttgatcatgtaaaaccttctcactttatttcaaagtttgttggatttagttttaagacttgtctgttaaatgcctgactttgataagagaattcattagtgtaacttgatcttttaatttatggttgttgtaagtttcaaaaaaa

SEQ ID NO: 4070 - DNA, 438 bp, Gerbera hybrid cultivar
atcacgtaagcgagtgaaagatggagtctcagatcaagcacgcagttgtggtgaaagtgatgggaagaaccggatcgagagggcaagtgacgcaggtgagagtgaagtttctcgatgaccagaaccgttttattatgagaaacgtgaaggggcccgtcagagaaggtgatgttcttactttgctcgagtccgagagggaggccaggaggctccgctgatttcgcctcctcccgtcttcacaaaatctcaggttcgatgtttaattttggcgcttatttttgaaacttgttttagtttgaagacttcgtaatgctacatgattggttttgagaagatatgattcgagtactatgtgtgctttagggcaaaattttatcctattcggtgatttttacatcattgtgttaagcgttaaaatcaaaaaaaaaaaaaaaaaaa

SEQ ID NO: 4071 - DNA, 427 bp, Gerbera hybrid cultivar
cagctgcagccgctctaacgatctatcagtgaaagatggagtctcagatcaagcacgcagtggtggtgaaagtgatggggagaactggatcgagaggtcaggtgacgcaggtgagggtgaagtttctcgatgatcagaaccgttttatcatgagaaacgttaagggacctgtcagagaaggtgatgttcttaccttgctcgaatccgagagggaggccaggaggctgcgttgatttcatctctttcttttgtttcaatcttcttattatgatcattcacttgtttgagtgtaagacttggtaatcttaaacgtttggcttttgatctgttttgttatgttagcatgctttttctcctaatttagtgacttatattgtcagattttgaatggagaatggattcattgcgtaaaaaaaaaaaaaaaaaa

SEQ ID NO: 4072 - DNA, 500 bp, Actinidia deliciosa
caacgaccctctctgcggcggcctctctctctctgtctctctgtctctctctctctgaaacagaatggagtctcagatcaagcatgctattgtggtgaaagttatgggtcgcaccggatcaagggggcaggtgacccaggttagagtcaagtttcttgatgatcagaatcggtacatcatgaggaacgttaagggcccagtcagggaaggggatgtgctcaccttgctcgagtctgagagggaggcaagaaggttgcgttgatcacattactcttttgtgccctccaggttgctatgtaacccagtcttgtcatgacattgcaaactttatgctttgatattaagttttgttgtggttgaaaaagatagtttccgagtttgattaaatgtttggatgtctatgcttgggagacagttaattgttacgagtaatgttatttgatttatcagatttttggttagtattgcgatgtggtggtcgcaggtagtaaaaaaaaaaa

SEQ ID NO: 4073 - DNA, 507 bp, Lactuca sativa
atctcctcattcgttcgggagcagccgtccatcaatccctagaactgcatcagcgagtgaaagatggagtcacagatcaagcacgcggtagtagtgaaagtgatgggaagaaccggatcgagaggtcaggtcacacaggtgagggtcaagtttcttgatgaccagaaccgtttcattatgagaaatgtgaagggacccgtcagagaaggtgacgttcttactttgcttgagtcggagagggaggccaggaggctgcgttgatttcccaccttattctcaacttttgaggtttgcttaagttttcgattttgttcttacaagatatgatttgagtaatatgtatttgagggccaactattttcatctcttctatgatttttacatcattactcctgtaatagacagttgattcaatggtagatcaatgcgaatcttgggtttattttttttcgaacaccttgtatttttacattaatggtagtgccaaggtcatatttttctatgtta

SEQ ID NO: 4074 - DNA, 464 bp, Lactuca sativa
actcattcaatcttttgcagccgctctatcgactctaacgcacggcagcttctgaaagatggagtcacagatcaaacacgcagttgtagtgaaagttatgggaagaactggatcaagaggtcaagtgacacaagtgagggtgaagtttcttgatgatcagaatcgttttatcatgagaaacgtcaagggacccgtcagagaaggtgatgttcttaccttgcttgagtccgagagggaggcaagaaggttgcgttgattttttttttttttttttgacctaattttcatattcgtaaaccctcttcgttttgatttcgatgttatgtgagactcggttttgaaagttgtttgagtgaaatgatttggtaatgttaagtgttattgtatttgaatttagtagtaaacttttgagttttgatataccttgttagggttgcagattttgaatggagaattaatcaatt

SEQ ID NO: 4075 - DNA, 426 bp, Lactuca sativa
cgcgggggctttcagttgcgtttccaccatcatagagttccctttgcgcgaggttgaaatttgaaagatggagtcgcaaatcaagcatgcagtggtggttaaagtgatgggtaggactggttcaagagggcaggtgacacaagtgagagtgaagtttttggatgatcagaatcgatttatcatgagaaacgtcaagggaccagtgagagagggtgatgttcttactttgctcgagtctgagagggaggccaggaggctccgttgattagttaaccattcaagtcattagtcatatgtcagtcgtgtaaaccttttccaattttgctggatcttctacttcagacttacttgagagttgcttattgattcaatgtcagacttgttagtcttaaattcttcatagcaacttaactttgggcttttgct

SEQ ID NO: 4076 - DNA, 445 bp, Lactuca sativa
actcattcgcaactttgcagccgctctatcgactctaaacatccgccagctagtgaaagatggagtctcagatcaaacacgcagttgttgtgaaagttatgggaagaactggatcaagaggtcaagtgacacaagtgagagtcaagtttctcgatgatcagaatcgttttatcatgagaaacgtcaagggacccgtcagagaaggtgatgttcttaccttgctcgagtccgagagggaggccagaaggttgcgttgactttttttacctaattttcatattcgttaacccttttcgttttcatttcaatattatgtgagactcggttttgaaagttgtttgagtgaaatgctttgtattgtatttgaatttagaagtaaacttttgagttttgatcctccttgttagggttgcagattttgaatggagtattgattaatttcgtg

SEQ ID NO: 4077 - DNA, 442 bp, Lactuca sativa
atctcctcattcgttcgggagcagccatccttcaatctctagaactgcatcagcgagtgaaagatggagtcacagatcaagcacgcggtagtggtgaaagtgatgggaagaactggatcgaggggtcaggtcacacaggtgagggtcaagtttcttgatgaccagaaccgtttcattatgagaaatgtgaagggacccgtcagagaaggtgacgttcttactttgcttgagtcggagagggaggccaggaggctgcgttgatttctcaccttattctcaacttttgaggtttgcttaagttttggattttgttcttagaagatatgatttgagtaatatgtatttgaggcaaactattctcatctcatctatgatttctacatcattactcttgtaacagacaattgatttaatggtagatcaatgcacatcttgggtttat

SEQ ID NO: 4078 - DNA, 411 bp, Lactuca sativa
tttgctagttgcagtttcctgcttccaccatcacagagtaccatttgcgcgaggttggagtttgaacaatggagtcacaaatcaagcatgctgttgtagttaaagtgatgggtaggactggctcaagagggcaggtaacacaagtgagagtgaagtttttggatgatcagaatcgatttatcatgagaaacgtcaagggaccagtgagagagggtgatgttcttactttgcttgagtctgagagggaggccaggaggctccgttgattatttcacaattgaaatcattactcatatgtcatgtaaaccttttccaattttgcttcagacttacctgagagttgcttattgattaaatgccagacttattaatcttcaattcgtaatagcaacttagctttgggcctgcttt

SEQ ID NO: 4079 - DNA, 465 bp, Lactuca sativa
atcaatccctcattcgttcgggagcagccatccatcaatctgtagaactgcatcagcgagtgaaagatggagtctcagatcaagcacgctgtcgtagtgaaagttatgggaagaactggatcgaggggtcaggtcactcaggtgagagtgaagtttcttgatgaccagaaccgtttcattatgaggaacgtaaaaggacccgtcagagaaggtgacgttcttaccttgctcgagtctgagagggaggccaggaggctgcgttgatttctcactttattctcaacttctgaggtttgcttaagttttggatttggttcttagaagatatgattagagtaatatgtgtttgaggacaaaaaaaatttcttcttatctatgatttttacattattactcttgtaatagacaattgaacaccttgtgttttgactttcatgtaatttcaaggtcatatttttctattcg

SEQ ID NO: 4080 - DNA, 521 bp, Lactuca sativa
gcgggggcggcgtggtattttcattcccccgtatataaattaaatctttagggttcttcgatcacaactcattcaaactttgcagccgctctatcgactctaacgcacagcagcttctgaaagatggagtcacagatcaagcacgcagtggtggtgaaagttatgggaagaactggatcaagaggtcaggtgacccaagtgagggtgaagtttcttgatgatcagaatcgttttatcatgagaaacgtcaagggacccgtcagagaaggtgatgttcttaccttgctcgagtccgagagggaggcaagaaggttgcgttgattttttttttaaactatttttcatattcgtaagctttcttcgttttgatttcgttgttatgtgagactcggttttgaaagttgtttgagtgaaattatttggtaatgttaagtgttattctatttgaatttagaagtaaacttttgagttttgatataccttgttagggttgcatattttgaatggagaattcatcaatt

SEQ ID NO: 4081 - DNA, 455 bp, Liriodendron tulipifera
  misc_feature (279)..(279): n is a, c, g, or t
gaagtggaagacgatcagacgctctctctctccatcgctctctagaaatggattcacaggttaagctggcagttgtggtgaaggtgatggggaggactggatctagggggcaggtcacccaagttagggtcaagtttctggacgatcagaaccgtctgatcatgaggaacgtgaagggacctgtccgggaaggcgacattctcaccttgctggagtcagagcgtgaggcaaggaggcttcggtgattgcctttatctgatgtgtgcccctccgtttatnccatggcttgctggaattttggtacttcataagatcgtgttcctatatattagtattagcatttttgaactacactctgtttcagttttgaatatttgttctctctcttcctttctttctaaaggattcaatttgaatttttgttgacttatcaatgcatttttaatattactagc

SEQ ID NO: 4082 - DNA, 420 bp, Liriodendron tulipifera
tgtctctaagcttgcagaatggattctcaagtaaagcttgcagtggtggtgaaggtgatgggccgcacaggttcaagaggacaagtgactcaggtcagggtcaagttcctggatgaccagaatcgactcatcatgaggaatgtgaagggccccgtcagggaaggcgacatccttaccctgcttgagtctgaaagggaagcaaggaggttgcgctgagcaaggttttgttccctgatgatctatggttttgttaggtttgtttttcattcatacgttctattgagctttctgaaatgcttttgacatgggtatgttagagagagagagagagtgatggctgagatggaaaagcctaggatttgggatgatataagctagacttgtttgcaagaatggttatttttactatttggttcttat

SEQ ID NO: 4083 - DNA, 537 bp, Nuphar advena
  misc_feature (415)..(415): n is a, c, g, or t
  misc_feature (459)..(459): n is a, c, g, or t
  misc_feature (466)..(466): n is a, c, g, or t
gtctgtctcttgccgaaggagagcggctccattgcttgtgcggtttcttccgttagagagaggcaaaatggactcccaagtcaaactggctgttgttgttaaagtgatgggacgaactggttcccgagggcaagtgactcaggtcagagtcaagtttttggatgaccagaatcgtctcattatgaggaatgttaaagggccagttagagaaggagacattctcacccttctcgagtctgaaagagaagcaaggaggttgcgctgatgctggtgaattgcttgatttatatctgcactgcagtatagatatgaatgtcaatttttaagagatgtgtctctgtccaaattctggcacagagtgccatttgaactattactttcgcactttattgtgttaatggcttcagtacactanattggggacctttttctaattctcaatttgtcgctttattcaanttgctantactttttggcttgtgctgcattttagttgattgctattggtaatttgctagcctgtgaaaagtggtattt

SEQ ID NO: 4084 - DNA, 545 bp, Prunus persica
acgcacgcattttttttctctccttgacgcagccgcgcactccttctcgtcacttttcctttgaagactctctctctaccaaagaatggactccactgtgaagcatgctgttgtggtgaaagttatgggccggactggatctcgtgggcaggtgactcaagttagagtcaagtttctggatgaccagaaccggttcatcatgaggaacgtcaagggaccagtgagggagggggatatccttaccttgctcgagtctgagagggaagctagaaggttgcgttgatcagagatggctcttgtttgttgatgcttgaacttcgaagttttggttacttgcaagcaactgttgtttatgttgatgaatggcagttgtgttgccaatctctgttcgtattttttttagtttatgtgtcttggtatttactagcaacgtagacttgattgttctgatgtgagttctttatcgaatcttgctaaacttctatgtcggaaaaaagccctaggttttgtttgaacaagtaacaaatattcctggtttctgtgtc

SEQ ID NO: 4085 - DNA, 568 bp, Prunus persica
ctctccttcacgtttcaagctacacgcagacgccgccaccatccctcctctcaccttctcaatctgatcggtttttccattgaagaaacctgtgactaagacctctccactgaaggtgacgaatggaatccacgatcaagcatgctgtggtggtgaaagttatgggtcggactggatctcgagggcaggtgactcaagtgagagtcaagtttctggatgatcagaatcgtttcatcatgaggaatgtcaagggaccagtgagggagggggatatccttaccttgctcgagtctgagagggaagccagaagattgcgttgataggagatgggtcttcttcgctgatgcgtttacttctcagcttcggttagttgcaaacaactgttatttatgctactggtgaactgcagttacgttgcaaatcactattcttatatttttagtttatgtttagcatcacgaacttggtatatggaaccttttaaacttctatttctgaaaatccttaggtttggttgaacatgtaggcccaatggacatcatcttggctaataattcaataatatttc

SEQ ID NO: 4086 - DNA, 487 bp, Prunus persica
ctcctcgacgcagccgccattaccatctcctctttccctctccctcttccattgaagaaggctgtgactgtgagactctctctaccaaagaatggactccactgtgaagcatgctgtggttgtgaaagttatgggtcggactggatctcgtgggcaggtgactcaagtaagagtcaagtttttggatgaccagaatcggttcatcatgaggaatgtgaagggaccagtgagggagggggatatccttaccttgctcgagtctgagagggaagctagaaggttgcgttgatctgagatggtctcgtttgttgatgcttgaacttcaaagttttggttacttgcaagcaaccgttaattactttttaagtttatcagtagcatcgtagacttgattgtgtgatgagatttctttgtggaatctttcggaacttatgtaggttttgtttgaacaagtaacaaatattcctgcttgctgtgtcaaaccttt

SEQ ID NO: 4087 - DNA, 440 bp, Helianthus annuus
tctcttgcattcgctatttgaagcttcaacgaacacaagcgccacttgtacccgtcggccgcaaggaagtgaaggatggagtctcaaatcaagcatgcagttgtcgttaaagtgatggggaggactggttcaagaggtcaggtgacacaagtgagagtgaagtttttggatgaccagaaccggtttatcatgaggaatgtcaagggaccagtcagagaaggtgatgttcttaccttgcttgagtctgagagggaagctaggaggttgcgttgatcgtgtaaacctttcgcttttaatttttgcttttaagacttgctgatgtttatcgtcattgcattttgatcctagtagcaggtttgggtttacttaaatctgtatttgttttcttttgaatggattgaatttggagtatgtttgatgggtggatgatttatgtttga

SEQ ID NO: 4088 - DNA, 504 bp, Helianthus annuus
gtccgagagagaggctaggaggttgcgttgatttcgggggtcattcatcaggagcagccgcacattaactttgtgttctgttaatcaatctctgtaatcacatcagctggtgaaagatggaatctcagatcaagcacgcagttgtggtgaaggtaatgggcagaaccgggtcaagaggacaggttacacaggtgagagtgaagtttcttgatgaccagaaccgtttcatcatgaggaacgtgaaaggaccagtccgagagggtgatgttcttactttgctcgagtccgagagagaggctaggaggttgcgttgatttcggttgtcttgtcaatcatcattgcaatggttcagtttttactctcattttggtgttacttttgatgtttgttttgagttgcagacatgatgttttggttttgagaagatatgattagtgtaatatgtgtttcatcttttgaatgggtaattgattcagtagtaaaacactggatattaagtttatg

SEQ ID NO: 4089 - DNA, 419 bp, Helianthus annuus
cacctcgattcatcgtctctctgaaagtttgcaagcagcagcagccgctcatacgcagcagatggagtctcaaatcaaacacgcagtggtggtgaaagtgatggggagaactggatcgagaggtcaagtgacgcaagtgagagtgaagtttctggatgatcaaaaccgtttcatcatgcgaaatgttaagggacctgttagagaaggtgatgttcttactttgcttgagtccgagagagaggccagaaggttgcgatgatttcacttatttgttttttaagatttcatctgtttgaattttattgatcaaatgttaaaagggtatgctgaacccggttttacttggaagttatggttaatttaattgatcttgttccaagtaaaaccgggttcagcataaccttttaacatttgatcaa

SEQ ID NO: 4090 - DNA, 602 bp, Sarracenia psittacina
aaagcagcttctctccagccgccgctcatcctctctttctgcctctcattatctacgatttagttcggtgcgtttctctagttcgaatggagtctcagatcaagcatgctattgtggtgaaagtaatgggtcgcacaggctcgagggggcaggtgactcaggtgagagtcaagtttgttgatgatcaaaacaggcatatcatgaggaatgtaaagggcccgtgagggaaggagacgttcttaccctccttgaatccgagagggaggcaagaaggttgcgttaagtgctttacattcgttcctaatcattttactccccaggttttgatttgcttcctatttaactttgcacttctttcacacacaatgcttcaataactatatttagattcaagaatgttgtatctggtggtggagttcactgaaatgcttgaagttctttatttattttgggtgtttgataaaagacaattttagtatggttggattttgttagatgctttcccatggtatggttggattttgtagatgctttcggttcatctatatgcttgagaggctattaagttgtttatttatttgtgggtgtttgataaaagacaa

SEQ ID NO: 4091 - DNA, 425 bp, Phaseolus coccineus
ggactttggttagcaagcatcgcaaaaccctagcctactttcttcactcgttttttatttcaggagggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctccttgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgata

SEQ ID NO: 4092 - DNA, 424 bp, Phaseolus coccineus
ggactttggttagcaagcatcgcaaacccctaccctactttcttcactcgttttttatttcaggagggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgat

SEQ ID NO: 4093 - DNA, 418 bp, Phaseolus coccineus
tggttagcaagcatcgcaaaaccctagcctccttttttcattcgttttttatttcgggagggactctcaggtgaagcatgctcttgttgtcaaagttatgggtcgttctggatccagagggcaggtgacccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaacagtggcttgatttttgtggtagttagtggatgccaaaggttatatcaccctatcttgatgttttggatctatttttattcgaattatggacggaattttgttgtttttagtctaagttttaagattgaagtatgattggcttgat

SEQ ID NO: 4094 - DNA, 559 bp, Eschscholzia californica
acaaaactaagaaagccaagtgtagcgaggagccgctcaagcttgtttcttcatttcagatagaagctttctagagaaaagatggattcccaagtgaagctagccattgttgtgaagattatgggacgtactggatcaagaggacaggtgacccaagttagagtgaagttttttggatgatcagaaccgtttgatcatgaggaatgttaaagggccggttcgtgaaggtgacattctcacactcctcgagtctgaaagagaagcaaggaggcttcgatgaggttacatacatttctgtatgttatatgatacttgatatttataagttcgattggggttttgtgtttttgaagttagaaccattgtcatagtttgacaatttgaagtagtattttgttaaatggtgtcggctgtttacaatttttgtttcttgaaattgaagattgaagtttgatttgctatttggaaaaaactgagtgatattgtagtctttaaatacttgttgactgagctatcttgttttgagcttctcttataaataagatgtttctgttacatt

SEQ ID NO: 4095 - DNA, 466 bp, Zingiber officinale
  misc_feature (54)..(54): n is a, c, g, or t
  misc_feature (56)..(56): n is a, c, g, or t
  misc_feature (455)..(455): n is a, c, g, or t
  misc_feature (457)..(457): n is a, c, g, or t
tttctggagccttgataggagacaacgcccgagagaacaaagagcagcgaactncntcatggattctcaagccaagcttgcagtggtggtgaaggtgatgggccggactggatctcgaggtcaggttacacaagtcagggttaagttcttggatgaccagaatcggctgatcatgaggaacgtgaagggtccagtaagggagggcgatatccttactcttctcgagtccgagagggaggctaggcggctgcgttgatgttcctctacactagttttttaattagcttatttcaattgcactatggattgattggtcttgtcttttcaatttatgaaggatgtcggtgatgttttaaagcaatggcaattgaattggtagtgttctatgttggctgttttgcttgtctgtggacctaaatagttttggcttacgttgatgcttgtgtgctttaatntntttgatgtt

SEQ ID NO: 4096 - DNA, 403 bp, Nicotiana benthamiana
  misc_feature (355)..(355): n is a, c, g, or t
ccactccgccgctaactctcctcctctccagcaaaatcagcttctgtttctccgagggaatcaaagcaatggaatctgcaaccaagcatgctattgtggtgaaagtcatgggccgcacaggatcaagagggcaggtgactcaggtgagagtcaagttcttagatgaccagaaccggtttatcatgagaaacgtcaagggaccagtcagagagggagatgttctcacacttctggagtctgagagggaagccaggaggttgcgctgagtgtttcatttgttctagagatggttttgattaccttgatactatgataactatcgtttcagtcctttaagaaaaatgcttggtatcgntttcaggacctgtgttaagtgtgcagtaaccgttgagtaaaaaaaaaa

SEQ ID NO: 4097 - DNA, 540 bp, Carica papaya
ttctccatagcagcaaccgccgcatttctgcgttctcctcctctcttgcgatctcttgcgatctaaggcacaaaatggattctcaaattaagcatgctgtggtggtgaaagtcatgggtaggacaggatctcgaggtcaggtgactcaggtgagagtcaagttcttggatgatcagaatcgattcatcatgagaaacgtcaagggaccagtcagagagggtgatgttctcacccttctcgagtctgagagggaagctaggaggttgcgctgatggggttctttttgctgttaatgtatgctattaattctggttttgtttgctgctgtttttcgagtcttgttagttaatgccttgaggatttctttgtttagactcgatagtaacattgagattatatcaattggatatttaaacgtatggctttggtcatatttcatttttcccccattagtttctttctgcaatttccatgcctcaaattgtggtatcagatttatagattcaacatttaaatggaatgtgcacttttttttctcca

SEQ ID NO: 4098 - DNA, 2934 bp, Oryza sativa
ggactcgtctctttcctcgggctcaagcgctcggcggcggccggccgccggcggggtggcgcggccgaggcccgagggggaaggagacggcggcggtgtgtggcgtggccggtacgcctccatgccttatcggtgctcgtgttccttcgcgtcgaggagtggggaagcggctggagaaatggctctccggcttccggcggcgaggccgccatgttcgcctagatgattaacatcgttgagcccggcgttgctgtgttcgggagtcggggacatcagcagcggcggcgcttcgtctcccagatgggtgaagacagcaacaaacccatccccgtgttcatctgccctcttccatggtcattacctactctccatttatgcctggttcccctacatttgctctcattcgtcatgcaaattttcagattccttttagctttcttcctcgcagacctctcatcaggaggttctgttgggtggatggtgctgtaccctttgagctagagctccagagcgacagaagtaaggcttatcagaagaaactatagggcggaaagcaaacaaaaaaaactgtcacgttattgcattttttcagtcaggaaatgggcctgtcaatctcatacccgccagatgactacctgcctacggaagaggacacagaccagatgtttgttcggtctctcagctctgacaatctcagcaccattgagacctttgagtcaccaccggcattactcgactccctgagttcccaaaggcctatcataaaagaatcctttaacttcaaaaaaagtgagggtgatccatttcatgttgaaactacagtatccttgatgagtcctaaacccggcaaggagaagagttgcacccataaacgcactatcctaccaagatatgggtcaatggaatacttgccaccacattctccagtggttgggatgatcagcccgaagcaccaggccgcagcagtaagagtgcagaaggtatacaagagcttcaggactaggcggcaacttgctgattgcgctgttcttgttgaacaacgctggtggaaactgatagatttcgcactgctcaagcacaattcagtatccttttttgaggaggagaagccagaatctgccctctcaaggtggtctcgggctagaacgaaagctgcgaaggtaggtaaaggtctgtcgaaggatgaaaaggctcagaagctcgctttgcagcactggctcgaagctattgaccctcggcatcggtatggtcacaacctccattactactaccaacattggcttcactgcgaaagcaaacaacctttcttctactggttggatgtgggtgaaggaaaagacgtaagtatggaggaccactgccctagatggaagctgttgcagcaatgcatcaggtatcttggccctaaagagagggagttctatgaggtagtaattgagaacaagaaactgctgtacaagatgagccgcaagattgtcgacacttctgagggccccaagaattcgaaatggatcttcgtgttgagcacaacaagagttctatacattggcacgaagagcaagggcacattccagcactccagcttccttgctggtggagccacatctgctgccgggagactagttgtagataatggaatcctaaaggctgtctggccacatagcgggcactaccgtcctacggaggcaaacttccgcgaattcatgatgtatctgaagaagagaaacgtagatcttgccaatatcaagttgagcccatcagaagacgaagaggacgagtgtctcaggtccaggagtggccgctcccagctcgagccaaccgagccaggaaagcctgagaaggaagaagacgccacggccgacgacaatggcactaccaccgtggccgcgcaagccgcgccaccctccaccaccggcggtgagccagccacgccggtgatgaagaggtcatcctccggcaaccgcctgcagcgcaagcggccgccgaggctgacgctggacaagagccggctggccaagggcgtggcggagcaggacgccgggtcgttcggcgaccgcctggacttctgcaaggtgaacctgttccgcggcggcgaggaggcggaggaggcggtggtggtgccgcaggagaagatcctccgccggctcaactccaggatgaccatgaactcgtaccagctcgggaagcagctgtcgctccggtggaccaccggcgccgggccgcggatcggctgcgtccgcgactacccgccggagctccagttccgggtgatggagcagatcagcctgactccgcgcggcggcgccgggccactgaggctcgggtcgacggcgaccccccggcagagcccctgcgcgccgctcccgtcgccggcgccgctctacgccgccgccgggactcccacctcgctgctgcagcacggtgcagcctaaaagtccttactttgtgggcgtattcagagtttcagacagtataaaattcgagccaataaccaatccatgcatcaattcagctaatattatcgagcacaaccatgtcacattgcatcaagtgaaattcagctcagttatataaaacaaaaaatgcgagattgtcatcaggtctagagctcaaagacaatcagacaaccacagtacgacagacatgtctgaattcgtgcaagaaggttcagcgaagcctcctggcctccctctcggactcgagcaaggtgaggatgtcgccctctcgaaccgggcccttgacgttcctcatgatgagacggttctggtcatccaagaacttgactctcacctgggtcacctgacccctggagccggtacgccccatcaccttcaccacaacagccagcttcacctgggtgtccatgctgcacgaacaaacagcatattggttatcaatgtgagtggagtagatgctaccgcgaatggttggttg

SEQ ID NO: 4099 - DNA, 505 bp, Secale cereale
ttgcgcccgcgccgccgcctccgtcgttgtagcagaagcaacgaccccccgtcgccaaccagctgaacaaagcatggatacccaggtcaagctcgcagtcgtggtgaaggtgatgggccgcaccggctccaggggtcaggtgacccaggtcagggtgaagttcctggatgaccagaaccgtctcatcatgaggaacgtcaagggccctgttcgtgagggcgatatccttaccctgctcgagtctgagcgggaggccaggaggctgcgttgagcggttgcttttcctgtcttcagaagaaatctctactgcatttgaatcaacttcttgaacgctgtctttgtcctttgcctaggctatggaaatgtaaccagtacttaataggttgcagttttcttctgttgcctgaattaaagtgcacttgatgttgtgagacttgatcatccttgggcacctctggcttatttggattgattggatgaattatatattgtaccctatgttttg

SEQ ID NO: 4100 - DNA, 429 bp, Euphorbia esula
  misc_feature (9)..(10): n is a, c, g, or t
aatctgcgnncgtctgctgctctttctctcggcgttcttctatctcattcgtcaaggatggattcgaccattaagcatgccttggttgtgaaagttatgggccgtaccggatctcgggggcaggtgactcaagttagagtcaagtttcttgatgaccagaaccggttcattatgaggaatgtcaagggaccagttagagaaggggatgtcctgacccttcttgagtctgagagagaagctaggaggctccgttgatcgctctatacatgtccttgttttggggattctctcggaaaatgttattatgtttattttttctttgatgcaaagaagacttgattagggattattatcttgctggtagggcttctaattttggagtatgaaacaaccctaatttgaacttaatgattttgtgtgttctcgtgc

SEQ ID NO: 4101 - DNA, 515 bp, Triticum aestivum
ccacgcgtccgcgactgcagcacgaggacactgacatggactgaaggagtagaaactcttctctcccccctccctgcgccgccgcctccgtccgttgtagcagaagcagcttgcgccgcctcctccgtcgtcccatccccaacagccgaagaaagcatggacacgcaggtgaagctcgcggttgtggtcaaggtgatgggccgcacggggtcgaggggtcaggtgacccaggtgagagtcaagttcctggatgaccagaaccgtctcatcatgaggaacgtcaagggacccgtccgtgagggggacatcctcaccctgctccgagtctgagcgggaggccaggaggctgcgctaagaaatttcttcctttatacctgtctgtcttcgggaagaagaatgctgtactgttgccttcttagtctactgctttcgttatttgcctaactatgtggaggtgtaatgagtcctgttctgttgcctaaattaaagtgcacttgatgttgtgagacttgatc

SEQ ID NO: 4102 - DNA, 234 bp, Malus domestica
ttattttgttttccgcgaagaatggaatccacgattaagcatgctgttgtgatcaaggttatgggacggactggatctcgtgggcaggtgactcaggtgagagtcaagtttctggatgaccagaaccgttttatcatgaggaatgtcaagggaccagtgagggagggggatatccttaccttgcttgagtccgagagggaggcaagaaggttgcggtgatcaatcagagattgt

SEQ ID NO: 4103 - DNA, 346 bp, Arnica chamissonis
tggaatctcagatcaagcacgcagtggtggtgaaagtgatggggagaaccggatcgagagggcaagtgacgcaggtgagagttaaatttctggatgatcagaaccgtttcatcatgagaaacgtcaagggacccgtcagagaaggtgatgttcttaccttgcttgaatctgagagggaggccagaaggctgcgttgatttgtttcaacttttatatctatttgagtgataatgctagatgtttgctacttttgatctgttgtggtagcatgtttatttgtcagaatttgaatggagaattgatcaaatgtcatatcagcatgctgaattgatttatggacaacttt

SEQ ID NO: 4104 - DNA, 677 bp, Cannabis sativa
cggactatataaagttataaagcaagggaaacaaaaccctagaagaagaagccgatctcctaactctctcggttttctcttaccaaactaaattagtggtggctgccactctctttctctaagtcgacggcgaagacaactatagtcggacgagaatggattcgcagataaaacatgctgtggtggtgaaaataatggggaggacaggatcaaggggtcaagtgactcaggtgagagtcaagtttctggatgatcaaaatcgtttcatcatgaggaatgtgaagggacctgttagggaaggcgatattctcacccttctcgagtccgagagggaggctagaaggttgcgttgatcatcttcttcatcatcgacatcgtcatcatgtttcttaattatcatgaatgattctctccttttacctgtattttttcaacctttcgttttcgtaatgcttacttgaattgatcaggactatgtttaatttagttttatttttctgtgttgggtagtacattgggttttgataagtttagagtgtgcacttttgaaagtgaattcctatatatgaatcgaaaggctgattgttcacttggcattgcatttcagtaaacaaattttaaagttggatggcaaattttagtttacatgataattcttttaaaatactagttaaaat

SEQ ID NO: 4105 - DNA, 639 bp, Cannabis sativa
ccggactatataaagtcataaaccaagggaaacaaaaccctagaagaacaagccgatctcccaactctctcggttttctcttaccaaactaaattggtggtggctgctactctctttctctaagtcgacggcgaagacaactatagtcggacgagaatggattcgcagataaaacatgctgtggtggtgaaaataatggggaggacaggatcaaggggtcaagtgactcaggtgagagtcaagtttctagatgatcaaaatcgtttcatcatgaggaatgtgaagggacctgttagggaaggcgatattctcacccttctcgagtccgagagggaggctagaaggttgcgttgatcatcttcttcatcatcgacattgtcatcatgtttcttaattatcatgaatgattctctacttttacttttattttttcaaccttttgtattcgtaatgcttacttgaattgatcagaactatgtttaatttagttttatttctctagtacattgggttttgataagtttagagtgtgcactttgaaagtgaattcctatatatgaatcgaaaggctgattgttcacttggcattgcattttagtaaacaaattttaaagttggatggcaaattttagtttacat

SEQ ID NO: 4106 - DNA, 472 bp, Ricinus communis
ttttgttagctttgttcagtgggtatttgtttcatagcttagaccttgactcttgtagagaatgatttgtttggaatttggatgtgtaatgaagttgtctcagacctgaacttgggagttcttgcaggatggattcacaaattaagcatgctgttgtggtgaaagttatgggtaggactggatccagaggacaggtgactcaagttagggttaagtttcttgatgatcagaatcgattcattatgaggaatgtgaagggacctgttagagaaggtgatgtgcttacccttctcgagtctgagagggaagctaggagactccgttgattgctctgctcttgcttgcataatcagtctagagaaattggcgttgttgtcattagcttttcttcatatggtttatatcaggacttgagttctgatttatggcttgtaatgtgactaattaacaaaattttgaagtatgagaaaaa

SEQ ID NO: 4107 - DNA, 528 bp, Euphorbia peplus
tgttcttcgtttccctgtctatctttttcgtccaggatggattcaacaattaagcatgctttggtggtgaaagtgatgggccgtactggatctagggggcaggtgactcaagttagggtcaagtttcttgatgaccagaatcggttcattatgaggaatgtgaagggaccagttagagaaggtgatgtgctaacccttcttgagtccgagagagaagctaggaggctccgttgattggtctatacttgtcctttttgtttttgattctgtggttttggtggcagtacaaggctggttttgatatggtaggctagaggaatttgattatggttcattgtgagattttgttatatgttctttatgttatcttttatgctataagacttgattacggatcatcctcttgttagtgcttgaactttttggagtatgaaagagccaaattgtactctttatggttttgcttttggtatttatgtactatccacccaaattatggccaacaacctaaatataaaaaattcctgc

SEQ ID NO: 4108 - DNA, 459 bp, Euphorbia peplus
cgtttccacctatcttcttcgttctcaagatggattccacaatcaagcatgctttggtggtgaaagtgatgggtcgtaccggatccagggggcaggtgactcaagttagagtcaagtttcttgatgaccagaaccggttcatcatgaggaacgtgaagggaccagttagagaaggtgatgtgcttacccttcttgagtctgagagagaagccaggaggctccgttgatcggtctatgccttgttttgatttcatggacttcagtgaaaattaaaaaatgtttgtgttgtttatgttttctttgatgcaagtaagacttgattagggattatgttgcttgtagtgcttgaaaattttggagtatgaaagacctaaatttgacttaatatattgatcttgattgttgaaatacttgtattatcatcaagctatttgggatgttacatggttgagttcatgc

SEQ ID NO: 4109 - DNA, 416 bp, Euphorbia peplus
ctgctgctctttctctcggcgttcttctatctcattcgtcaaggatggattcgaccattaagcatgccttggttgtgaaagttatgggccgtaccggatctcgggggcaggtgactcaagttagagtcaagtttcttgatgaccagaaccggttcattatgaggaatgtcaagggaccagttagagaaggggatgtcctgacccttcttgagtctgagagagaagctaggaggctccgttgatcgctctatacatgtccttgttttggggattctctcggaaaatgttattatgtttattttttctttgatgcaaagaagacttgattagggattattatcttgctggtagggcttctaattttggagtatgaaacaaccctaatttgaacttaatgattttgtgtgttctcgtgc

SEQ ID NO: 4110 - DNA, 463 bp, Euphorbia peplus
ggaatcccatatcaagcatgctgtggtggtgaaagtgatgggtagaactggatcaagggggcaagtgactcaagtgagagttaagtttctagatgatcaaaatcgttacattatgaggaatgtcaagggaccagtgagggaaggagatattcttaccctgttggagtctgagagggaagctagaagattgcgttgatggggattctttcaaggtcccagttttccagtttgcagttgctgaaagttatccttttagttttaatcttacctacaaatagaatggctgttatcatttttccctattttatgtgtggtctttagtgacaaccgtgtccaagacatttttggctctaagccagaatacgtgaactggatgagtaatttttgagttttgaaacgatcaatttcttctcttatttggagtttctgtaaaattttgtggttgtttgccaactgcttaata

SEQ ID NO: 4111 - DNA, 368 bp, Euphorbia peplus
gatggattccacaatcaagcacgctttggtggtgaaagttatgggtcgtactggatccagggggcaggtgactcaagttagagtcaagtttcttgacgaccagaatcggttcattatgaggaacgtgaagggaccagttagagaaggtgatgtgctaacccttctcgagtccgagagagaagccaggaggctccgttgattggtccatacatgtccttgtttggatttggtagagttgagagagaattgaaaaatgttgtgttgtttatgttttctttgatgctgataagacttgattagggattatgttgcttgtagtgcttgaaagttttggagtatggaagacctcaatttaacttaattattta

SEQ ID NO: 4112 - DNA, 267 bp, Flaveria ramosissima
atttgcatccgccaattgaaacttcaagcagccatccgaacacgttgggtgcaaggaagtgaacgatggagtctcaaatcaagcatgcagttgtggttaagataatgggaaggactggttcaagaggtcaggtgacacaagtgagagtgaagtttttggacgaccagaatcggtttatcatgagaaacgtcaagggaccagtgagagagggtgatgttcttaccctgcttgagtctgagagggaggcccggaggttgcgttgatcat

SEQ ID NO: 4113 - DNA, 365 bp, Flaveria ramosissima
atcgtcattctgaaagtttgcaagcatctgcagccgctcaaacgcccggtagtgaacgatggagtctcagatcaagcacgcagtggtggtgaaaatcatggggagaactggatcgagagggcaagtgacgcaggtgagagtcaagtttctcgatgatcagaaccgtttcatcatgagaaacgtcaagggacccgttagagaaggtgatgttcttaccttgcttgaatccgagagagaggctagaaggttgcgttgatttcacctgtttttctatattcatgagctcctgtttcaactttatgttatgaacctgtgattgactttgttttgagatctatctgaatgcacgattttggtacttttga

SEQ ID NO: 4114 - DNA, 257 bp, Flaveria ramosissima
atcgtcattttgaaagtttgcaagcatctgcagccgctcaaacgctctcgttagtgaacgatggagtctcagatcaagcacgcagtggtggtgaaaatcatggggagaactggatcgagagggcaagtgacgcaggtgagagtcaagtttctcgatgatcagaaccgtttcatcatgagaaacgtcaaggggcccgttagagaaggtgatgttcttaccttgctagaatccgagagagaggctagaaggttgcgttg

SEQ ID NO: 4115 - DNA, 624 bp, Linum usitatissimum
gaaaataatggatcttcctcctccctacaaaaaccctaatctgtataaaattcgccctgaaacatctcctgagactaaatccgcgagagaaacctagcagcagaagcagaagccgccattttccgtcttgtatcatatcgtttcacaaggatggaatcaggaatcaagcacgctctagttgtgaaggtgatgggccgtaccggatccagggggcaggtgactcaggtcagggttaagttcatcgacgatccgaaccgtttcatcatgaggaatgtcaagggacccgtgagagaaggtgacatcctcaccttgctcgagtccgagagagaggccaggagacttcgttgatttccatcctgcctttgcattcctcttggttcgtttttgggagcaatttgtctggcgcttgtggtagttacaatgttaaggtttacttttgatgacctactcaaaaacacttgaatgttgtcacaaaaagttggttatgttaagttgttttggggatttattgatgtatggattccttttagtgttcaatctgtcttgaattgaatttaccttgaaagcttgtcttttggttgctacttctgtgtctatctattgctcaccgagtttcagagtgtc

SEQ ID NO: 4116 - DNA, 657 bp, Setaria italica
ctgcctcctctctccacacgacttgctcgcgccgccgccgccgccgccgttgcagcagtcaccgtgaccagcaaccggagaaagcatggatacccaggttaagctcgccgtcgtggtcaaggtgatgggccgcaccggctccaggggtcaggtgacccaggtcagagtgaagttcctggatgaccagaaccgtctcatcatgaggaacgtcaagggcccagtccgtgagggtgacattctcaccctgctcgagtcggagagggaggccaggaggctgcgctgaggcagcttgtcgttgtgcctgttgtccgctgttcctgtcttaaacaagttaaatcatggattgttgcccactttactagtactgctttcatatcaagttattgaacaatgctactttgtcctttgagtaggctatggagaattgagttaagagcaatggaaatgtaacttgagcacttgtcctgttgcaagttttggtctgttactgcgtgaatttaaggctctcctgttgcaagttttggtctgttactgcgtgaatttaaggctcttgatattgtgtgacatggttatgtacttaagttgcaatcttgggtatcaatcatgaatggcttgtatggttgctacttataatatgaattcttgggtgaatgctgc

SEQ ID NO: 4117 - DNA, 718 bp, Setaria italica
gtccacggtggtcccaagtcctcaacggcccccttcctactatataagcagccagcgcaggcctagggtttccttcctcctccagtgctccctgcgcgccgccgtccccgcccttcgcttcgcgtgctcgtgagctcgtcggcctccgcgttctcgcgagaacgagagcatggacacccaggtgaagcttgctgttgtggtgaaggtgatgggcaggactggctccaggggtcaggtgacccaggttagagtgaagttcttggatgaccagaaccgtctcatcatgaggaacgtcaagggcccggttcgtgagggtgacatcctcaccctgctcgagtctgagagggaggccaggaggctgcgctgaggcagttggtgccatggtggttcttgtatggagttgggtgtcatcgaattcgtgctgtgtttgtcaaactttgtgtgacccttatgattagtaagcctggtgataagattgcagttttgttttttgatccaggttcaaagtgcacttgttgtgctgagatccatagacatctgccatggtcatccttcgctatattagctcaatcgatgcatgaattgaatactagctgaatctctgaggttttattctacctggttgaatataatagtcgttgaggtgtctggtcgtgtgcctgtcgatgcatgaataacgaagctgttcagtgcttcaccaagtgtcgctattctggtg

SEQ ID NO: 4118 - DNA, 256 bp, Setaria italica
ctcttccggggctaattggagtcgattctgttggtgcagcatggatacccaggttaagctcgccgtcgtggtcaaggtgatgggccgcaccggctccaggggtcaggtgacccaggtcagagtgaagttcctggatgaccagaaccgtctcatcatgaggaacgtcaagggcccagtccgtgagggtgacattctcaccctgctcgagtcggagagggaggccaggaggctgcgctgaggcagcttgtcgttgtgc

SEQ ID NO: 4119 - DNA, 393 bp, Vitis vinifera
catatctgtctcctctgaagccgccgtaagtgctccaagcctctcttattctcgtcgtcttctctcttcgcagtgcaaaatggaatctggggtgaagcatgctatggtggtgaaagttatgggtcgaactagctcaagaggtcaggtgacccagatgagagtgaagtttttggatgaccagaataggtttatcatgaggaatgtgaagggacctgtcagagaaggagacatcctcaccctgcttgagtctgagagggaggccagaaggttgcgttgatgaggtcatctttggctccacttccatgttttgataggtatcttatgagttttccagtttcaaacttgtagttttgggttttttcaaattaaaatactgttggaagatgggtcttt

SEQ ID NO: 4120 - DNA, 546 bp, Avena sativa
aggcgctagggttttaacccccttctttccgccctcctagcgccgccgccgcctccgtcgtcgtagcagaagaagcgatcccccatcgccaacagccgaagaaaggatggacacccaggtcaagcttgctgttgtggtcaaggtgatgggccgcaccggctccaggggtcaggtgacccaggtcagagtgaagttcttggatgaccagaaccgtctcatcatgaggaacgtcaagggccctgtccgtgagggtgacatcctcaccctgctcgagtctgagcgtgaggccaggaggctgcgatgagcggttgtttttctggaagtaaaatgctgttgccttattactgtactgctttcgaatcaagttcttgaactttggtttcttctttaggctatggatgtgtaatgtgtacttcactggttgcagttttgttatgttgcctaaattaagttgcactgtggtttgagacctgatcatgctgtcgcctctgggtaatgtgaattgattggatgccttctatattggatccaattatttggttgctg

SEQ ID NO: 4121 - DNA, 413 bp, Platanus occidentalis
gcaacctgccacatcgtctcttctctctttctttccattagagcgcagatggattctcaggtgaagcttgctgttgtggtgaaggtgatgggccgaacagggtcaagagggcaggtgacccaggtgcgtgtcaagtttctggatgaccagaaccgactcatcatgaggaacgtgaaaggtcctgttagggagggagatgtcctcaccctgcttgagtctgaaagggaagctaggaggttgcgttaagagaagtttccttcctgtgaaggttttgcttagtttttattatgtttttttgggaatcttttatagacactttcctctatttttatgttgaacttgtaatgcggatggatcaggcctgttgaaatgcttaaatctgattaagagacttaacgttttgaaaagttgcc

SEQ ID NO: 4122 - DNA, 573 bp, Platanus occidentalis
ccctaagcgaggcggctctcgacagccttgctgctctttcgtccgctttctctccgaacagagcacaagatggattctcaggtgaagcttgcagttgtggtgaaggtaatgggtcgaacagggtcaagaggacaggtgactcaggtgagagtcaagtttctggacgaccagaaccgactcatcatgaggaacgtgaaggggcctgtcagggaaggagacgtcctcaccctgctcgagtctgaaagggaagctagaaggttgcgctgagaggatgtccctgtgagggtttttgtttttgttttaatgggaatccttgttttgatggtatctttctggaatttttacgccaatcttggtgatgagtatggatatggtctattttaatgttttaatttgtctctgattgagagacaggtcgtttgggaagctgctactatttgtttcccgtacatctctctacttaagtgattttgtttggacttatagagcttatattagaaaatgtgagctgtttaacagtcttcctgtatgtaatgcagagtagagggattacccaaagtagcaagacaataa

SEQ ID NO: 4123 - DNA, 472 bp, Pteridium aquilinum
ccagaaattcgctacagaagcagccgctaccctgcgctctgctccgaccctcgtgttctcttagccaaggcctgatcagaatggattcccaaattaagcatgccgtggtggtgaaagttatgggaaggacaggatcaagaggtcaggtgactcaagtgagagtcaagtttttggatgatcagaaccgttacattatgaggaacgtgaagggacaggtcagggagggagatattctcaccctgctcgagtctgaaagagaagcaaggagacttcgttgattatccttttatcttgtgtgacattgttatcgatgttttgtggtattagctagttttttatttctgctgagttttgtttttacttttgaaagtggccaatctcatacctagacttggattttggtgagaatggttttacatggatgatttgtcctaaatctttaattatgttgttgaatgaactaagttggttt

SEQ ID NO: 4124 - DNA, 645 bp, Sorghum bicolor
aggatctgatttaccttggtaactgacaaatgctttctacaagtgcagcatggacacccaggtgaagcttgctgttgtggtgaaggtgatgggcaggaccggctccagaggtcaggtgacccaggtcagagtgaagttcttggatgaccagaaccggctcatcatgaggaacgtcaagggcccagttcgcgagggtgacatcctcaccctgctcgagtctgagagggaggccaggaggctgcgctgaggtggttgtgtgtcctggtggttcttgtatgaagttggatctcggcgaatttgagctatgtttattgaacttggtgtgagaacacctgccttatgattagtgagcctggtgataatgttgcaatttggttttatgatccaggttgaaagtgcacttgtgctgagacatggatattctttgctgtattagctcaatcgatgcatggattgaatactagctgaatcccagggtttatgcttggtagtatggtcgtctatgtggttttgtcatagtctgatagtcatggtggtggctatcttaatctcgatatttgcttgatgatggtcgtagtgcttcaccaaaggatcttgttctggtgatcacttagatggttgttaggtcattttatctgtatgttt

SEQ ID NO: 4125 - DNA, 253 bp, Sorghum bicolor
gaagtatgtgaatccccttggtaactgacaaatgctttctatcagtgcagcatggacacccaggtgaagcttgctgttgtggtgaaggtgatgggcaggactggctccaggggtcaggtgacccaggtcagagtgaagttcttggatgaccagaaccgtctcatcatgaggaacgtcaagggcccagttcgtgagggtgacatcctcacccttcttgagtccgagagggaggccaggaggctgcgctgaagcc

SEQ ID NO: 4126 - DNA, 331 bp, Vinca minor
cagaatggattctaccactaagcacgcgatagtggtgaaggtgatgggtcgaacgggatctcgaggacaggtgacccaggtgcgtgttaaatttctcgacgatcagaatcggttcatcatgaggaatgtcaagggacccgtcagagagggagatatccttaccctgcttgagtctgagagagaagctagaagattgcgctgatttgtgcttcactgcgtttcttaagtattacaaatcattgggtgtaaaactattatgctatattctgagctttttggagatgcaagacacttgttgtttacgattgaacatgattaagttttggttgat

SEQ ID NO: 4127 - DNA, 508 bp, Amborella trichopoda
ggtctggcgagaaagccctaatactagaaatctcgttttcctagcaactgaaatggatacccaggtgaagctcgcagttgttgttaaggttatgggaagaactggatcaaggggtcaagtgactcaggttcgagtgaagtttttggatgatcagaatcgtttcatcatgcgtaatgtgaaggggcctgtcagggaaggtgacattctcaccttgctcgagtctgagagagaagcccggaggttgcgttgatctctctcatcttgccgggtttttgtttgtgttttctttcatgtctactcatgcatccgaaatttgcgagtacagctctctggatttttcattcgaagctatggtgatttgtgatgttaagagtggggttgggaagatcttctttcccattgatagccttcggcctatgatatgtgattgttagggtattataaatctggattgcttggatcttcttaaattgccaaatttttcctagataatagagtcattaatgtt

SEQ ID NO: 4128 - DNA, 501 bp, Antirrhinum majus
atctctgctccaaatccaattgtggtccaccgcctcctgttttcaagaatggaatcccaaatcaagcatgcagtagtggtgaaggttattggcaggacagggtctcgtggtcaagtcactcaggtcagagtcaagtttatcgatgaccagaaccgtttcattatgagaaacgtcaagggacccgttagggagggtgatattctcaccctgctggagtctgagagagaggccaggaggttgcgttgatttttctgtcggcgtatctcgtttagagtttttgtagtttgggtacaattaagtcgatgtagctttccgtgggtttttgcatgtttttgaacgtattactggacatcatgtcagaattggctgctgttggttttcctttcaattatggaatcatgttcctttcaattatggaatcatgtttctttggactacaacgtatttctctctgtttggttatgttatcattatttgccaattgttttattgaatctatcc

SEQ ID NO: 4129 - DNA, 650 bp, Malus domestica
ctaatttgcactgcgtcgttcactcgtcttgcgattcagcctccccttccgcgccgccactttcccgtcttctccgacctcgattgctctcatctggacatccagcctccagaatggaatccacgattaagcatgctgttgtgatcaaggttatgggacggactggatctcgtgggcaggtgactcaggtgagagtcaagtttctggatgaccagaaccgttttatcatgaggaatgtcaagggaccagtgagggagggggatatccttaccttgcttgagtccgagagggaggcaagaaggttgcggtgatcaatcagagattgtcttgtttatcgaagctcctatgtctctgtttgttggggaatgactgttgttttgccaattctgggtatttctagcatcatagacctaatttttgtcattgagattttgttacggaatcgttctaaactaaattgtctgagaatgttttttgtttgtttgaacaagtaacaatgttcctgcatgctgtgttgaatttttgctttccttcttccctgacctcatcttattgttattgagcaacaattctggttcttaaaagttaccatgttttgttgcttcgtcggagttgaaatttggtatgtaatttatcttgttctttgttta

SEQ ID NO: 4130 - DNA, 545 bp, Malus domestica
cattgtgttgggtgcgattcagcctccccttccgcgccgccactttcccgtcttctccgacctcgattgctctcatctggacatccagcctccagaatggaatccacgattaagcatgctgttgtgatcaaggttatgggacggactggatctcgtgggcaggtgactcaggtgagagtcaagtttctggatgaccagaaccgttttatcatgaggaatgtcaagggaccagtgagggagggggatatccttaccttgcttgagtccgagagggaggcaagaaggttgcggtgatcaatcagagattgtcttgtttatcgaagctcctatgtctctgtttgttggggaatgactgttgttttgccaattctgggtatttctagcatcatagacctaatttttgtcattgagattttgttacggaatcgttctaaactaaattgtctgagaatgttttttgtttgtttgaacaagtaacaatgttcctgcatgctgtgttgaatttttgctttccttcttccctgacctcatcttattgttattga

SEQ ID NO: 4131 - DNA, 702 bp, Artemisia annua
agtataaaatgctttctccttagggttttttcgtttcacccatacgtagcagccgcacctcaccttctttggtttatatcttcagcgagtgaaagatggagtcacagatcaagcacgcagttgttgtgacagtgatgggaagaactggatcaaggggtcaggttacacaagtgagagtgaagtttcttgatgaccagaaccgttttatcatgagaaacgtaaagggaccagttagagagggtgacgttcttactttgcttgagtctgagagggaagccaggaggttgcgttgatttcacagattccggattctcaaaactttaggttcaattctaatattttagttgttgcatttgaggcttgttacatgttaaacatggtgatggtataatatggtttttcagggctaagatctcaattcggtggttttttatgttgttacattttaaatagataattttggtttctctattgtaatgaacttttgttttctgtaaaagctttacagtttaataatctgaagcttataaatatgtgaaaatttgtacagttgctaaactgaacccaagtatgcaggatcttattctctgcttgagtttactcaggtcgacacttgcaagtttaattgtggcttgctatgtgttacagtttgttttgctgtcgacttgttgatcaaacttactatagctctggatgccattc

SEQ ID NO: 4132 - DNA, 590 bp, Persea americana
aagtccccggcaacaggaccttctttttctctattgtacgtgcttgcagaatggatactcaggtgaagcttgctgtggtggttaaggtgatggggcgaacaggatcgcgaggacaagtgactcaggtccgagtcaagtttctcgatgaccagaaccgtttgatcatgaggaacgtgaaggggcctgtcagggaaggtgacatccttaccttgcttgagtctgaaagggaagcaaggaggctgcgctgaggatgggatatcgttaggtttgtgagggaaggtgacttccctagaactgcttaaaatgagttttatttaactttaagaagaacgttgagatgagagttatggggactcgtttggctaaaagacttgttgtgtcattgttgagtgagtattttccgcttccctctattgtagtggcttgtgattgagaattccaagtttgatgagataagccttttgttttgcaactgaaggcgttttttcatatttattagcttacttttatctgcctcattctgggatgtgcagatacactgcctctttaatcagaaaatgagtgtcttcctccaaaaaaaaaaaaaaaaa

SEQ ID NO: 4133 - DNA, 572 bp, Hordeum vulgare
ccgccgccgcctccgtccgttgcagcagaagcagcttgcgccgccgcctccatcctcgcagcagaagcagcgatccccatcgccaacagccgaagaaaggcagcatggatactcaggtgaagcttgcagtggtggtgaaggtgatgggccgcactggctccaggggtcaggtgacccaggtgagagtcaagttcctggatgaccagaaccgtctcatcatgaggaacgtcaagggacccgtccgtgagggcgacatcctcaccctgctcgagtctgagcgggaggccaggaggctgcgctaagaagtttctttacctgtctgtcttgggaagtaaaatgctgtgctgttgccttcgtactctatatactgcttccgtcttttgcctaggctatggagatttaatgagttttcttgtgttgcctgaattaaagtgcacttgatgttgtgagacttgatcattgtttcgcacctctgggtaatgttagtcgactatgttggattctatgatttgggtataaatctggatcacttctggttgtaaaggttctgtttcgtaagttcttttttttcc

SEQ ID NO: 4134 - DNA, 425 bp, Phaseolus coccineus
  misc_feature (32)..(32): n is a, c, g, or t
  misc_feature (42)..(42): n is a, c, g, or t
  misc_feature (47)..(47): n is a, c, g, or t
  misc_feature (55)..(55): n is a, c, g, or t
ggactctggttagcaagcatcgcaaaaccctngcctactttnttcantcgtcttntatttcaggatggactctcaggtgaagcatgctcttgttgtcaaagttatgggtcgtactggatccagagggcaggtgccccaggttagagtgaagtttttggatgatcagaatcgtcccctcatgaggaatgtgaaaggccctgttagagaaggagacattctccccctcctcgaatccgagagggaagcaagaagattgcgctagatggtttaaatcgaaacagtggcttgatttttgtggtagttagtggatgccaaaggttatatcaccctatcttgatgtttgggatctatttttattcgaattatggacggaattttgttgtttttagtttaagttttaagattgaagtatgattggcttgata

SEQ ID NO: 4135 - DNA, 427 bp, Phaseolus coccineus
ggggactttggttagcaagcatcgcaaaaccctagcctacttttttcactcgttttttatttcaggatggactttcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgata

SEQ ID NO: 4136 - DNA, 424 bp, Phaseolus coccineus
ggactttggttagcaagcatcgcaaacccctagcctacttttttcattcgttttttatttcaggatggactctcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagccattctccccctcctcgaatccgagagggaagcaagaagattgcgctagatggtttaaatcgaaacagtggcttgatttttgtggtagttagtggatgccaaaggttatatcaccctatcttgatgttttggatctatttttattcgaattatggacggaattttgttgtttttagtttaagttttaagattgaagtatgattggcttgat

SEQ ID NO: 4137 - DNA, 424 bp, Phaseolus coccineus
  misc_feature (55)..(55): n is a, c, g, or t
  misc_feature (105)..(105): n is a, c, g, or t
  misc_feature (174)..(174): n is a, c, g, or t
  misc_feature (371)..(371): n is a, c, g, or t
ggactttggttagcaagcatcgcaaaaccctagcctactttcttcactcgtcttntatttcaggatggactctcaggtgaagcatgctcttgttgtcaaagttangggtcgtactggatccagagggcaggtgccccaggttagagtgaagtttttggatgatcagaatcgtcncatcatgaggaatgtgaaaggccctgttagagaaggagacattctccccctcctcgaatccgagagggaagcaagaagattgcgctagatggtttaaatcgaaacagtggcttgatttttgtggtagttagtggatgccaaaggttatatcagcctatcttgatgttttggatctatttttattcgaattatggacngaattttgttgtttttagtctaagttttaagattgaagtatgattggcttgat

SEQ ID NO: 4138 - DNA, 424 bp, Phaseolus coccineus
ggattttggttagcaagcatcgcaaaaccctagcctactttcttcactcgttttttatttcaggatggactttcaggtgaagcatgcttttgttgtcaaagttatgggtcgtactggatccagagggcaggtgccccaggttagagtgaagtttttggatgatcagaatcgtcacatcatgaggaatgtgaaaggccctgttagagaaggagacattttcaccctcctcgaatccgagagggaagcaagaagattgcgctagatggtttaaatcgaaacagtggcttgatttttgtggtagttagtggatgccaaaggttatatcagcctatcttgatgtttgggatctatttttattcgaattatggactgaattttgttgtttttagtcccagttttaagattgaagtatgattggcttgat

SEQ ID NO: 4139 - DNA, 1426 bp, Beta vulgaris
  misc_feature (402)..(402): n is a, c, g, or t
gcacgaggctttctctcgcccttagcttaaaaaatacagaatggagtcccaaatcaagcatgctgttgtcataaagtgcatgggccgcactggctcaagggggcaagtgacccaagtcagagtgaagttcttggatgaccaaaaccgtttcatcatgaggaacgtcaagggtcctgtaagagagggagacatcctcaccctcctcgagtctgagagagaagcaaggaggcttcgttgaataattaaccatgttcgttgctgcagttatagtctgaatgttgggactttatttttggaaatgttcttagtttgatgagtgtaaaccttatgactttcttttgcaaggaacatactttctggttgtaagacggttatcctaatatgataattttttgaaaactnccaatttgataaccctacctcacctttccgtgttttctccgtcacctattccatcctttttccgtagcacttttgacaacttcctactatcacatatatttcttcactccttgttttgcaattaactcctgctttaacctataccttatattgtattaccataccctattctctactttatgctacttgcttttacttcccattctctacctttcctctctctccccatcattccacttcccaatccattcgccctcctactgatacctcccaccttccaccaattatcactactccatacgtgtccgcattatacaacgctttattactttttctctacacttcctattttttcactttacccctccatactccacatccctcttaattacttctccttccccttatattcttcaccacctttttttctcccaccatccccatccatttactcactttacatactccacttctttcatcttcctcctcaatttctcctcaccttaatccacacctcttctcgcttacttcttcactctctccgctcctccacccatttctctatttctccttcacctctcctcctctttcccttctcctctcccgctactacctcaccaccttgtctccttcacttcctctcatttaccatacatttttccttaatcatgaatttcctaccacttcctctacgttctcttctcgaaatccctaccttcatctcttttttttagcttctctacatatcactctatacttctttattcactccacactctctactcctttcttccgcaccctctgctttacctcgcgcttctctattcactatctcgcccaccctctctttcttctaccctcttctcacctttttctcctaacttctttcttttttttgtcattccttctctatactcctcttttaccttcatatatctcactacactccttctccttctttctccattcaccctacactactattttatccctccttcctcgtcttccactcttccttcgaacc

SEQ ID NO: 4140 - DNA, 1352 bp, Beta vulgaris
gcacgaggctatctaccttctgtttgaagcgccgtctctctctctccaatttctctcttgctttctctcgcctgaagcttcaaatccagaatggagtctcagattaagcatgctgttgtcatcaagtgcatgggccgcactggatcaaggggtcaggtgacccaagtcagagttaagttcttggatgaccagaaccgtttcatcatgaggaacgttaagggacctgtcagagagggtgacattctcaccctcctcgagtctgagagagaagcaaggaggcttcgttgaattaccatacttgttgctgcacttgtatgtcagttttggcttctgtgagtcttatgcctaagttagattttcagagtgagattctatatttttgatgatttagattttcagagtgagattctatattttgatgatttaatatcaaaaatctggttctggatgcttatcttaattattgggatgttgtttgagatgcctagtttgagttaatataaagtcttaaatcctgttggcttttgctcttcaaatcacttactatcccttcttgtgctagtcccgtccaccatctcgcctatcattccttatatcgcgctttcatctgtgccatgtttctcagcccttctttatctgaaacaaggcctggtatcactccgcgtagagagcattcctggctctctttccctttcctctcactgccttgtcgcctctgggccctgcctgacattcaccgtcttagtcttccgcccctcacaatgtgctctcgttcctcgtttcacccctttggacttttccctattcgaccaagcctatctctacacctcgcctcccttactccgatctgccaccgctcctaccgtccatctgctttctctcgccttttcccactccctgtatcttcctgttctgctctctttctgctcactaccctccagtactgatcaccgtctttcgtgagctctcttattacagcatgctactctctctatctgctgcatactattcttgctttcttgcccttcgttccttaccgtttcacctctcgttccacctcctcttcaatctcatggtttctttccttgaccgcctctactctttctcttgcctctgccactctcttgttctattgttcacctgcgccgagcctctgatctccacttgttctgttcttagccagcctacctccccagcgatacgtcttcttcgcatgtccaatctacagcctcttttaagtctgccttactatgcctctgttatacacgtgatcccccttcgttccattgctgttagtcgtctcccgcgttgttgtgccactacacatctactcacgatacttgatctccttc

SEQ ID NO: 4141 - DNA, 496 bp, Bruguiera gymnorhiza
gactcatcgtctccgtttcagcctctccgtttgcaggatatggattccggaattaagcatgctgtggtggtgaaggtcatgggtcgaactggatcccgtgggcaggttactcaggtcagggtcaagtttcttgatgaccagaatcgtttcatcatgaggaatgtgaaggggcccgtcagagaaggggacatcctcaccttgcttgagtctgagagggaggctcgaaggctccgctgattggtcagttcgtccgcttctggattgttctgttgtcgcccgtggttgtttagctagtagtagtattggcagtgttgtcatatgagttcttcttagtcgctttatcattaggttacgccgatatgaatacttgaatttcagtttgtgggtgataatcccattatggttttgctccatagaatttgtgtttctttacttgcgttgactatgtataagcattgagctcctgttggggatatatcaattcaatgtgattttc

SEQ ID NO: 4142 - DNA, 578 bp, Ricinus communis
acgataaactggtgtatatttactatagtacccataacccgaaactcgagccttttaaaaccctagactcggtggtcgcttaaatagcaaaccctagcctcttacttattcttctcccctcctctcaaagcctgcggcaaacttagcgacccctgtctctgcttccatctccttctttgctcaggatggattcacaaattaagcatgctgttgtggtgaaagttatgggtaggactggatccagaggacaggtgactcaagttagggttaagtttcttgatgatcagaatcgattcattatgaggaatgtgaagggacctgttagagaaggtgatgtgcttacccttctcgagtctgagagggaagctaggagactccgttgattgctctgctcttgcttgcataatcagtctagagaaattggcgttgttgtcattagcttttcttcatatggtttatatcaggacttgagttctgatttatggcttgtaatgtgactaattaacaaaattttgaagtatgagaaaaacctaaagcttggtttgcattaaaatgttgcttgctggaaattatttttc

SEQ ID NO: 4143 - DNA, 796 bp, Ricinus communis
acgataaactggtgtatatttactatagtacccataacccgaaactcgagccttttaaaaccctagactcggtggtcgcttaaatagcaaaccctagcctcttacttattcttctcccctcctctcaaagcctgcggcaaacttagcgacccctgtctctgcttccatctccttctttgctcaggatggattcacaaattaagcatgctgttgtggtgaaagttatgggtaggactggatccagaggacaggtgactcaagttagggttaagtttcttgatgatcagaatcgattcattatgaggaatgtgaagggacctgttagagaaggtgatgtgcttacccttctcgagtctgagagggaagctaggagactccgttgattgctctgctcttgcttgcataatcagtctagagaaattggcgttgttgtcattagcttttcttcatatggtttatatcaggacttgagttctgatttatggcttgtaatgtgactaattaacaaaattttgaagtatgagaaaaacctaaagcttggtttgcattaaaatgttgcttgctggaaattatttttcagtgtgtctgggatttcactagtttaatttgcttttaggacatctctactgcttactggatgtgaaatatggctgattttcccaccttcgcacttttttgacaaccttcttcttttctgtccaagcattatcatcttgattctccattacaaggggttgaattctttttgcttatggttttatcactgcaagaatgttctgcaatatcctgacatgag

SEQ ID NO: 4144 - DNA, 603 bp, Ricinus communis
ggcaataaacatgggcaaaactgtaattctatatccactctttctttcgaaaccctaatatctttccccataatcactcctttctctaaaacccccagaatcggcaacagcagcaaattagcggctactttttttttcttttcttctctcctgctcatcttttgcattcaggatggattcacagattaagcatgctgtggtggtgaaagttatgggtaggactggatcaagagggcaagtgactcaagttagggttaaatttcttgatgatcagaatcgatttattatgaggaatgtgaaaggacctgttagagaaggtgatgtgcttacccttcttgagtctgagagggaagctaggaggctccgttgaaaggttttcgcatttaatggcatcatcttgttcttgttcttgtttatggatgatagcacaagactgtcctttttgttatgtttagttattagtttttgttcttttatttgattcttaccgagacttgagttttcatttatgggttgtattgcaatgtcacggatgcaaatgtttgaagtacactaagatttgctaattatatctttactggatgtgaaagtttttggtgtccc

SEQ ID NO: 4145 - DNA, 682 bp, Ricinus communis
ttgtgatctaaccttaaggacttttgtagaaattaaccgtaaatatttattttactatagtaccctaaacttatcggcaataaacatgggcaaaactgtaattctatatccactctttctttcgaaaccctaatatctttccccataatcactcctttctctaaaacccccagaatcggcaacagcagcaaattagcggctacttttttttttcttttcttctctcctgctcatcttttgcattcaggatggattcacagattaagcatgctgtggtggtgaaagttatgggtaggactggatcaagagggcaagtgactcaagttagggttaaatttcttgatgatcagaatcgatttattatgaggaatgtgaaaggacctgttagagaaggtgatgtgcttacccttcttgagtctgagagggaagctaggaggctccgttgaaaggttttcgcatttaatggcatcatcttgttcttgttcttgtttatggatgatagcacaagactgtcctttttgttatgtttagttattagtttttgttcttttatttgattcttaccgagacttgagttttcatttatgggttgtattgcaatgtcacggatgcaaatgtttgaagtacactaagatttgctaattatatctttactggatgtgaaagtttttggtgtccctaa

SEQ ID NO: 4146 - DNA, 580 bp, Coffea canephora
cggccgggggcccattccccagtttcagctctccagctctctcatattcggcggccgccccatctctctcgaatccctcttcgcctccgtctctcgtctccgatttcgacagaatggattctcagatcaagcatgctgtggttgtgaaagtgatgggtcgcactggatccagagggcaggtgactcaggtgagagtcaagtttcttgatgaccagaaccgattcatcatgaggaatgtcaaggggccagtcagggagggtgatgtcctcactctgctagagtctgaaagagaagcaaggaggctgcgatgattggctctcttcatgtctgttcttattacgtgttgcagatctgaaatgcaaacattgttctgatgttaaccttaaatcagttttgtgcttttgagatgcttattgaagactttttaggctttaaggaatgatgaatcaatgttgtttacattaaattaagtgttattcagtgattagtagctgtgttgagaagtttaatgcttttgttttaaaagcaaagatggtgtggtagtgtttatttttctttggtgaagtctctggttggtcct

SEQ ID NO: 4147 - DNA, 730 bp, Cyamopsis tetragonoloba
  misc_feature (537)..(537): n is a, c, g, or t
  misc_feature (600)..(600): n is a, c, g, or t
  misc_feature (634)..(634): n is a, c, g, or t
  misc_feature (671)..(672): n is a, c, g, or t
  misc_feature (684)..(685): n is a, c, g, or t
cacgaggctcaggtgaagcatgcagttgttgtcaaagtcatgggtcgcactggatctagagggcaggtgactcaggtcagagtgaagtttttggatgatcagaaccgtttcatcatgaggaatgtgaagggacccgttagagaaggggacgttctcaccttacttgagtctgaaagagaagcaagaaggttgcgctagagggtctctctatgcttgcttactgttttcatttcgtgacctgagttttgatgttactgagattgctcagttttgagtttatttatgctttgacttccatataatgttttcattgctctattggccttattgctatttgctacttttaactattataatagtagtatatataataatagtattattcggctcgtttttaaatgcattactgaaaagttttcaactttgttagtgagattgtcatgcttttacaagtacaaactgaaaatagattcaagtttcccttctttagaaaccaggctccagggatgatagacatttcaaaactaatttcattcnagttgtcaactgcgttagtgagattgccatgcttttgataagttttctttcaacctcattaancatcattatggaagtcaatatcctattgcagcanatagttcaaaattcaatttcattttttttgtttttanntaactgcataannctatttaacaaattaacttattatatttattttctctttagtcaa

SEQ ID NO: 4148 - DNA, 633 bp, Cynodon dactylon
gccgtcgtcagcagcgaaagaaagcatggatactcaggttaagcttgctgtcgtggtcaaggtgatgggccgcactggctcaaggggtcaagtgacccaggtccgagtgaagttcctggacgatcagaaccggctcatcatgaggaacgtcaagggccctgtccgggagggtgacattctcaccctgctcgagtctgagagagaggccaggaggctgcgctgaagcagctggtggatgtctgtcgtttgcagttcctatcttaaaatgttccaatgatggattgttgctcccttgcttagtgtactgctttcgtaccatgttattggaccctgctgctttgtcttctcaataggctatgtagtcaccgagttggattaaaattcaagtactcatcaggttgcagttttggtgaagtgctgtgatgttatgacttatgagatgtttgtgctctatctccttgggtaacatgaatttatatggtgcattgatccaatttcatcggtgcgttaagttggaattgtttattttgtttttacctgttggactgcgaagatgctcgattgttcacttcattatcactgttagtgactcttactgtgatatgaatagcaattgtaatgttattgccctgg

SEQ ID NO: 4149 - DNA, 468 bp, Solanum melongena
acgtcaaaatcttgtgagcactccgccgctagctctcttcttctccggcgaaatcagattctatttctccgacggaatctaagcaatggaatctcaaatcaagcacgctattgtggtgaaaatcatgggccgcacgggatcaagaggacaggtgactcaggttagagtcaagttcatggatgaccagaatcggtttatcatgagaaacgtcaagggaccagtcagagagggagacattcttactctgttggaatccgagagggaagctaggaggttgcgttgagcaattaattttccagatggtcttgattacctcgatactatgataccctatcgttcaatattttccaatagtaaatgtttggtcttgttttctgggctagttgcaagtgttttctagcatacatttcgaaatgttctgtgaggactgtttgagtaattttctgtctattgcaagttattgttgga

SEQ ID NO: 4150 - DNA, 523 bp, Linum usitatissimum
ggcaaaatcgccgagagaaaaacctagtagcagctgcagcagcccgccgttgtccgcttccatcgctctcatctcgtcggagcttcctcttgcaattgaaggatggaatctgggatcaagcatgctttggtggtgaaagtgatgggccgtactggatcgaggggtcaggtgactcaagtcagggtcaagttcatcgatgatcctaaccgcttcatcatgaggaatgtcaagggaccagtgagagaaggtgacatcctcaccttgctcgaatccgagagagaggccaggagacttcgttgaaaccctgctcttcatactggaactgttcctgggtggccttgcttttttgttgctttggataatatctagtgatgtctacccgtatcgacgctctacttaatcgattttgctgtcaaaagacttgagttttaaattgtggaattggtgatgttctgaatgtttccaagtgtccgtcattctgatgtctgaattaccttaaagcttgtctgcataatgatatgtg

SEQ ID NO: 4151 - DNA, 530 bp, Linum usitatissimum
gagagaaaaacctagtagcagctgcagcagcccgccgttgtccgcttccatcgctctcatctcgtcggagcttcctcttgcaattgaaggatggaatctgggatcaagcatgctttggtggtgaaagtgatgggccgtactggatcgaggggtcaggtgactcaagtcagggtcaagttcatcgatgatcctaaccgtttcatcatgaggaatgtcaagggaccagtgagagaaggtgacatcctcaccttgctcgaatccgagagagaggccaggagacttcgttgaaaccctgctcttcatactggaactgttcctgggtggccttgcttttttgttgctttggataatatctagtgatgtctacccgtttcgacgctctacttaatcgattttgctgtcaaaagacttgagttttaaattgtggaattggtgatgttctgattgtttccaagtgtccgtcattctgatgtctgaattaccttaaagcttgtctgcataatgatatgtgttgcgagtctattgtcatc

SEQ ID NO: 4152 - DNA, 749 bp, Setaria italica
cgggtcacctgacccctggagccagtcctgcccatcacctccaccacaacagcaagcttcaccttcctcctccagtgctccctgcgcgccgccgtccccgcccttcgcttcgcgtgctcgtgagctcgtcggcctccgcgttctcgcgagaacgagagcatggatacccaggtgaagcttgctgttgtggtgaaggtgatgggcaggactggctccaggggtcaggtgacccaggttagagtgaagttcttggatgaccagaaccgtctcatcatgaggaacgtcaagggcccggttcgtgagggtgacatcctcaccctgctcgagtctgagagggaggccaggaggctgcgctgaggcagttggtgccatggtggttcttgtatggagttgggtgtcatcgaattcgtgctgtgtttgtcaaactttgtgtgacccttatgattagtaagccgattgcagttttgttttttgatccaggttcaaagtgcacttgttgtgctgagatccatagacatctgccatggtcatccttcgctatattagctcaatcgatgcatgaattgaatactagctgaatctctgaggttttattctacctggttgaatataatagtcgttgaggtgtctggtcgtgtgcctgtcgatgcatgaataacgaagctgttcagtgcttcaccaagtgtcgctattctggtgatctctcttatgttagttggatcgtctcttatgttatgatctctcggaaa

SEQ ID NO: 4153 - DNA, 523 bp, Zingiber officinale
  misc_feature (385)..(385): n is a, c, g, or t
gcacgaggcgcttctcgagcccttgagcccttggtaggagaacaaagagcaggagcaggtgaactacatcatggattctcaagccaagcttgcagtggtggtgaaggtgatgggtcgtactggatctcgaggtcaggttacacaagtcagggttaagttcttggatgaccagaatcggctgatcatgaggaacgtgaagggcccagtaagggagggcgatatccttactcttcttgagtctgagagggaggccaggcggctgcgttgatgttcatctacactagttttctaattagcttatttcaactgcactatggattgatcttttcttttcaatttgtcatgcatgttggtgatgttttaaagcaattgaattgcctgtggncctaaatgttttggtttactttgttgcctgtgagctttaatctatttgatgtttttactgcaaacagcttgttagtagtatttatcatggcactttgtttttattgtcgccaattgtacttgatggttttataaaaaa

SEQ ID NO: 4154 - DNA, 846 bp, Vitis vinifera
gtaccccgcatgttccatttgtccagggtggctaaaggagtaatttcattcacctcttcagcctatataagcaaaattttgggggtttctccttcagaagccgccgtcgatcttctaaaccctcacgtcgtcgtctccttaacagtgcgaaatggatgccggggtgaagcatgctgtggtggtgaaagttatgggtcgaactggatcaaggggtcaggtgacacaggtgagagtgaagtttttggatgatcagaataggtttattatgaggaatgtgaagggaccagtcagagaaggagacatcctcaccctgctcgagtctgagagggaggccagaaggttgcgttgatgggttcatctttgttcccgcatccatattttggtggctcgattatgagttttgtagtggcagctagtatatgactatgactgttttatcctgagttgttatgttgaagctcgattacgaatttcttggtttttaaagttcaaatgtagtgtgaagattgttatctttctggaacacttaaaatttacttgttttggaatgcattggcttgatcgatgacagtagtttctactgtgagtatgatatagggtatgtgaatgttatggggatttttatatggtattgtggacatatgagctaatactatgttcttcaatcacttcgggctcatcatgcagctgattttggagttgaatgaggtgattccttttggtgaagaatggtggtaatggtattgtgaggcattgctgcatttgtgcaattgtgcttgtttggcatagctaattttattactctctttctacttccaacttaacaaaatccgaactggaattgat

SEQ ID NO: 4155 - DNA, 661 bp, Vitis vinifera
cgtcgatcttctaaaccctcacgtcgtcgtctccttaacagtgcgaaatggatgccggggtgaagcatgctgtggtggtgaaagttatgggtcgaactggatcaaggggtcaggtgacacaggtgagagtgaagtttttggatgatcagaataggtttattatgaggaatgtgaagggaccagtcagagaaggagacatcctcaccctgctcgagtctgagagggaggccagaaggttgcgttgatgggttcatctttgttcccacatccatattttggtggctcgattatgagttttgtagtggcagctagtatatgactatgactgttttatcctgagttatgttgaagctcgattacgaatttcttggtttttaaagttcaaatgtagtgtgaagattgttatctttctggaacacttaaaatttacttgttttggaatgcattggcttgatcgatgacagtagtttctactgtgagtatgatatagggtatgtgaatgttatggggatttttatatggtattgtggacatatgagctaatactatgttcttcaatcacttcgggctcatcatgcagctgattttggagttgaatgaggtgattccttttggtgaagaatggtggtaatggtattgtgaggcattgctgcatttgtgc

SEQ ID NO: 4156 - DNA, 421 bp, Heritiera littoralis
gaaactcgcaggagaagcagccgttcctctttcgttctcctcgtacctcttgcttcgcttagccaagaatggattcccaaatcaagcatgctgtggtggtgaaaatcatgggaaggacaggatcaagaggtcaggtgactcaagtgagagtcaagtttttggatgatcagaaccgttacattatgaggaacgtgaagggcccggtcagggagggagatattctcaccttgctcgagtctgagagagaagctaggaggcttcgttgaccggttttctctctgctttcttacattgttgatgtcatattgcattagctagttattatctgctgagttttgttacttggaaaaggagttcaatttctcaagacttggattttgtgagagtagtttttgcatggacgaattgtttttgtatgctt

SEQ ID NO: 4157 - DNA, 454 bp, Hevea brasiliensis
agaattcggcacgaggttgcgacaagaaatcttagcggctgctcttcctctctctccttctcctatctactcaggatggattcacagattaagcatgccgtggtggtgaaagtaatgggtaggactggatccaggggtcaggtgactcaagtcagagtcaagtttcttgatgaccagaatcgattcatcatgaggaatgttaagggacctgttagagaaggagatgtgcttacactccttgaatctgaaagggaagctaggaggcttcgctgatgggtgtattttgcccactcttgttcttatgattttcgtgatagtagcaaggctgttttgtcatggtagctaagattaatttccaatgcttttatgagttttgttatctgggttccattttctcataatgacaatatgaagacatgaattttgatatatgggttatgaaaaagacctagag

SEQ ID NO: 4158 - DNA, 462 bp, Hevea brasiliensis
agcggctgttcttcatctcgctccttctgcaatcttctcaggatggattcacagattaagcatgccgtggtggtgaaagttatgggtaggactggatcgagggggcaggtgactcaagtcagagtcaagtttcttgatgaccagaatcgattcatcatgaggaatgtgaagggacctgtcagagaaggggatgtgcttaccctccttgagtctgaaagagaagctaggaggcttcgatgatgggtttatctttgcctactcttcatatggttttaatatagtagcaagaatgttctgttatggtagctagagtaatttccaatgattttacgaacattgttgtgtgggttacattttctcatcattacaatatcaagacttgaattttgatatatgtgttgtcatggaaccaatacttgaagtttttcaattatgaaaagaccccagagtttggtttgagtt

SEQ ID NO: 4159 - DNA, 763 bp, Mesembryanthemum crystallinum
  misc_feature (17)..(17): n is a, c, g, or t
  misc_feature (600)..(600): n is a, c, g, or t
  misc_feature (700)..(700): n is a, c, g, or t
cactagttgtagagggnctgcaggaattcggcacgagctctctctccaactgcggctagggttttagcgaattctctctcaggatggagtctcagatcaagcacgctgtcgtcatcaaatgcatgggccgcacaggatcaaggggacaagttactcaagtgagggttaagttcttggatgaccaaaatcgtttcatcatgaggaacgttaagggcccagtcagagagggagacatccttactctcctcgagtctgagagagaggcaaggagacttcgttgatcatccctcccacttgctgactacaccagcttgaagtttttgattacttgggtgactgtcatatactcatctagtactgcaaattggtttctcttagtagtgtcggtgtgctatgttcaaactcttttgttgtgtgtagtctattctcgtcacagtcttctggctcctattctctgaatcgggtgctggattgagtgtggcgagcttttggatctgcagtgtcctatgttggttgttctgtagtagtcgcaaatctatgttcttgtaactgagactgcaattttggttatagatcatgtaagagattttacgcgttganaaatatcattattactttcctttgtctttcctctttttctggggggtgcctttccccactccgccctatctttttttctttccgcctccttcctttcctntcttttccaccctcctccttggataaccctgttttccccattctttttgtcttcccatttttg

SEQ ID NO: 4160 - DNA, 434 bp, Ipomoea batatas
tacggccggggacctttccatctcctctaaccctagttcagagcggccgtagcctccatcctctcctctcctctcgatctctgaagaatggagtctcagatcaagcatgctattgtggtgaaggttatgggtcgtactggatccagagggcaagtgactcaggtgcgggtcaagtttattgatgaccagaacaggtttatcatgaggaatgtcaagggaccagtcagagagggtgatgtgctcactctgctggagtccgagagggaagccaggaggttgcgttgattgccttgttatatatctcgattgcatcttgaaagggcgttaaatacgcaaaatctatttatcagttttggtgtactacttaatagctttcttggattatgacagtttgttaaatttggacaaatgcatcacttcatttaatggatttg

SEQ ID NO: 4161 - DNA, 518 bp, Ipomoea batatas
gcagcttttccctaaatactccttttgccgataatctctctccgttatctctcccttctccggctttccgccctcggcatctccggctcaaagtctcggagttcattctttccagaatggaatctcaaatcaagcatgcaattgtggtgaaggttatgggtcgcacgggatccagaggacaggtaactcaagtcagggtaaagtttattgatgaccaaaacaggtttattatgaggaatgtgaagggaccagtgagagagggtgatgtcctcaccctgctcgagtctgagagagaggctaggagattgcggtgatggctttatctatcaaagtactatgagggtcttgaataccttttgatgccttgttaagttgttttgccggaatgattagtagttggaaccattagttgtgtgggatgctcaagtttatgtttgatcaagttatttttacttgtattttcagtttggacaactgtttttggctactaaatggaatgtgattgttaagtgattttg

SEQ ID NO: 4162 - DNA, 414 bp, Ipomoea nil
  misc_feature (62)..(62): n is a, c, g, or t
  misc_feature (70)..(70): n is a, c, g, or t
  misc_feature (344)..(345): n is a, c, g, or t
ctcgccccgttccatctcctccaaccctagttcagagcggccgtagcttccctcctctcctntcaatctntgaagaatggagtctcagatcaagcatgctattgtggtgaaggttatgggtcgtactggatccagaggacaagtgactcaggtgcgggtcaagtttattgatgaccagaacaggtttatcatgaggaatgtcaagggaccagtcagagagggtgatgtgctcactctgctggagtccgagagggaagccaggaggttgcgctgatcgattgccttgctatatatcttgattgcatcttgaaagggcgttaaatacgcagaatgtattatcagtnntggtgcactacttaatagctttcttggattatggcagtttgttaaatttggacaaatgcgtgactttat

SEQ ID NO: 4163 - DNA, 547 bp, Ipomoea nil
acggactcaccatctctgtctccggcctccgcttgccgccctctcacaatctcaccattcaccggtcacctctcagggtcatcgtctgcaaagcgtacaacatagatccgggccgctgaaaatccgaatggaatctcaaatcaagcatgcaattgtggtgaaggttatgggtcgcactggatccagaggacaggtaactcaagtcagggtaaagtttattgatgaccaaaacaggtttattatgaggaatgtgaagggaccagtcagagagggtgatgtcctcaccctcctcgagtctgagagagaggctaggagattgcggtgatggctttatctatcaaagtactatgaagggtcttgaataccttttgatgccttgttaagttgttttgacgtaatgattactagttggaaaccattggttgtgtgggataatcaagtctatgttttgatcaagttatttttacttatattttcagtttggacaactgtttttggctactaaatggaatgtgatttgatttatatgtgatgtctaacaaaaaaa

SEQ ID NO: 4164 - DNA, 587 bp, Jatropha curcas
gagtggtatcacgcagagtacgcgggggagcgaaacctatagagtgcgagaaccgagcttctttctctgaccctatcttgcttcaggcgatccttatcggaatcgttctcaggatggattcacaaatcaagcacgccgtggtggtgaaagttatgggtcggacaggatcgagggggcaggtgactcaagtcagagtcaagtttcttgatgatcagaatcgattcatcatgaggaatgtcaagggacctgttagagaaggtgatgtgctcacccttcttgagtctgaaagagaagccaggaggcttcgttaatatgtgcatctctacccacttctttttttatggtttaattttgtattagtatcaagactcttttgttatgctatagctagagtgattaaaagtgctgttatgagcttttgctgtgcggtttacattttcccagccattgtcatatcaagactagaattttgatttatggagttgcttaagctttaatataccctaaagaatttctctttttctgggaaatgctattgtaatttatcttttgttatgctagttggttttttttgtcttaaaaaaaaa

SEQ ID NO: 4165 - DNA, 420 bp, Actinidia deliciosa
  misc_feature (255)..(255): n is a, c, g, or t
  misc_feature (317)..(317): n is a, c, g, or t
  misc_feature (334)..(334): n is a, c, g, or t
ccagagtctctccagccgtctctctctctctctctctctctctctctctctctctctctctctccagagaatggagtctcagatcaagcatgctgttgtggtgaaagttatgggccgcacaggatcaaggggtcaggtgacacaggtgagagtcaagtttcttgatgaccagaaccggtatatcatgaggaacgttaagggccctgtgagggaaggggacgtgctcaccctgctcgagtctgagagggaggcaanaaggttgcgctgatcgcttcacaatttattcttaatctttttcaggttgtgattgcttgtancttatcccttcactgcnaactttatttaacgatacctttattaagatttaagaggtggtatctgggacaggattggtgacacacttttgttttgggtctgtgt

SEQ ID NO: 4166 - DNA, 579 bp, Leymus cinereus x Leymus triticoides
  misc_feature (35)..(35): n is a, c, g, or t
gcacgagggccgccgcctccgtcgttgcagcagangcagcgacccccatcgccaacagccgaagaaagcatggatacccaggtcaagctcgcagtcgtggtcaaggtgatgggccgcaccggctccaggggtcaggtgacccaggtcagagtgaagttcctggatgaccagaaccgtctcatcatgaggaacgtcaagggtcctgttcgtgagggcgacatcctcaccctgctcgagtccgagcgggaggccaggaggctgcgctgagcgcttgcttttcctgtcttcggaagtaaactctactgcatttgaatcaacttcttgaacgctggctttgtcttttgcctaggctatggagatgtaatcagtacttaataggttgcagttttcttctgttgcctgaattaaagtgcacttgatgttgtgagacttgatcgtccttcacctctgggttatttgaattgattggatgaatgctatatattgtatcctatgatttgagtgcgagtgctggtatgaatctgaatcgcttgtacttgtaaaatcatgaacgtgccttaacacttgaattggaaaatt

SEQ ID NO: 4167 - DNA, 455 bp, Liriodendron tulipifera
aagaacttgaacaaagcagccgctgcactcgcttcttctctctaacgtgcgcaggatggatacacaagtgaagctagcagtggtggtgaaggtgatgggccgcactggttcgagagggcaggtgactcaggtcagggtcaagttcctggatgaccagaatcgactcatcatgcggaacgtgaaggggcctgtcagggaaggcgacatcctcacccttctcgagtctgaaagggaagcaaggaggctgcgctgagcaaggttctgtttcccaactccctagttttgttaggtatgttttcattcacatcatcccttgtttggctatgccaaaatcctttggactttgtatgagagagaaactgctgagatgaaaatcacaggatttggaatagatttaagcttttagactttgtttgcaagagaagtcatccaagaacttttattaagttatgagg

SEQ ID NO: 4168 - DNA, 361 bp, Lolium multiflorum
agcatggacactcaggtcaagcttgcggttgtggtcaaggtgatgggccgcaccggctccaggggtcaggtgacccaggtcagggtgaagttcttggatgaccagaaccgtctcatcatgaggaacgtcaagggccctgtccgtgagggcgacatcctcaccctgcttgagtctgagcgggaggccaggaggctgcgctgagcgattgtttttcctgtcttcggaagtaaaatgctgttgccgtcgtactgtactgcttttgaatcaagttcttgaacattggtttggaccttcgcgtaggctatggagctgtaatgaggtttgtttttcctgtctttggaagtaaaatgctgttgcctta

SEQ ID NO: 4169 - DNA, 353 bp, Lolium multiflorum
aggtacgcggggacccctcttcttctgccctccagcgccgccgccttcgtcgtcgccgtcagtgcagcagcaatctccggtgccaaccaacgacgaaagtatggatacccaggtcaagcttgctgtcgtggtcaaggtgatgggccgcactggatccaggggtcaggtgacccaggtcagagtgaagttccttgatgaccagaaccgtctcatcatgaggaatgttaagggccctgtccgcgagggtgacatcctcaccctgcttgagtcggagcgtgaagccaggagactgcggtgatgatctgtggttcgtgtcttcagaagtaaattgttctgttgttaccttctttagg

SEQ ID NO: 4170 - DNA, 546 bp, Eragrostis curvula
gttggccgcgttcggtcggccatgcacggcctgcaaaagacctagctctcacctcttcttcccccatatcttccacacacgccgccagccgcctcagacctgtgaggcagcgaagtccccggcgcaccgtccctcccggcctccccaatcctccgccgaccgccaagcatggacgctcaggtgaagctggctgttgtggtgaaggtgatgggccggaccggctccaggggtcaggtgacccaggtcagagtcaagttcttggatgaccagaaccgtctcatcatgaggaacgtcaagggcccggttcgtgaaggagacatcctcaccctgctcgagtccgagagggaggccaggaggctgcgctgaagcagcttgggatcatggtggttcctgtatggcttgggtgtcatcgaatttgtgctatgtttgttgactcagtgtgacccttagagcacttgccttatgagtgttaagcacggtgatactattgcagttttgtatttatgataagagttcaaagtgactcggtgtactgagacatggttg

SEQ ID NO: 4171 - DNA, 828 bp, Zea mays
gcgggtccacggcggtctcgactcgaccgccgccttctcttactataaaacgaagcaacgcgatcctagggtttccttcctgctcagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaagggccctgttcgtgagggtgacatcctcaccctgctcgagtctgagagggaggccaggaggctgcgctgaagccctggtggccttggatgtaattctgttaattttgttctatgtttgtcgaacttgccgtgtgaccttcacaacatctgctttgagatttactcagcctggattgcagttttattttatgttcctggtggaaattgcaattgtttgtcggcatgttctcttgaatttaatgcgtacggtttctactactactacaatgatttttagcattctgaacagctttaatcccatgtgtccaatctgaaggtgttgttatatgtggtaaggtcgtctatgggtttttgtcatcgttttatttgtatgatctccctgggcatgctggttctgttgtattctgttcgatttcttctgtaagctgacactgatcgaatgtggttatagaacgccaaacaaacgaactccagtgcaacctttcataaccttttgggatggcttctaaatacgccctttggtccgttc

SEQ ID NO: 4172 - DNA, 419 bp, Zea mays
tatatataggcctagggtttccttcctcctccagtgctgtcatcgccgccgccgccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcggaatagtgtcttggtagttttcgtatggagttggatgtcatctaattgtgctatgtttgtcaaactttggtatgacctttaaaacacctgccttgtatgatt

SEQ ID NO: 4173 - DNA, 525 bp, Zea mays
aaccaacgcggacctagggtttccttcctcatccagtgttctgtcctagcgccgccgccgccccagctcgccttgcgtgactgagagctcgtcggcttccgtccacgcgagaagcgagagcatggacacccaggtgaagcttgctgttgtggtgaaggtgatgggcaggaccggctccaggggtcaggtgacccaggtcagagtgaagttcttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttcgaatttgtgctatgtttgaacttctgtgaccctgtcttaagagtagtaagcctggtgataagattgcagttttgtttatcctggttgaaaatggaattggtgttgagacatggttatccttgctatattatctataaaacgacgcatgcattgaatacta

SEQ ID NO: 4174 - DNA, 529 bp, Pennisetum glaucum
gcttgctgttgtggtgaaggtgatgggcaggaccggccgccgccgctcttcgcttcgcgtgctcgtgagctcgtcggcctccgcgtcctcgcgagaacgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaagggcccggttcgcgagggtgacatcctcaccctgctcgagtccgagagggaggccaggaggctgcgctgaggcagttgggtgccatggtggttcttgtatggagtagggtgtcttcgaatttgtgccgtgcttgtgtgcttagtgtgaccctcagaacacctgccttatggttagtaatcctggtgataagattgcagttttgtttttattatccaggttcaaagtgcacctgttgcttggagacatctgccatggttaacctaaactgtattagctcagtcgatgcatgaattgaa

SEQ ID NO: 4175 - DNA, 570 bp, Pennisetum glaucum
agcgcgtacatcagcgtctcgggcacttacttgcccccgaccctgcctcctctctccacacaacttgctcgcgccgccgccgccgtcgcagctgttaccgtgaacagcaaccggagaaagcatggatacccaggttaagcttgccgttgtggtcaaggtgatgggccgcacaggttccaggggtcaggtgacccaggtcagagtgaagttccttgatgaccagaaccgtctcattatgaggaatgtcaagggccctgtccgtgagggtgacatcctgaccctgctcgagtctgagagggaggccaggaggctgcgctgaggcagctggcgcttgtgcctgttgttcgctgttcctgtcttaaacaagttaaatgatggattgctaccccctttcctagtgtactgctttcgtatcaagttattgaacaatgctactttgccctttgagtaggctatggagattcttaagcaatggaaatgtaatttgagcactcatcttgttgcaagttttggtcagttactacatgaatttaagtgcacttgatgttgtgggacatgattatgttgcaa

SEQ ID NO: 4176 - DNA, 412 bp, Pennisetum glaucum
tcctctctccacacaacttgctcgcgccgccgccgccgtcgcagctgttaccgtgaacagcaaccggagaaagcatggatacccaggttaagcttgccgttgtggtcaaggtgatgggccgcacaggttccaggggtcaggtgacccaggtcagagtgaagttccttgatgaccagaaccgtctcattatgaggaatgtcaagggccctgtccgtgagggtgacatcctgaccctgctcgagtctgagagggaggccaggaggctgcgctgaggcagctggcgcttgtgcctgttgttcgctgttcctgtcttaaacaagttaaatgatggattgctaccccctttcctagtgtactgctttcgtatcaagttattgaacaatgctactttgccctttgagtaggctatgga

SEQ ID NO: 4177 - DNA, 509 bp, Mimulus guttatus
gcgcctcttcttcttcccgaaagaaaaaaaaacctaatccctttgctcaggcttcttctctgttctgttctgttcggttcggttgttcctcaacaagaaatggagtcgcaaattaagcatgctgtggttgtgaaggtgattggaaggactgggtctcgtgggcaagtgactcaggtgagggtcaaatttatcgacgatcagaaccgtttcatcatgaggaatgtcaaaggccccgttagggaaggagatattctcaccttgctcgagtctgaacgagaagctaggaggttgagataattggttcgtctacttagtagtttgcgaatgtattcgattttgttctgaattgacattgactctcgtgtttactttttgttttggttgaaacatctatgcgtttttcttcaggctatgaattattccttttgagttaaagattgtttattcttggttccattttctggccataagagtatatttagtatattatacatacataaaattttgct

SEQ ID NO: 4178 - DNA, 567 bp, Mimulus guttatus
agggttttcattttcgttcttggcatcaaacaatttgcctgccgctccaactctgtgttctttcgtttcagaatggagtcgcaaattaagcatgctgtagttgtgaaggtgattggcaggacaggttcacgtgggcaagttactcaggtgagggtgaaatttatcgatgatcagaaccgtttcataatgaggaatgtcaaaggccctgttagggaaggagatatcctcaccttgctagagtctgaacgagaggctaggaggctcagatagatgattaataattgctctcgtatcatcattatgttttgcttgctgatgcatttctttttgagatattaatttcaataccaagtattttgatgtaagcttgatttggatttgcggggatgtatcacaagacttgacttttgtttctgaattgagactctctcatgtttacttgtttgttttgtttaaaatggttgtctaatgtctattgtttttaagcaagttggatttggttaattagtctaaattttgggaagatgtactcgaagttgagcaatcaatcttggttccattttctgg

SEQ ID NO: 4179 - DNA, 575 bp, Mimulus guttatus
ctgctagggttttcattttcgttcttggcatcaaacaatttcgcctgccgctccaactctgtgttctttcgtttcagaatggagtcgcaaattaagcatgctgtagttgtgaaggtgattggcaggacaggttcacgtgggcaagttactcaggtgagggtgaaatttatcgatgatcagaaccgtttcataatgaggaatgtcaaaggccctgttagggaaggagatatcctcaccttgctagagtctgaacgagaggctaggaggctcagatagatgattaataattgctctcgtatcatcattatgttttgcttgctgatgcatttctttttgagatattaatttcaataccaagtattttgatgtaagcttgatttggatttgcggggatgtatcacaagacttgacttttgtttctgaattgagactctcatgtttactcgtttgttttgtttaaaacggttgtctaatgtctattgttttaagcaagttggatttggttaaatagtctaaattttgggaagatgtactcgaagttgagcaatcaatcttggttccattttctggtagaa

SEQ ID NO: 4180 - DNA, 647 bp, Mimulus guttatus
cacccggcttctataaaataaaatcttcttttggggtttcttcttttccgttgttgctcatcgaacggctgcaactctctgtcttttcgtttcccagaaatggagtcgcaaattaagcatgctgtggttgtgaaggtgattggaaggactgggtctcgtgggcaagttactcaggtgagggtcaaatttatcgatgatcagaatcgtttcatcatgaggaatgtcaaaggccccgttagggaaggagatattctcaccttgctcgagtctgaacgagaagctaggaggttgagataattgattcgtcttacttaggagttggttgcttttgcgaatgtattcgattttgtttctgaattgacattgacattgactctcgtgtttactgtttgtttttttggttaaaacatctatgttttgggaagatatgcgtttttattcaggaagttcggttgatctatgtttttttgggttatgacttcttccttttgagttaaagatcgtttgttcttggtttcattttctggcgatagagtatatttagtgttatacgtacataaaattttgcttcttagagatgtgattgatgattcatctttgcttatgcaatgccgagccttttgctaatgttttcgattttggttttg

SEQ ID NO: 4181 - DNA, 552 bp, Nicotiana benthamiana
cctagctggctggttgaaccaagtccttacatagttttgccaatcctcgtgccgaattcggcacgaggcttttgttggccgtcgtagctttcaactcgttcttcatctcttccaagaatggaatctgcaaccaagcatgcgattgtggtgaaagtcatgggtcgtactggatccagaggacaggtgactcaggtgagagtcaagtttcttgacgaccaaaacaggtttatcatgagaaatgtcaagggaccagtcagagagggtgatgttctcacactgctggagtctgagagggaggccaggagattgcgctgagggcataattatgaatgccacattgaaattgcctggagcacttgtactggctttgatttagtctttggttttgtttgctcagactcgtaatttccaacatgtttttaacaatgatagtcgtgtaattttggtgcacttcaagattttggaatagtttatgataatgttttgctagcttttgcatcaatggggaaaacaaattattttagaaaaagaattaaaaaaaaaaccgagggg

SEQ ID NO: 4182 - DNA, 498 bp, Nicotiana benthamiana
  misc_feature (403)..(404): n is a, c, g, or t
gggccaatagggcaaggcattttttctcctcttcggccgtcatagcaaattgcgctttgtgctcgctcgtctgctcctatcaaggatggaatctgcgacaaagcatgctattgtggtgaaagtcatgggccgtactggttccagaggacaggtaactcaggtgagagtcaagtttcttgatgaccagaacaggtttatcatgagaaacgtcaagggacctgtcagagagggtgatgttttgacattgttggagtctgagagagaggctagaaggttgcgttgaaggggcacatttttgaattccatatggagctggtttgattattatactgtcctagattttgttatagtcttttaatgttatgttttgcttttgcaagacttggttaattgtggacaaganntttagtgccaagctcagttgttttggtgacgtttgtatccatgtcggttgagtaattttggtggtgttacaagttttggtaatgttttatgacc

SEQ ID NO: 4183 - DNA, 437 bp, Nuphar advena
cgtctccgctgagggaacgttaattttccggttatccgagggaatttccagtcgatttctgagcctacgagagatggatacccaagtgaagcttgcagttgtcgtcaaagtgatgggaagaactgggtcaagaggtcaggtgactcaggtaagagtcaagtttctagatgaccagaaccggcttatcatgaggaatgtcaaagggccggtcagagaaggtgacatacttactttgctcgagtctgaacgtgaagcaaggaggttgcgctgatggccttattgtatatgttttgaaaattttggttatgatccatggaaattgtggttgtcactgtttacacttctgaggttatttttattgctagggttttctttgccaattgtggagtacctggtacatggtgaattttggtgttttaacacttggctgaattttc

SEQ ID NO: 4184 - DNA, 647 bp, Avena sativa
cttctttccgccctcctagcgccgccgcctccgtcgtcgtagcagaagaagcgatcccccatcgccaacagccgaagaaaggatggacacccaggtcaagcttgctgttgtggtcaaggtgatgggccgcaccggctccaggggtcaggtgacccaggtcagagtgaagttcttggatgaccagaaccgtctcatcatgaggaacgtcaagggccctgtccgtgagggtgacatcctcaccctgctcgagtctgagcgtgaggccaggaggctgcgatgagcggttgtttttctggaagtaaaatgctgttgccttattactgtactgctttcgaatcaagttcttgaactttggtttcttctttaggctatggatgtgtaatgtgtacttcactggttgcagttttgttatgttgcctaaattaagttgcactgtggtttgagacctgatcatgctgtcgcctctgggtaatgtgaattgattggatgccttctatattggatcctattatttggttgctgctacaactctgaattgttttatgtagttgtgaagttatgatgtgcctctcgtcggttctgcttcttgtaacatcctgaaagatggagtttcattagtctccaagaattgtccacccactttagaa

SEQ ID NO: 4185 - DNA, 513 bp, Avena sativa
cttctttccgccctcctagcgccgccgcctccgtcatcgtagcagaagcagcgatcgcccatcgccaacagccgaagagaggcagtgcagcatggacacccaggtgaagcttgcggttgtggtcaaggtgatgggccgcaccggctccaggggtcaggtgacccaggtgagagtgaagttcttggatgaccagaaccgtctcatcatgaggaacgttaagggccctgtccgcgagggtgacatcctcaccctgctcgagtccgagcgggaggccaggaggctgcgctgagcggttgtttttcctgtcttcggaagtaaaatgctgttgccttcttattgtactgctttcgaatcaatcaagttcttgaacattggtgtctgtctttaggctatggaggatgtgtaatgagtacttcactggttgcagttttgttatgttgcctaagttaagttgcactgtggtttgggacctgatcatgctgtcacctctgggtaatgtgaattgatttgatg

SEQ ID NO: 4186 - DNA, 498 bp, Avena sativa
cgccgccgcctccgtcatcgtagcagaagcagcgatcgcccatcgccaacagccgaagagaggcagtgcagcatggacacccaggtgaagcttgcggttgtggtcaaggtgatgggccgcaccggctccaggggtcaggtgacccaggtgagagtgaagttcttggatgaccagaaccgtctcatcatgaggaacgttaagggccctgtccgcgagggtgacatcctcaccctgctcgagtccgagcgggaggccaggaggctgcgctgagcggttgtttttcctgtcttcggaagtaaaatgctgttgccttcttattgtactgctttcgaatcaatcaagttcttgaacattggtgtctgtctttaggctatggaggatgtgtaatgagtacttcactggttgcagttttgttatgttgcctaagttaagttgcactgtggtttgggacctgatcatgctgtcacctctgggtaatgtgaattgatttgatgcctt

SEQ ID NO: 4187 - DNA, 531 bp, Avena sativa
cttctctccgccctcccagcgccgccgcctctgtcgtcgtagcagaagcagcgatcgcccatcgccaacagccggagagagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggccctgtccgtgagggcgacatcctcaccctgctcgagtctgagcgtgaggccaggaggctgcgctgagcggttgtttatcctgtctttggaagtaaagtgatgttgccttaactgtactgctttcgaatcaggttgttgaacattgcctgtcttttgcataggctgtggaggtttaatgagtagttcaccggttgtggttttgttatgttgcctaaattaagttgcactgtggtttgagacctgatcattctgtcacctctgggtaatttgaattgattggatgcatgctatattgtatcctatgatttggttgctgc

SEQ ID NO: 4188 - DNA, 537 bp, Avena sativa
gattcctcttctctccgccctcccagcgccgccgcctctgtcgtcgtagcagaagcagcgatcgcccatcgccaacagccggagagagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggccctgtccgtgagggcgacatcctcaccctgctcgagtctgagcgtgaggccaggaggctgcgctgagcggttgtttatcctgtctttggaagtaaagtgatgttgccttaactgtactgctttcgaatcaggttgttgaacattgcctgtcttttgcataggctgtggaggtttaatgagtagttcaccggttgtggttttgttatgttgcctaaattaagttgcactgtggtttgagacctgatcattctgtcacctctgggtaatttgaattgattggatgcatgctatattgtatcctatgatttggttgctg

SEQ ID NO: 4189 - DNA, 584 bp, Avena sativa
cttctttccgccctcccagcgccgccgcctccgtcgtcgtagcagaagcagcgatcgcccatcgccaacagccgaagaaagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggccccgtccgtgagggtgacatcctcaccctgctcgagtctgagcgtgaggccaggaggctgcgctgagcggttgtttttcctgtctttcgaagtaaaatgctgttgccttaactgtactgctttcgaatcaagttgaatcaagttgttgaacattgcctacgtctttcgcggaggctatgtaggtttaatgagtactttcactggttgcagttttgttatgttgcctaaattaagttgcactaggctatggatcattctgtcgcctctgggtaatttgaattgattcgatgcctggtatattggatccttatgatttggttgctgctacaaatctgaaattttttatgtattgtgaagttatgatgtgcct

SEQ ID NO: 4190 - DNA, 636 bp, Avena sativa
ctcttctttccgccctcccagcgccgccgcctccgtcgtcgtagcagaagcagcgatcgcccatcgccaacagccgaagaaagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggccccgtccgtgagggtgacatcctcaccctgctcgagtctgagcgtgaggccaggaggctgcgctgagcggttgtttttcctgtctttcgaagtaaaatgctgttgccttaactgtactgctttcgaatcaagttgaatcaagttgttgaacattgcctacgtctttcgcggaggctatgtaggtttaatgagtactttcactggttgcagttttgttatgttgcctaaattaagttgcactaggctatggatcattctgtcgcctctgggtaatttgaattgattcgatgcctggtatattggatccttatgatttggttgctgctacaaatctgaaattttttatgtattgtgaagttatgatgtgcctttggttggttctggttctcaatatactttatttaacccctgccaaaaaaa

SEQ ID NO: 4191 - DNA, 514 bp, Avena sativa
cagcgccgccgcctccgtcgtcgtagcagaagcagcgatcgcccatcgccaacagccgaagaaagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggcccggtccgtgagggtgacatcctcaccctgctcgagtctgagcgtgaggccaggaggctgcgctgagcagttgttttcctgtctttggaagtaaatgctgttgccttaactgtactgctttcgaatcaagctgttgaacattgcctacgtcttttgcctaggctatggagatttaatgagtacttcactggttgcagttttgttatattgcctaaattaagttgcactatggtttgggacctgataattctgtcacctctgggtaatttgaattgattggatgcctgctatattggatcctatgatttggttgctg

SEQ ID NO: 4192 - DNA, 495 bp, Avena sativa
cgccgccgcctccgtcgtcgtagcagaagcagcgatcgcccatcgccaacagccgaagaaagcatggacacccaggtcaagcttgcggttgtggtcaaggtgatgggccgcaccggctccaggggtcaggtgacccaggtcagagtgaagttcttggatgaccagaaccgtctcatcatgaggaacgtcaagggcccggtccgtgagggtgacatcctcaccctgctcgagtctgagcgtgaggccaggaggctgcgctgagcagttgttttcctgtctttggaagtaaatgctgttgccttaactgtactgctttcgaatcaagctgttgaacattgcctacgtcttttgcctaggctatggagatttaatgagtacttcactggttgcagttttgttatattgcctaaattaagttgcactatggtttgggacctgataattctgtcacctctgggtaatttgaattgattggatgcctgctatattggatcc

SEQ ID NO: 4193 - DNA, 454 bp, Orobanche aegyptiaca
tcttgcaagcactccgccgctaactcttatcgcagcgaactcagcttctatttctccagcggaatcaaaaaatggaatctgcaaccaagcacgctattgtggtgaaagtcatgggccgcacaggatcaagagggcaggtgactcaggtgagagtcaagttcttagatgaccagaaccggtttatcatgagaaacgtcaagggaccagtcagagagggagatgttctcacactgctggagtctgagagggaagccagaaggttgcgctgagcatttcatttattgtcgagatggttttgattaccttgatactgtgatagctattgtcttagtccttctccaagaaaaatgtttggtattgttttcaggacttgtgctaagtgtgtattagcatatatttagaactgtttggtgatgcttttgaccatgacatgttgagtaattttctttctctt

SEQ ID NO: 4194 - DNA, 415 bp, Orobanche aegyptiaca
agctttcgttggccgtcgtagctttcaactcgttcttccgctcttccaagaatggaatctgcaaccaagcatgcgattgtggtgaaagtcatgggtcgtaccggatccagaggacaggtgacacaggtgagagtcaagtttcttgacgaccaaaacaggtttatcatgagaaatgtcaagggaccagtcagagagggtgatgttctcacactgttggagtctgagagggaggccaggagattgcgctgagggcataattatgaatgccacattgaaattgccttgagtacttgtactggctttgatttagtctttggttttgtttgctcagactcgtaattttcaacatgtttttaacgatgatagtcgtgtaagtttggtgcagttcaaggtttggaatagttttatgaataaa

SEQ ID NO: 4195 - DNA, 441 bp, Arachis hypogaea
aatcctccctgacgagtaagagagcaagcagcagcagctacaagcgactcctcaaatctcaggatggatactggcataaagcacgctatcgttgtcaaggttatgggtcgcactgggtctagagggcaagtgacccaggttagagtcaagtttctggatgatcagaaccgccacatcatgaggaatgtgaagggaccagtgagagaaggtgacattctcaccctacttgagtctgagagagaagcaagaagattgcgctagatggtcaccgatggtttttctctgtattaagtaaaaaaattgtggatttttgttcctctggttttagttttaatggtagttagcagatgccatagttcgatgctacttttgttgtcctggatctatactatatgctcttattattaaacttaaattttgatattgaggtggctgaattta

SEQ ID NO: 4196 - DNA, 535 bp, Arachis hypogaea
ggggctctttcaatcctccctgacgagtaagaagagcaagcagcagcagctacaagcgcctcctcaaatctcaggatggatactggcataaagcacgctatcgttgtcaaggttatgggtcgcactggttctagagggcaagtgacccaggttagagtcaagtttctggatgatcagaatcgccacatcatgaggaatgtgaagggaccagtgagagaaggtgacattctcactctacttgagtctgagagagaagcaagaagattgcgctagatggtctccgatggtttttctctgtattaagtaaaaatattgtggatttttgttcctctggtttcagttttaatggtagttagcagatgccatagttcgatgctacttttgttgtcctggatctatactatatgcccttattatgaaacttaaaatttgatattgaggtggctgaatttataaattttttttgtgatttgattttgatataatgctttccccactctgatattgagctgtggatatgaccttatgtttatat

SEQ ID NO: 4197 - DNA, 458 bp, Capsicum annuum
gcacgagggcagcatacaacacaatcgcttctcctctaaagaatggaatcttgtaccaagcatgctgtcgtggtgaaaatcatgggtcgtactggatccagaggacaggtgactcaggtgagagttaagtttcttgacgaccagaacaggtttatcatgagaaatgtcaagggaccagtcagagagggtgatattctcacactgttggagtctgagagagaggccaggagattgcgctgagcaatgtttacgaacgacacattgaaattcccttgatgaatacttgatattggctgggatgtagtccctatttaatagcctatggttttgtttgcttagtctcgtgtgtttggacatgtcgattttggtcattttgatgcacttcaggattttggaaaagttttatgatacgtaatatttttcatcaatggcagcaaactaatggttcttgtttgttt

SEQ ID NO: 4198 - DNA, 899 bp, Ananas comosus
aaggtattgcaattagtgctttgatctagtgataaaacatttgctgtttacattctcttgttatgtttctggatggtaatgagctcagggctttggcttgttggtcaatactacattgttgcatagaatgttttcaaaagagtctaaacaggaaaggggaactggactttagtgtaaaccatactccacgcattaggagaaggttaaacaaattgttttggatgtcatagcccctacttgtccaaaattgtggtctattatgctttgctatgtccaaaagagtcattaccagtaagattttctgtgactatcaaacagttcattaatgttgttaagggttgtcaatgagcagctacagactccatgaaactttggttatatatcaactctatgggaatctatcaactgtatgagttacctatttgagatgcctgttgttattgctatttgttcgtgcagaatggatgcccaagtgaagcttgcggttgtcgttaaggtcatgggccgaactgggtcaagaggtcaggtgacccaagttagggttaagtttctggacgaccagaaccggctcatcatgaggaatgtgaaagggccagtgagggagggtgatatcctcaccttgcttgagtctgaaagagaggctaggaggctgcgctgatgctgttccttattgcaggagctctattatggcttttggtgatgcattgctgctataattgtttttcacagttggtgttttggattgttagagcaagtattcaatactatgagactgcaaaggtgctattttttttttcccctctcgtctgattaagattgaaaagttgtcttgaatagtgttcgccagttaaatgtgatttgatggtcattagggtgcgtttggttcgcgttattttttt

SEQ ID NO: 4199 - DNA, 523 bp, Podocarpus macrophillus
ggttcgtgtcgcttcaatttcaattcaataggagggattcattttcatcggagcatctaacggctgcaactttgctctactgcttcctttcaggaaatcatggattcacaagtaaagttggcagttgtagtcaaggttattggccgtactggatcaagaggacaagtcacacaggttcgtgtgaagtttttggatgatcagaatcggctcatcatgagaaatgttaaaggtcctgtcagagaaggtgacatccttactttgcttgaatctgaaagagaagcaagaaggctgcggtgataacatttttacattatgatgaccttggatttgcgcaataactttgattagtttgggacagtatttcatatggattttttggacgaggagatgccaaaatgtatggacttttacttcggcaaataggatttaaggtctggcaattaaagtactgtttatactaaaattcaaactacaattatgtattttgattgaaccatcggttttactttttcttgaattgtac

SEQ ID NO: 4200 - DNA, 501 bp, Podocarpus macrophillus
ctctttctgttccacacaagacgcgtttggtttaacggctgcaatctgctactacttcaggttctctctactgtaaggttgaaccagggaatcatggattcacaggtgaagttggcagttgtggtgaaggttattggccgtactggatcgagaggtcaggtaacacaggttcgagtgaagtttttggatgatcagaatcgactcatcatgagaaatgttaagggtcctgtcagagaaggtgacatccttactttgcttgaatctgaaagagaagcaaggaggctgcggtgatcacatttttacattattatagccttcgatttgtgaaagagcttgattagtttgggtcattatttcatatgggttttttgaaagagtagacaccaaaatatatggactatgaatagtttgcaaagtatagtccttcggcaaataggacttaaggtctggcaattaaagcactgtttgtattaaaatccaaactacaattatgtattttga

SEQ ID NO: 4201 - DNA, 416 bp, Podocarpus macrophillus
ttcaggaaatcatggattcacaggtgaagttggcagttgtggtcaaggttatcggccgtactggatcaagaggacaagtcacacaagttcgtgtgaagtttttggatgatcagaatcggctaatcatgagaaatgttaaaggtcctgtcagagaaggtgacatccttactttgcttgaatctgaaagagaagcaaggaggctgcggtgatcacatttttacattattataaccgatttgctaaagaacttgattagtttgggacattttttcatatggattttttgaaagagtagacaccaaaatatacggactatgaatagtttgcaaagtattgtactttggcaaataggatttaaggtctggcaattaaagtactgtttgtattaaaatccaaagtacaattatgtattttga

SEQ ID NO: 4202 - DNA, 660 bp, Prunus persica
atgaggaggaggagaggggggcttggttgtcgaatgaacaagaaggagagtgggggagagaggacggaagggaacttcctctctctctctctctctcttctcgcttctgtctgtgcttctctctctctatattcccggcggccagtgttgcagtctcaacctttggacaatcagagaatggattccactataaagcatgctgtggtggtgaaagttatgggtcggactgggtctcgagggcaggtgactcaagtgcgagtcaagtttttggatgaccagaatcggttcattatgaggaatgtcaaggggccagtgagggagggggatatcctgaccttgctcgagtctgagagggaagcaagacggttgcgttgattggagatgggtcttctatggtgaagctcctacctctccctgtttgatgttttggttactcgcataagactgttgtttgtgttggtgcagtgcaggacagttgtgttgccaatttatgctctcattttgtttgtttatttatcatgactctgagtgtgtgttattagctgatggaatttctagtgtatgtctagttaatagttgaacatggtggatgtttctgtttagtttggatcctgcaactttatatggattactattttgtttcacatgaattttgtttca

SEQ ID NO: 4203 - DNA, 529 bp, Pseudoroegneria spicata
ccgccgcctccgtcgtcgtagcagaagcagcgagccccgtcgccaacagccgaagaaagcatggatacccaggtcaagctcgcagttgtggtgaaggtgatgggccgcaccggctccaggggtcaggtgacccaggtcagagtgaagttcctggatgaccagaaccgtctcatcatgaggaacgtcaagggccctgttcgtgagggcgacatcctcaccctgctcgagtctgagcgggaggccaggaggctccgctgagcgcttgcttttcctgtcttcggaagtaaactctactgcatttgaatcaacttcttgaacgctggctttgtcttttgcctaggctatggaaatgtaatcagtacttaataggttgcagttttcttctgttgcctgaattaaagtgcacttgatgttgtgagacttgatcatccttgcgcacctatgggttatttgaattgattggatgaatgctatatattgtaccctatgatttgagtgctcgtatgaatctgaatcgcatctacctgca

SEQ ID NO: 4204 - DNA, 448 bp, Pseudoroegneria spicata
gcagaagcagcttgcgccgccgcccccgtcgttggagcagaagcagcgacccccatcgtcagcagccgaagaaattaagcaagcatggatacgcaggtgaagcttgcggtggtggtgaaggtgatgggccgcactggatccaggggtcaggtgacccaggtgagagtcaagttcctggatgaccagaaccgtctcatcatgaggaacgtcaaggggcctgtccgagagggcgacatcctcaccctgctcgagtctgagcgggaggccaggaggctgcgttaagcactttctttcttcacctgtctgtcttcggaagtactcctaaaatgctgtgctgttgccttcttactctatactgctttcgtcttttgcttagctatatggacatgtaatgagttttcttctgttgcccacattaaagtgcacttgatgttgcgagtctagatca

SEQ ID NO: 4205 - DNA, 325 bp, Rhizophora mangle
gagggttttatttactgtcggtcatattcgttctgtgagacttaagagcttcttcgcttggccgtgtacgccgctcatcgtcttcgtttcagcctctccgtttgcaggatatggattccggaattaagcatgctgtggtggtgaaggttatgggtcgtactggatcccgtgggcaggttactcaggtcagggtcaagtttcttgacgaccagaatcggttcatcatgaggaatgtgaagggacctgttagagaaggtgatatccttaccctgcttgagtctgagagggaggctcgaaggctccgttgatggggctcagtcggttc

SEQ ID NO: 4206 - DNA, 515 bp, Oryza sativa
gtcgaccgccgctctgatataaaggagacacgaaggcccagcgcttcctcctcctcccaacgccgccgccgccgccgccgccatcgtcttgcgccctcgtcggccgccgcccacgcgaggaaacgagcatggacacccaggtgaagctggctgttgtggtgaaggtgatggggcgtaccggctccaggggtcaggtgacccaggtgagagtcaagttcttggatgaccagaaccgtctcatcatgaggaacgtcaagggcccggttcgagagggcgacatcctcaccttgctcgagtccgagagggaggccaggaggcttcgctgaaccttcttgcacgaattcagacatgtctgtcgtactgtggttgtctgattgtctttgagctctagacctgatgacaatctcgcattttttgttttatataactgagctgaatttcacttgatgcaatgtgacatggttgtgctcgataatattagctgaattgatgcatggattggttattggctcgaa

SEQ ID NO: 4207 - DNA, 662 bp, Oryza sativa
ttttcaccctcgcctccactccttcctcctcgcgccgtcgccgccgccgcatccgtgccctccttcgccgtccgccgtcgctagcagccggagaagagaagcatggatacccaggtcaaacttgccgtcgtggtgaaggtgatgggccgcaccggctccaggggtcaggtgacccaggtcagagtgaagttcctcgacgaccagaaccgtctcatcatgaggaacgtcaagggcccggtccgtgagggcgacatcctcaccctgctcgagtctgagagggaggccaggaggctgcgctgaagctgtggcggttgtgttatttcgtggttcctgccttttgaaagtaaaatgccatattgtcgccttatttcgtgtactgcttttccggtccagttcttgaacaatggtttgtctttctgagtaggccttatatgttatgagttaagagcaatggaaatgtaatgggtacttgtctggttgcagttttggtctgttgcctataactaaagttccattgttgtgagacatggttatgctctactggctttgggcaacatgaactgattagatgaatgctatcttcaatttactacgagtgtgacatggctgtcaatgttacaaatcagcacaaatctgcttggtaaatgtccttatttgtttga

SEQ ID NO: 4208 - DNA, 502 bp, Carthamus tinctorius
gcggggatgcatatatcatcgagttcatgttgaatcttgtgatggtttcaatatactgattggatttgcttttggttagtgaaagatggagtctctgatcaagcacgcagtggtggtgaaagtgatggggagaactggatcgagagggcaggtgacgcaggtgagggtgaagtttctggatgaccagaaccgtttcatcatgagaaatgtcaagggaccagtcagagaaggtgatgttcttaccttgctcgagtctgagagggaggccagaaggttgcgttgatttcatctatttttcacaactgagtctttgaaatttatttttttcttgtgttgttatgtggaactcctcctcagtgtatgtttacattttcatctctctagttttctctcccagcttatgacatttgctgtcagattttgaatggagatttcagttaattcaatttagttgtctgattattgggatttaatgatgagcttgttacttattactcacgag

SEQ ID NO: 4209 - DNA, 457 bp, Salvia sclarea
ctgcaggaattcggcacgaggtgcagcggctccttcaaaaaaaaaaacgatctgtgcagcggctgctcctcagtcttttctcctttgctctgcagaatggaatcccaaatcaagcatgcagtggtggtcaaggtcattggcaggaccggatcccgtgggcaggtgactcaggtcagagtgaaattcattgatgatcagaaccgtttcatcatgagaaacgtcaagggaccggttagggagggcgacatcctcaccttgttggagtctgagagagaggctaggagactccgctgatttctcagcatcatttcttcatgtcgcaatactttttgcaacttcattttgatgtaggctgtgtcttgattttggttacctttcgagatctataactagacaaactagacctcaaatgcaagcactttaccccagcggtttgtttaacattatttatgagttt

SEQ ID NO: 4210 - DNA, 392 bp, Salvia sclarea
gaattcggcacgagggttccccatctctattctcggttccagccttccagaagagaagagaagaatggaatcacaaatcaagcacacagtcgtggtgaaagtaattggtcggacaggatcccgggggcaggtgactcaggtgagagtgaaattcctcgatgatcagaaccgtttcattatgagaaatgtgaagggacctgttagggagggtgatattcttaccctcctcgaatctgagagagaggccagaaggttgcgctgatctcatccatctcttttgctgttttgaaatgtagttgagaattttgattcaccaccacttgctgtttttgtttcctcacttcacattgccaatatactttgaaatgcttcttcaaaaaaaaaaaaaaaaa

SEQ ID NO: 4211 - DNA, 492 bp, Salvia sclarea
aagtctcgattgtgtcattgaataatttctgcagcggctgctcctcagtcctttctccctagctctgcagaatggaatcacaaatcaagcatgctgtggtggtcaaggtcattggcaggacgggatctcgtgggcaagtgactcaggtcagggtgaaattcattgatgatcagaaccgtttcatcatgagaaacgtcaagggaccggttagggaaggcgacatcctcaccttgttggagtctgagagagaggctaggagactccgctgatatctcagcatctcttcttcctatggtgatactttttgcgacttcattttgattgtaggctgtgtctggattttggttacctttttgagatgtataactagaccttaaatgcaagcacggtttgctgctttgtttctaagtcgaccttattttgatgttcactcctacaatggtttgtttaacatgattttatgaattttcgtactggtagtagaatttagcc

SEQ ID NO: 4212 - DNA, 516 bp, Senecio madagascariensis
acgcgggggtgtttccaaatcttaaatctcttcattcaccagagcagcagccgcataaacaaacaggtagatcaaaaaatggaatcacaaatcaaacacgcagtagtgattaaggtaatgggcagaactggatccaggggacaagtgacccaggtccgagttaagtttttggatgaccagaatcggttcattatgagaaatgttaaggggccagttagagaaggtgatgttcttactttgcttgagtctgagagggaagctagaaggttgagataagcccgtgttagttttcggtgtttttcggtgttcggttatgatgaattgagattatgatgatgttttgtcatatgtttgggggtttgataaggagttattagagtaatttatgtttttatgcaatgttttgatttcgtttagtgaatttttatataattttggttttgaatctgtttttgtttcgtcttgatataaagttttggttttagcaaatgttattataatcgtgcaatttcgaat

SEQ ID NO: 4213 - DNA, 443 bp, Solanum phureja
actctctgatacacagcagcaacatacagcagcagatttttctcaccggaaggatggaatctgtaaccaagcacgcaattgtgattaaagtcatgggtcgtaccggatcgagggggcaggtgactcaggtgagagtcaagtttcttgatgaccagaacaggtttatcatgagaaatgtgaagggaccagtcagagagggtgatattctcacgctgttggagtctgagagggaagccaggaggttgcgttgagcccatgattatgattgccaaaccaatattcccttgaatactagatattggctgggattttgttccctattaatagtcttttggttttgtttgcgtagactcttttaagtatggacatgtcgactttggtcatttttgtgcacttcatatttctggaatagttttaatataatattttgctacatttgtgtc

SEQ ID NO: 4214 - DNA, 771 bp, Sorghum bicolor
ggtccacggtggtctcgactcgacagccgcccactcctactataaaacgaaccaacgcaggcctagggtttccttcctcatccaagtgtactcctcgcgccgccgccgccgcagttcgcttcgcgtgaccgagagctcgtcggcccccgtccacgcgagaagcgagagcatggacacccaggtgaagcttgctgttgtggtgaaggtgatgggcaggactggctccaggggtcaggtgacccaggtcagagtgaagttcttggatgaccagaaccgtctcatcatgaggaacgtcaagggcccagttcgtgagggtgacatcctcacccttcttgagtccgagagggaggccaggaggctgcgctgaagccctggtggtcttagtggttcttgtatggtttcttggatgtcgtcgaatttgtgctatgtttgttgaactcgtgtgacccttgcaacacctgccttaagagtagtaagcctgataagattgcggttttgtttaatgatccttgtcgaaagtgcacttatgctgagacatggttatgctttggtatattagctcaatctatgcatgcattgaatactagctgaatctcaaggttttgttctgtggtttggtcgtcaatgtggttgtcatatagttgatgttggtttgatctgtatgatctctctgaccatgttgctttgtatatgtatgatctctttggtcatgttgattggtttgggaaaagcagcgagtgcgtttattccagcggtttggttttcctcaaa

SEQ ID NO: 4215 - DNA, 717 bp, Sorghum bicolor
aaccaacgcaggcctagggtttccttcctcatccaagtgtactcctcgcgccgccgccgccgcagttcgcttcgcgtgaccgagagctcgtcggcccccgtccacgcgagaagcgagagcatggacacccaggtgaagcttgctgttgtggtgaaggtgatgggcaggactggctccaggggtcaggtgacccaggtcagagtgaagttcttggatgaccagaaccgtctcatcatgaggaacgtcaagggcccagttcgtgagggtgacatcctcacccttcttgagtccgagagggaggccaggaggctgcgctgaagccctggtggtcttagtggttcttgtatggtttcttggatgtcgtcgaatttgtgctatgtttgttgaactcgtgtgacccttgcaacacctgccttaagagtagtaagcctgataagattgcggttttgtttaatgatccttgtcgaaagtgcacttatgctgagacatggttatgctttggtatattagctcaatctatgcatgcattgaatactagctgaatctcaaggttttgttctgtggtttggtcgtcaatgtggttgtcatatagttgatgttggtttgatctgtatgatctctctgaccatgttgctttgtatatgtatgatctctttggtcatgttgattggtttgggaaaagcagtgagtgcgtttattccagcggtttggttttcc

SEQ ID NO: 4216 - DNA, 688 bp, Sorghum bicolor
tgctctcctcgcgccgccgccgccccagtttccttcgtgtgcccgtgcgctcgtcggcctccgtccgcgactccgctcgagaagcgagagcatggacacccaggtgaagcttgctgttgtggtgaaggtgatgggcaggaccggctccagaggtcaggtgacccaggtcagagtgaagttcttggatgaccagaaccggctcatcatgaggaacgtcaagggcccagttcgcgagggtgacatcctcaccctgctcgagtctgagagggaggccaggaggctgcgctgaggtggttgtgtgtcctggtggttcttgtatgaagttggatctcggcgaatttgagctatgtttattgaacttggtgtgagaacacctgccttatgattagtgagcctggtgataatgttgcaatttggttttatgatccaggttgaaagtgcacttgtgctgagacatggatattctttgctgtattagctcaatcgatgcatggattgaatactagctgaatcccagggtttatgcttggtagtatggtcgtctatgtggttttgtcatagtctgatagtcatggtggtggctatcttaatctcgatatttgcttgatgatggtcgtagtgcttcaccaaaggatcttgttctggtgatcacttagatggttgttaggtcattttatctgtatgtttt

SEQ ID NO: 4217 - DNA, 828 bp, Sorghum bicolor
tccacggcggcggcctcagctcaataacaagccagcgcaggcctagggtttccttcctcctccagtgctctcctcgcgccgccgccgccccagtttccttcgtgtgcccgtgcgctcgtcggcctccgtccgcgactccgctcgagaagcgagagcatggacacccaggtgaagcttgctgttgtggtgaaggtgatgggcaggaccggctccagaggtcaggtgacccaggtcagagtgaagttcttggatgaccagaaccggctcatcatgaggaacgtcaagggcccagttcgcgagggtgacatcctcaccctgctcgagtctgagagggaggccaggaggctgcgctgaggtggttgtgtgtcctggtggttcttgtatgaagttggatctcggcgaatttgagctatgtttattgaacttggtgtgagaacacctgccttatgattagtgagcctggtgataatgttgcaatttggttttatgatccaggttgaaagtgcacttgtgctgagacatggatattctttgctgtattagctcaatcgatgcatggattgaatactagctgaatcccagggtttatgcttggtagtatggtcgtctatgtggttttgtcatagtctgatagtcatggtggtggctatcttaatctcgatatttgcttgatgatggtcgtagtgcttcaccaaaggatcttgttctggtgatcacttagatggttgttaggtcattttatctgtatgttttttcagaacctgttgattgaatcagatatttctatggagaccgaggatgactctgcaaacaagatatagaaaagtt

SEQ ID NO: 4218 - DNA, 482 bp, Euphorbia esula
ggaatcccatatcaagcatgctgtggtggtgaaagtgatgggtagaactggatcaagggggcaagtgactcaagtgagagttaagtttctagatgatcaaaatcgttacattatgaggaatgtcaagggaccagtgagggaaggagatattcttaccctgttggagtctgagagggaagctagaagattgcgttgatggggattctttcaaggtcccagttttccagtttgcagttgctgaaagttatccttttagttttaatcttacctacaaatagaatggctgttatcatttttccctattttatgtgtggtctttagtgacaaccgtgtccaagacatttttggctctaagccagaatacgtgaactggatgagtaatttttgagttttgaaacgatcaatttcttctcttatttggagtttctgtaaaattttgtggttgtttgccaactgcttaatatttttggtgtttttttggc

SEQ ID NO: 4219 - DNA, 700 bp, Saccharum officinarum
gtcgacccacgcgtccgtctcctcgcgccgccgccgccgccccagttcgcttcgtgtgaccgagagctcgtcggcctccgtccacgcgagaagcgagagcatggacacccaggtgaagcttgctgttgtggtgaaggtgatgggcaggaccggctccaggggtcaggtgacccaggtcagagtgaagttcttggatgaccagaaccgtctcatcatgaggaatgtcaagggcccggttcgtgagggtgacatcctcacccttcttgagtctgagagggaggccaggaggctgcgctgaagccctggcgggcttggtggttcttgtatggtcttggatgtcatcgaatttgtgctgtttgttgaacttggtgtgacccttagaacacctgccttgagagtagtaagcctggtgataagattgcagttccgtttgtttaatgatcctggtcgaaagtgcacttgttatgctgagacatggttatgctttggtatattagctcaatctatgcatgcattgaatactagctgaatctcaaaaaaacaactaatataattctatcttatttcattaataaactaatcacaatttctcaatattcttcttattttttcacttaattctttttatattataaaaggggctccttttaagtacaattttccacatttcttaacatttttttttttactcctattaaaa

SEQ ID NO: 4220 - DNA, 449 bp, Helianthus annuus
gcttgatttgagactccatccttcacttccttgcggccgatgagtacgcgggggctcttgcattcgctatttgaagcttcaacgaacacaagcgccacctgtacccatcggccgcaaggaagtgaaggatggagtctcaaatcaagcatgcagttgtcgttaaagtgatggggaggactggttcaagaggtcaggtcacacaagtgagagtgaagtttttggatgaccagaaccggtttatcatgaggaatgtcaagggaccagtcagagagggtgatgttcttaccttgcttgaggctgagagggaagctaggaggttgcgttgatcatgtaaaccttttgcttttaagacttgctgatgtttatcatcattgcattttgatcctagtagcgggtttgggtttacttaaatctgcatttgttttcttttgaatggattgaatttggag

SEQ ID NO: 4221 - DNA, 630 bp, Panicum virgatum
ctatatattcgacccgacgagcctagggttttgcttctgcctcctctctccacacgacttgctcccgccgccgccgacgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggttgcgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgttgcaagttttggtctgttattgcctgaatgaatttaagtgcacttgatgatgtgtgacatgattttgttgctatcttgggtaacaacaatgaatggcttgtatgactctaatgtttaatttg

SEQ ID NO: 4222 - DNA, 707 bp, Panicum virgatum
gcttctgtctcctctctccacacgacttgctcgggccgccgcctacgccgtcgtcgcagcagtcaccgtgacctgcaaccagagaaagcatggatactcaggttaagcttgccgtcgtggtcaaggtgatgggccgcaccggttccaggggtcaggtgacccaggtcagagtgaagttcctggacgaccagaaccgtctcatcatgaggaacgtcaagggccctgtccgtgagggtgacatcctcaccttgctcgagtctgagagggaggccaggaggctgcgctgaagcagctggttgttgtgtcagttgttcgctgttcttgtcttaaacaagttgatgatggattgattaccccttgcctagtgtactgctttcgcatcaagttcttgaagaatgctactttgtcttttgcataggctatggagaatgagttaagagcaatggaaatgtaatttgtgcaaatgtcctgttgcaagttttggtctgttaccctgaatgaatttaagtgcacttatgttgttacatggttgtgttgcaatcttgggtaacattataatgaatggcctgtatgagttctgtataatttgaatttattgggtgaatgctagactgtccactgcacatcgaaattgttttgtttggacgtcctggaacagtctgatgtgcacgattgttcattttagtcactcagatgtgcagtcacag

SEQ ID NO: 4223 - DNA, 481 bp, Panicum virgatum
gctgcctcctctctccacacgacttgctcccgccgccgccgccgtcgcagcagtcgccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggtcgcgccagttgttggccattcctgtactgctttcgtatcaagttattgaacaatgctactttgtcctttgagtaggctatggagaatgggcttaagcaatcgaattgtaatttaagcactcgtcttattgcaagttttggtctgttattgcctgaatgaatttaagtgcacttgatgcgtgacttgattc

SEQ ID NO: 4224 - DNA, 589 bp, Panicum virgatum
gcatctgacttttctctctacacgacttgctcgggcgccgccgccgacgtcgcagcagccaccgggacctgcaacccgagaaagcatggatactcaggttaagctcgccgtcgtggtcaaggtgatgggccgcactggttccaggggtcaggtgacccaggttagagtgaagtttctggatgaccagaaccgtctcatcatgaggaacgtcaagggccctgtacgagagggtgacatcctcaccctgctcgagtctgagagggaggccaggaggctgcgctgaaacagctggtggttgtgccagttgttcgctgttcttgtcttaaacaagttaaatgatggattgattcccccttgcctagtgtactgctttcgtatcaagttattgaagaatgctaccctgtcttttgagtaggctatagaatgagttaagagcaatggaaatgtaatttgtgcacttgtcctgttgcaagttttggtctgttaccctgaatgaatttaagtgcactttgatgctgtgtgacatgtatgagttctgtataatctgaattttattgggtgaatgctatactgtccactacaaataaaa

SEQ ID NO: 4225 - DNA, 618 bp, Panicum virgatum
ggcctcctctctccacacgacttgctcccgccgccgccgccgtcgcagcagtcgccgtgaccagcaaccggacaaaggtggctgatctcgctccctgccgtgctcgctcgcaacactgcctgccagctagccagccctgccagccagccaactgaacaggagctttgtgggcagtatggatacccaggttaagcttgctgttgtggtgaaggtgatgggccgcactggctctaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggtcgcgccagttgttggccattcctgtactgctttcgtatcaagttattgaacaatgctaccttgtcctttgagtaggctatggagaatgggcttaagcaatcgaattgtaatttaagcactcgtcttattgcaagttttggtctgttattgcctgaatgaatttaagtgcacttgatgcgtgacatgattttgttgctatcttgggtaacaacaatgaatggtttgtatgact

SEQ ID NO: 4226 - DNA, 444 bp, Camellia sinensis
ggggattcgagcgccaactaaactacaagcctgcgccaagtctctccagccgcacctctttctccccggcacagaatggagtctcagatcaagcatgccatcgtggtgaaagttatgggtcgcacaggatcaaggggacaggtgacccaggtgagggtcaaatttattgatgatcagaaccggtttatcatgaggaatgtcaagggaccggtgagggaaggggatgtgctcaccctgctcgagtctgagagggaagcaagaaggttgcgctgatcgcttttacgcttggttctacccaccaaggttctgtggatgtggctgtgggttacggcaaacggccggcagcgtatagcgtccagatataacagttatgttgtgtgataggcgtaaagttaagacttgagacttcgtatctgaggatggagattgatgatttgcctttct

SEQ ID NO: 4227 - DNA, 624 bp, Camellia sinensis
gacatacacttggttgttccatatcgttacagcagcggcgacccacactgagacgaagcacctgtcttctcttcaactcttccttcacagctgtcgctgattccttcacctcagaatggagtctcagatcaagcatgccatagtggtgaaagttatgggtcgcacaggatcaagggggcaagtgacccaggttagagtgaaatttattgatgatcagaaccggtttatcatgaggaatgtcaagggcccagtgagggaaggggacgtgctcaccctgctcgagtctgagagggaggcaagaaggttgcgttgatccctttcatttgctctagccctgcaggttttgattgcttgctatataaccatactttatgcattgatagtactttggtatctgaggatggggattgatgaagtgaagtgctagttttgtttactgtttgagaatgacaattagtatgtttgagttttgttaaaagcttgtatcatttatgcttgagctggagtaaaatgttttaggtggtattattaagccagtgtgaaatctcttcattttatattttttgggcacaatgtttggttttgtgggtataattgactgtgcgagttgtatcgctagtttac

SEQ ID NO: 4228 - DNA, 924 bp, Nicotiana tabacum
  misc_feature (605)..(605): n is a, c, g, or t
ggacccaatagagcaaggcatttttctcctgttcggccgtcgtagcaatttgctctgctcctatcaaggatggaatctgcaacaaagcatgctattgtggtgaaagtcatgggccgtactggatccagaggacaggtaactcaggtgagagtcaagtttcttgatgaccagaacaggtttatcatgagaaacgtcaaggggcctgttagagagggtgatgttttgacattgttggagtctgagagagaggctagaaggttgcgttgaaggggcacatttttgaattccatatggagctggtttgagtattatactgtcctagattttgataaatcttttaatgttatgtttttttttgcaagacttggttaattgtggacaagaattttagtgccaagctcagttgttttggtgatgtttgtgtccatgtcggttgagtaattttggtattattgcaagttttggtaatattttatgatcattcatagctggcttttgctctctatatcttaacttggtccaacttgtcagcatgctggtcagataaccctccattgttgctaagacaatttcgcatttcttaatctctattttgatgtccttgntttatacttttattagagtggaagttcttaagcatcgctggtgtaactttaaagtagaaagccagagaatgaagattagaagtagtaccgtctaggaaatgaaatgattagaatgggagggggaagtctcgatttgtaatgaaaagatcaagtggaggatcctttcttttagggaagcggggtggttgcttttgggactggacaatttgtcccaacagaagcacagtaatatatggaaagcatggctctagtggggaggtccaagactggtgtgtactatggcgggccttctgtattatggactgcagcggccgcatga

SEQ ID NO: 4229 - DNA, 522 bp, Nicotiana tabacum
cccaatagagcaaggcattttttctcctattcggccgtcatagcaatttgcgctttgtgctcgctcgtctgctcctctcaaggatggaatctgcaaccaagcatgctattgtggtgaaagtcatgggccgtactgggtccagaggacaggtaactcaggtgagagtcaagtttcttgatgaccagaacaggtttatcatgagaaatgtcaagggacctgtcagagagggtgatgttttaacattgttagagtctgagagagaggctagaaggttgcgttgaaggggcgtgcttttgaattccatatggagctggtttgagtattatactgtcctagattttgttatagtcttttaatgttatgttttgttttttgcaagacttggttaattgtggacgagaattttagtgccaagctcagttgttttggtgatgtttgtaatccatgatggttgagtaattttggttgtattgcaagttttggtaatattttatgatcgttcgtagctggcttttgctctct

SEQ ID NO: 4230 - DNA, 560 bp, Nicotiana tabacum
gagccaaaagccttgcaagtacgccgccgctaactctcctcctctccagcgaattatttctccgagtgaatcaaagtaatggaatctgcaaccaagcatgctattgtggtgaaagtcatgggccgcacaggatcaagagggcaggtgactcaggtgagagtgaagttcttagatgaccagaaccggtttatcatgagaaatgtcaagggaccagtcagagagggagatgttctcacactgctggagtctgagagggaagctaggaggttgcgctgagcaattcatttattgtcgagatggttttgatagacccttgtggtccggctcttccccggaccctgcgcatagcgggagcttagtgcaccaggctgccctttttatggttttgattaccttgatactgtgatagctattgtcttagtccttctccaagaaaaatgtttggtattgttttcaggacttgtgctaagtgtgtagtagtagcatatatttagaactgtttggtgatgcttttgaccatgagggttgagtaatttttttctcttgcaagttattgctgg

SEQ ID NO: 4231 - DNA, 500 bp, Nicotiana tabacum
gagagctgtgtgagcttttgttggccgtcgtagctttcaactcgttcttccgctcttccaagaatggaatctgcaaccaagcatgcgattgtggtgaaagtcatgggtcgtaccggatccagaggacaggtgacacaggtgagagtcaagtttcttgacgaccaaaacaggtttatcatgagaaatgtcaagggaccagtcagagagggtgatgttctcacactgttggagtctgagagggaggccaggagattgcgctgagggcataattatgaatgccacattgaaattgccttgagtacttgtactggctttgatttagtctttggttttgtttgctcagactcgtaattttcaacatgtttttaacgatgatagtcgtgtaagtttggtgcagttcaaggttttggaatagtttttatgataatattttgctaccttttctgcggtgttccatttctgtgaattggttctgtagaagcgatggtttcttctgaccc

SEQ ID NO: 4232 - DNA, 416 bp, Tragopogon dubius
cctttcgcatttgctattcggagcttccaccatcaaagtatctgctcggcgctcatacgcaagttgttgaagatggagtctcagatcaagcatgcagttgttgtaaaagtgatggggaggactggatcaagaggacaggtgacacaagtgagagtgaagtttattgatgatcagaatcgatttatcatgagaaatgtcaagggaccagtcagagaaggtgatgttcttaccttgctcgagtctgagagggaggccagaaggttgcgttgattttctttttcgtgttctttttctggatcatatttgagtttcttgttatttgccaaatgtcggatttttgatatcatgggaagttgatcttaatagaacctttgggcttgcttaaatttatattattgttgcatgttttatttacg

SEQ ID NO: 4233 - DNA, 532 bp, Tragopogon dubius
actttccagccgctttatcgatctctccctatcgtcaggtaatgagttaatcttcgtcggctatcgatttctaagagttattgatgtaatcatttatagtttgcgcctcaatcaattcgtggaattccaattatcttagatttggtttgtatttttggtttagtgaaagatggagtctcagatcaagcacgcagtggtggtgaaagtgatggggagaaccggatctcgaggtcaggtgacacaagtgagagtgaagtttatcgatgaccagaaccgattcatcatgagaaacgtgaaaggacccgtcagagaaggtgatgttcttacccttctcgagtccgagagggaggccagaaggttgcgttgattctgcatattttccatattcgtaagttgttggttttggttttgattttatattatgttgtatttgtttagacaaacttatgaatccccttcttaggattgtagggtttttcccaaatttgtgatttgtcttaagattttgatcaattggtagctgttttgctac

SEQ ID NO: 4234 - DNA, 387 bp, Triticum aestivum
cccatcgccaacagcccaagaaagcatggatacgcaggtgaagctcgcggtggtggtcaaggtgatgggccgcacggggtcgaggggtcaggtgacccaggtgagagtcaagttcctggatgaccagaaccgtctcatcatgaggaacgtcaagggccccgtccgtgagggcgacatcctcaccctgctcgagtccgagcgggaggccaggaggctgcgctaagaaatttcttcctctatacctgtctgtctttggaagaagaatgatgtactgttgccttcttagtctaccgcttttgttctttgcctagccatgtggaggtgtgatgagttttgttctgttgcctaaactaaagtgcacttgatgttgtgagacttgatcattgt

SEQ ID NO: 4235 - DNA, 852 bp, Triticum aestivum
cccacgcgtccgcccacgcgtccgcggacgcgtgggcgactggagcacgaggacactgacatggactgaaggagtagaaaaccctctcttctttccgccctacttgcgcctgcgcagccgcctccgtcgttgtagcagaagcagcgatcccccgtcgccaacacccgaagaaagcatggatacccaggtcaagctcgcagtcgtggtgaaggtgatgggccgcaccggctccaggggtcaggtgacccaggtcagggtgaagttcctggatgaccagaaccgtctcatcatgaggaacgtcaagggccctgttcgtgagggcgacatcctcaccctgctcgagtccgagcgggaggccaggaggctgcgctgagcggctgcttttcctgtcttcggaagtaaactctactgcatttgaatcaacttaatgaacgctggctttgtcttttgcctaggctatggaaatgtaagcagtacttaataggttgcagttttcttctgttgcctgaattaaagtgcacttgatgttgtgagacttgatcatccttgcgcacctctgggttatttgaattgattggatgaatgctatattgtatcctatgatttggtgctggtgtaaacctgaattgcttctagtaaaattatggttacctgtggtgacttgtttcttgacacttgaactggaaaattcagtagttctctctcacaacaatcctgctggtaataatagtgaatgcaatttgggttacatccaaagttttctctcacaacgttgttctctgttgagtaaagctgtctatcatccaaagttgctatatgaatggagaacagcgttgatagataaaaaaaaaa

SEQ ID NO: 4236 - DNA, 416 bp, Triticum aestivum
ccccatcgccaacagcccaagaaagcatggatacgcaggtgaagctcgcagtggtggtcaaggtgatgggccgcaccgggtccaggggtcaggtgacccaggtgagagtcaagttcctggatgaccagaaccgtctcatcatgaggaacgtcaaggggcctgtccgggagggcgacatcctcaccctgctcgagtctgagcgggaggccaggaggctgcgctaagcactttctttcttcacctgtctgtcttcggaagtatcatgaaatgatgtgctgttgccttcttactctaccgctttcacttttgccttggctatggagatgtaatgagtttccttctgttgcctacattaaagtgcacttgatgttattgttgcacacctctgggtaatgtgaatcgactatattggatcc

SEQ ID NO: 4237 - DNA, 405 bp, Triticum aestivum
cccatcgccagcagcccaagaaagcatggacacgcaggtgaagcttgcggtggtggtcaaggtgatgggccgcaccgggtcgaggggtcaggtgacccaggtgagagtcaagttcctggatgaccagaaccgtctcatcatgaggaacgtcaaggggcccgtccgtgagggcgacatcctcaccctgctcgagtccgagcgggaggccaggaggctgcgctaagaaatttcttcctttatacctgtctgtcttgggaagaaaaatgatgtactgttgccttcttagtctaccgctttcgttctttgcctagctatgtggaggtgtaatgagttttgttctgttgcctaaactaaagtgcacttgatgttgtgagacttgatcattgttgcagacctcttggtaat

SEQ ID NO: 4238 - DNA, 396 bp, Triticum aestivum
agctcgtcggcctccgtccacgcgagaagcgagagcatggacacccaggtgaagcttgctgttgtggtgaaggtgatgggcaggaccggctccaggggtcaggtgacccaggtcagagtgaagttcttggatgaccagaaccggctcatcatgaggaacgtcaagggcccagtccgcgagggtgacatcctcaccctgctcgagtctgagagggaggccaggaggctgcgctgaacccttgttgtcttggatgtaatctgttaattttgttcaatgtttgtcgaacttgccgtgtgacccatactatatctgctttgggatttaagtaagcctggattgcattttttttagttcctgggtgggaaattgcaattgtttgtccgcaaaaaaaaaaaa

SEQ ID NO: 4239 - DNA, 423 bp, Triticum aestivum
ctcagaagcagccggagaaagcatggatacgcaggtgaagctcgcggtggtggtcaaggtgatgggccgcacggggtcgaggggtcaggtgacccaggtgagagtcaagttcctggatgaccagaaccgtctcatcatgaggaacgtcaagggccctgtccgtgagggcgacatcctcaccctgctcgagtctgagcgggaggccaggaggctgcgctaagaaatttcttccttcatacctgcctgtcttcaggacgaagaatgatgtactgttgccttcttagtctactgctttcgttctttgcctagctatgtggaggtgtagtgagttttgttctgttgcctaaattaaagtgcacttgatgttgtgagacttgatcattgtcgcacctcttggtaatgtgaatcgtgaatcgtctatat

SEQ ID NO: 4240 - DNA, 428 bp, Triticum aestivum
cccatccccaacagccgaagaaagcatggacacgcaggtgaagctcgcggttgtggtcaaggtgatgggccgcacggggtcgaggggtcaggtgacccaggtgagagtcaagttcctggatgaccagaaccgtctcatcatgaggaacgtcaagggacccgtccgtgagggggacatcctcaccctgctcgagtctgagcgggaggccaggaggctgcgctaagaaatttcttcctttatacctgtctgtcttcgggaagaagaatgctgtactgttgccttcttagtctactgctttcgttatttgcctagctatgtggaggtgtaatgagtcttgttctgttgcctaaattaaagtgcacttgatgttgtgagacttgatcattgttgcagacctcttggtaatatgaaccgtgaatcgtctatat

SEQ ID NO: 4241 - DNA, 506 bp, Linum usitatissimum
gagaaacctagcagcagcagaagccgccgtactccgtctcgtctcatatcgtttcacaaggatggaatcaggaatcaagcacgctctagttgtgaaggtgatgggccgtacaggatccagggggcaggtgactcaggtcagggttaagttcatcgacgacccaaaccgtttcatcatgaggaacgtcaagggacccgtgagagaaggtgacatcctcaccttgctcgagtctgagagagaggccaggagacttcgttgatttccgtcctgcctttgcattccccttggttcgtttttggggactacaatcgtctggcgtttgtggtagttacaatttcaaggtttacttctgatgacctactgaaaaacacttgaatgttatgttttggggattatattattgtatggattgctgttagtgtgttcaatcagtctttgaattgaatttatcttgaagcttggcttgtggtttgttaatttattgctcaccgagccagctctttccg

SEQ ID NO: 4242 - DNA, 482 bp, Aquilegia formosa
ttttctgggagagtttctgagcattcgatcttccctttctctctcgatcagacgaactttgttagcaagtgaagcatggattctcaggtgaagaatgctgttgtggtgaaagttatgggccgaactggttcaagagggcaggtgactcaggtcagagttaagtttattgatgaccagaaccgtctcatcatgaggaatgtcaagggacctgtcagagaaggtgacatcctcacccttcttgagtctgaaagggaagctcgaaggttgcgctgattcaaagatgtgtgttttcgccagagttgttttttcccatgattttaggtttatattggactactagattcaaagatggattaatatgggaattttgtttagttttgttatttaagaatcttcctttctacttaatgaacctctgttatgttatgcagacataaatattgtgctggttacttgttattgatcctctttatgtgtttttt

SEQ ID NO: 4243 - DNA, 468 bp, Aquilegia formosa
ttttctgggagagtttctgagcattcgatcttccctttctctctcgatcagacgaactttgttagcaagtgaagcatggattctcaggtgaagaatgctgttgtggtgaaagttatgggccgaactggttcaagagggcagagttaagtttattgatgaccagaaccgtctcatcatgaggaatgtcaagggacctgtcagagaaggtgacatcctcacccttcttgagtctgaaagggaagctcgaaggttgcgctgattcaaagatgtgtgttttcgccagagttgttttttcccatgattttaggtttatattggactactagattcaaagatggattaatatgggaattttgtttagttttgttatttaagaatcttcctttctacttaatgaacctctgttatgttatgcagacataaatattgtgctggttacttgttattgatcctctttatgtgtttttt

SEQ ID NO: 4244 - DNA, 341 bp, Carica papaya
agaatggattctcaaattaagcatgctgtggtggtgaaagtcatgggtagaacaggatctcgaggtcaggtgacacaggtgagagtcaagttcttggatgatcaaaatcggttcatcatgaggaatgtgaagggaccagttagagaaggagatgttctcactcttcttgagtctgagagggaagctagaagattgcgctagtaggtttttttttttttgttctgttaatttttctagtgttgaatttggttacagtgactgctagtaattgaggtttgatagttaatgaaaacatgttaagattcattatatttaatgagatgctttaaatgtttctattt

SEQ ID NO: 4245 - DNA, 606 bp, Amsonia hubrichtii
gccgtcgaagtcacagctcttcgcagtttcagctccagccaaatggattctcagattaagcatgctatagtggtgaaagtaatgggtcgcactggatccagaggacaggtgactcaggtgagagtcaagttcattgatgaccagaaccgtttcatcatgaggaatgtcaagggaccagtcagggagggagatgttctcactttgcttgagtctgagagagaagctaggaggttgcgctgattttctctgctggtgttcttatcctcttttaaggccttcatactacatataatttgatgtaaaaccatatccaattttgagctttctggtgatgcaagacttggtcatggttggttaggattatatgtcatttagtttaaattgattgctttagtttcttatgtttgacaatatggtggttttccagtcattgctaatcagttcttagtggtcatggaaatatgagaacttggtattgtatgcatctctctctatctctctcaagatccgtctatgccactgttttgatgccatgcccttgactcaaacatttgctgttattcattgttcttctttagattagactgaaaatttcaagttcaagat

SEQ ID NO: 4246 - DNA, 669 bp, Amsonia hubrichtii
ctatcgcaagatggattcccagatcaagcatgctatagttgtgaaagtgatgggccgcactgggtctaggggacaggtgactcaagtgagagtcaagtttattgatgaccagaaccgattcattatgaggaatgttaagggaccagtcagggagggagacgttctcaccctgcttgagtctgagagagaagcccggaggctgcgttgatggctttgctctatgctcataccatcttttgagtttgatgtagatgtagaagaaatccatgttttcgtttttgggaatatccatttaagactattcgacaggctgggttgcttttgctgtttgattcaagttgtttaggtgaatgctttttgtcattttgaacaattatgaaatgagttcgtcgatacgtcttcgttctgcaatctcaatattgatagagaaatttcaatcagaaagagcttatgccagttagataatgaccttatttggttttggaaggttaaaactttaacttccatgtagttcatatttgagatttgtaatgctttaggcagaaaagttctttccatgggaaacattgtcgcctctgagtccttaatcttacctggatggtgtctatgtttgtcaatatagcgattgcctgcttagcctaatattcgacaacttggattaaataatgg

SEQ ID NO: 4247 - DNA, 228 bp, Malus domestica
ctattttgtcttctgtgaagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccggtcagggagggggatatccttaccttgctcgagtccgagcgggaggcaagaaggttgcggtaatcatcggag

SEQ ID NO: 4248 - DNA, 228 bp, Malus domestica
ctattttgtcttctgtgaagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccggtcagggagggggatatccttaccttgctcgagtccgagcgggaggcaagaaggttgcggtaatcatcagag

SEQ ID NO: 4249 - DNA, 470 bp, Catharanthus roseus
caatagccgtctgagcttctgccaccttagctctgaattcttcgcagttcaagcttcagcatggattcacagattaagcatgctatagtggtgaaggtgatgggtcgcactggatccagaggacaggtgactcaggtgagagtcaagttcatagatgatcagaaccgtttcatcatgaggaatgtcaagggaccagtgagggagggagatgttctcactctgctagagtctgagagagaagctaggaggttgcgctgatttatgtcctttctttttttttttttttatcaatgttttaaggctttgatactacattaatttcatgtgaaagtataatcaattttgagcttacccggggagatgcaagacatgatcagtggttctttagaattaattatcaattagttgattgctctagttgtgttttgccaatatgaagtgtttcccagtcatgctagtcacttaatggt

SEQ ID NO: 4250 - DNA, 463 bp, Catharanthus roseus
cgtttgtgcttctgccgccgtagctctcctctcctcgctcttcctagtttcagcttcagaatggattctcagattaagcatgctattgttgttaaagtcatgggtcgcactggatccagagggcaggtgacccaggtgagagtcaagttcatcgatgatcagaaccgtttcatcatgaggaatgtcaagggaccagtcagggagggagatgttcttaccctgcttgagtctgagagagaagccaggaggctgcgctgatttgcttccttgtattctcatcttccttgaggtttcgtataattcgatgtaaaactatatccaattttgagctttctggtgatgcaagactttgttcaatggttgtttaggattgaatattatttagcttaagttgattgctttagttatgtttggttttctgactctgctagtcaaatgttaatggtaatggaattattggagc

SEQ ID NO: 4251 - DNA, 506 bp, Distylium racemosum
cgaaattttggtcgatcgaggggaagaagttccttgcttggttacagcgactttgcgggtagagctcggaaggccaggaaatcatggattcacaggtgaagttggcagtagtggtcaaggttattggccgtactggatcaagaggtcaagtcacacaggttcgagtgaagtttttagatgatcagaatcgactcattatgagaaatgtcaaaggacctgttagagaaggtgacgtccttactctgctggaatctgaaagagaagcaaggagattgcggtgatcatggttttagatttggacttggactccagtggactagcttttgatgctattttcattttttttgattgagaaaagactggaaagagtatggttattatgaacagtatgggaaaaaagattttgcaaagttgttttccttggcagttaagccacatgagaattaatttactgtaatgaaatttgaacttaaatatctatatattgagtgtagtacatgatactc

SEQ ID NO: 4252 - DNA, 539 bp, Eucalyptus grandis
cgccctcgctgaagattttcagaagctcaagctttcggccgcttcctctcttcctcgcctctccttcctctctccccatctcagaatggattctcagatcaagcatgctgttgtggtgaaagtcatgggccgaactgggtcaagagggcaggtgactcaggtgagagtcaagttcttggacgacatgaaccggttcatcatgaggaacgtgaagggaccggtgagggaaggagatgtcctcacccttctggagtctgagagagaagcaaggaggctccgttgagcaaatcatgatttttatgtttcccttgagttttggtaatgactgtagtggggtttctgctgctgctggtggattgaatgtgagagtgttttaactttattttcagttcacattttggtcactttgtgtcaaacatttgaacttgatcatgaatgaattgtaggaaagtatcttacgtttagtgacgtgttatggatctccatatattggtgcgtgagatatgatgtcaatttcagcttcacctttgtgtttctga

SEQ ID NO: 4253 - DNA, 318 bp, Flaveria ramosissima
cttcattcatccgcagcagccgcacctaagcatttatcgtttgttaatcaatctctacgatcacatcaggtagcgaacgatggactctcagatcaagcacgcagttgtggtgaagataatgggccgaaccggttcacgaggtcaggtgacgcaggttcgagtgaagtttctcgatgatcagaaccggttcatcatgagaaacgttaaaggaccggttagagaaggtgatgttcttacgttgcttgaatcggagagagaagctaggagattgcgttgattgttcgatgattttgtcatcggagattcactggttcgatt

SEQ ID NO: 4254 - DNA, 311 bp, Flaveria ramosissima
gttaatcaatctctacaatcacatcaggtagcgaacgatggactctcagatcaagcacgcagttgtggtgaagataatgggccgaaccggttccagagggcaggttacgcaggttcgagtgaagtttctcgatgatcagaaccgattcatcatgagaaacgtcaaaggaccggtgagagaaggtgatgttcttactttgctagagtcggagagagaagccaggagattgcgctgattgttcgatgattttgtcatctgaaattcactggttcgattattacgctattgtcgttgttttgattttgattttg

SEQ ID NO: 4255 - DNA, 352 bp, Flaveria ramosissima
cttcagtcatccgcagcagccgcacctgagcatttgtggtctgttaatcaatctctacaatcacatcaggtagcgaacgatggactctcagatcaaacacgcagttgtggtgaagataatggggcgaaccggttcacgaggtcaggtgacgcaggttcgagtgaagtttctcgatgatcagaaccggttcatcatgagaaacgttaaaggaccggtgagagaaggtgatgttcttacgttgcttgaatcggagagagaagctcggagattgcgttgagtgttcgatgattttgtcatcggtgattcactggttcgattgttacgctattgtcgttgtttttgattttgattt

SEQ ID NO: 4256 - DNA, 854 bp, Phalaenopsis aphrodite
ccagcgccgaaagtttcgctggaaacctagcttcggtcggtctcctcgcgctcaaaacccgccggccgaccgctacttgctggcgattcctcctcgttggtgctctcctccttgtcggatcgcctctccttctctgcaccgaactcgctctcggcattgcaagcgccggcttttccctcttctctctttttaccaaaccctagccgagcccttcttcccctctttcatctgagcttttggaaaagatggattctcaggtgaagttggctgttgttgtgaaggtaatggggagaactggttctagaggtcaggtgacccaagtccgggtcaaatttatggatgatccaaaccgattaatcatgcgaaatgtgaagggtccagtcagggaaggagatatcctcacccttcttgaatctgaaagagaagctcggaggcttcgttgaattatattatcattgcatgtttctgctcactgtttggtctctactttttgtttgctctgaactactttatatgcatcttttgatgtagaactgttgcagcatgtttctgctcaccatttggtctccactttttatatgcatctttttgatgtagaactgttatttcagtttatttatgtatccgtaaaacttgagatattttctgagtattttcttctgtgtcattcaattgaaatatgaagttcattttaaacatttgggataaagttaatgaatgcttcagtgggcgctgccataaactgcatttatttttattaggggtagtttatatacataatcatatgattatgatataaatatctatttattatccatctttcatttttactttgcatagccctcaaacctcac

SEQ ID NO: 4257 - DNA, 773 bp, Phalaenopsis aphrodite
agcgccgaaagtttcgctggaaacctagcttcggtcggtctcctcgcgctcaaaacccgccggccgaccgctacttgctggcgattcctcctcgttggtgctctcctccttgtcggatcgcctctccttctctgcaccgaactcgctctcggcattgcaagcgccggcttttccctcttctctctttttaccaaaccctagccgagcccttcttcccctctttcatctgagcttttggaaatttaacttgaaaactgcagaagatggattctcaggtgaagttggctgttgttgtgaaggtaatggggagaactggttctagaggtcaggtgacccaagtccgggtcaaatttatggatgatccaaaccgattaatcatgcgaaatgtgaagggtccagtcagggaaggagatatcctcacccttcttgaatctgaaagagaagctcggaggcttcgttgaattatattatcattgcatgtttctgctcactgtttggtctctactttttgtttgctctgaactactttatatgcatcttttgatgtagaactgttgcagcatgtttctgctcaccatttggtctccactttttatatgcatctttttgatgtagaactgttatttcagtttatttatgtatccgtaaaacttgagatattttctgagtattttcttctgtgtcattcaattgaaatatgaagttcattttaaacatttgggataaagttaatgaatgcttcagtgggcgctgccataaactgcatttatttt

SEQ ID NO: 4258 - DNA, 711 bp, Phalaenopsis aphrodite
aacaacgctcgcctggctcttctctcctctcctcatccttcaaacgagacaagaagcttttcttcctcttttgagccccccaacctcgaagggtttctgctttcaatttctttctccgatcatctgagccgcaaggaatttcttcctccgatcatttgaaccgctagaaactttaatcgatctaactagagaattgcagaagatggattctcaggtgaagctggctgttgttgtgaaggtgatggggagaactggttctagaggtcaggtgacccaagttcgggtgaaatttatggatgatccaaaccgattaatcatgcgaaatgtgaagggcccagtcagagaaggagacatccttacccttcttgaatctgaaagagaagcccggaggcttcgttgaattatattattaccattgcatatttctgctcactgtttggtctctacttgttgtttgctctgaagtactttatatgcatcttttcatgtagaactattgcatgtttctgctcaccatttgctatctactttttatatgcatccttttgatgtacaactgttatttcagtttatttatgtatcggtaaaacttgaagtattttcttcttctgtttatttatgtatctgcatttattttagtagggatatttgtatacataataatatgattatgatataattatctatttatcatccatctttcatttttac

SEQ ID NO: 4259 - DNA, 457 bp, Lippia dulcis
ctcctcagcttcgaacaattttctcgcggccgcctcctcgaatttctgcttttcgatcaagttcagaatggattcccaaatcaagcacgcaattgttgtgaaggtcatgggccgaaccggctctcgtggtcaggtgactcaggtgcgagtcaagttcattgacgaccaaaaccgtttcatcatgaggaacgtgaagggaccggtcagggaaggtgatgttctcaccttgcttgagtctgaaagagaagccaggaggctgcgttgatgcggttccacctgcttatgctatagttttggtgaaatgtgatacaatagtatgatgttgattgttgatttaagccttgctttccaagaatgttttaggggttgccaagttgagctttgtttgtccttttaacttcttattcgacattggtgttctggattttgcttttgtaatggtaatggaatatgactt

SEQ ID NO: 4260 - DNA, 406 bp, Lippia dulcis
caactatctacgcatcgttcccaatctctgtgcagagcttctctccggttctaagatctgcaattcctgacgaatggattccactatcaagcacgcgattgtggtgaaggttatgggccgaacagggtcaagggggcaagtcactcaagtgagagtcaagttcatggatgaccaaaaccgcttcatcatgaggaacgttaaggggcccgttagggagggagatattctcaccctgctcgagtctgagcgtgaggcaaggaggttgcggtgaaccttgcagctggtttctctacccctcttcagatcttggataaacttacggactgctgatttcttcaccagtcttctgattatgattagatttacggcaattgttgtttacataaacatttttcttctagattgg

SEQ ID NO: 4261 - DNA, 472 bp, Lippia dulcis
tataaataagaaccagtgctagggtttttcgctctccatcgagaattttttttccagcgcctttctgctttgctctgcaggatggaatcacaaatcaagcatgctgtggttatcaaggtcattggcaggactggatctcgtgggcaggtcactcaggtcagggtgaaatttattgatgatcagaaccgtttcatcatgagaaacgtcaagggacctgttagggagggcgacatcctcaccttgttggagtctgagagagaggcgaggaggctccgttgatttctctgcgccatttcttgctataacaatactactacagtttcttttttgaaaggttattttggtgtaggttttgtctgtattttggttaccttttgagatgacaaaacaagacctcacttatcgctgctttctgtttttatttgattgtttgccataatttcgtcttttaatatatttatgtgctaacttc

SEQ ID NO: 4262 - DNA, 418 bp, Lippia dulcis
ctgcagcggttgctcctaagctttctccgtcgctccgaagaatggaatcacaaatcaaacatgctgtggtgatcaaggtgataggcaggaccggttctcgtgggcaggtgactcaggtcagggtgaagttcattgatgaccagaaccggttcatcatgagaaatgtcaagggaccggtcagggagggtgacatcctcaccttgttggagtccgagagagaggcaaggagactccgttgatttccccgggctcttttattcgaatggcgaatactctttttgcatcttcatttttgaagtaggttgcgtttggattttgggtacctttaagtttctgcttttgttgctaaatcgaccttgtttggatgtttgcccctgcaaagatgtgtttgaacactgtttgttgagtaaacctgcac

SEQ ID NO: 4263 - DNA, 438 bp, Platanus occidentalis
agagattttgagcgaacggcttcccgcgttctttccttcgtctcgtcttctctctttcgctcctaactgagcacaggatggataatcaggtgaagcttgcagtcgtggtgaaggtaatgggacgaacagggtcaagaggacaggtgactcaagtgcgagtcaagtttctggatgaccagaaccgactcatcatgaggaacgtgaaggggcctgtcagggagggcgatgtcctcacactgcttgagtctgaaagggaagctaggaggttgcgttgagtgcatgttctttcgtgtgagggtttagtttagatttttagttcatttttgattggaatcattatcaacaatgtctttctggtatttttatgttaagagcatgagacaagaatgtaggatttggttagtagtactgcgtaaatttgcgtctgaaatactaagg

SEQ ID NO: 4264 - DNA, 482 bp, Silene vulgaris
taaactctgaggcgccgttctctccttgtttttcctctccaattcgcctctcttccaactcagcatggattccgcaaccaagcacgctgtagtcgttaaaatcatgggacgcacaggatcaaggggtcaggtgactcaagtcagggttaagttcttggatgaccaaaatcgttttatcatgaggaatgttaagggacctgtcagggaaggagacattctcacccttctcgaatctgagagagaggctaggagacttcgttgaatggcctatgcttgttcgtgcgctgtggtggaattttgtctcagttttcatgctattcgtgtttctgttagccttttaaactgaactctgtcaagacttctatcttatgtgctgttgctacagagtttaacattatgtgttccagtccctagtattttatgatgattttgtaaggatttattggtttatggatatgtgcggtttgttctaaattataacc

SEQ ID NO: 4265 - DNA, 444 bp, Tabernaemontana elegans
gcgccgtctctgagcactgccatctttcttcgctcttcacagcttcagcttcaggttcagaatggattctcagattaagcatgctatagtggtgaaagtgatgggtcgcactggatccagaggacaggtgactcaggtgagagtcaagttcatcgatgaccagaaccgtttcatcatgaggaatgtcaagggaccagtcagggagggagatgttctcactctgctcgagtcagagagagaagcgaggagactccgttgatttcttttattatgtctttgtccccttttgaggtcttgaactctgtgtaaaaccatgttcaattttgtgctttgttgtgatgctagacttgattgatggtgggttataggattgaaggtctttgaatttaagttgattgccatagttatggttgacaatatggtggattttctacttgcactaat

SEQ ID NO: 4266 - DNA, 679 bp, Tabernaemontana elegans
tgagcaccgccgcagcctttcgttgctcttggccgtttcagcctcagaatggattctcaaattaaacatgcgattgtggtgaaagtgatgggtcgtactggatccagaggtcaggtgactcaggtcagagtcaagttcattgatgatcagaaccggttcatcatgaggaacgttaagggaccagtcagggagggagatgttcttactcttcttgaatcagaaagagaagctcgtcggctacgctgattagcttctcttgttcctactcttgaatactccagttttgtgctttgttgagatgcaagacttaagttgattgctttacgtatgtttgacaatatggtgggttttccgctattggtaatccagtttttaatgtaatggaattatgaaagttccctgatagttcattctgctttaaaccaaacgtttcaagtttgagatgccaagtccattggaacaaaagcagaagcagccaaattgatttggttacatcaagtgacttgttgaagcctggttaagcatttgttgaatagactagctgatattgtttgcacgaacatgccttatggactagctgatattttttggaagtcaacgtatattgcaggccattacaaacaaggcatgatgtggtttagttagtgccttctaaatttttgtttcttttccttgcttt

SEQ ID NO: 4267 - DNA, 658 bp, Solanum lycopersicum
cgtaaccctacttataaggtttttagggtttaatcattctccattctctgatacacagcagcagcagcaacaacaacctacagctgcagatttttctcaccggaagaatggaatctgtaaccaagcatgcaattgtgattaaaatcatgggtcgtactggatccagggggcaggtgactcaggtgagagtcaagtttcttgacgaccagaacaggtttatcatgagaaatgtcaagggaccagtcagagagggtgatattctcacattgttggagtctgagagggaggcaaggagattgcgctgagcccataattatgattgccatatcgagtacttgattattggctgggatttatttcctatttaatagtctttgattttgtttgcttagactctataattttgaatatgttgattttgttgcactttatgtttctggaatagtttcatgttaaaattttgctagcattgcgtcaatggcaacaagcaatggttcttatttgttttcgtgtgtgtccatgtattgcgttgaatcttttccagtgttccttatgtgtgatattggtgctttgtcaaaggaaagggttttatgagaattcaaaatggttaagagaacataatttaatgttacaatgcctacaaatttattactttgga

SEQ ID NO: 4268 - DNA, 338 bp, Utricularia gibba
accgacatttccaagcgttaagttctctaaacaagttgttcttgttgaatcaagatggattctcagatcaagcacgccatcgtggtcaaggtcattgggagaacaggctcacgggggcaggtcactcaggtgagagtcaagtttgtggatgatcagaaccgattcatcatgagaaatgtcaagggccctgttcgagagggcgacattctcacgctgctcgagtccgagagggaggcacgaaggctgcgttgagtcctttgcttggtgttttgcttctcattgtgagttctttgtggcaccctatctacttctggtttctatggcacaaaaaaggtttg

SEQ ID NO: 4269 - DNA, 419 bp, Utricularia gibba
ggcgtctctcatctagggattgttctgtagactgctgccgttcttcggaaatctgaatttgatctctgagcttgttagagcaggcagcaatggattctcagatcaagcatgcgatcgtggtgaaggtgattggcagaacagggtcgagaggacaggtcactcaagtgagagtcaagttcgtggatgatcagaaccggttcatcatgaggaacgtcaagggcccagttcgcgagggtgatatcctcaccttgctggagtccgaaagagaggccaggaggctgcgctaactccatcatcaagcttaatgttggaagagttcattctgtgttgcatgcagtctttgaatttgggatccccggctctggtttcatgtcttagcaatgttggtgactaccgccttgcatctcgtcttcttgctg

SEQ ID NO: 4270 - DNA, 523 bp, Antirrhinum majus
gggtttaagctcgtagtttgattcagctgcatattcctcactctctgcgacctaatctctcgtactcgaaagaatggagtcacaaatcaagcacgctatcgtggtgaaggttatcggcaggactggatctcgtggtcaagttactcaagtcagagtaaagtttatcgacgaccagaaccgtttcatcatgaggaacgtcaagggacccgttagagagggtgacgttctcacattgctcgagtctgaaagagaggcgaggagattgcgttgatgtcttgaatttccgtttcttccttattgtggtgatttttactgttttgtgcttccgaggattttattaaagagtttaatgctagacttatccggttattgctaatgttatcagaatccttcacttttcagttttatcaaggaagcagtactatgtatcacttagctgctttggcgatgcgttgagaaattttgttacatgattgtgatccctgtttgaatcatttgtatcggtggcatgtttagttgtttc

SEQ ID NO: 4271 - DNA, 480 bp, Antirrhinum majus
  misc_feature (428)..(428): n is a, c, g, or t
ttcactcccgctttggcgttcaagcttcttcatcattaagaatggagtcccaaattaagcacgctattgtggtgaaagttattggaaggactggatcccgtgggcaagtcactcaggtcagagtgaagttcatcgacgaccagaaccgattcatcatgagaaatgtgaagggacctgttagggagggtgatgttctcacattgctcgagtccgaaagagaggccaggaggttgcgttgattcctctctcgtgtgtgtgttttagttcattacgaatatgtttattaagcttatgtgtgcatttttggtactttttgggaggtattactagacattgatgcaagcaagaattttgttccctagatattgatatttgtttgtttacctttgatggttactattgttgctgaaatttatctgcaatgttgnatcatactcacttgtgttttaagttcatatcttttgataaaaaaagaaaaaa

SEQ ID NO: 4272 - DNA, 626 bp, Malus domestica
cgttccctcgtctcttgcgattcagcacgcccttctgcgacgctgtttcttcttcttctccaagctctcgcagtatcttctgaaactccaaccagcagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccggtcagggagggggatatccttaccttgctcgagtccgagagggaggcaagaaggttgcggtaatcatcagagatggttttgtttgtcgatgctcctatgtctgagtttaggttcgttgcaagcaacagttattttgtgtcggtgaatggctgttgtgttgccctgggaattactagcattacagacattatttttgtgatgagattttgttatggaatgtttctaaactaaattgtctgaaaaaatcctaggttttgtttgagcaagtgactgttccttcttgctatgtcaaatgtttgctttccttcttaccatttaccaggagtgttccttaattgctagtcattctgttgtcttaaaatcaatacaagatgttgacgtggtttaaaaaa

SEQ ID NO: 4273 - DNA, 502 bp, Malus domestica
caacgccgttccttcgtcttgagcgattcaacacacccttttccgacgccgttttatcgtcttctccaagctcctgcagtcacttctgaaactccaacctccagaatggaaaacacgatcaagcatgctattgtgatcaaggttatgggacgaactggatctcgtgggcaggtgactcaagtgagagttaagtttctggatgaccagaaccgtttcatcatgaggaacgtcaagggaccagtcagggagggggatatccttaccctgctcgagtccgagagggaggcaagaaggttgcggtaatcatctgagatggtcttgtttgtcgatgctcctatgtctgagtttaggttctttgcaaacaactgttattttgtgtcactgaatgactatgcttttaccattactgcgtactactagcgttacagactttatttttatgatgagatgttatggttattgagcaacaattttagttcttaaaagttacaatgttttgttg

SEQ ID NO: 4274 - DNA, 584 bp, Malus domestica
tcctctcttcccactcattttgtcctacgccgttcctacgtctcctgcgattcagcacactcctctgcgacgccatttaatcgtcttcttcaagctctcgcagtctcttctgaatctccaacctccagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccagtcagagagggggatatccttaccttgctcgagtcagagagggaggcaagaaggttgcggtaatcatcggagatggtcttgtttgtcgatgctcctatgtctgagtttaggttcgttgcaagcaacagttattttgtgtcagtgaatggctgttgggttgccggttctgggaattactagcattataaacattatttttgtgatgagattttgttatggaatgtttctaaactaaattgtctgaaaaagtcctaggttttgtttgaacaagtgacaattttccttcttgctatgtcaaatgtttgctttccttcttacca

SEQ ID NO: 4275 - DNA, 498 bp, Malus domestica
tcttcttcaagctctcgcagtctcttctgaatctccaacctccagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccagtcagagagggggatatccttaccttgctcgagtcagagagggaggcaagaaggttgcggtaatcatcagagatggtcttgtttgtcgatgatcctatgtctgagtttaggttcgttgcaagcaacagttattttgtgtcagtgaatggctgttgggttgccggttctgggaattactagcattataaacattatttttgtgatgagattttgttatggaatgtttctaaactaaattgtctgaaaaagtcctaggttttgtttgaacaagtgacaattttccttcttgctatgtcaaatgtttgctttccttctta

SEQ ID NO: 4276 - DNA, 454 bp, Musa acuminata
gagcgaggcgtgcggtgtggattcttcatcttgaatcgatctcggcaagcatggatgctcaagctaagcttgcagttgtggtgaaggtgatgggccgaactggatctagaggtcaggttacccaggtcagggttaagttcttggacgaccaaaaccggctgatcatgaggaacgtgaagggcccagtaagggaaggtgatatccttacacttctcgagtctgaaagggaagctaggaggttgcgctgatgatacttcaaaaatagattatctttattggctacagactctaatcatcgtcctctttgccatggtttctgtttctctggtatcatttatctcaattttgtggcttgtggatgtgctataaagaatatcatgagtggtggtttttatattgctgactattgtggaaactgcatctttctattgtgaactccattgtattatcttca

SEQ ID NO: 4277 - DNA, 474 bp, Musa acuminata
agagagcgagagcggaatccccttttcttcgagtcgatttccggaaagcatggatactcaagctaagcttgcagttgtggtgaaggtgatgggccggactggatcaagaggtcaggttacccaggttagggttaagtttctggacgaccaaaaccggctgatcatgaggaacgtgaagggcccggtgagggaaggcgatatccttacccttcttgaatccgaaagggaggcaaggagattgcgctgatgaaactccatggcatttcttgcctaaccaggtagtgtatttctatttggctacagatttggtttcaagctacagacttggtttatgtttatgtggttttagctacttcagttgtctcatgtgagactgcttagaacacattatgttgaaaacttgattatctgctttatgttaaattttcttgtgaaccgttaatgttttagttccttgtgggctggtgtcgtaat

SEQ ID NO: 4278 - DNA, 507 bp, Musa acuminata
gggtgctttccccgcggccgccttcgcttccggagatctcaatagagaggcgatcttagcagcatggatactcaagctaaacttgcagttgtggtgaaagtgatgggccgaactggatctagaggtcaggtaacccaggtcagggttaaatttttggatgaccaaaaccggctgatcatgaggaacgtgaaaggccctgtgagggaaggtgacatcctcacccttcttgagtctgaaagggaggctaggagattacggtgatgactttcatgtcaatgttgcctacattagtagggtaactctattaagctacagattcgtccttctctgccatggtctttctggttctatggcattagtttgtattacttagtcgctttattatgagctgtatcgagtcactttattatgagctgtatcgagccaagaaactgtttttttctctagtgagtcatttaactctcaatgttttaacattttttatgctcatgtcagttctctctctcc

SEQ ID NO: 4279 - DNA, 535 bp, Musa acuminata
gctcccgcggccgccttcgcttacccatcgccccctacgcgagagagatcgtagcatggatactcaagctaagcttgcagttgtggtgaaggtgatgggccgcactggatctagaggtcaggttacccaggttagggttaagtttttggatgaccaaaaccggctgatcatgaggaacgtaaagggccccgtgagggaaggtgatatccttacccttcttgaatctgaaagggaggctaggagattgcgctgatgatggtaattattattatgatactctaatggtctttcttgcctacttcagtaggctatttctatttgtctacaaacttgtattatcggctcagtgggttttgttcattttttttgttgcatggattgtgttgaaaaattgagaaactgctctatgttctgttttggtatgaacccataatattttaattcgctgtggtgtttgtgtctggtcttaattaattgcatgtactcactccatcaaaaatgttttctcttggaatgagccgtggattgagcatgg

SEQ ID NO: 4280 - DNA, 424 bp, Phaseolus coccineus
  misc_feature (113)..(113): n is a, c, g, or t
ggactttggttagcaagcatcgcaaaaccctagcctactttcttcactcgttttttatttcaggatggactctcaggtgaagcatgctcttgttgtcaaagttatgggtcgtnctggatccagagggcaggtgccccaggttagagtgaagtttttggatgatcagaatcgtcccctcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtttaagttttaagattgaagtatgattggcttgat

SEQ ID NO: 4281 - DNA, 424 bp, Phaseolus coccineus
  misc_feature (27)..(27): n is a, c, g, or t
  misc_feature (42)..(42): n is a, c, g, or t
  misc_feature (49)..(49): n is a, c, g, or t
  misc_feature (174)..(174): n is a, c, g, or t
  misc_feature (232)..(232): n is a, c, g, or t
  misc_feature (371)..(371): n is a, c, g, or t
ggactttggttagcaagcatcgcaaanccctagcctactttnttcactngttttttatttcaggatggactctcaggtgaagcatgctcttgttgtcaaagttaggggtcgtactggatccagagggcaggtgccccaggttagagtgaagtttttggatgatcagaatcgtcncatcatgaggaatgtgaaaggccctgttagagaaggagacattctccccctcctcgantccgagagggaagcaagaagattgcgctagatggtttaaatcgaaccagtggcttgatttttgtggtagttagtggatgccaaaggttatatcaccctatcttgatgttttggatctatttttattcgaattatggacngaattttgttgtttttagtctaagttttaagattgaagtatgattggcttgat

SEQ ID NO: 4282 - DNA, 424 bp, Phaseolus coccineus
  misc_feature (27)..(27): n is a, c, g, or t
  misc_feature (33)..(33): n is a, c, g, or t
  misc_feature (89)..(89): n is a, c, g, or t
  misc_feature (115)..(115): n is a, c, g, or t
  misc_feature (272)..(272): n is a, c, g, or t
  misc_feature (327)..(327): n is a, c, g, or t
  misc_feature (391)..(391): n is a, c, g, or t
ggactttggttagcaagcatcgcaaanccctancctactttcttcattcgttttttatttcaggatggactttcaggtgaagcatgctnttgttgtcaaagttatgggtcgtacnggatccagagggcaggtgccccaggttagagtgaagtttttggatgatcagaatcgtcccatcatgaggaatgtgaaaggccctgttagagaaggagacattctccccctccttgaatccgagagggaagcaagaagattgcgctagatggtttaantcgaaccagtggcttgatttttgtggtagttagtggatgccaaaggttatatcancctatcttgatgtttgggatctatttttattcgaattatggacggaattttgttgtttttagtntaagttttaagattgaagtatgattggcttgat

SEQ ID NO: 4283 - DNA, 425 bp, Phaseolus coccineus
ggactttggttagcaagcatcgcaaaaccctagcctacttttttcactcgttttttatttcaggatggactctcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagacattttccccctcctcgaatccgagagggaagcaagaagattgcgctagatggtttaaatcgaaccagtggcttgatttttgtggtagttagtggatgccaaaggttatatcaccctatcttgatgttttggatctatttttattcgaattatggacggaattttgttgtttttagtctaagttttaagattgaagtatgattggcttgata

SEQ ID NO: 4284 - DNA, 426 bp, Phaseolus coccineus
ggggactttggttagcaagcattgcaaaaccctaccctactttcttcattggttttttatttcaggatggactctcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagacattttccccctcctcgaatccgagagggaagcaagaagattgcgctagatggtttaaatcgaaacagtggcttgatttttgtggtagttagtggatgccaaaggttatatcaccctatcttgatgtttgggatctatttttattcgaattatggacggaattttgttgtttttagtttaagttttaagattgaagtatgattggcttgat

SEQ ID NO: 4285 - DNA, 426 bp, Phaseolus coccineus
  misc_feature (8)..(8): n is a, c, g, or t
  misc_feature (57)..(57): n is a, c, g, or t
  misc_feature (350)..(350): n is a, c, g, or t
  misc_feature (373)..(373): n is a, c, g, or t
  misc_feature (393)..(393): n is a, c, g, or t
ggggactntggttagcaagcatcgcaaaaccctagcctactttcttcactcgttttntatttcaggatggactttcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcagcctatcttgatgtttgggatntatttttattcgaattatggacngaattttgttgtttttagtntaagttttaagattgaagtatgattggcttgat

SEQ ID NO: 4286 - DNA, 425 bp, Phaseolus coccineus
  misc_feature (282)..(282): n is a, c, g, or t
ggactttggttagcaagcatcgcaaaaccctagcctactttcttcactcgtcttctatttcaggatggactctcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagacattttccccctcctcgaatccgagagggaagcaagaagattgcgctagatggtttaaatcgaaccagnggcttgatttttgtggtagttagtggatgccaaaggttatatcaccctatcttgatgtttgggatctatttttattcgaattatggacggaattttgttgtttttagtttaagttttaagattgaagtatgattggcttgata

SEQ ID NO: 4287 - DNA, 422 bp, Phaseolus coccineus
ggactttggttagcaagcatcgcaaaaccctagcctcctttcttcactcgttttttatttcaggatggactctcaggtgaagcatgctcttgttgtcaaagttatgggtcgtactggatccagagggcaggtgccccaggttagagtgaagtttttggatgatcagaatcgtcccctcatgaggaatgtgaaaggccctgttagagaaggagccattctccccctccttgaatccgagagggaagcaagaagattgcgctagatggtttaaatcgaaccagtggcttgatttttgtggtagttagtggatgccaaaggttatatcaccctatcttgatgttttggatctatttttattcgaattatggacggaattttgttgtttttagtctaagttttaagattgaagtatgattggcttg

SEQ ID NO: 4288 - DNA, 562 bp, Brachypodium distachyon
gggttccttcctctcctcacgcactcgtcccttcgcgccgccgccgtaaggagcacaaccgccgccgccgctgacaaaccgaaaaaagcagcatggatacccaggtgaagctcgcggtggtggtgaaggtgatgggccgcaccggctccaggggtcaggtgacccaggtgagagtcaagttcctcgacgaccagaaccgtctcatcatgaggaacgtcaagggccccatccgcgagggcgacatcctcaccctgctcgagtcggagcgcgaggccaggaggctgcgctgagctcttgcggtggtttcagtctctgaaagcaaaatgttgccatctttagtgtatttcttccatattaagttcctggacactggttatgtctttggcctaggctttggagttgtatgaaagagcaatggagatttaatgactactgcttgcctggtttcagttttggtctgttgcctaaattaagtgcatttgctgtgagattgatcttgttatgttatgatagcctgttggtctgcttgcctgtcccctttggaggtaatgttatgattttt

SEQ ID NO: 4289 - DNA, 601 bp, Brachypodium distachyon
tagcccatcaattcgctttaagagcacgcccaagcccgccggcggcgctaggttttactccctcttcctttcagccctgctcgcgccgccgcctccctcgcagcagcagcaagcaatcaccgtcgccaacagccaaggaaagcatggacacacaggtcaagctcgcggtcgtggtcaaggtgatgggccgcaccggctccaggggtcaggtgacccaggtcagagtgaagttcctggatgaccagaaccgtctcatcatgaggaacgtcaaggggcccatccgcgagggagacatcctcacccttctcgagtccgagcgtgaggccaggaggctgcgttgagccgccgtggtttctgtcttcgaaagtaaaatgctgggttgttgcttcctttactgtagtacgtttgaatcttgaatgaacactggttatgtgtttcgcctaggctatggatgtgtaatgagcacttaactggttgcagttttggtctgttgcctaaaccttgatgttgtgagactcgatcatgctgtgtgacctcccggtgatatgatggattgaatgagcgctatatttaaaaaagaatatttcgctttgtgctagtg

SEQ ID NO: 4290 - DNA, 612 bp, Brachypodium distachyon
atagataataatataagagcgctagggttttagcatctcttcctctcagccctcttcgcgccgccggctccgtcgtccctgcagcagcagcaaccgccgtcgccaacagccgaagaaagcatggacacgcaggtcaagcttgctgtcgtggtcaaggtgatgggccgcaccggctccaggggtcaggtgacccaggtcagagtgaagttcctggatgaccagaaccgtctcatcatgaggaacgtcaaggggcccatccgtgagggcgacatcctcacccttcttgagtccgagcgtgaggccaggaggctgcgctgagcagctatggtccctgtctccggaagtaaaatgctgttgtgttgcctttactgtactgcgtctgtatgaagttcttgaacactggttatgtcttgcgctcagctatgtaggtctaatgagtacatcactggttgcagttttggtctgttgcctaaaattaaagtgtactttggtgttgctagattgatcttcctctgtgacctccggtgatatgaatttattggatgagtgctttattgaatcctactctgagtgctactatatgaaagaatctgaaatctttatctgctggtg

SEQ ID NO: 4291 - DNA, 542 bp, Bruguiera gymnorhiza
gctgtctcatagttctgtatctgagctccctcgcgcagtcggctgcctccaagctctctcgttctcggtttcggccgctgcgatttgcaggaaggatggattcgcagattaagcatgccgtggtggtgaaggttatgggtcgaactgggtcccgtgggcaggtcactcaggtccgggtcaagtttattgatgaccagaaccgattcatcatgaggaacgtgaagggacctgtcagagaaggggatgtgctcacattgctagagtctgagagggaggctagaaggctccgctgaatgttccatctatttctatttctagttcaatatgcagtctcaattgttgtttggctagtgacttgtcagtatcgacatggtctcttctctacttactctgtcattagatagacttgaagtttggtttttgggtggtaatctgattatggttttacttcttacaagttttgtcgtgttacttgcatcaacgactatgcattagcattgaattcctgttgggggtaatatcaaatacaacgtgctttcttt

SEQ ID NO: 4292 - DNA, 534 bp, Manihot esculenta
aaccttgtaatagctgcaacaagaaatccaagcggctgctcttcctctgcatctctgacttttcttcctatcagcacaggatggatactcaaattaagcatgccgtggtggtgaaagtaatgggaaggactggatcaagggggcaggtgactcaagtcagagttaagtttttggatgaccagaatcggttcatcatgaggaatgtgaagggacccgtcagagaaggagatgtgcttaccctccttgaatctgaaagggaagctaggaggctacgttgatgggtgtatttctgccactcgttccttgctttttatgatgtagcaaaagctgttttgttgtggtagctaagagtaatttccaatgctttttatgaggtttgtcatctgggttacgttcttcatcataacaatatcaagacatgaattttgaaatatgggttttcttaaatacttgacaaaggcctagagtttgttgcgaattgtggtttcctttgttgggatttttcaatactactgtcaatttgtgttgcttgca

SEQ ID NO: 4293 - DNA, 482 bp, Manihot esculenta
gccttgcaagagctgcaacaagaactacgagcggccgctcttcctatcagcccaggatggatactcaaattaagcatgctgtggtggtaaaagtaatgggaaggactggatcaaggggtcaggtgactcaagtcagagtcaagtttttggatgaccagaatcgattcatcatgaggaacgtgaagggacccgttagagaaggagatgtgcttacccttcttgaatctgaaagagaagctaggagactacgttgatgggtgtatttctgcctctcattcctatgctttttatgatgtagcaaaggctgttttgtagtagaagctaagagtaatttccaatgcttttggattacttttttcttcatgagaatatcaagacgtgaattttgatatatggtttttttaagtgcttgaaaagacctagaatttgctgtgaattgtggtttcctttgttgggattttttaatttgtagctatgctaat

SEQ ID NO: 4294 - DNA, 559 bp, Manihot esculenta
actcagaatttccctcctttaaaaaccctagatatccgccctcttttttctcaccttgcaagagctgcaacaggaattccgagcggccgctcttcctctgcgtctccgactgctcttcctatcggcccaggatggatactcaacttaagcatgctgtggtggtgaaagtaatgggaaggactggatcaaggggtcaggtgactcaagtcagagtcaagtttttggatgaccagaatcgattcatcatgaggaacgtgaagggacccgttagagaaggagatgtgcttaccctccttgaatctgaaagagaagctaggagactacgttgatgggtgtatttctgcctctcattcctatgttttttatgatgtaaggttgttttgttgtggtagctaagagtaatttccaatgctttttatgagctttgtcatctgtattacatttttcatcataacagtatcaagacatgaattttgatatatgggttttttgggtacttgaaaaagacctagattttgatgtgaattgtggtttcctttgttgggattttttatttttt

SEQ ID NO: 4295 - DNA, 495 bp, Catharanthus roseus
atccaaagaattcggcacgaggcttcaatagccgtctgagcttctgccaccttagctctgaattcttcgcagttcaagcttcagcatggattcacagattaagcatgctatagtggtgaaggtgatgggtcgcactggatccagaggacaggtgactcaggtgagagtcaagttcatagatgatcagaaccgtttcatcatgaggaatgtcaagggaccagtgagggagggagatgttctcactctgctagagtctgagagagaagctaggaggttgcgctgatttatgtcctttctttttttttttttttatcaatgttttaaggctttgatactacattaatttcatgtgaaagtataatcaattttgagcttacccggggagatgcaagacatgatcagtggttctttagaattaattatcaattagttgattgctctagttgtgttttgccaatatgaagtgtttcccagtcatgctagtcacttaatggt

SEQ ID NO: 4296 - DNA, 518 bp, Catharanthus roseus
tagtggatccaaagaattcggcacgaggcttcaatagccgtttgtgcttctgccgccgtagctctcctctcctcgctcttcctagtttcagcttcagaatggattctcagattaagcatgctattgttgttaaagtcatgggtcgcactggatccagagggcaggtgacccaggtgagagtcaagttcatcgatgatcagaaccgtttcatcatgaggaatgtcaagggaccagtcagggagggagatgttcttaccctgcttgagtctgagagagaagccaggaggctgcgctgatttgcttccttgtattctcatcttccttgaggtttcgtataattcgatgtaaaactatatccaattttgagctttctggtgatgcaagactttgttcaatggttgtttaggattgaatattatttagcttaagttgattgctttagttatgtttggttttctgactctgctagtcaaatgttaatggtaatggaattattggagcctatgcatctgtctctc

SEQ ID NO: 4297 - DNA, 536 bp, Gossypium hirsutum
accttactctgaaattcacaagaagcagccgctaccgtgtcgttggcctcgtacttagccaaatttaaggatggattcacaaattaagtttgctgtggtggtgaaaattatgggaaggacgggatcgagaggtcaagtgactcaagtgagagtcaagtttttggatgatcagaaccgttttattatgaggaacgtgaagggaccggtcagggagggagatattctcaccttgctcgagtctgagagggaagctaggaggcttcgttgatcacttcctcttatctccattttgttacgttattaatgtttatgttgcgcaagtagctagctgtttcttatttctgaaaggtatccaaattttcaaatctagacttggattttgggagactgatttaaatggatgagttgtttttaaagcataatcattatgtttaaatgaactaagttggtttttgagattatgattttcatgcccctttaatttctgctgtttcaaaatgttattcatttctaaaagttgcttgaacgtggctggc

SEQ ID NO: 4298 - DNA, 1108 bp, Gossypium hirsutum
attcaaccaccctaaaaaaaaattattattacaaaaggccaaagcaaagcaaaactgcataatatgaatacaaaagaaatagcgcatcaatacccttatatatctatgatatataagaaaatcacaccaattcacattcacaaaatcaaatttatgtccactcaatgtcaaccatgcatcatcatataacgagatatctaaaactttagagaacattgcaacaattgataaccaccccaaatattatctcggacgcaacgattagaggctactccccgtccatcgaccgagtgcagcagtgaaattcacagggtagccaatgtcatgaacagtcttggaaaagcttctgaattcaatgcaccaagagagcaattcaaagagaccaacatcggaagacgcataagaagcacagcggaaaccggcaaagcagagcctgctccggtagccattgcaggagaaggagcaatatcctgtgccatggtcccggacacaacaaacatggccacagcaaatattgccaacacaatgtgagctgcagaggtcccaatccgagccattggcactaattacaacactattcaccaacttacgagaccacaagagaagcagccgctcctccttccatctcctaaacaagaatggattcgcaaattaagtttgctgtggtggtgaaaataatgggaaggaccggttcaagaggtcaagtgacgcaggtgagagtgaagttcttggacgatcagaaccggttcattatgaggaacgtgaagggaccggttcgtgagggagatatcctcacattgctggagtctgagagagaagctaggaggcttcgttgaagggttatttttatactttttggggtttatgcttgttttgaattgtctaccgtattgcttttgaattacgtttagtaggtattcgtatatcgagacttgcgatttgggagaatggttgttgcttaaacctggattttatgatgattatgttgaaatgaactgaattggttttgagttttggttatatttttgcctcccgtttgagaaaatgttcggattagatttgtttgtttgaatgatcacttgttatgattatgtaagttgtatttgta

SEQ ID NO: 4299 - DNA, 569 bp, Gossypium hirsutum
acaagagaagcagccgctcctccttccatctcctaaacaagaatggattcgcaaattaagtttgctgtggtggtgaaaataatgggaaggaccggttcaagaggtcaagtgacgcaggtgagagtgaagttcttggacgatcagaaccggttcattatgaggaacgtgaagggaccggttcgtgagggagatatcctcacattgctggagtctgagagagaagctaggaggcttcgttgaagggttatttttatactttttggggtttatgcttgttttgaattgtctaccgtattgcttttgaattacgtttagtaggtattcgtatatcgagacttgcgatttgggagaatggttgttgcttaaacctggattttatgatgattatgttgaaatgaactgaattggttttgagttttggttatatttttgcctcccattttgagaaaaatgttgggattagatttgtttgtttgaatgatcacttgttatgattatgtaagttgtatttgtattaatttagcctcttaaatattttatatttctggaagatgaaagaaatgaaattg

SEQ ID NO: 4300 - DNA, 406 bp, Gossypium hirsutum
ccaaatttaaggatggattcacaaattaagtttgctgtggtggtgaaaattatgggaaggacgggatcgagaggtcaggtgactcaagtgagagtcaagtttttggatgatcagaaccgttttattatgaggaacgtgaagggaccggtcagggagggagatattctcaccttgctcgagtctgagagggaagctaggaggctccgttgataacttcctcttatctccgttttgttacgttattaatggatgagttgtttttaaagtataatcattatgtttaaatgaactaagttggtttttgagattatgattttcatgtcccgttaatttctgctatttcaaaatgttaattcttttctaaaagttgcttgaacgtgactagaaccttttccttctgttacag

SEQ ID NO: 4301 - DNA, 594 bp, Eucalyptus grandis
gccctcgctgaagattttcagaagctcaagctttaggccgcttcctctcttcctcgcctctccttcctctctccccatctcagaatggattctcagatcaagcatgctgttgtggtgaaagttatgggccgaactgggtcaagagggcaggtgactcaggtgagagtcaagttcttggacgacatgaaccggttcatcatgaggaacgtgaagggaccggtgagggaaggagatgtcctcacccttctggagtctgagagagaagcaaggaggctccgttgagcaaatcatgatttttatgtttcccttgagttttggtaatgactatagtggggtttctgctgctgctggtggattgaatgtgagagtgttttaactttattttcagttcacattttggtcactttgtgtcaaacatttgaacttgagcatgaatgaattgtaggaagtatcttacgtttagtgacgtgttatggatctccatttattggtgcgtgagatatgatgtcaatttcagcttcacctttgtgtttctgagatgtttggctgtatgcgcgcttggtttattatcatttctttcgatcaaatagctaa

SEQ ID NO: 4302 - DNA, 506 bp, Eucalyptus grandis
cggccggggctcgctgaagattttcagaagctcaagctttcggccgcttcctctcttcctcgcctctccttcctctctccccatctcagaatggattctcagatcaagcatgctgttgtggtgaaagtcatgggccgaactgggtcaagagggcaggtgactcaggtgagagtcaagttcttggacgacatgaaccggttcatcatgaggaacgtgaagggaccggtgagggagggagatgtcctcacccttctggagtccgagagagaagcaaggaggctccgttgagcaaatcattatttttatgtttcccctgagttttggtaatgactatagtggggtttctgctgcctgctggtggattgaatgtgagagtgttttaactttattttcagttcacattttggtcactttgtgtcaaacatttgaacttgagcatgaatgaattgtaggaagtatcttacgtttaatgacgtgttatggatctccatttattggtgcgtgag

SEQ ID NO: 4303 - DNA, 593 bp, Eucalyptus grandis
atcagctagggtttttgctcatcctagctcaagatttttacgaagctcaagctgtccgcccccttcctttcctcctctcgtctcccccttcgcttccgatctcagaatggattctcagattaagcacgccgtcgttgtcaaagtcatgggtcgaactgggtcgagggggcaggtgactcaggtgagagtcaagttcttggacgacatgaaccggcacatcatgaggaatgtgaagggaccagtgagggaaggagatgtcctcgcccttttggagtccgagagagaagcaaggaggcttcgttgagcaatcacctctatgcgttccctgatttttggtatgtccatagcagggctctctgctgctgttgatcaaatgtgagagtgtcgaattatattttcagttcaccttttggttactttgtgtcaaagattcaaagttcggtatgaatgaatagtaggaagtatctcacttttaatgatgcgttgtgaattttcattcttggcttgtgagatgtgatgtcagtttcagcttcgttggaccgcatgtgcttgaatgattaccttttcttttgagggatcgatatgaactctgg

SEQ ID NO: 4304 - DNA, 507 bp, Eucalyptus grandis
cggccggggagggtttagctcatcctagctcaagatttttgggaagttcaagctcggcccccttcctttcctcctctcgtctcccccttcgcttccgatctcagaatggattctcagattaagcacgccgtcgttgtcaaagtcatgggtcgaactgggtcgagggggcaggtgactcaggtgagagtcaagttcttggacgacattaaccggcacatcatgaggaatgtgaagggaccagtgagggaaggagatgtcctggcccttttggagtccgagagagaagcaaggaggcttcgttgagcaatcacctctatgtgttccctgatttttggtatgtccatagcagggctttctgctgctgttgatcaaatgtgagtgtcaaattatattttcagttcaccttttggttactttgtgtcaaagattcaaagttcggtatgaatgaatagtaggaagtatctcacttttaatgatgcgctatgaattttcattcttggcttgtgc

SEQ ID NO: 4305 - DNA, 461 bp, Linum usitatissimum
ccacgcgtccgaatccgcgagagaaacctagcagcagcagaagccgccgtactccgtctcgtctcatatcgtttcacaaggatggaatcaggaatcaagcacgctctagttgtgaaggtgatgggccgtacaggatccagggggcaggtgactcaggtcagggttaagttcatcgacgacccaaaccgtttcatcatgaggaacgtcaagggacccgtgagagaaggtgacatcctcaccttgctcgagtttgagagagaggccaggagacttcgttgatttccgtcctgcctttgcattccccttggttcgtttttggggactacaatcgtctggcgtttgtggtagttacaatttcaaggtttacttctgatgacctactgaaaaacacttgaatgttatgttttggggattatattattgtatggattgctgttaatgtgttcaatcagtctttgaat

SEQ ID NO: 4306 - DNA, 526 bp, Gnetum gnemon
ggtttggagaaggtctttgagtcgcagagggcttctgcatcgtctcgaaaggtttttggttttgtttctttgcgaaacgcgttggctctgcgatcaacagagttgaagccatggattcgggagtgaagcttgctatcgttgtcaaggttatcggtcgtacgggatcgcgagggcaggtcacgcaggttcgcgtcaagtttctggatgatcagaaccgtctgattatgaggaacgttaaggggccagttagagaaggggacattttaacccttctggaatccgaaagagaggctaggagactgcgttgatttctgacttttttgggatggaaaaatgtgcttttgattttttgctctgaatatttagctatgggatctgtgttatttcatggaggagaatgtgaaatcgacattttccctttgaaatttgaaagagattttgtgagattttaaaagggtactgtgagattttgaatgaatttgaaggttgagaatgtattttgattgatatgaatatggtacttttt

SEQ ID NO: 4307 - DNA, 509 bp, Jatropha curcas
actagccgcttgtgtttgcttctctttcctttcctcttccttcagaatggattcacagattaagcacgccgtggttgtgaaatttatgggtaggactggatctagaggtcaggtgactcaagttagagtgaagtttcttgacgaccagaatcgttttatcatgaggaatgttaagggacctgttagagaaggagacgtgcttacccttctcgaatctgaaagggaagctaggagactccgttaatggttgcatctttgcatttgttttggtgatagtagcaagactgttttgttatgttagctagaggaattggtcatgctgtcatgagcttttgttatctggttttacatttatgtcaagacttcaacttttgatttatgtgttattatctaaggaatgcttgaaattttgaagtatgaaaagaccttaaagattggtttgaattctggttttgtgtttattggatttgagaatctcaactgttgctaatcttttccataaaaaaaaa

SEQ ID NO: 4308 - DNA, 800 bp, Marchantia polymorpha
ttctggactgtaaatctgtcgctccgtcgatcacctccctccaccctaaccctaagctacatatcgaagtgcagagatcgggaagttctctttcacagatttgtgcacggtgcgtggctgtcttgctgctctcgaacaccgccggcttgttgacgacaccgctgctgccgcaccatggaaacgcaggtgaagctcgcgatcgttatgaaggtcatcggccgcactggatcaaggggacaagtgacccaggtgcgcgtgaagtttttggacgaccaaaatcgtcttatcatgaggaacgtcaaggggcccgtccgtgaaggtgacattctcaccctgctcgagtccgagcgcgaggcaaggaggctgcgatagattgaatggcctgcacctcgactgttaggtgaaccatggatggcgcctgatctttgaggccttccgcctcgaacgttgggaagtaggggcaaggaatagagaattgccaccagctggccggcgccgacgggagcgatggatggaggacggggctccgagattgcatctagccggttagcagtcggcatgcgggtgaagcacatgtggctcccttcttgatacataatttgattttgacactgtatggacaagatttgagcacccggtgtgtagctgaaattttgtttactggaatttgatcatctttaattcaagagcgaaaaggttcttggttctcgtttgatgttcagttttacatggttgttatgtctcagtttatctcttgtcaataaaatcttgtcgcacaattcgtttcgccaaaaaaaaaa

SEQ ID NO: 4309 - DNA, 908 bp, Mimulus guttatus
acacggccacgggccggttcaaaccggttcacagttcacgttttccggaaccggacccggcccgtagtatggacggttcagcgggccggttcggcccgtcggtttgggccggttccggaaccgggcccgtcccgggtaggacgggccggttcacgggtccgggccggttcatccggtcaacgggccggtttgagccgtcaacgggcctgttcgggccggttacaggcccaaaaccggcccatggccatgtctacatgtgatgggcctttttgccccctgatgataagaaaaaaagaatttaacgtgggtaaaaatgtaattgtccattgctcctttaaaacggctctcccactaggactagggtttatcgaacaatttcttttacgccgtcgattcatatttctttgtgttggtcaagtgcagaaaatggagtcgcagataaagcatgcgatagtggtgaaggtaattggaagaacaggttcacgaggtcaggtgactcaggtgagagtgaagtttattgatgatcagaaccgtttcattatgcgaaatgttaagggccctgttagggagggtgatgtccttaccctgctcgagtccgaaagagaggctcggaggttgcgttgattctcattattatttttcatggattattttctcaattgacaattcacattttcttctagttataaaatgatttctattttggggaccggacttaaatgattctattaatcttttttcttgtactagttgtcaagatttaggttcttatagacaagataagatatttgatgattagcacgggaagtttgagagtgatgattagtattgataatgtagcttgaaaactggctatctttttatggactttgtcttttgatggacttgttatatggactagttccttc

SEQ ID NO: 4310 - DNA, 200 bp, Mimulus guttatus
aatggagtcgcaaattaagcgtgctgtagttgtgaaggtgattggcaggacaggttcccgtgggcaagttactcaggtgagggtgaaatttatcgatgatcagaaccgtttcataatgaggaatgtcaaaggccctgttagggaaggagatatcctcaccttgctagagtctgaacgagaggctaggaggctcagataga

SEQ ID NO: 4311 - DNA, 597 bp, Tropaeolum majus
aaaaaacttctccacacccttttattatatatagaaatatatcaaacaataggcggaactttataatttcagcctattaattctcagccccataacctaatttctttctcccacaaatcactaaacttagagaaaccctaattctcttcaagcgcagcagcagggagcgaaagtaatcttcagagttcatctgccgatttcaaaatggagaatcaggtgaagcatgctttggtgatgaagatcatcggtagaactggttcgaggggtcaggttactcaggttagagttaagtttgtggatgaccagaaccggctcattatgaggaatgttaagggaccagtcagagaaggtgacatcctgactcttcttgagtccgagagggaagctaggaggttgcgttaagtggcccttacggggttagcgacatggcccttgtgagacttccaacttcagttctcatttatatgtatgaggtggttatgatgttttgatcaatgttaaatgtctaagtttgaattttttatatttatattgaaggacatattatgttttgattgaatggttcttagtttttaaatgcatttatgttccattctt

SEQ ID NO: 4312 - DNA, 589 bp, Elaeis guineensis
  misc_feature (401)..(401): n is a, c, g, or t
  misc_feature (466)..(466): n is a, c, g, or t
cgccgtcactcttcctctcaaaccctcttctcctgttcttggatcaccgattaacgacgcgttttgatcttttctcaggcccggattatttccccgctctgatttaggatggatactcaagtgaagcttgcagtcgtggtgaaggttatgggacgaactgggtcaagaggtcaagtgacccaggttagggtcaaatttctggatgaccagaaccgcctaatcatgcgtaatgtgaagggccctgttagggaaggcgatgtccttacccttcttgagtctgaaagagaagctaggaggctgcgctgatgatgttattggtctgaacttgcctttgtgcatgaggcttcatagaattttgcatatggattgcatttagcatgttttattgttctgtagttctncacattaggtttgccatgaggagtctataagtcatgtgttagacaaggatatctaagacttaagngtgaagaaatgctgtctgtttcattttagtttactgtctttttctaagtccatcacttgccaatgactttcttgttgctgatctatgtgctatatatactattttcttacaaggttaacacat

SEQ ID NO: 4313 - DNA, 646 bp, Arachis hypogaea
tcgggggacaacggtggagctgcaacaagaacgagagagctttgaagcttagtgccgcctccttctcctcttcctcctccaccacgtttgtgcgacaagatggattctgggattaagcatgctgttgttgtgaaagttattggccgtactggatccagaggtcaggtgactcaggttagagtgaagttcttggatgatcagaaccgtcacattatgaggaatgtgaagggaccagttagagaaggtgatgttctcaccctgcttgaatctgaaagagaagcaaggaggttgcgttgaagtgttttcttttgttgcctacaaatgcagtcaaagtaatgttttctttgatttttgttagtcagtgaatccccaattataagctttctttttatgtttttattggacctatttttccatttgaattttggcttaatgtgtattagatttatatgagagtatggattaatgtgttttgatttctatatagtgtgttttcatatttaattctcgatcatacatgtggcctaaagtcttatatatctataacacagccatataatgtaatgattttgtgaccccctgaaacagttcaatatcttcaaccagtttgtatgggtttcagtttagtagttcaatttattctctt

SEQ ID NO: 4314 - DNA, 577 bp, Arachis hypogaea
gggggacaacggtggagctgcaacaagagcgagagagctttgaagcttagtgccgcctccttctcctcttcctccgccacctcgtctgtgccacaagatggattctgggattaagcatgctgttgttgtgaaagttattggccgtactggatccagaggtcaggtgactcaggttagagtgaagttcttggatgatcagaaccgtcacattatgaggaatgtgaagggaccagttagagaaggtgatgttctcaccctgcttgaatctgaaagagaagcaaggaggttgcgttgaagtgttttcttttgttgcctacaaatgcagtcaaagtaatgttgctttgagttttgttagtcagtgaattcccaattatattgctttctttttatgttttttggacctatttttccatttgaattttggcttaatgtgtattagattgatatgagagtatggattaatgtgttttgatttctatatagtgtgttttcatatttaattctcgatcatacgtgtggcctcaagtcttaaatatctgcaactcagccatataatataatgattttgttaccccct

SEQ ID NO: 4315 - DNA, 454 bp, Petunia hybrida
gggaagcactccgccgtatactcttgagcttctatttctctaacaaagcaatggaatctgcaatcaagcacgcaatcgtggtgaaagtcatgggccgcacaggatcaagaggacaggtgactcaggtcagagtcaagtttatggatgaccagaacaggtatatcatgagaaatgtcaagggaccagtcagagagggagatgttctcacacttctcgagtctgagagggaagccaggaggttgcgctgagtaattaattctggagatggttttgtgataactcttgtttagtcctttccaaaatttaatgtttggttttgttctaaggacctgtgttaagtgtgtgctagcatatatctagaatgttttggtgactgcttttaaccatgaaggttgagtaattttctttctattgcaagtaattgtcggaaaaaaacaaccacaaaaaaaaaaaa

SEQ ID NO: 4316 - DNA, 436 bp, Petunia hybrida
gccattgtccattcttctttctttgagccgtcactgatatttgctctctgtctcaaggatggaatctgcaattaagcatgctattgtggtgaaagtgatgggtagaactggatccagaggacaagtgactcaagtaagagtcaagtttatggatgaccagaatcggtatatcatgagaaacgttaaaggacctgttagagagggtgatgttctcactctgttggagtctgagagagaagccaggaggttgcgctgaagccacagttacatggagctggtttgagtttgataatgtaatcgattttgtcctttattattgtgtttgtattttttcagacattgttatttttggagatgaatatggatgccaagcgttgtgaaatgattttggtgatggttaagtaattttgctgattattgcaagttttggtattgt

SEQ ID NO: 4317 - DNA, 726 bp, Populus trichocarpa
tcgtctctctagggtttttgtttctctcgttgctgtgagtgagagaacccagcagcagccgcgtgctctctctctgcatccttagctccttcagaatggatagtcaaattaagcatgctgtggtggtgaaaattatgggaaggactggatctcgaggacaggttactcaggttagagtcaagtttattgatgaccagaaccgtttcataatgaggaacgtcaagggaccagttagagaaggtgacattcttaccttgcttgagtctgagagagaagctaggagactccgttgatgggcatcatactgttttggtacaagattctcatcctagttttgctggtaatcaatcaggactgttttgttctgtactagctagcgagtgctcattgtttttgcttacagtttgattatcaagactgggattccagatttatgagtcatatgtaaggatgctttgaatgtcttaagttcagttcaaacctgcaagtcttgttaaaattaagttttctgcaacttataatctcttgatgtgttcaattcgatacctgttatctcagcataaaagtcctgattttgggatatgggagttccatcttccatgtatggttttcttgtagcaaatttgttgctggtgctttcccccccactttctctgattttactatggaccttggtgccaaacgttccaactgaaatgcctataaaaatggatttggctttctttg

SEQ ID NO: 4318 - DNA, 499 bp, Populus trichocarpa
tctagggtttttgtttctcttattgcagtcaggtgagaagtgcgaacctagcagcagccgcttcctctcccttggttgatatctagctccttcagtatggatagtcaaattaagcatgcagtggtggtgaaaattatgggaaggactggatctcgtggacaggtcactcaggttagagtcaagtttattgatgaccagaaccgtttcatcatgaggaacgtcaagggaccagtcagagaaggtgacattcttaccttgcttgagtctgagagagaagctaggagactccgttgatgggcatcttactgcttgtccacaagattctcatcctggttttggtggtaatcaatcaggactattttgttatgtagtagctagtgagtgctaatgggttttgtttacggttggattatcaagacttggattccagatttatgaactacatgtaagaatgctttgaattttttaaagtttgggttgaacccacgagtcttcttta

SEQ ID NO: 4319 - DNA, 497 bp, Papaver somniferum
cagaccgaagctgctttgaacttgtgtgcgctctctctctctctctctctctctctctctctttcgtcaaaaacacaggatggattctggtgtgaagctagcaattgttgtgaaggttatgggaaggactggatcaagagggcaggtgacccaggttagagtgaagtttcttgatgaccaaaaccgtctcatcatgaggaatgtcaagggacccgtcagggaaggtgattatctcacccttcttgagtctgaaagagaagccaggaggttgcggtaagatgttgttctcctcaagcatcttgtcaggagatttttggcaattcaagtggtatctgataatggccttacattttacaatatttagctggtttatgattccagagtagatttgcttcttctaaatgttaattggagattatataccaatttgagattatatacccatgtgtgattattgggttaatgatttcagagtagatttggcttcttattattgt

SEQ ID NO: 4320 - DNA, 455 bp, Salvia sclarea
ctactagaccttggctgtcactcagatcaaagccgtcgctcccaacctctatactctgtttcaggagagaagagaagaatggaatcccaaatcaagcacgccatcgtggtgaaagtaattgggcggacagggtcgcgtgggcaggtgactcaggtgagagtgaaattcatcgatgatcagaaccgtttcattatgaggaatgtgaagggacctgtgagggagggtgatgttcttaccctccttgaatctgagagagaggctagaaggttgcgttgatctcgtcactcccctctccttcgattggtgtttgttgtattagtcatttgcaatgtgaccaccaggagctgttgttgttttcttacttgacatttgccaatatatttagaaaatgctcgacgtttgtttgattacttgacatttgccaatatatttagaaaatgcttgacgtttgtttg

SEQ ID NO: 4321 - DNA, 475 bp, Salvia sclarea
ctactagaccttggctgtcactcaattcaacatttcctgcagcggctgctccttagtcctctctttctttctttagctcttcttcagaatggagtcacaaatcaagcatgctgtggttatcaaggtgattggcaggactgggtctcgtgggcaagtgactcaagtgagggtgaaattcattgatgatcagaaccgtttcatcatgagaaatgtcaagggaccggttagagagggtgacatcctcacattgttggagtctgagagagaggctaggagactccgctgatttctcagcatcatttcttctcatgttatttgtagcctatttctggattttcgttaccttttcagatgtacaactagacctcaaatgcaacctctgtttgtactaaattcaccttatgttatgtttactcctacaatggtttgtttaacatgatttatcaagccttcgcagtgagtgacaggctagtag

SEQ ID NO: 4322 - DNA, 294 bp, Senecio madagascariensis
tcgagcggccgcccgggcaggtacgcgggggtgtttccaaatcttaaatctcttcattcacaagagcagcagccgcataaacaaacagtgagatcaaaagatggaatcacaaatcaaacacgctgtggtgattaaggtaatgggaagaactgggtccaggggacaagtgacccaggtccgagttaagtttttggatgaccagaatcggttcattatgagaaatgttaaggggccagttagagaaggtgatgtccttactttgcttgagtctgagagggaagctagaaggttgag

SEQ ID NO: 4323 - DNA, 653 bp, Solanum phureja
cgtaaccctacttataaggtttttagggtttaatcattctccattctttgatacacagcagcagcatacagcagcagatttttctcaccggaagaatggaatctgtaaccaagcatgcaattgtgattaaaatcatgggtcgtactggatccagggggcaggtgactcaggttagagtcaagtttcttgacgaccagaacaggtttatcatgagaaatgtcaagggaccagtcagagagggtgatattctcacattgttggagtctgagagggaggccaggagattgcgctgagcccataattttgattgccatatcgaaatttccttgagtacttgattattgactgggatttattccctagttaatagtctttggttttgtttgcttagactctttaagtttggatatgttgattttggtgcacttcatgtttttggaattgtttttatgttaaaattttgctagcattgcgtcaatggcaacgagtaatggttcttatttgttttcgtgtttgctggatggacgtccatctatcatgttgaatctttttccagtgttccttatgtgtgatattggtgcttttcagaggcaatggttttattagaattcaaaatggttattacccaataaaaagaacatatttttgatgtt

SEQ ID NO: 4324 - DNA, 934 bp, Saccharum officinarum
tccacggcggcggcctcagctcaataacaaagccagcgcaggcctagggtttccttcctcctccagtgctctcctcgcgccgccgccgccgccgccccagtttgcttcgtgtgcccgtgagctcgtctgcctccgtccgagactccgcgcgagaagtgagagtatggacacccaggtgaagcttgctgttgtggtgaaggtgatgggcaggaccggctccaggggtcaggtgacccaggtcagagtgaagttcttggatgaccagaaccgtctcatcatgaggaacgtcaagggcccagttcgcgagggcgacatcctcacactgctcgagtccgatagggaggccaggaggctgcgctgaggtggttgcgtgtcttggtggttcttgtatggagttggatctcgtcgaatttgtgctatgtttgttgaacttggtgtgacccttacaacacctgccttatgattagtaagcctggtgataaggttgcagtttggttttatgatccaggttgaaagtgcacttgtgctgagacatggatatcctttgctatattagctcaatcgatgcatggattgaatactggttgaatgtcagggtttgattctggttggtagtatggtcgtctatgcggttttgtcatagtctgagtgtcatggtggtggctatcttaatctcgacatttgcttgatgagggtcttagtccttcaccagaggatcttgttctggtgaccacttatatgttggtgagatcattttatctgtatgtttcccataatatgttgattgaatcaactatttttatggagagcgaggatgattttctagagtgcaaacaagatatagaaaagttgttggagggtgctcgggtgttgttccttttgcatctcttttgctcatttatatattggatactcgatgtgcgttggataagat

SEQ ID NO: 4325 - DNA, 502 bp, Camellia sinensis
ttcgagcgccaactaaaccacaagcctgcgccaagtctctccagccgcacctctttctccccggcacagaatggagtctcagatcaagcatgccatcgtggtgaaagttatgggtcgcacaggatcaaggggacaggtgacccaggtgagggtcaaatttattgatgatcagaaccggtttatcacgaggaatgtcaagggaccggtgagggaaggggatgtgctcaccctgctcgagtctgagagggaagcaagaaggttgcgctgatcgcttttacgcttgttctacccaccaagttttgattgcttgttacgcaacgccgcactcactccatatacattatgttttgatagctaaattaagacttgagacttcgtatctgaggatggagattgatgatttgcctttctttttttttgttgttgtgtgagaaaagacaattagtatgttttagtgcttgagatgttggagtaaaatgctttaagcgctattgagcttgtg

SEQ ID NO: 4326 - DNA, 658 bp, Solanum lycopersicum
cgtaaccctacttataaggtttttagggtttaatcattctccattctctgatacacagcagcagcagcaacaacaacctacagctgcagatttttctcaccggaagaatggaatctgtaaccaagcatgcaattgtgattaaaatcatgggtcgtactggatccagggggcaggtgactcaggtgagagtcaagtttcttgacgaccagaacaggtttatcatgagaaatgtcaagggaccagtcagagagggtgatattctcacattgttggagtctgagagggaggccaggagattgcgctgagcccataattatgattgccatatcgagtacttgattattggctgggatttatttcctatttaatagtctttgattttgtttgcttagactctataattttgaatatgttgattttgttgcactttatgtttctggaatagtttcatgtcaaaattttgctagcattgcgtcaatggcaacaagcgatggttcttatttgttttcgtgtgtgtccatgtattgcgttgaatcttttccagtgttccttatgtgtgatattggtgctttgtcaaaggaaagggttttatgagaattcaaaatggttaagagaacataatttaatgttacaatgcctacaaatttattactttgga

SEQ ID NO: 4327 - DNA, 477 bp, Zostera marina
tttttactcgccggcgactctagggttcatcaagttttgatttttttgctaacaatcatctctgcagatctaacgaatggacactcaagttaagttggccgttgttgtcaagatcatgggacgaactggatcccgtggacaggtgactcaagttcgagtcaagtttttagatgatcagaaccgtttgatcatgcgcaacgtgaaaggacctgtccgagaaggtgatatccttacccttctggagtcagagagagaagcaagaagactgcgttaatttggatgttgtctctctgttaagcatcccccaattccaccatgttgtttactttcttttcctttaagacacttttgtttttcaatgcatttccttgtccttcttatctttgtattggatgatttttgactctgtttttaatttattattttctataaccaattgtttttttttaataaattcaattgaattgcattgattct

SEQ ID NO: 4328 - DNA, 1106 bp, Utricularia gibba
gctctctggttggctcgctctcggtgatgagtgtcaaagcacttggaatagcactgaagctgacattcaatgggacgaaccagctgttctatccccagacatgggtctttgcactggttgtcctggtttgtgtcctcacgcagatgaattacctgaataaggcccttgacacattcaacacagccgtggtgtcgccaatttattatgtgatgttcacatccttgaccatcatagccagcgtgatcatgttcaaggattgggaccggcagaatccgacccagattgttacagaaatgtgcgggtttgtaacaattctctcaggcaccttccttcttcacaagacaaaagacatggctgatggatcaatttccttcgttataagggccatgaagcaagccgagaacagcgaggaagacattccattgaccctgagacgacaagagacataaaccacctgagtgatcagctgcaggtttcagtaaactcccacgacaccattgagtgtctcatgtccttcgcattcaccttgtgcttgtattgcatccatatggtttgctgggtaccaatccatttgtttattcattcgtgtcacataccatgttccgtttggcctcatgggtaccctctgtccactttcacagaaaaaaaaaaagaagcccatgtggcgatttagacaaggggatcattttcttggttctgacatcataatgaaagagcaaacagttcacttaaaattcaaatcttgtttgtccaaaaaggaggatctcacagaactagaagcaactacgtatagtttgccgcaaagaactcataccaagtgccaagcaagatcaacactaaataggattaagaacaagataactcagcgcagccttcttgcctccctctctgactcgagcagtgtgagaatgtctccctcgcggacagggcccttaacgtttctcatgatgaaacgattctgatcatccacaaacttaactctcacttgggttacctgccctcttgagcctgttctcccaatgacctttacaacgatggcatgcttgatctgagaatccatatctgcagagatcagatgcgaatttcgcaagacgagatgaatcaca

SEQ ID NO: 4329 - DNA, 3710 bp, Malus domestica
acgagaggtggggtttaacagggcaaaagaggcgtgatatgaagaatgcataaaaacgacgtcgtaccggccctgcgaactttgaataatcggtggacgtgaaattaatagaattagaagggtaaaacagtaaacctaacccgaaccctagtcgactaaattatatttcctctcttcccaccttttgcactgcgccgttccctcgtctcttgcgattcagcacgcccttctgcgacgctgtttcttcttcttctccaagctctcgcagtatcttctgaaactccaaccagcagaatggaaaacacgatcaagcatgctattgtgatcaaggttatgggacggactggatctcgtgggcaggtgactcaagtgagagtcaagtttctggatgaccagaaccgtttcatcatgaggaatgtcaagggaccggtcagggagggggatatccttaccttgctcgagtccgagagggaggcaagaaggttgcgaaaatcagccgatgatgtgaaaaaaacaaataatacaataacaaagggtaaaatagtaaacccaacccaaaccctagtacataaacacttctcttctgcgccgctccctcgtcgtctcgagcgattcagcacacccctcgcagcgccattttcttgctttctccaagctctcccaccgtcttctgaaactccaacctccagacaccatggccgctgctgatgtcgctgctcctgtgctggaaccaacgcaggcgcactatgacgtgaagctgttcaaccgctggagcttcgatgatgtccaggtcagtgacatttcactggcggattacgttggagttgcaccttccaagcatgcaacatatgtacctcacactgctgggagatactcggtcaaacgattcaggaaagctcagtgccctattgtggagaggcttactaactcactcatgatgcacggcagaaacaacggaaagaaactcatggctgtcaggattgttaggcacgcgatggaaattattcatttgctaactgatctgaacccaatccaagttattgttgatgccgttgttaacagtggtccacgtgaagatgcaactcgcattggatctgctggagttgttaggcgtcaggctgtggatatctcacctttgagacgtgtgaatcaggctatctatctcctcacaaccggtgctcgtgagtctgctttcaggaacgtcaaaactattgcagagtgtttggctgatgaacttattaatgctgccaagggttcctctaacagacccgaatcgaaaccccaactcgagtccggaaaccgaaacccgaatcccgaaacccaaaaccctagccgattaaaataccctctacctctcgccctgcgccatttccttcagcgattcagcaacccctccgcggcgccgtcgtcttgtgttcctcaacctctccctctcgtcgaaaaatccaacctccggaaccatggctgctgatgctgtagctcttcctgtagccgaaccaacgctggctcactatgacgtgaagctgttcaacaagtggagctttgatgatgtccaggtcagtgacatttcactggcggattacattggagttgcaccttccaagcatgcaacttatgtacctcacactgctgggagatactcggtcaaacgattcaggaaagctcagtgccctattgtggagaggcttacaaactcactcatgatgcacggcagaaacaatggaaagaaactcatggctgtcaggattgttaggcacgcgatggaaattatccatttgctaactgatctgaacccaatccaagttattgttgatgctgtcgttaacagtggtccacgtgaagatgcaactcgtattggatctgctggagttgttaggcgtcaggctgtggatatctcacctttgaggcgtgtgaatcaggctatctatctcctcaccaccggtgctcgtgaatctgctttcaggaacgtcaaaactattgccgagtgtttggctgatgaacttattaatgctgccaagggttcatctaacagttatgcaatcaagaagaaggatgagatcgaaagagttgccaaggccaaccgacatcatttctttgagactcacctgatgcttttcgaagggctgccatggtggaagtacacttaccaccttcccatcttcctttcggaggatggccgcgttggcggtgtcggagtaattattgcacaaagcaatcacgtgggtggaccaagtttcccactgggcgccatcacttccgtctttatattgtccttatatgcaggaacctgtcttatgtatatgtttcccagtcctatcgtctctctctctcaccctccagacatggatctctcattcgctccctcctcttctccgcggttcccagctataagccctcactgcagcacctcctcctatattcctccaatttctgctaatcccaccactgcaaaatcagctgcttttctctcaagctgcaggacaaacttgtactcaattgggctgtccagaagctgctccaaatctttgctcagctgccggaagaagcgaaattccatctgggcctgcagtcaagttggagctgctgaatctaatccagtattgaccaaagtctcagattttaaagatgcttgttggcgattcctcaggccccataccatacgtgggacagttctcgggtctactgctttggtgacaagagctttgattgagaactccaatttgataaagtggtctctgctgtttaaggcattctctggtctttttgcgctactatgtgggaatggttatatagttggcatcaatcagatttacgatatcaaaattgacaaggtaaacaaaccttatttacctatcgctgcaggggatctttcagttaaatcagcatggctcttggtggtattttttgcggtgactggcttgttgattgttggactgaactttggggcattcattacttctctctactgtcttggtcttttccttggcaccatatattctgttcctccgcttagaatgaagagatttcctgttgcagcttttcttataattgccacggtaaggggtttccttctcaattttggtgtatattatgccactagagctgcccttgcgcttcaatttgagtggagctcggccgttgcttttatcaccacttttgtaacattgtttgctttggttattgcgataacaaaagaccttccggatgtagagggggaccgcaagtttgaaatatcaacatttgcaacaaaactcggagttagaaacattgcgtttcttggttctgggcttctgctactaaattatgttggttccatattcgcagcaagtttaatgccggaggcattcagacgtagcttaatgatacccatgcatgcaatcttggcactgagtttagttttccagacttgggtgctcgagcaagcaaattacaccaaggaagcaattgccagctactacagatttatatggaatctcttctatgccgagtatctccttttccccttcatctagcaactcgggtcagtattttctgaattgtattcctgtcgaattgtaaatattggcacaagaagctagtctatgttatataaatccgtatgcgataaaattttcttgtatcaaattcttatctcataggtaaggaaaagtaacagataaattgagctgtgagaattctgttattaacgctgtactatttgacatgccaaa

SEQ ID NO: 4330 - DNA, 427 bp, Phaseolus coccineus
ggggactttggttagcaagcatcgcaaaaccctagcctactttcttcactcgttttttatttcaggagggactctcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtttaagttttaagattgaagtatgattggcttgata

SEQ ID NO: 4331 - DNA, 424 bp, Phaseolus coccineus
ggactttggttagcaagcatcgcaaacccctagcctactttcttcactcgttttttatttcaggagggactctcaggtgaagcatgctcttgttgtcaaagttatgggtcgttctggatccagagggcaggtgccccaggttagagtgaagtttttggatgatcagaatcgtcccatcatgaggaatgtgaaaggccctgttagagaaggagacattctccccctccttgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtttaagttttaagattgaagtatgattggcttgat

SEQ ID NO: 4332 - DNA, 425 bp, Phaseolus coccineus
  misc_feature (66)..(66): n is a, c, g, or t
  misc_feature (134)..(134): n is a, c, g, or t
  misc_feature (218)..(218): n is a, c, g, or t
ggactttggttagcaagcatcgcaaaaccctagcctactttcttcactcgttttttatttcagganggactctcaggtgaagcatgctcttgttgtcaaagttatgggtcgtactggatccagagggcaggtgncccaggttagagtgaagtttttggatgatcagaatcgtcccatcatgaggaatgtgaaaggccctgttagagaaggagacattntccccctcctcgaatccgagagggaagcaagaagattgcgctagatggtttaaatcgaaccagtggcttgatttttgtggtagttagtggatgccaaaggttatatcagcctatcttgatgttttggatctatttttattcgaattatggacggaattttgttgtttttagtctaagttttaagattgaagtatgattggcttgata

SEQ ID NO: 4333 - DNA, 424 bp, Phaseolus coccineus
  misc_feature (33)..(33): n is a, c, g, or t
  misc_feature (42)..(42): n is a, c, g, or t
  misc_feature (196)..(196): n is a, c, g, or t
  misc_feature (218)..(218): n is a, c, g, or t
ggactttggttagcaagcatcgcaaaaccctancctactttnttcactcgttttttatttcaggagggactctcaggtgaagcatgctcttgttgtcaaagttatgggtcgtactggatccagagggcaggtgccccaggttagagtgaagtttttggatgatcagaatcgtcccatcatgaggaatgtgaaaggncctgttagagaaggagacattntccccctccttgaatccgagagggaagcaagaagattgcgctagatggtttaaatcgaaccagtggcttgatttttgtggtagttagtggatgccaaaggttatatcaccctatcttgatgttttggatctatttttattcgaattatggacggaattttgttgtttttagtttaagttttaagattgaagtatgattggcttgat

SEQ ID NO: 4334 - DNA, 425 bp, Phaseolus coccineus
  misc_feature (66)..(66): n is a, c, g, or t
  misc_feature (134)..(134): n is a, c, g, or t
  misc_feature (229)..(229): n is a, c, g, or t
  misc_feature (278)..(278): n is a, c, g, or t
ggactttggttagcaagcatcgcaaaaccctagcctcctttcttcactcgttttttatttcagganggactttcaggtgaagcatgctcttgttgtcaaagttatgggtcgtactggatccagagggcaggtgncccaggttagagtgaagtttttggatgatcagaatcgtcccatcatgaggaatgtgaaaggccctgttagagaaggagacattctccccctcctngaatccgagagggaagcaagaagattgcgctagatggtttaaatcgaancaggggcttgatttttgtggtagttagtggatgccaaaggttatatcaccctatcttgatgttttggatctatttttattcgaattatggacggaattttgttgtttttagtttaagttttaagattgaagtatgattggcttgata

SEQ ID NO: 4335 - DNA, 422 bp, Phaseolus coccineus
ggactttggttagcaagcatcgcaaaaccctaccctactttcttcactcgttttttatttcaggagggactctcaggtgaagcatgctcttgttgtcaaagttatgggtcgttctggatccagagggcaggtgccccaggttagagtgaagtttttggatgatcagaatcgtcccatcatgaggaatgtgaaaggccctgttagagaaggagacattctccccctcctcgaatccgagagggaagcaagaagattgcgctagatggtttaaatcgaaccagtggcttgatttttgtggtagttagtggatgccaaaggttatatcaccctatcttgatgttttggatctatttttattcgaattatggactgaattttgttgtttttagtctaagttttaagattgaagtatgattggcttg

SEQ ID NO: 4336 - DNA, 459 bp, Cichorium intybus
ggggattgaacttttcagatgctgctgccgctctcaatcgactctcacaccagctactgaaagatggagtctcagatcatgcacgccgattctcgtgaaagtgatgggtagaactggatcgagagggcaagtgacacaagtgagagtaaagtttctcgatgatcagaatcgtttcatcatgagaaacgtcaagggacccgtcagagaaggtgatgttcttaccttgctcgagtccgagagggaggccagaaggttgcgttgattttacctgtttcctatattcgtaagcccttcgtttcgattttggtgttatgtgaaactcgtttttgagatttgttctagtgcgatgactttgtaattctaaatgtttggtagtaaacttttaatccgccatgttagggttgcaggttttagtttgtgttgtcagattttgaatggagatttgatcaattgcgtaaa

SEQ ID NO: 4337 - DNA, 572 bp, Pennisetum glaucum
tgctctctacgcgccgccgccgctcttcgcttcgcgtgctcgtgagctcgtcggcctccgcgtcctcgcgagatcgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaagggcccggttcgcagggtgacatcctcaccctgctcgagtccgagagggaggccaggaggctgcgctgaggcagttgggttccatggtggttcttgtatggagtagggtgtcttcgaatttgtgccgtgtttgtgtgcttagtgtgaccctcagaacacctgcctactatcctggtgacaagattgcagttttgtttttattatccaggttcaaagtgcacctgttgcgcggagacatccaggttcaaatggatgcatgaattgaatactagctgaatctcttgtgatttcatgggtctacctgtttctaatataatagtcattgaggtgaacaaaaaaaaaaaaaacaaaaagtactactgt

SEQ ID NO: 4338 - DNA, 596 bp, Elaeis guineensis
  misc_feature (526)..(526): n is a, c, g, or t
tctcgtgccgaattcggcacgagttccaactctctagtcggctgccgcttgaagcgtcctcgcatctagagagcatggatactcaagttaagcttgctgtggtggttaaagtgatgggccgaaccggatcgagaggtcaggtgacccaggtcagggtcaagtttttggatgatcaaaatagacttattatgaggaacgtgaagggcccagttagggaaggtgatgtccttacccttctcgagtctgaaagggaagctaggaggctgcgctgatgctactgcatggtctgatcatgcctaccttcatgtgatgtttctaaaatggagcttcttgatgccttttgtcatgttttccattagcactagtgctggtttttggatttttcttgttggagttcattatagtttatgtgtgatgttgctacagagccagacgaagtgcaacatggttgttttgtttctagttttggatttagcttaatttttgcttttatcaaggtttttgaaactatataccctgtggtccnaaaatgttacgtttcctatttgtgctatgaatctccggcttcaatttatgactttgtttggaggcagctc

SEQ ID NO: 4339 - DNA, 437 bp, Cichorium intybus
gcacgaggggagcagccattcatcaatctccagcaccacatcaggaagtgaaagatggagtcccagatcaaacacgcggttgtggtgaaagtgatgggaagaactggatctaggggacaggtcacacaggtgagagtgaaatttcttgatgaccagaaccgtttcatcatgagaaacgtaaagggacccgtcagggaggggtgacgttcttactttgctcgagtcggagagggaggccaggaggcgtgcgctgatctcactttcttatattttgaggtttgtttgagttttgcacttggttccgagaagaatatgaattttgtaatacgtgtttgagggcaaagcattttcatctcatctatgttttatataccagtactgttttagtagacaatttatttaatggtagatcaatgcatcttgcgtttattgcttcc

SEQ ID NO: 4340 - DNA, 390 bp, Pteridium aquilinum
ttctggagctccttcaggcgcagcattacagggccctaagaaatggatacacctgtgaagcttgcaatagtggtgaaagttatgggcggacaggctctagaggacaagtcactcaagtgagggtcaagtttctcgacgatcaaaatcgacttattatgagaaatgtgaagggccctgtccgagaaggtgacattctcacactccttgagtctgagagagaggctcggagacttcgatgagtgcctgtgttttgtatccttgtttgatgtgcgagacatagaagatagaggatggagcagagcaacagcgtttttgcataatgtggtgattactacattgtatgtatcgataacgatttattaatctaccaagatttttagcaaaaaagaa

SEQ ID NO: 4341 - DNA, 408 bp, Sarracenia psittacina
  misc_feature (387)..(387): n is a, c, g, or t
gttctcgcagcgcctccctgcaattcgcgtgctcccgctcactcgctcgctagcgatcgtcgcctcccgctatggagtctgctgtgaagctggctattgtaatgaaggtgatcggccgcaccgggtccagaggtcaggtgacccaagtgcgagttaagtttctggatgatcagaaccgacttatcatgcgcaacgtgaagggaccagtgcgtgaaggcgatatcttgactcttctagagtcggagagaggaggcggggaggttgcggtgaagactggagggacttgagcagtttccaggtcttggtctttagtgttcctcgctagttatactagactgtgtggatgtatttgatttcattccttgattgttatcagaagatataacntgtcgatattgtgttcgggtc

SEQ ID NO: 4342 - DNA, 425 bp, Phaseolus coccineus
  misc_feature (4)..(4): n is a, c, g, or t
  misc_feature (42)..(42): n is a, c, g, or t
  misc_feature (49)..(49): n is a, c, g, or t
  misc_feature (52)..(52): n is a, c, g, or t
  misc_feature (174)..(174): n is a, c, g, or t
  misc_feature (200)..(200): n is a, c, g, or t
  misc_feature (343)..(343): n is a, c, g, or t
ggantttggttagcaagcatcgcaaaaccctagcctactttnttcactngtnttttatttcaggagggactctcaggtgaagcatgctcttgttgtcaaagttatgggtcgtactggatccagagggcaggtgccccaggttagagtgaagtttttggatgatcagaatcgtcncatcatgaggaatgtgaaaggccctnttagagaaggagacattttccccctcctcgaatccgagagggaagcaagaagattgcgctagatggtttaaatcgaaacaggggcttgatttttgtggtagttagtggatgccaaaggttatatcagcctatcttgatgtttnggatctatttttattcgaattatggacggaattttgttgtttttagtctaagttttaagattgaagtatgattggcttgata

SEQ ID NO: 4343 - DNA, 424 bp, Phaseolus coccineus
  misc_feature (176)..(176): n is a, c, g, or t
  misc_feature (213)..(213): n is a, c, g, or t
  misc_feature (278)..(278): n is a, c, g, or t
ggactttggttagcaagcatcgcaaaaccctagcctactttcttcactcgttttttatttcaggagggactctcaggtgaagcatgctcttgttgtcaaagttatgggtcgtactggatccagagggcaggtgccccaggttagagtgaagtttttggatgatcagaatcgtcccntcatgaggaatgtgaaaggccctgttagagaaggagncattctccccctcctcgaatccgagagggaagcaagaagattgcgctagatggtttaaatcgaancagtggcttgatttttgtggtagttagtggatgccaaaggttatatcagcctatcttgatgtttgggatctatttttattcgaattatggacggaattttgttgtttttagtctaagttttaagattgaagtatgattggcttgat

SEQ ID NO: 4344 - DNA, 411 bp, Phaseolus coccineus
ggactttggttagcaagcatcgcaaaaccctagcctactttcttcactcgtcttctatttcaggagggactttcaggtgaagcatgctcttgttgtcaaagttatgggtcgtactggatccagagggcaggtgccccaggttagagtgaagtttttggatgatcagaatcgtcccatcatgaggaatgtgaaaggccctgttagagaaggagacattttccccctccttgaatccgagagggaagcaagaagattgcgctagatggtttaaatagaaacagtggcttgatttttgtggtagttaggggatcccaaaggttatatcaccccatcttgatgttttggatctatttttattcgaattatggacggaatttggttgtttttagtctaagttctaagattgaagta

SEQ ID NO: 4345 - DNA, 499 bp, Carica papaya
gagtcctctaagatacctggagtgtatatacagtcgtttattatccatattctgatactccatagctcgcgcaaccctaattcggcgcttctccttctccagtctccgtcgtcttctcttctcattcaaagacacatggattctcagataaagcttgctgtggtggtgaaggtcatgggtcgaacagggtcccgagggcaggtgactcaggttagagtcaagtttttggatgatcagaatcggttcatcataagaaacgtcaagggaccagtcagagaaggggacgtgctcactctgcttgagtctgagagggaagctaggaggttgcggtaaaatgggtccattaagaatcagtctttctcttgttttttgtagcagcagccactggttgtttgagtcttggcctagtttctcgtgtctagagttgaattattagatggattgtacttacggaggtatgcttaaggctttttggtatggaaaattaattcttgtctta

SEQ ID NO: 4346 - DNA, 601 bp, Thalictrum flavum
ctttcgttttgtagttactttaatttttgttttagttcttaagttgtaagtctattggtattctcaggtgaagaatgctgtagtggtgaaagtgatggggcgaactggttcgagagggcaggtgacccaggtcagagttaagtttattgatgaccagaaccgtctcatcatgaggaatgtcaaggggcctgtcagagaaggtgatgtcctcaccctgcttgaatctgaaagggaagctcgaaggttgcgctgattcatagatgtgtgttgttctccagggttttgttgttaagtttatatttgtctaagattcaaagatggtttgatatgggaattttgtttagttttgttaattaagtgtcatcctctaatagttgatgaacctctgttatgtcgacattaatatgttagttactttgttattgctatgagagcttgagactttcttgccacgtattgtaggtttaatcatgactggtcattgtttctgcctttgcattcttcatgtgtctgtcatgacttcacctacacatgttggcagaatggcagggggtagtgctccttgtgtagtcaagtttcggcttagtttgggtgagtatat

SEQ ID NO: 4347 - DNA, 497 bp, Thalictrum flavum
tatctctcgttgagacgaaatttgttagcaagtgaagcatggattctcaggtgagaatgcagttgtggtgaaagtgatgggacgaactggttcgagagggcaggtgacccaggtcagagttaagtttattgatgaccagaaccgtctcatcatgaggaatgtcaagggacctgtcagagaaggtgatgtcctcaccctgcttgagtctgaaagggaagctcgaaggttgcgctgattcatagatgtgtgttgttctccagggctctgttgttaagtttatatttgtctaagattcaaggatgtcttgatatgggaattttgtttaattttgttaagtgccatcctttaatggttgttgaacctctgttatgttgacatcaatatgttagttacttcgttattattatactatgctatgatagcctgagacttgcttactgcatattgtaggttaattataatcaatagtcgattaccaataaagccatatagatcac

SEQ ID NO: 4348 - DNA, 407 bp, Catharanthus roseus
caatagccgtctgagcttctgccaccttagctctgaattcttcgcagttcaagcttcagcatggattcacagattaagcatgctatagtggtgaaggtgatgggtcgcaccggatccagaggacaggtaactcaggtgagagtcaagtccatagatgatcagaaccgtttcatcatgaggaatgtcaagggaccagtgagggagggagatgtcctcactctgctagagtccgagagagaagctaggaggttgcgctgatttacgtccttttttttttatcaatgttttaaggctttgatactacattaatttcatgtaagagtataatcaattttgagcttacccggggagatgcaagacatgatcagtggttctttagaattaaatatcaattagttgattgctct

SEQ ID NO: 4349 - DNA, 648 bp, Cephalotaxus harringtonia
cggtgtaaaattgaatctgcggcaaatccataaatcttcctctgtggtgccgttggttcgttggttgcagatatatttgggtttttctccgattctcccaggctacacttccaggaaaccatggatacgggcgtgaaattggccgttgtggtcaaagttattggccgtactggatcaagaggtcaagttacacaggttcgagtgaagtttttggatgaccagaatcgtctcattatgagaaatgtgaaagggcctgtcagagaaggtgacatccttactcttttggagtctgaaagagaagcaaggagattgcggtgatcatgttttcatattataacatccttggtgaattagcttgtggctctatttctctgtgtatttttgggataagaagagtatggtttgttacgaatgacgactaaattttattgcaaaattgtcttctttgacaaataatgtttactttggattattgaacaagaattatagctattagctactgtttttgaattggatttcaatctatagtcattcggtttattgcgattgttcccttgctggcttctataataactctagttatttcgtaactggttattaacctttttaaaccttagatattatgtatatcaaatgtgtacagttcac

SEQ ID NO: 4350 - DNA, 459 bp, Cephalotaxus harringtonia
ttgctggaggcgttggagggcggatcagcaggtgtcttctttgatttctctcagtggttggttacactatcaggaaaccatggatacaggggtgaagttggctgttgttgtcaaagttattggccgtactggatcaagaggacaagttacacaggttcgagtgaagtttttagatgaccagaatcgtctcattatgagaaatgtgaaagggcctgtccgagaaggtgacatccttactctgctggaatctgaaagagaagcaaggagactacggtgatcatgttttgatattatgatgtctttggatctggactgggtggattagcttgtgacaccattttgctgtttattttttggatgagagcatggcttattatgaatgttttgactaaagtttatcgcaaaattgttttctttgacaattaatgttactttggtttattaaatgagaactcttag

SEQ ID NO: 4351 - DNA, 446 bp, Fraxinus spp
aaaggtgaaattgtacggtcaccctttatatagaggaatttctcctagggtttcaacatctaataacgagctccattgtgcatcgagatttctcacagccgtcacttcattcattctcagaatggattcacaaatcaagcatgccattgtcgtgaagatcatgggcaggactggttctcgaggtcaagtcacccaagtgagagtgaaatttattgatgaccagaatcggttcatcatgagaaatgtcaagggacctgtcagggagggtgatgtactgaccctgcttgaatctgagagagaggcaaggaggcttcgctgatggcttcatttctgcttgagtttttgtagtttgatataataatctaatgtaagctattgcgtggtttatgcttttttgggacttcatagtagactttggtgccactttgggacacttttttgtttcc

SEQ ID NO: 4352 - DNA, 409 bp, Fraxinus spp
cggccgggcctccttttcagaatggattcccaaatcaagcatgctatcgtggtgaagattatgggcaggacagggtctcgaggccaagttactcaggtcagagtgaaatttattgatgaccagaaccgtttcattatgaggaatgtcaagggaccagttagggaaggcgatgttctcaccctgctagagtccgagagagaggccaggagattgcgctgatggttttattagcagtctcaatctctgctcgactttttagtatttcaaaaatagtaatatgatataagcattacgtagtattattacttttcgggaattcatgcaaggcattgaggagctcgtggctgttgtgttgtttttcagttgacattggatacttcattttcatgtttgtgatataaacatgatt

SEQ ID NO: 4353 - DNA, 431 bp, Fraxinus spp
tctctctgccgccacttcgttcattctcagaatggattcacagatcaagcatgccattgttgtgaagatcatgggcaggactggttctcgaggtcaagtcacccaagtgagagtgaaattcattgatgatcagaatcgattcatcatgagaaatgtcaagggacctgtcagggagggtgacgtactcaccttactcgaatctgagagggaggcaaggaggcttcgctgatgactttatctcttattgagtttttggtagtttgatatgatattctaaagcaattttgcgtggtttatgcttttttgggagttcatagtagactttggtgtgactgtgggatgctgttttgttctctctctcaattcacttctatgctcttcttttatgtccaaaaaaatctagagtttgctgctatgtttctttaccgtgc

SEQ ID NO: 4354 - DNA, 529 bp, Fraxinus spp
ggggggacaaaggtgtaattgtacggtcacccctttataaagaggaatttctcctactagggttttaacatctaatcgcgagctccattgtgtatctagatttctctcagccgtcacttcattcattctcagaatggattcacaaatcaagcatgccattgtcgtgaagatcatgggcaggactggttctcgaggtcaagtgacccaagtgagagtgaaatttattgatgaccagaatcggttcatcatgagaaatgtcaagggaccagtcagggagggtgatgtactgaccctgcttgaatctgagagagaggcaaggaggcttcgctgatggcttcatttctgcttgagtttttgtagtttgatataataatctaatgtaagcttttgcgtggtttatgctttttttgggacttcatagtagacttggtgccactgtgggacacttgtttgtttccttttcgtaatttcaaattggtgtctttacttatattgttgtagtaatcagtagttgtaaacttgtaaaacg

SEQ ID NO: 4355 - DNA, 559 bp, Fraxinus spp
gctcctctcgactatcacttctccgcatttgttccctcactctgtcttgcggccgagcctcctccttctcagaatggattcacaaattaagcatgccatcgtggtgaagattatgggcaggaccgggtctcgtggtcaagtcactcaggttagagtgaaatttatcgatgaccagaaccgtttcattatgaggaatgtcaagggaccagtcagggaaggtgatgttctcaccctgctggagtctgagagagaggccaggagattgcgttgatggctttacttgcagtctttttctctgctcgagtttttagcatttcaaaattactctatgtaggattcttcctttatgggaattcagacaaggcatcgaggtgctcatgactgctctggatgcttcattttcatgtttgtgatgtcaaggtagatgaacagatttgagtgcatttcacgagggattttgcaattataatccgatatcactttcttactcttcaggctttactacaaagtttgtagtgacataattgaacggtggtttctccacacgttgttttacttt

SEQ ID NO: 4356 - DNA, 415 bp, Fraxinus spp
acacttaagagctccattgtgtatcaagtattctctctgccgctacttccgttcattctcagaatggattcacagatcaagcatgccattgttgtgaagatcatgggcaggactggttctcgaggtcaagtcacccaagtgagagtgaagtttatagatgatcagaatcgattcatcatgagaaatgtcaagggacctgtcagggagggtgacgtactcaccttactcgaatctgagagggaagcaaggaggcttcgctgatgactttatctcttattgagtttttggtagtttgatatgatattctaaagcattttttgcgtggtttatgcttttttttggggagtttcattagtagtacttttggtgtttctgtgggatgctgtgttgttctctctttcaatacacttctatg

SEQ ID NO: 4357 - DNA, 420 bp, Olea europaea
ttggcatccatttacgagctccttttctctctgccgccgcttcatattcattctcagaatggattcacagattaaacatgccattgtcgtgaagatcatgggcaggactggctctcgaggtcaagtcacccaagtgagagtgaaatttattgatgatcagaatcgattcatcatgagaaatgtcaagggacctgtcagggagggtgacgtactcaccctgctcgaatctgagagggaggcaaggaggcttcgttgatgtcgttatctcttaatgagtttttggtagtttgacatgatattctaatgtaatcttttttccatggtttatgcttttttgggaattcgtaatagactttggtgtgactgtgggatgttgttttgttttctttttcaattcacttctatgcttttcttttatgt

SEQ ID NO: 4358 - DNA, 480 bp, Primula obconica
ctctctcccactctgtaacaggatggaatcccagatcaagcacgcagttgtggagaagattatgggacgtaccggttcaaggggacaagtgactcaagtgagagtcaagtttatggatgatacgaaccgattcatcatgaggaatgtgaagggaccagtgagagagggagatattctcaccctcctcgagtctgagagggaagctagaaggctgcgttgattcgtcaggtcatcaccttcttcaggtttttattggttaggagaccatgtcgcattttcttttcgagatgtaggttcaatatctatcttaagacttcgtatcgaatcatgatctattttgtctgttttgttcttgtttaaagacaattgagatgttgactgctgccgttacaggcagtaaaatcgtttaagatggttttgttatgttaaatgttgtgtgagatattatatctgtgttatgcttttgttagagttttcagt

SEQ ID NO: 4359 - DNA, 459 bp, Primula obconica
gccgcctctctttctctctcccactctgtaacaggatggaatcccagatcaagcatgcagttgtggagaagattatgggacgtaccggttcaaggggacaagtgactcaagtgagagtcaagtttatggatgatacgaaccgattcatcatgaggaatgtgaagggaccagtgagagagggagatattctcaccctcctcgagtctgagagggaagctagaaggctgcgttgattcgtcaggtcatcaccttcttcaggtttttattggttaggagaccatgtcgcatttccttttcgagatgtaggttcaatatctattttaagacttcgtatcgaatcatgatctattttgtctgttttgttcttgtttaaagacaattgagatgttgactgctctgctgttacaggcagtaaaatcgtttaagatggttttgtttgtgttaaatgttgtgtgagat

SEQ ID NO: 4360 - DNA, 510 bp, Primula obconica
ggatggaatcccagatcaagcatgcagtcgtggagaagattatgggacgtaccggttcaaggggacaagtgactcaagtgagagtcaagtttatggatgatacgaaccgattcatcatgaggaatgtgaagggaccagtgagagagggagatattctcaccctcctcgagtctgagagggaagctagaaggctgcgttgattcaccaagtcgtcaccttcttcaggttttcgtcgcttaagagaccatgtcgcatttccttttcgagatgtagtttctatatctatcttaatacttcgtatcgaatcatgatctattttgtctgttttgttcttgttgaaaaacaaatgagatgttgactgctgccttggcaagcagtaaaatggtttaagatgattttgtttgtgttaaatgtcgtttaagatattgtatgtgttacgcttttgttagagttttcagtagatttgcttacaggtaggatgcggaacacgtttaaagcaattttatcatc

SEQ ID NO: 4361 - DNA, 660 bp, Primula obconica
ccagctcctcctgtctgcatcgtcttgggatgtcgagtaaacccgtaaaaccctagacgggagcgcgagcgggtctgaatgggagggagtttcggccgcccattacggccgaaatatagcgccaattcaactaatttactcagccgcctctctctgtctctctctctctctctctgtaacagtaacaggatggaatcccagatcaagcatgcagttgtggagaagattatgggacgtaccggttcaaggggacaagtgactcaagtgagagtcaagtttatggatgatacgaaccgattcatcatgaggaatgtgaagggaccagtgagagagggagatattctcaccctcctcgagtctgagagggaagctagaaggctgcgttgattcgccaagtcatcaccttcttcaggttttcgtcgcttaagagaccatgtcgcatttccttgtcaagatgtagtttctatatctatctttaatacttcgtatcgaatcatgatccttgtttttttctgttagaaaaacaaatggtttaagatgattttgtttgtgttaaatgtcgtttaagatattgtatgtgttaggcttttgttagagtttttagtagatttgcttacaggtaggatgcggaacacgtttaaagcaattttatcatcatac

SEQ ID NO: 4362 - DNA, 708 bp, Silene vulgaris
ttaaaatcatttgattcacttcattcttacccttctgctactttccgccgtcttcccacaatcttattcatctttgatttcaattcttccttcaatcaataatacagaatggattccgccatcaagcatgctgttgtcattaagatcatggggcgcacaggatcaaggggtcaggtaactcaagtcagggttaagttcttggatgaccaaaatcgtttcatcatgaggaatgtcaaaggaccagtcagggagggagacattcttactcttctcgagtctgagagagaagccaggagacttcgttgaaggccctatcttgtttctgcactatgtttaagttttgtcttagtttatgacattgcgtttcttttagctttattaagacttaagtgctgccatgacttcttacttgtcaggaggttaatgttgagaactacttcttttccaaagaggaagattgtgtttgtttaatatcttagtagtttatggtgattttgtgaggatttgtatgtttctggatatgtgcgtcttgttttctaaattttagtctcgtcgtctgtttctcattgcctaatcttctgttcactatattttttacctcccttctcttccattttgattgaagggtttgaacgggaatgactcagaaaccctacgtggactactaaaggttatagacattctgtgttgtccatggcgctactaaag

SEQ ID NO: 4363 - DNA, 702 bp, Trigonella foenum-graecum
aataatataaataagcaatagcgaaaactagggtttcagtgtcttcgcgcagctagattgaggtgttctttcttcttttccggccaccgcacacaaagatggaatctcaaatcaagactgctttggttgtcaaggtcatgggtcgtaccggttctagaggacaggtgactcaagttagagtgcagcttagggatgaccagaaccgtttcatcatgaggaacgtgaaaggaccagttagagaaggagacgtgctcaccctacttgagtctgagagagaagccagaaggttgcgctagagaaactcaatggattggtgcaggattaaataaaacatttgttttttgggggtatttagtagatggcaaatgttattttcaaacagttaaattttgaacctattgtggcatgaccttttatttggttgaattttgagtaaaactttatttgactctatatattgatgtaaatctatttgcttttcttagatgtagttaggggttactttgctttgatatttcaagctctttatactatattatatgtgctggcttgaatctgaaatcatttaattgctgtactggtaacctattgagtaccataggttagatagtcattcttttccgatggcaaaaccatagggtcccaaacttaaatcctggtaaaacaggctatgacattaaatacatatttgtagttctgaaa

SEQ ID NO: 4364 - DNA, 388 bp, Vinca minor
ttctcagatcaagcacgcgatagtggtaaaagtcatgggtagaactggatcaagagggcaagtcacccaggtccgcgtcaagttcattgacgatcagaaccgattcatcatgagaaatgtgaagggaccggtcagagagggtgatgtgcttactctactggaatctgagagagaggccaggagactacgctgattttttacatatttatgatcttgtcttgtgttctcgaatattacaaatatatttcatcgtgaaacaatgtggtatttttagcttcgtggagatgacgctagacagttggattgttgtttaagattacattaaagtaattgagtattgtgggttttccactcttggtattgagtttgcaaaatttaattaacaagt

SEQ ID NO: 4365 - DNA, 431 bp, Vinca minor
tactcagattaagcacgcgatagtggttaaggtgatggggcgaactggatcgagagggcaagtgacccaggtccgtgtgaagttcgttgatgatcagaacaggttcattatgaggaatgtcaagggacccgtccgagagggtgatatccttaccctgctcgagtctgagagagaagccaggagattacgctaatttgttcatcctcgtttcttaaaactatatggttatcttgagctttttggagatgcaagacagtagttatttaggattgacatcattaagtttttgttaatttcttcagttacttatgttgaagcttttgtgagttattaatggataatgcatctttcttgctatttttcttactgtagcctcttgcttgacctgttaaggttttacctatggtcacgtttagagttactgatttgtt

SEQ ID NO: 4366 - DNA, 744 bp, Aristolochia fimbriata
gcaattaaatcggactcaatctgcgcctcgcgcccgctgggagtcgctctcccgactaacgcaaaaagggataaaaccctaaccctaaatcgcttttcttcacccgaaatcgcttcccttcgccctctcccccctttcccaaaaccctaaccctaattctcgacgtcggtttcgcgcttcgtcttccgcgggattgatccgtttctcgtctgtagaaaaaaagcgaatatggattctcaggtgaagcttgccgtcgtggtcaaagtgatgggccgaactggttccagagggcaggtgacacaggtccgagtgaagttcattgacgacatgaaccgtctgattatgaggaacgtcaaggggcccgtacgcgaaggtgatgtcctcaccttactggagtccgaacgtgaggccagaaggcttcgctgatgtgctctcgtttctcctctcccgtaatggatgttttacttcgtgtaggattctgaagtatttttttttaagtggaggatgttgtcttcttatgactataagatctagtatggggtttacggaatattgctcttgttctacacatcttgacagcgtaagtaaagtttctatttgttcgtgtggttttctattattttagaatctgcttcatggttgtggttcttaaggatgctggatgttaaacaaatccaggtagtaaggcctgatatctttacgactctgtttgtctcttaaatctaaaaaactgacaattattca

SEQ ID NO: 4367 - DNA, 548 bp, Musa acuminata
ggggctgcatccgaggtacgtgcgtgcctgctcacccttgtcgatcctcgtttgtcatctccaaactcgatctttccgttatctgactacgagtaagtcttgcttcggtctccatagttcgcgctctcagctgacggtttaggcttcttccggaggcggtccttgagagcatggatactcaagctaagcttgcagtcgtcgtcaaggtgatgggtcgtaccggatccagaggtcaagtgactcaggtcagggtcaagttcttggatgatcaaaatcgtctcatcatgaggaacgggaaaggtccagtaagggaaggtgatatcctcactctcctcgagtccgaaagggaagcgaggagattgcgctgatcgtattccctcggtgaatcctgcatggatgtgcacatgaacatgatgcagttttgtggtagattagttatttgccctattatggcactttggtgtggtgtgcgataccattgctagcttgaccaaatgccacaactatcacttttattgaactcttggaatcattttgtttggtgctta

SEQ ID NO: 4368 - DNA, 424 bp, Phaseolus coccineus
  misc_feature (4)..(4): n is a, c, g, or t
  misc_feature (37)..(37): n is a, c, g, or t
  misc_feature (47)..(47): n is a, c, g, or t
  misc_feature (49)..(49): n is a, c, g, or t
ggantctggttagcaagcatcgcaaaaccctagcctnctttcttcantngttttttatttcaggatggactctcaggtgaagcatgcttttgttgtcaaagttatgggtcgtactggatccagagggcaggtgccccaggttagagtgaagtttttggatgatcagaatcgtcccatcatgaggaatgtgaaaggccctgttagagaaggagccattttccccctcctcgaatccgagagggaagcaagaagattgcgctagatggtttaaatcgaaccagtggcttgatttttgtggtagttagtggatgccaaaggttatatcagcctatcttgatgtttgggatctatttttattcgaattatggacggaattttgttgtttttagtttaagttttaagattgaagtatgattggcttgat

SEQ ID NO: 4369 - DNA, 425 bp, Phaseolus coccineus
  misc_feature (237)..(237): n is a, c, g, or t
  misc_feature (311)..(311): n is a, c, g, or t
ggattttggttagcaagcatcgcaaaaccctacccttcttttttcactcgtcttttatttcgggatggactctcaggtgaagcatgcttttgttgtcaaagttaggggtcgtactggatccagagggcaggtgccccaggttagagtgaagtttttggatgatcagaatcgtcccatcatgaggaatgtgaaaggccctgttagagaaggagacattctccccctcctcgaatccgngagggaagcaagaagattgcgctagatggtttaaatcgaaacagtggcttgatttttgtggtagttagtggatnccaaaggttatatcaccctatcttgatgtttgggatctatttttattcgaattatggactgaattttgttgtttttagtttaagttttaagattgaagtatgattggcttgata

SEQ ID NO: 4370 - DNA, 424 bp, Phaseolus coccineus
ggactctggttagcaagcatcgcaaaaccctaccctgctttcttcattcgtcttctatttcaggatggactttcaggtgaagcatgcttttgttgtcaaagttaggggtcgtactggatccagagggcaggtgacccaggttagagtgaagtttttggatgatcagaatcgtcccatcatgaggaatgtgaaaggccctgttagagaaggagccattctccccctcctcgaatccgagagggaagcaagaagattgcgctagatggtttaaatcgaaccaggggcttgatttttgtggtagttagtggatgccaaaggttatatcaccctttcttgatgttttggatctatttttattcgaattatggacggaattttgttgtttttagtctaagttttaagattgaagtatgattggcttgat

SEQ ID NO: 4371 - DNA, 424 bp, Phaseolus coccineus
ggattctggttagcaagcatcgcaaaaccctaccctacttttttcactggttttttatttcaggatggcctctcaggggaagcatgctcttgttgtcaaagttaggggtcgtactggatccagagggcaggtgccccaggttagagtgaagtttttggatgatcagaatcgtcccatcatgaggaatgtgaaaggccctgttagagaaggagacattttccccctcctggaatccgagagggaagcaagaagattgcgctagatggtttaaatcgaaacaggggcttgatttttgtggtagttagtggatgccaaaggttatatcaccctatcttgatgttttggatctatttttattcgaattatggacggaattttgttgtttttagtttaagttttaagattgaagtatgattggcttgat

SEQ ID NO: 4372 - DNA, 424 bp, Phaseolus coccineus
ggactctggttagcaagcatcgcaaaaccctagcctactttcttccctcgttttttatttcaggatggactctcaggtgaagcatgctcttgttgtcaaagttaggggtcgttctggatccagagggcaggtgccccaggttagagtgaagtttttggatgatcagaatcgtcccatcatgaggaatgtgaaaggccctgttagagaaggagacattttccccctcctcgaatccgagagggaagcaagaagattgcgctagatggtttaaatcgaaacaggggcttgatttttgtggtagttaggggatgccaaaggttatatcaccctatcttgatgtttgggatctatttttattcgaattatggactgaattttgttgtttttagtctaagttttaagattgaagtatgattggcttgat

SEQ ID NO: 4373 - DNA, 520 bp, Ceratodon purpureus
gaacaaacaacccagattgcttttagaccccctctttcgtctttgcatcgccaccatcgtcttccctgcgcccgcctttgccttgccgccatggattctgctgtgaagctggctattgtcatgaaggtgatcggccgcactgggtcccgaggtcaggtgacccaagtgcgtgtgaagtttctggatgaccagaaccgtcttattatgcgcaacgtcaagggacctgtccgtgaaggtgacatcctgaccctgttggagtcggagagagaagccaggaggttgcggtgaagggcgaggatgcttgcagtcctatccttggttttctctgtatcacagagatgctagagtgtatggttttattgcaatctagtatgcttgataaaatgtaaactttaattgagcgtttggtgtttggcacaccggttccaagcatgtcatcttggcctgatccagatgatcaactatcacattttttttgtatgtgattacgttgctatctgcaattcacttttccttttct

SEQ ID NO: 4374 - DNA, 683 bp, Cryptomeria japonica
ggcaagccttctaaaaccctacacagtctcgctgttaattatatcttgtgaatttggttcacaatacttggcgttttgatcaagccgcagcagcgtgaaaaaaaaaaaaaacatttttctactcttaattttctaaggctcgcgatttggaaaccatggatgcgggtgtgaagatggcagttgtggtcaaggtcattggccgtactggatcaagaggtcaagttacacaggttcgagtgaagtttctggatgaccagaatcgtctcattatgcgaaatgtgaaaggtcctgtcagagaaggtgacatccttactctgctggaatctgaaagagaagcaaggagactgcggtaattatgtttttgtatcatcgtatatggatttggactatgggtggattagcttgtgacactttttccagttttttgccatgaagagaggccacatagtattaccggagtttattgcaaagttttttactggtttggtttattggacgataattataattattggctactcctcttgatttgaaatcaagaatatcatgtggtttgctggaagcgtacattgatctgtgatcatgattgttcccttgacgaacctattacctttttttcctttttgcatatcaaatatgtatacagtttacagaaataacaagttttgtgcttttgaggcgaa

SEQ ID NO: 4375 - DNA, 534 bp, Cycas rumphii
gaaaccatggatacgccagtgaagttggcagttgtggtcaaggtaattggccgtactggttcaagaggtcaagtgacgcaggttcgtgtgaagtttttggatgatcaaaatcgacttataatgaggaatgtgaaaggacctgtcagagaaggtgacatccttactctgctggagtctgaaagggaagcaaggaggttgcggtgatgttatggctgggatcataacactaaggtttggaagtatgagctgatttaagcttagtagagtctttgtgttgatatgttgtggtgagaagaaaccatggattaaggctctcaatgatctttgataattaaggctattacaattatttgtttttgcttgtggattgaaattcaagaatgccaaatatagaaattgtatgaagcatacgtactctatgatactgtgattgtgatgctgtgcatcttgttccaacttttgatgtgctagttttctaaagaatgttacatttatttgtttacgcgtgctggttgcaaatcaaataccaatatc

SEQ ID NO: 4376 - DNA, 730 bp, Cycas rumphii
ggttttattaacgtggtgcgtttcggtgttccggtggagtggaaggggcggcttggaagacgtcatcgatttcatcgatcttgaaccttcgaatttcaggaaaccatggatacacctgtgaagttggcagttgtagtcaaggttattggccgtactggttcaaggggccaagtgacgcaggttcgggtgaagtttttggatgatcaaaatcggcttataatgaggaatgtaaagggacctgttagagaaggtgacatccttactctgctggagtctgaaagggaagcaagaaggttgcggtgatgttatggcggggatcataacactatgtcttggaagtatgagttggttttatcttagcagagaatttgtgctgttattttgttgtgagaagaaaccatgaattatggttctgaatggtctttgacagttgacgctgttacaattatttgtctttgcttgtggattgaaattcaaaaactcaaatatagaatttgtatgaagcatacatactttattatactgtttgattctgatgctgtgcatattattccagctcttgatgtactggttttctgaagaaagttacatctatttgtttatgattgctgattgcaaatcaaaatacgaatattgacatgtttgaaccatgataatttacaagagtgcttctatatgataccatgcttctcttgtaattttttgaatttaatcttcttgatttgaaatc

SEQ ID NO: 4377 - DNA, 719 bp, Solanum melongena
aggacacagcagagctgaaagcccaatcctaatcccacctccacgcgactcacgaaaccctactataaaatttctagggttttatgattctccattctctgatacgcagcagcatacagcagcagacttttctcccttgaagaatggaatctgtaaccaagcatgctattgtgattaaaatcatgggtcgtaccggatccagagggcaggtgactcaggtgagagtcaagtttcttgacgaccagaacaggtttatcatgagaaatgtcaagggaccagtcagagagggtgatgtcctcacactgttggagtctgagagagaggccaggagattgcgctgattgcataattatggatgtcgcgttgaaattcccttgaatactcgatgctggctggaatttattctatatgtaatagtcttcggttttgtttgcttagtttcttttaagtttggccatgtcgtttttggtgttttggtgcacttcaacttttctggaatagttttatgataaaatttggttagttttgtatcaatggcaacaagtaatgattcttgtttgttttgctgtgtgctggttgatatacatccatcaatcatgttgaatctttttccagttttccttgtctggggttacattagatctatttagaggcaatgagtttattcatttttgtatctgaattctcttatttgaatgacatggtttgaataattttac

SEQ ID NO: 4378 - DNA, 597 bp, Solanum melongena
ggggactttaaaatccattagtgctgcgtgtgagctattttcggccgtcgtagctttgttctccttcttcccctcttttaagaatggaatctgtaaccaagcatgctgttgtgattaaaatcatgggtcgtaccggatccagaggacaggtgactcaggtgagagttaagtttcttgatgaccagaacaggtttatcatgagaaatgtcaagggaccagtcagagaaggtgatgttctcacattgttggagtctgagagagaagccaggaggttgcgttgaacacataactatgaatatctttgccagctgggatttattccatatgtaatagtattcggttttatttgcttatagactcgttagtctggacatggcgattttgagatttggactatgattcgtgtaattttggtgcacttcaagtttttggaattgtttacgataacattttggtgtgtgctttggatggtcatccgactgtcatgttgaatctgttctgcagtatttattgtttgttggtttcttttgttcttgacaataatgttgatagtctatatgccttgagcaaaaatattcaagctgtttggttttagtg

SEQ ID NO: 4379 - DNA, 565 bp, Adiantum capillus-veneris
gatacttttagggcttttgcaagtgaggcttttcttctctgctgcgttgcctagcgttgctaaatctcgcgctcgcgctctgctaccgggcctccagatatggattcgcctgttaagcttgccattgtggtgaaagtcatggggcggactggctcccgaggtcaagtgactcaagtgagggtcaagtttgtcgatgaccaaaatcgtctcatcatgagaaatgtgaaaggtcctgtccgagaaggagatatcctagctcttttggagtctgagagagaggctcgaagacttcgatagctgtggtggttttttgatggttcgaatgggctattgtcatggatcataagttggaaaagcattttggagagtacggccggttataggatgataggcttgctgttttggcaacaacttaatcatgtttttgacaatgcggcatgtgcttctatgtaacatgagtttttcagattgatgagaatcaagtattgtttttagtatttccttatttgacacttgtattcagagttttttttataagagcatgtgcgtgtcactgggattttgt

SEQ ID NO: 4380 - DNA, 216 bp, Mimulus guttatus
aatggatacgcagataaagcatgctattgtggttaaggttatcgggcgaacggggtcgaggggacaagtgactcaagtgagagtcaaatttgtggacgaccagaatcggtttattatgagaaatgttaagggtcccgttagagagggcgatattctcacccttctcgaatccgagagggaggcgagaaggttgcggtgaacccttattccgatttt

SEQ ID NO: 4381 - DNA, 521 bp, Tropaeolum majus
cggccgccggggggtattcttgctcccattagacaaaaccctagttttttttttgagcgccgcagggagcaaaagtaaactctagagtttttcatctgccgatttcagaatggataatcaggtcaagcatgttttggtggttaagatcattggaagaactggttccaggggtcaagttactcaggttagagttaagtttgtggatgaccagaaccggctcattatgaggaatgtgaagggaccagttagagaaggtgacatcctgactcttcttgagtccgagagggaagctaggaggttgcgttaaaagcggattccgtggttatggattttgtttggcttgttttgttttggggtattttatgtttatctttgttagacttcaatttcaattttgattaatatgtatgagatttgcttggatgtttaacaactaagtttgaattttatatttatattgaatttctttttatatgttggttaaatattgttagtgtttttgattaatatatgattctagt

SEQ ID NO: 4382 - DNA, 560 bp, Capsicum annuum
gcacgagggaactcactccgccgctaacgttttcttcttcttcttcttctccttctccgttgaaatcaaaataatggactgtcaaatcaagcacgctattgtggtgaaagtcatgggccgcacaggatcaagaggacaggtgactcaggtgagagtcaagttcatggatgaccagaaccggtttatcatgagaaacgtcaagggaccaatcagagagggtgatattctcacactgttggagtcagagagggaagccaggaggttgcgctgaggaattaattgtcgagatggttttgatcaccttagggtttgtaaacgactattgtttagtattttaccatgtcacatgtttggttttgttttctagactatcggcaagtgttgttctggcatatctctcgagttgtttggttgtgcttttaagttttaaccatgaagattgagttattttctgtctattgaaagttggaaaatgttgtgaacttgtgatgagatcttgctttctccctattgaatactgattctcttgtgtggctatttctaatttcacactgttggat

SEQ ID NO: 4383 - DNA, 603 bp, Physcomitrella patens
gaacaaggcaagcgaagctcgagctcgaagtcctctttcgtcgtcctcgcagcgtcgtcgcttccctcggagctccccccttgcgcttgacgtctgccctctcttcgtcgtcctgccgccatggattccgccgtgaagcttgctattgtcatgaaggtgattggccgcaccgggtcccgaggtcaggtgacccaagtgcgtgtgaagtttctggatgatcaaaaccgacttatcatgcgcaacgtgaaggggccagtgcgtgaaggtgatatcctgactcttctagagtctgagagagaggcaaggaggcttcggtgaaaaacccgaaactagcggtttcctagcctgatcttactgtatgcaaccggaatactaggatgcatggttttactgcattactagtattttgatggctgatgtttagtattttaatgagacgaaacaggagtctgatgtctccaagcatattaattgcgcactagaccttatcttacgctcagttctatgtgattacaattcagttctgcttgtatttgtgggtgttgactttgtatgcaatgcctcagaagccatttggcgaaacagggtccttttccttgtaca

SEQ ID NO: 4384 - DNA, 593 bp, Physcomitrella patens
gagcgagtgagtgggaattagggtttagtagaacaaccacaacgaggcttctcgtcaagccctcctcgctcgagctcccagcgtcgaaaccatctctgcatcgccccgtctgcacccgctgtacacgtgcttccctccgccttaccatcatggattctgccgtgaagctggctattgtaatgaaggtgattggtcgcactgggtcccgaggtcaggtgacccaagttcgtgttaagtttctggatgatcaaaatcgactcattatgcgcaatgtgaaggggccagtgcgtgaaggtgacatcctgactctcctggagtctgagagagaggctaggaggctgcggtgaagaagcgggatttcacaagtctctagctttttttttcctatttatcacttaaagactagactatggttttacggaaccattattgtattgatgagttatgattggtacacaatgacatcaaacaggagtttgaggcatcaatgcaccaagcatgctaattctctcctgaagcttgtctttcgccaggtgattaactgggtgcagcactttttatattttaactgatcaaaattcgtttctgctacc

SEQ ID NO: 4385 - DNA, 416 bp, Physcomitrella patens
ctcttccgcagtcgaaatctacctctgcgccttctgctcgctcgcccgcccgctcgccctctcgttgttcgcttgctactgcaggctttctcgctacttggccacaatggattcagcagtgaagctggctattgtaatgaaggtgatcggacgcactgggtcccgagggcaggtgacgcaggtgcgcgttaagttcttggatgaccagaaccgtctcatcatgcgcaacgtcaaggggccagtgcgagaaggtgacatcttgacccttcttgagtccgagcgcgaagcccggaggctgcggtgaggagaaacagtctcccggtgctctgaagcttgatttgctgtgcatgtatgtgaacctctatttgcacaagtagtgcaagatcaattttcacgtaatatagttccagtcttcc

SEQ ID NO: 4386 - DNA, 658 bp, Sciadopitys verticillata
cgatttcggatgtgctatgaattttagggtttgagaggtctgaaaacttaataatggtttaagaagtcaccgtttctattctgttcagctgctcttttggcggacgaaatacatagcctttgtatttactgagcttttgtttgcaggttgagttgataagattcaagaatggacgcacaagtgaagttggcagctgtggtgaaggtgatagggaggacgggatcaagggggcaagtgacccaagtgcgagtgaagtttctggacgatccgaatcgtctcatcatgaggaatgtcaagggccccgtcagagagggcgacattcttaccctcctcgaatctgaaagagaagccaggaggctccgctgattttactttcttatgaaaattggggttttgtttttattccgcggaatataggtatgcgtatgaaattagggtttcaatatctcatggattaatttaaattcaggtcaatattggttgaagccatgccaatgttggattatattgttttgtaacatattggattgattttgttatggaggcataatattaaacagcatatcatttagtcactcctgttaaactatctggccagaaccctaatataaaaaaaggttatctaatgtattagatacattgccgcacttatcttgat

SEQ ID NO: 4387 - DNA, 528 bp, Sciadopitys verticillata
cggaggacatacatcgtctttgtatttgctctctgcgcagagctttttgtttgtcgggttgagttgataagattaaagaatggacgcacaagttaagttggcagctgtggtgaaggtgatagggaggacaggatcaagggggcaagtgacccaagtgcgggtgaagtttctggacgacccaaatcgtctcatcatgaggaatgtaaagggccccgtcagagagggtgacattctgactctcctcgaatctgaaagagaagccaggagactccgttgattttcttatgagttagggttttgttgattttctaattccgggtaagacctgtgattgctgttaaatcggtgtttttaatatctcgtggattaatttaaattaaaaaaaaaattctgtttgaagctatgacaatggcggattatattgttttgtaacaacttggattgattttgaatccctccctactattgaggcataactataaccggcatattattagtcactcctgttaaattcttggtctgaacacg

SEQ ID NO: 4388 - DNA, 276 bp, Senecio madagascariensis
cgcggccgaggtacgcgggggtgtttccaaatcttaaatctcatcattcaccagagcagccgcaaaaacacacagtgagatcaaaagatggaatcacaaatcaaacacgcagttgtgattaaggtaatgggcagaactggatccaggggacaagtgacacaagtccgagttaagtttttggatgaccagaatcggttcattatgagaaatgttaaggggccagttagagaaggtgatgtccttactttgcttgagtctgagagggaagctaggagg

SEQ ID NO: 4389 - DNA, 527 bp, Tamarix hispida
  misc_feature (496)..(496): n is a, c, g, or t
ggggaatcgtctgcgcagctagggttttacttcgcttgcctctgcgccaattgatctgcacgctcgaatttcaaacaccttctagcgaaagatggattctgcaatcaagcacgccattgttgtgaaggttatgggtcgtactggttcaagaggacaggtgacacaagtaagggtgaagttcatggatgaccagaaccgattcatcatgaggaacgtcaagggacctgtcagagagggcgatgtcctcacccttctcgagtctgagagagaagccaggaggcttcgttgagggtctgttttcgtcgtttggataattttgcgttttcgctgtgattttgccaaacatttgatgttaggtttttgctactttgcatccgatttgttatgctatggttattgaacggagtcttgttaagcagatgcttgaagctgtaagcttgatctgctaatgattgttaaattgttggatatttaaatattaatagttgatacaaancttgtggtggtcgtggattcttacctgctac

SEQ ID NO: 4390 - DNA, 781 bp, Taxus baccata
ccggggaagattttgggatcgacaagcttcaagaaacctgtaaatcctgcggtgaagtggtttctctcagttgttgatcagctatatacttaggtctttctccgctcctcccaggtagcacttccaggaaaacatggatgcaggggtgaagttggcggttgtggtgaaagttattggccgtactggatcgcgaggtcaagtcacacaggttcgtgtgaagtttttagatgaccagaatcgtctcattatgagaaatgtgaaagggcctgttagagaaggcgacatccttactctgctggagtccgagagagaagcaaggagattgcgctaatcatgttatctcatctatggagcttgcttgtttttatgaggttttttccctgcgttttccaaaactggcatcctcgtatacatgtttaagctgtttattattccgaatttaatattaatggtaaatattgagtgacactgcaacaaatagaagaatctgataatgcaaggttttctaaactttcacagtgaagataaagatcagagattgcatttgattgaaatttaagcagtcacaattattagattgatattattgctttcatttaatggatgcttcttccaattttgtctatattactaaatcaaacgagtttgaagaatggatcccagtttcaggaatggcttgagatccaatttagtaacaggaatgacccaggtatttttacttcccaaccattgacaaaccatgtttctcaaaaaatgaaaaaaagatgttcaaaatagaagc

SEQ ID NO: 4391 - DNA, 480 bp, Taxus baccata
attggattacatttccaggaaaccatggatacaggggtgaagttggcggttgtggtcaaagttattggccgtactggatcaagaggtcaagttacacaggttcgagtgaagtttttagatgaccagaatcgtctcattatgagaaatgtaaaagggcctgttagagaaggagacatccttactcttctggagtccgaaagagaagcaaggagactgcggtgatcatgttttaatattatgatatccttggacttgttggactatgggcggattagcttgtgacactattttgctgtttatttttgttggatgagcagagtattgctttttatgtgttctgaagtttttgcaaaattgtttttttgacattcaatatacttttattgaatgagaattataactattagctactgctcttgatttgaattccaatctataatcatacagtttattgtgactgtttcctctactgaacatatt

SEQ ID NO: 4392 - DNA, 497 bp, Triticum aestivum
  misc_feature (218)..(218): n is a, c, g, or t
  misc_feature (298)..(298): n is a, c, g, or t
  misc_feature (305)..(305): n is a, c, g, or t
  misc_feature (351)..(351): n is a, c, g, or t
  misc_feature (398)..(398): n is a, c, g, or t
  misc_feature (425)..(425): n is a, c, g, or t
  misc_feature (442)..(442): n is a, c, g, or t
  misc_feature (447)..(447): n is a, c, g, or t
  misc_feature (458)..(458): n is a, c, g, or t
  misc_feature (496)..(496): n is a, c, g, or t
ggagaagtagcttgcgccgccgccttcgtcgtcgtagcagaagcagcgatccccatcgccagcagcccaagaaagcatggatactcaggtgaagctcgcggtggttgtcaaggtgatgggtcgcacggggtcgaggggtcaggtgacccaggtgagagtcaagttccttgatgaccagaaccgtctcatcatgaggaacgtcaaggggcccgtccgtnagggcgacatcctcaccctgctcgaatccgaacgggaagccaagaggctgcgctaagaaattctccttatacctgtctgnccttggnagaagaatgatgtacgttgccttcttacccaacgcttcgtccttgnctaactagttgaagtgtaatgatttttgtccgttgcctaaattaaangcacttgatgttgtgaaacttgtcatngcccgcaccctgggaangtgancctgaacctcnacctggtaaaaaaggggggcccggtaccaatcccctana

SEQ ID NO: 4393 - DNA, 688 bp, Zamia vazquezii
cgtttgagggtaatggaatgggaatttcaacttcgccgatacacgtgaacaagggagaaccggtcgagggaggcgaggcttgctctgggctccgaagggctgattgattgcattcttctgaagatttccagtgtcggaaggaaacgatggacgctccagttaagttagcggttgtggtcaaggtaattggccgtactggttcaaggggccaagtgacacaggttcgtgtgaagttcctggatgatcagaatcggcttattatgaggaatgtgaaaggacctgtcagagaaggtgacattctcacactgctcgagtctgaaagagaagcaaggaggttgcggtgatatgcttgtgactgcaacgtccgtggtttcgaagtatgagtttggctaagcttagcagagtttgtgcaattatgtcgtgccaagaagaagcttttgattaaagtcatcgatgaattttgactattaagcgtagcaaaattatttatcggattaaaatttaaaatccaagtatgtaatgtgggtgaagcatgcatattcgacaatattgtttgattaggatgccgtgcatcttattctgccttctgatttactagtttttgaaagaatgttacatctatttgtttatgtttggtgattgcaaatcaaaataacaatattggtaagtttgaaacattttaatctac

SEQ ID NO: 4394 - DNA, 523 bp, Zostera marina
cggcagcattagcaggcttctttctttcaaaaaattgcagcgaatcaagatctaacagaatggatactcaagttaagttggctgttgttgtgaagataatgggacgcactggatcccgtggtcaagtgactcaggttagagtcaagtttttagacgatcagaaccgtctgatcatgcgtaatatcaagggaccggttagagaaggtgatatcctcacactcctagagtcagagagagaagcaagaagattgcgatgattctgatggcctctgtctactaatcacctatctatctattcagcatgttggtctttttagacatttttgtaatacatcatcttctcttcctttctctttgtatttggtgtatttttgattctgttaactattttcttaatatctatctatcctcgattttttgtttattctttgagcacttgtttttttctgtttgattgtgcctctatttgttagaaaatgattccttaatcagaaatttttgttcgaaactgaagaaatctctg

SEQ ID NO: 4395 - DNA, 355 bp, Abies balsamea
gagagcgagagaattcgtctacgaggaaatcatggatacaggtgtgaagttggcagttgtggtgaaagtagttggccgtactggatcaagaggtcaagttacacaggttcgagtgaagtttttggatgatcagaatcggctcatcatgaggaacgtaaaaggacctgtcagagagggggatgtccttactctgttagaatctgaaagggaagcaagaagactgcggtgatcattattgttcagattatatattagagattcaacaggattgcgttatatttttgtttttcttttcaatgcaaagagatcatgtgtaaggctatgaatgttctgtggtaaatgtatttcattttgt

SEQ ID NO: 4396 - DNA, 463 bp, Brassica napus
cttcttctctaaccgccgctaagctcccaccatctctacagaatggattctcagattaagcacgccgtggtggtgaaggtgatgggacgtacggggtccaggggtcaggtgactcaggttcgagtcaagttcactgactctgaccgtttcattatgcgaaatgttaagggacccgtgagggaaggagacatcctcaccttgctcgagtccgagagagaagccaggagacttcgttgatccacctgcaagaacacagaacaatgtctgcttagttccctatttttttttcgcttcttgtgtctggattagtgattatgcacttggattgtgtttggttgttgctataagacaattcctggattgatatttgttctgttttttttgggtcttcagagtttattgtttcacacacatatcaccttcacatcaataatacatatagaataatagattcttaggtatc

SEQ ID NO: 4397 - DNA, 412 bp, Brassica napus
ggttctcgcttcttctctaaccgccgctaagctcccaccatctctacagaatggattctcagattaagcacgccgtggtggtgaaggtgatgggacgtacggggtctaggggtcaggtgactcaggttcgagtcaagttcactgactctgaccgtttcattatgcgaaatgttaagggacccgtgagggaaggagacatcctcaccttgctcgagtccgagagagaggccaggagacttcgttgatccacctgcaagaacacagagcaatgtctgcttagttcccttttttctttgcttcttgtgtctggattagtgattatgcacttttggattgtgtttggttgttgctataagacaattcctggattaatatttgttctggttttttgagggtcttcagagtttattgt

SEQ ID NO: 4398 - DNA, 294 bp, Brassica napus
atctctggaaaattagggttctcgcttcttctcaaaccgccgctaagctcccaccatctctacagaatggattctcagattaagcatgctgtggtggtgaaggtgatgggacgtacggggtcaaggggtcaggtgactcaggttcgagtcaagttcactgactctgaccgtttcattatgcgaaatgttaagggacccgtgagggaaggagacatcctcaccttgctcgagtccgagagagaggccaggagacttcgttgatccacctgcaagaacacagagcaatgtctgctt

SEQ ID NO: 4399 - DNA, 312 bp, Brassica napus
tcttctctaaccgccgctaagctcccaccatctctacagaatggattctcagattaagcacgccgtggtggtgaaggtgatgggacgtacggggtccaggggtcaggtgactcaggttcgagtcaagttcactgactctgatcgtttcattatgcgaaatgttaaagggcctgtgagggagggagacatcctcaccttgctcgagtccgagagagaggccaggagacttcgttgatccacctgccagaacacagaaccatgtctgcttagtttcccttttttttgcttcttgtgtctggattagtgattatg

SEQ ID NO: 4400 - DNA, 307 bp, Brassica napus
atggattctcagattaagcacgccgtggtggtgaaagtgatgggacgcactgggtcaaggggtcaggtgacgcaggttcgagtgaagttcacagactctgatcgttacattatgagaaacgttaagggacccgtgagagaaggcgatatcctcaccttgctcgagtccgagagagaagccaggagacttcgttgattcgccttttttttattttctacaagttggaaacaagaaaacagaacaatgtctacttatttgtcttttggtttctgtgagcggtttagttattatgctttggtttgttgct

SEQ ID NO: 4401 - DNA, 486 bp, Cedrus atlantica
cagcttggacagagatatcggagctcagagcgagtgaattcgtgtacgaggaaatcatggacacaggtgtgaagttggcagttgtggtgaaagtaattggccgtactggatcaagaggtcaagttacacaggtccgagtgaagtttttggatgatcagaatcggctcatcatgaggaatgtaaaagggcctgtcagagagggcgatgtccttactctgttagaatctgaaagggaagcaagaagattgcggtaatcatactgtttggattatagattggagtttaaagtttcaatagactagctttatattgtttgctttttttcaatgcgaagaggtcatgttgaaggcaatgaatggtctgtgataaatgtatttcaatttgttttggaggattaagacctatcttacttttcagtggaggttggaacaataactatggattgaaattcgaggtaatacaaatatagattttgtgtgaagaagc

SEQ ID NO: 4402 - DNA, 445 bp, Cedrus atlantica
cgggaatgctcgggctgttcgatcaaggtggtacagagatcggagctctgaacgtgagcattcgtcttcgaggaagtcatggataccggtgtgaaattggcagttgtggtgaaagtaattggccgtactggatcaagaggtcaagttacacaagtccgagtgaaatttttggatgatcaaaatcgactgatcatgaggaatgtaaaaggacctgttagagagggtgacgtccttactctactagaatctgaaagggaagcaaggagattgcggtgattatgttgtttggatcatagcatggacttaaagtgagaatggaataacttagctagttatgtttcccatttccacattagtttacggtgttatgttttcattattttttcaactgtgaatgttctgtgatatgtaatccagaatttgacaattaaaatttaaagcttgt

SEQ ID NO: 4403 - DNA, 660 bp, Pinus pinaster
cggatgaactagggtttgaaggctcgaacaactaagttctttgaaaccctaacgaggtttcatctttacttatatccaagaagcgtctgaaatcgattgttttaggcttatccggtggagcttggacagagatttggagctcagaacgtgagaactggtctgcgaggaaatcatggatacaggtgtgaagttggcagttgtggtgaaagtaattggccgtactggatcaagaggtcaagttacacaggtccgagtgaagtttttggatgatcagaaccggctgatcatgaggaatgtgaaaggacctgtcagagagggtgatgtccttacccttctagaatccgaaagggaggcaagaagattgcggtgatcatattattccagattatagattggagttgtagtgatcatattattaagattgtagatttgagtttttcaatggttagttttctagcgtttgcttttcttttcaatgcaaatagaccacgtgcaaggcactaaacggtttgtgataatgtttaaatttgttttggaggattaagacctatcttatttttgagggggagttggaaccatatttatggattgaaattgaagttaatacagttacagattttttgtgaagaagcattattatagagctgtgcttgtttccgc

SEQ ID NO: 4404 - DNA, 742 bp, Pinus pinaster
atcatcgtactgaacagaggcaggctacgttatatggatgccaatttcgctaattaaatgatataaatttagaaaaaaacgcgtttaatatataccgttgctttaacggacggttacgattaactagggtttgaagcggcaagatccgaaaacccattaaaccctaatcagggttgcagtttactctcttctctcaagacgcccgatacacacaactccggctattcggtggagttcgcacagagatcggagctttcaacgtgagcaatcgtcttcgaggaagtcatggatactggtgtgaaattggcagttgtggtgaaagtaattggccgtactggatcaagaggtcaagttacacaggtccgagtaaaatttttggatgatcagaatcgactgatcatgaggaatgtaaaaggacctgtcagagagggtgatgtccttactttgctagaatctgaaagggaagcaaggagattgcgctgattttgttgtttagattataacattggacttaaagtgagacgggaataacttatattgttatgtgttctgtttctgcattatcttgtagtgtagtgtttgctattgttttcgatgcaaagggatcaatgagtgaggctataaatgatctgtgatatgtaatccagaattttacaattaaagtatgaagcctgtcatacttgatggggaatcggaacagtaactgtttatttttgcatttggaatgaaattcaaattacta

SEQ ID NO: 4405 - DNA, 544 bp, Plantago ovata
ggttttattacttgcggccgcctcttcttctctttttctccgtctccgcctcatttcgataagttctccgttcaggcgatcaattctcctttcgttacgttcagtatggattctcaaatcaagcacgccatcgtggtaaagattattgggaggaccggttctcgtggacaggtcactcaagtcagagttaagttcattgatgatcaaaaccgtttcatcatgagaaatgtcaagggaccagtcagggagggagatgttcttaccctccttgagtctgaaagagaggctaggaggttgcgatgatttctgacacagaggctatgggtttgtcaactgcaaacgtttttgctagaattgtgtttttactataatgtgtaactagacatcaatgtaagcttgagcttttgcctcctgttttgtgtttttgacatttgaagttttatttttacgtttgaatgttgttggcatggttggcatttatggtctaaatctattttatgaaacttgctcttgtcttactgtgctagtcttagtagtctacatg

SEQ ID NO: 4406 - DNA, 599 bp, Plantago ovata
cggccgggggcgtttctcactgttttcttcgagcagccgagttcttccccaaatatattcattaaactacatccagtcgaaaggagcttgcttttttgcagaggaagcaaaatggattcccaaatcaagcatgctattgttgtgaagatcattggaaggactggatctcgtggtcaagtcactcaagtcagagttaagttcattgatgaccagaaccgtttcatcatgagaaatgtgaagggacctgttagagagggtgatgttctcaccttgctcgagtctgagagagaggccagaagattgcgctgatggattttagtccaggattatttgagatcaagtttgtttttcagtttttttctagactatgctgaaagtaccggatatatcttgttctcaaatttcctagatgatttttgttttgttggtacttgaatggtgtttgaagaaacgtagacaaattttctgttaaatgcttgttacccgagtgctcattgattctgccctgttttcactttcactcaatgcaatggttcaatttggcttcatgaaaagtgtatgaaatgctaagatcttatgttaattagatgaattcttgt
